United States Patent 9,328,346 (POLYCOMB-ASSOCIATED NON-CODING RNAS) - sequence listing, part 120

SEQ ID NO: 191164 - RNA, 244087 nt, Homo sapiens
ucuuuaaaaaguucauuuauugaaaaucauauguauaaccuagcauacgaaugagcagauuuaaacacauaacuucaagccauuucugaaaacauacaccaggagcucugcucagcuagagucagacuccagcuccagcccgacugcgugcggggacagcgcccgcguugaugaggaccagccccacugcaggcugaggcggugucacccugggaaggucguggugcguuguggcauauuaagucuaaaccagaugaauguaaauaucucuuuguaaaucauuuauuucacucuguuccauccaggucagcaaucagauuguggcaugcuggguaacuggaaaaaauaauaaaaaguaaguuucaauagcucauguucuucaauguuauuugucuucucauuugcugguuuagucaccuuuuaugaugaaaacuguuguuggagaaaaaaaccuguugcuaaaaauguggaaauuauaugaaaaguuugugccucaucuuguccacaucaaagcccuucacauaugaaauaagguuaacugguuuaauggguuaaauuugaagacaaccuagacaaaagacacgccugccucuuaaauaaggacagucugguguuaggacauggccagagagccaucucuucuguccgggaaaggacacauugauuugugccauaaucuguuuacugaaaauuuaucugaccuuaacggcagguaauucuagaacaaaaacaggguguaggccaagugccccuaagaaauuccucgugaaacaauacaagcugaaacaccuccaaauuuguaacugcaagcaauuuauuguaaccuaugaaaaaguacuuucacauggaaaccucacauguguuggaagaggggauuggguguacugaggucucuuaguuuuacgcagauacaaauguuccaaaguagcuucaugcagaucagguugggggagaaucacaaguucagaaaguauugaauacuguuccuggccucugcugccauggcugcccaaauuaguuuaaaccacaucaggaacuagagucagaagccacuggaaauguuuccacuccacaaagcaugucuggaguuucuacugugcacugugugggaaggugacugggccacaguccucgcccucuagauugugaaguccagagaaaagccaggaugguauuuuccaaaucccgguuucuacgucagauaaauugggacgcacugcagggccaggggcccaaucuggucccucuuucuuuaguuaggaaccaucuuccaaaaagagaagugggccugccccucuccagugaggauuuuccaagcuggacuccaagggaggacucuaucaaccuaauuuaagccaucauuaacauggggauuuccaagacagggcaaugagugaaacugaauccgcauucaagagaaauauaugaacaucagccuguugccuuuuaugaaaaaugagaaaaaguaauguuuacauuucaaguagauuucccagugugugagagacccugaggacaacuuuuucuugaacaggucugugaguagugggguggucucagcaggguaguuagaguagguggggggccuggccucaggcugaaugcagguggggcuccggcaggaggccucacuccuccucguaaaccugccaucccaugcacacagcccucccaggcccguggagccagguggacaauuuccugggcccacgggaugcuuuguucuccaggcccugucugaguggcccaugaggaguccaccccaugcacuaugcccuagagcccugccauugcagaggggacucccuucuguccucagugggauacugacagcacggagacugccaccaacacgaucugauugucaaacgcaggguuugcaccaagcugacgugcccuccaggccaggugaucgaacugacccagcacaguccugcuaaaugacugguuugaauggcccuccaccccugcuccauggauuggccacauaaggcagguggccugguggccucgcucuugacacaguggcuuccuaacuuuagaaaugcuaggaugacugaauacaaaagggauaagcauaaaucccaacagauaacacuucaaaagaaaaacaacccaacaguggcucacaccuguaaucccagugcuuugggaggcuggggcaauaggaucgcuugaguccaggaguucgagaccagccugggcaacauagugagaccucaucucuacaaaaaaaauuguaaaaauuagccaugugugguggcgcaccccuguagucccagcgacucaaaaggcugauguaggagaauugcuguagcccagaauucaaggcugcagugaugaauuuuggguagagaacacacccacguacacacaauacagaauaggcguaaagaccugaaguaaaaguaaaauguguugcggaauuuuuugauaagcuccaggaaacaggcauuucucaugaugagucuacauaaugccugugggcucccaggccaccuagcaauuuaucacuaucggagcuguuccagaaacgggugaccuccugauuccgugggccugcaugggggugacacagauguacgggccucaccaggaaccaaucaaaagucagccugauuccuuccugcggcagaucagccauggccaucucuaugggcuuuguauuuccugcgguucaggugagaagccccauauccauccccacuuucacacuguugaacuuaccguucacugcucaacgcccccccccccacccgugccuacagccgugccugacccauggugagcguucagucagcacuggagggcuggauaauuuguccuaggaggucaccguuuugucgccuccauuugcugacucuuugguaacacacauuucucugaccgagacagaagccuuaguuacugcccacaucuggcuugucugccauuagggauauccacgaugcuuauuuccaggaaguccugucaucaacaccacagugaucauggucucguccaggagaguagagcgugcguaugccagugggacaugagcccucagccagugucucccguccuucugcccuuccauuugucaucauggcccuugcuguggcccuccuguggcuguccugcagcucagaggggggcgacagggcgcccuggccacugcuccccugccgugcuguccacaggugguggaaacgugcccccaucugcaggcacacagcugcuaacccauuuucuuuguucucauuuuaaauccuaucggagucaucucuccacaaacccugccucauuuauuucuaaaguuuguuaaguucugaguguaagaaaucaguugcucugggugaccugaacuguuccccaggcaaccacacugugggguccagccagccuuugcugcugcuuuguucccaaaccagccagaaguggcagcccggggagaugguggcaccccucgccccugcucacaggagaccugcccgggcuucgcacuucacugucuccguggguggcucuagccaacccuucugaagguaacaaccccuucccccccugcuguccgcucugcucacuggcacgcugucucuguuuggccaagucaaaacgugguccuguuccuugugugucuggcaauaaagcauccauuuguaacuggagagggcaggccccucccccuaccuccaucuggggcauuucaaagcuggcccugaguugacagagcuccagggcagccccugccucgcuugguggcucgccucccgccuccgccucguguucugggcaccggggccagggcucggcagcuguuccagccaggcccggcuccgcccgcacccgcucggguaccugcccccauccacacauccuguggccugagaagaaguucauuucccugcccagccacuucccaauuccauucacuucauuucucugggccuuauuuuucuaucuguacaaaaugguuauuuaucucaaauggcccuuucaagcccacaaugaucucagcacuaauccuguugguuucauaaucaucugugcugggcucuggguaauaugaggcacuuccuuuuaaagggaagcugguucuuucuuuuucucugccagaaaucaagugacaugaaagcuaacacaugucucugaagcaacgcagagcugagauucgaauccaggcaguuugaccucaaaguccagacucucccaugcgaggcucuccugcuugcucuggcagaugaggggcagccaguuugauaucuacggaauuaagcugccaaauugggaaggcaaccuggaugaaauaagccacgugagcucuggcucgccaccaacgcacugaggagagaggugcccucagcaugcugggcagaacgucggggaaacgcggccuucgagcaggaccgcccaccugucagaagggagcacuccucuacagagccgaggggcagucagccacccucaggccccugcggcccugcuguccccagcacagcgacugaaguucucacugaggggccucguccccuccgggucaggccuuuccaggaaccuggcucugccagcugcaaagcaggcgggggcucacgguuaaggccaucgcagggcagcggccauucuucccuccuggcugcccggcugggccccugauaacagccuccacaccgcagucagaguucaaagcccuccuucccuuccaccgcagggcuuggcuuugcugcuucugggcuccgagaaaggaacagggccgcagaaaccagaggaauggaaagguauccacagagaaggccgccuugcagacaugaagugggacguuccguaagacagcaucucgagcuggacuuggcggggagagggaggcggccccgcacaggccagggaggccccagcacacaugaggccgggguggaggcccuggcucugcggugccaccuguccuccccagggcgcacccaagcccaaggguuccuucccaaccguggggucugaguuugucaucuuccagcuuucucaaguccccugagucaugagaacuuccucuacacacaggcaggucuguguuuuauaugaaccauguuuccaugguaaauagauuuuaagaauucccaaaggacagacagugucaccaacagcagagaguggagccucuggcugccucauguuugaaaguguuaaaaauaaagacaacacugacauuugggguuguaaugugacggaauuacagucuuuuaaaggcaagaaccacuuaucuacacuacaugcaauauucaguguuuuguucacuugucuaauuggauuaaaauauuuagcucccuuuaaaaucuugauugugaauuuauauugugaaauguaaugucugacucaggaagcaauaaguagagugaauguaucugaaggaauauaaaauucaauugacuuuucucccaugauucuuauucugaaaguacucacucuuggacaaagugaacuguuaacggaagagcaagucuggcuaaaaugaagcccuaugcgcuuuucaauauuaauuauacacggggcgcucagucaaaaaacaaaaaguuuaacugucugcuguuggagguguuuggggaaguuucuccgaaggucgcgagaugcuuauguuagacaugcagcacccagggucuugugucauuuuuuaaaaacacucaggcagcagggaguuaaugacauuuuagcugcauauguucaaguuuauuuaaaaaaauaugcaagucacuuugguugacagugucuuguacacaguuuugaaagaaucagggcaaacuuuaacagagucaguuuuuauuugaaaaauauuuucugggaauguaucaguguuuauuuuugagacugacaauucgggugaaaaucaggauaaaaacaaaaaaacaacaauuugguugaaaucaaauuguuuguuuucaucuauuuagaauucuuuccaaaaaaucuugguucaggaggaggcuuuuuaauuuauuuuauucaauguauuugcuguucuauucaagcgccaucugucuuacagguagcuaacuuugugguagcuccuaagucagcugggcgaggcccccagggcuccuggaaggaccacaguaaauuaggugacaccuccaaggccuaacaugggcagccugcagcagcuccgccuugcagccaggccucccucggcagggagucuugcucccugagagcugucacuuuucuagaaccucccuucucccuuugcuuccaguugcaaugggccuuuccucccuucaucaucuucugugucucuguguccccugcuuguuuucggcucucuucuaugaguccuuugguauaaugagauaaugucgaugaucuugaauauaaucacauauggcugcuggauccaugcacaaguuuaaaucaaauuagaaaguaaauucacugccaagaaugcuuaaaagucauagggccaacugauuaaccacugacaagucaguuuccgacucuguuuucuaaacuguaagugauucauaugaggggacuaaaagggaaucacuccccagauugaacacugcagacagaaccaagcagccugcucaggauacgacggcuaccagaaaaugcaagucagccaaaaccguauucauuaccaaauaagaaagcagacacagaaaaucaucuugaugguugagaccauccucuaaguggacagauaauuucuguuuuccccugucccagaugccauucuccccaagacucauguuuccucaccagcuggcuccaaccuuccuagccagauguuagagcccccaggcucugggccgcagaccccugacccugcuccaagcugucaggcccugcccaaacuccccugagacccaccacccucaccccgaaucccccuccccccacccccaccaccaagguuucagccucccccagccagggccugccucucaagagggcgagagugcgacuacccagcccagucucaaacaaaagacaggccagggugugugucuggaggcccugacccucccggaauacagaguguggggaacugcaucuaggcaaagcugggcuagugcuucagugucuguuucuccacaaggacaaguaagagccauuucaugacauuuaaaagcuauuuucuugaaguuguuuccgaacccaggugaggcaggagaucaauaaugccauuauuuguagucacccuaaacuaagaacaagccaagaggccgggcaaagcucaugccuguaaugccagcacuuugggaggccaaggugggcagaucaccugaggucaggaguucgagaccagccuggccuacguggagaaacccagucucuacuaaaaauacaaaauuagccaggcgugguggcaggcaccuguaaucccagcuacuugggaggcugaggcaggagaauugcuugaacccaggaggcagagguugcaguaggccaagaccaugccauuguacuccagccugggcgacaagaacaaaacucaucaaaaaaaaaaaaaaaaaaaaaaacagcugggcgcaguggcucacgccuguaaucccagcacuuuaggaggcuaaggugggcggaucauuugaggucaggaguucaagaccagccuggccaacauggcgaaaccccguuucuauuaaaaauacaaaaaaauuagcuaggugugguggugggugccuguaaucccagcuacuugggagccugaggcaggagaaucacuugaagccgggaggcggagguugcagugagcagagauugcaccacuguacuccaguccgggugacggagcaagacuccgucucaaaaaaaaaaaaaaaaaaaaaaaagccaagaaacgagccgagagcuugagccagugcccugaguccugcccaccgcagacagcgccggggagcggggaggauggggguucucguggccaaaagcauccauguggcagcuaccacuaccaggggcucccucugccagccauguuguugugaguguuucagaauucaagcagaaacaauuagaauaaugaagccugccaacaggcuagacacuuccuguuggaggccacaggccagccugagccccaccaccaggggcagcggggcucaggacccaggacagggagggaaggaaagggguggacuuugcuuuggaaccauugcccgacccauucucuucuggguauuaaguggacagagauguuuagaguuugacaugcaaaauuaaguuaagcuuaacucauccaggcugagaaaacggaagccuuuaguuaaaccaucucuaacccggacaugaggacagcucuaacccucagcugcccaagaucuggacccacaggccacuccaggaaaacagagaggguggcugagcacuccggagcccucaggcggcaccgcauccaaaauaccugcucgaaccuacagcagccucgcccacaucauggcucagcagaagccuaacucacaacucaagcugauuccaugacaagaaggcaucgcagaggcugaagcccacugacagccccuaccuagaggugaaggccaggcuuagccagaaaaagcaggcucuggguuuagauauucagcagagagcuugcaaaccuggaucccugccuccucucugaccacuaguauuugcaacugaaagccaacauucccucuaccaaauuucuuuugucauguucauauuaaaauaacuccaaguguaauauuugaaucugaaaggccgcuuuagagaugagccagaugggccaguaucagauagcacaggaaugggcaaaucauugcuguugcuucaggcaaaagaagaaagaaagaccugcuaguuuuucugaggauuuuuugagguuugggguuuuuuuaaugcguuuugugaaaauuuugcaacucauuuggcaauagccagauuuuuaaagcccuggaagaagcuucuaagcaucggugauccauguuaagaucuaagugugcuguaaagcaggcagauggggaguuaaaaggcaaagcccacguucuccugaucuaguccagagcccaaaggaagcugccgugugcuccagcuuccacggaagacuccccacaaccugaggucugacagaguucuuggcuuuagaggcugaagauucacucaugccaggagucacggucccucccuccuaugugacaagagccuagucaccugccaggagaccuaguggcuccagugguccugaucuuuggcuggccaggccuaaagcaggugcugcuggggcccucccuggggaccugcccacagggcuggguucugggcugggucugguggaggaugagggggucauccugaaagcagaggggaggggaguggcacuggucccacagcugcugcucugcaggccucugccuucccugaaccucucccaggacccucugaagaugagggagaaaggaaacacccucacacguccucagccugugugcccaagggcccguggggcaucccgccugcacucagcacucccaguagcccgugaagccaggcgugcaccaugcccacugugcagaggagaaacugaggcuggaaaaaggcuuaaguuacuuguccgaagcgggggcaggggauucagcacagugacacaaccuggaauaauucucuguucuuuccagcuccaaacacuucagagguuuucaaaauguagugucguccagaaucaucccaacagcuuggcaaaauucagguuccagggcccugccauggagcgugccaggugaggccucgccuccuagauuagcuguggcagugcggcuguggcucggacuuugagcggcccgcucccccacagucccugggagcagucucagaagcauggggacaguagaggcauuuccaccuccaggccuuagcuccguggcgccugggugugcucauuuacugucugugaacacauguuuggcagagggauuuuggaccgagugggaaaagucaguacuuacagguuccuugagcacagggucauuuugugaggagaaugagacuccucuucguuuucauuuccagaugcauuuuucauauuaaucauuccaagcacuuacugccugaaguccccagggcacucacagagcaccugggugcaauccuaauuaaaggcggaggccuuggucagcccacggaccaccucauuauccuaacaaacugcuugacggggcaaaaugcacagccucucugacaggaagagaagcgauuuagcaaacgagguuucauacuguguuccaaauucaccgggacacuuuccuuccucccuuuucccugcugguggccccggaucuaaccugaauggggaaagccugggcuguggagucaggcuuagccuccguuugcggugucccuacuugccagcuguaaugcuugucugggccuuaguuucccuaucuaaaccaugaagacaauaaagucagcaucgccugcuuguucaaggguaaagggaauuaaugcauguucuguguguaacacugccgggugcucugcaagcacuccagauauuagcccaguaaucagucagcuaauuuaggaugagaugccugccuuccauucaagacgacuuugcuaauugggaacaccucuuuccucaaccaauucaaaccauacacgaccuucagaggcagcucaaggccaccauccuccaaaaagccuguucugccgcccacggccguccucccgcuucucccugcucucgcacccuccgcagccugcacggcgcaacuuggcacucggugugguucguugauucgcgggccggggucuguucaccugcacggacuuuaacucccucaccaggacgggcccauggcuccgcuucucuggguccugcacugugcccagcacagucuucgggaccucccucccagcuuacugcuaaccgaugugauccgugagaaagccggccuguugaggugcauaaaagauccaccuguagacgcccgcccaaggacucccaccugcgccgcguucugcacaguaccuggguccgcagccgguccaccucuuccgacaggcucugccucuccaggagaagcugguucugcuugcugaggagcugcaccagcugcugggcuguggccuggcugugcuuauccagcugccuuagccuggagaaaaauccaccgcagaauuaaagagggauaacgucagccuuucaacaggcccaggggcuguguguaucugagggaagccccugauagggaaccaugagcaggacgccuagggugacccugaggugccaggcucuggcuggcacuagguccuugguacgcacugugugaagguaacauucuagcaaaugugcgugggaacugggagccaucucaguacacuaucaauuagaaaacacgcagauaagugggguaaguagaaggaaaaggaagcuuugaacucccaagcagaggucaaagaugaggggccuaaaugccgccauuguucagcuggaaaggucucuggcaggcugagcagacggccgccccggcuggggaagugggugagggccguggaaacacugaaguaaggguuuuccauuauuaaucacucagucaaucacgagcuccggcaucgcugaccagaugucuuuaaagauccuaaauuugucauucugcugaugggcgcuccucuccagacuugcuaauucacucagaccauuauccucaucuguccacagucggcuuccuacagccagcagcacagucacccauggaacuguuggcuuuggauuaaauguggaauugaacgacuacccagaaguguucuggaaagaagcgagauguguggccugccucaccguccucacccaucaaaagcaccagcaggcacguuaacucgaauucucacaaggaaaaggccauuaaagcucaaggugcauuucaaacuccaggcuacugagccgaaggccucgugggccguucugcggacaccggccucuggcugcccucaguccgggcucuccugggacuccgggcacaacuaaacuuacacggccacacguuugggccuucggguugggauagguuccuuuacaaaaaaggccgcacaugugggcacagguaccacugcccucugggaaacccggcgauggucgguaccugccuccggcgcugcucggcccacacccucccauuuccccacggcucccccggcccugccccaucgcccugcucagccuccgauggauuuggcuagagucuuugguccaggggcccgagcccccagcccugacccuuccccagaacgcaccaugacucccuguuuucagccacacccagcguuguccgggucugcggggcgcccuaccugugccgggggaggcgggagcagcagccuaggaccccgcccaggcagagccggcacuacgcaugcucccaggaagccccgccuccccgggcuuggcaccuccgacugccacgcccacaauuccgcaccaccgccccccuugccugucccgacaagggccuccugcugcccgcagguucuggagaaaguguaaggacuaagggacgcccuggcgccucuuuggagccugggcaacagccaggcccugcccugccuccaggaucaggcuggccucaacagaacagcaaagauccuccauccaaguaggaguguuucccugugugugugauguauauauauggugaugcuccaacaccccaccucauccuucccucugaucuuggaggaaaaguagguuuccuucuggcaauaccuaaggccaucgcugcucugggaagccucaucggccccuacccguccccaucacgcuggggcugaggcagccuuuccugggagcuacccucaaagccacccaguggaucacagaagcucuccugcaaggccccaggggggggcccgggcuguccugaacagugagcggccgggagagaggaggacgucccgggccagcggacuggggaaccugccuaggccgacccucugacacaggcaggcggccaccauucaucugagcaccugcccugcuguggggcccaggagugggucccauugaagagacagagaugguaacagcucuuuuccuugagaagcagacaaucugaugcuuccguauuuaaauuaguggguggaaagcaucauucgcccuugagcucuggaacccuaagguggcuuuuccccuccgaugaaggccuaccuguggagagagcuacuggcuaagagcaacugagguagccccguggcuuccugcuugcucgaaaagaauggaacagaaacgugacaaaugacaucaugacauugcugcauggcaagaaggugccaggaaacgugacaagugacaccaugacauggcugcauggcaagaaggugccacgagcagccauuguccauguggucccuugcccugugcuuggaucaaaugagaugaugguccuuuggaccgaugggcucaguaugugguuuugaacuccugaaaagggauggcagcccauccagggcaaugggcagggccaaagccgcucucacagcauaaacaccggucacggccggccacccuggcuccaccuucagcgauggggccgguucuggccuagaccuuccuccuauggagcccucagaaccuggaggagguuuaguccagagugcuuugcaaccugggggccugggaaggcuauagcgauuacuggggugggaaggaggaaggagacaccacccagaccccgcugaaucaagugccugggugugagccccacaagacagcaggggaccagcugaccaggauguccacacacagaagcaccccugcugugagaagugagaucccuaagaaggggcagcucucccuucacagcuaagagcugaggauggauuccaauugacucaauuuuuaaaucaacuugaacacucccaguauuacaaauauugggaaaagagauuuuuuuuuuuuuuuuuuuuuuuuuuuuggaggcagaguuuugcucuuguugcccaggcuggaguacaauggugcgaucucggcucaccgcaaccuccgccuccggguucaaacaauucuccugucucagccucccgaguagaguagcuggaauuacaggcaugugccacaacggcggcuaauuuuguauuuuuaguagagacgggguuucuccauguuggucaggcuggucucaaacuccugaccucaagugauccacucgccucagccucccaaagugcugggauuacaggcgugagccaccacgcccggcccgagauugauuuuuuuuuuuuucuugauacgaagucuugcuuuguugcccaggcuagggugcagcggugcuaugucagcucacugcaaccuccgccuccuggguucaagcgauucuccugccguagcugggauuauaggcuccugccaccgugcccagcuaauuuuuauauuuuucguagagacaggguuucaccaucuuggccaggcuugucuugaacuccugaccucaugauucacccaccucagccucccaaagugcugggauuacaggcaugagccaccgcgccuggcugagauuuuuugaaaguuauuuauuuuuggaaaagccuccaacccugcacaaaccagccuacccucuguuaauggcuauuucauugccaucauucauucagaagagauuucuugggguguccuagacacauaagcucucuuuucuuuuccauggugguuacugcucugucauauuugugguguugaguucaccucuucauccacccacaguuucaaauagcacuguugaugacugcuaacaccuugagccccugggcucacugcgccacaauuaccuauguaaauuucauuaauaaacuaccuguuaaauucaauaauuaucuuaauuaaaaguucacuauaguccuaggagguacaugcuaguaucauccccauuucacagaugagaaaacaagcugagauguuaauuaacuugcacaaagucacacaaguaaucgguaaagcucggagucaaaucgagccagcgcccaaguguccuuaaccaucguuaauggugguuaacucacugaguuaauucaccaaacgaaccaagccuugcuaaacaccucucuucuucugcuucuucuucuuuuuuuuuuuuugagauggagucuugcucuguugcccaggcuggagugcaguggcauaaucuuggcucacugcaaccucugccuccuggguucaagaaauucuccugccucagccucccagguagcugggacuauaggcgcgcaccaccacaccugucuaauuuuuguauuuuuaguagagaugggguuucacgauguuggccaggcuggucucuaacuccugaccucgugaucugcccgccuuggccucccaaagugcugggauuacaggcgugagccaccgcgcccggccaacaccucuuaagggucaaguacugauuuaagaccuggggguccaucaagaaugacaaaugcucccggcucucgggcgguucccggccaauggaggagagacucacuuguaaaaaaaacaugcucaacucaaacaggacacugaggcaugaagagaaauggccaauauugcagaugagaagccugggagggcuugcgccugcuuagacauggcucaugaucgucguaugcugagcacuuuuaugucgggcacuagacuuacuguuuauuuagcacucacaauuccaugaggcaggaacuaauuauuaugccacuuuaagguuaaggaaacugaggcacagacaacaugaaucauugauucaaagucacucagcgggcaagcugggaugggaaaggaugagugggugcuuuucuggccagggccaggggcggggccuucccacuucggggccgcacugcaaaggccaaugcgugucuggaaacugcaagcugugcaguguggcugcaccagaggcugcaggcugcucagaggaaggcgacgcuggacucuguagccaaaccagcaaauauggacuucguccugcaggcaauggcagugccauuuaacagacagaggauggcaggagggaucggccuggcguagaagagacguucuggggucagggcgaguccgagguaccuguggaacacgcacccaccaggcagcuaugcaacuuggggcuuaggaagggccgagcuggagcucuagcugggugggccaaaccugcugggaggcgagaccaugaacgugggggcaagauuugccugggaaggguuggcaaagauugucaguguggggaguuuguuaaaaaugcagcucuccgggcccgcacgaccccccuagcugagaagcucuucugcagugagagggaagggcucgccccaggauagggguuaaggaaccuccgccuucaauggcuggcaguggacuggaauccggcaagacacugagagugggauccuggagggaggaaaacugggagacggagguccagggaggagaggggucagggcggaguggccgguuugugggaaaugccaccugguggcggagcgcccugcggagccuccuggcuggggcagaagccagauuucaggggcuggaagagaaagccucuucuggugaggggcugggcuggcggggaggucgcgagacggggugcggagggugggagccaccgaagccgcuggggaggaggcacuggaggagagaggggcaaucuucacggcagaggacggcggacuucccaagggaggagggcgccuuaggcagaagacugagacccuccccccgaggcaagaguggaggcgggagcaggggcgggucgcggagggcgcucgugcucagcagccuccaggaucccccacguagagggcaccgcuguuugcgagaaaggcgacgaggcagcgggguggcggcggggacgcugcugcggggacgagggcgccggcgggaggcagggacacgccgcccagcccagggggcgcgcuccgaggaagacccgggcgcccgccgccuccuccccgggcuccgcagccgccgccccgugcccuccaccugcgaccuucaccccccucaccgucgccacgggccuggaaaccucuuccagcguccguuucagggcgacugucguuuugagagagugcaauuucuuguucugugugucuuguuuuuagccuuuucuucuaggaggcauuaagucaugaacggggcgaggggguuugccaucauggggcccgcggagucuguuuaggcagcagcccccgcugcaagaagccccccacagccugcgaaccacacacgcccuccaugcggcaggaaacacagaaucguccgauuucagagcucaaccccuaauucagacccuucuuucccgcgccuuuaucucaucuuugcaacaggcagggauugcauccagggcccccaggaugugguugcuaucuucacugugcugucauggagcccugggagcuguggccaggccccaucaggggcaggaagccaguccuccucccaggaagccccugugcuccccggcccucacagcacagcguaggguccgcggguccaugaggaaggacacuugagggagccugcacccaggcuggugcggccguccuaaucucaggcacaggguccauguccuucaggaucugcagaugaacaacugccaccccugccuggguaggacuggggacccugagggagaaaagcagcugccccaugcagggguagaaugggcagcacgggcuccccuuccacgcaagggcaucccaggaauuucaggcgugucaggggcagcaguuaccaugggaacaaacacgcccggguuucuaaaggcagaugcugaugaaaucacaggggacucauaagagugcugggcccaggcagaucuccauugguccaacagcgauccucugagccacacccugcaagcaugaucagaaccagcauuuaaaaaaauaugcaaggcuucaagauaagauggagcaaguggugaaauacaaaacaacuuuauagagcugagugggcuggggaaaauaucuuaugcaaaacagaagcggugcaagcugccagcucugguccuaugcuucagacacucauuugcuaugaauacugugaaagcaagugaauacauagauuuaaauuuuuuuauguuguaugugauacauacaaaauauaugcaauguauacauaagucaugagguauaauaaccaaaugaacacuugugaaccuagcaccagcuccacagggccacuaccaauggauuucuucuccaggccagccccuuccuuccccagagggggccuauauccuuaugcguguauguuuuucaaugagaguuuuuugcuucacuggacaauucccccugggagcuaccuacggacuacaguggaagguuuuaguuguuguuuugggguuuuguuuuggguuugguuuuggugguagugguaaaauccuuuguucugaaauguuuucagaccagagccuccucccuguggucacucugacuacagcuaagauuguccuuccucuuagauaaguguucucaaagugcuuagacucacuauuucccugggagcggcgucuuccucauggaaaugaagaacauuuuucaaacaacauauggauuucaaaggugcaaauacaugaacuguaaaauaugcacucacuuuucuacuccucccaguggccuccucuaauguuuacugagcauuuacuaaaugcccaacauuguaagcauuuuacauucccuaauuuaauccucauaacaauacuacacguuacuuuaucaucugcauuuuaugcaugagagaagcaaggugcagagaagcgaucauuugcccaagcgcacacaagguaaggcagagccaggauuaccuaagccaccaaggccacagagcaaggcccacagugcgacucaucacucuccuucuuagacucuguacaggucucucacuccccuuuggucccucuuccuccuccaucagaccuucaaaugcuggugugacccagggcugggcucagugcucuccugacuggaaauguuccgccugcaugauuuuuaaaaucuacacucaugacuccaaguggagaggccaaggauccugagcacuugaucucagccucgggccucucucuugcauuuccaagcccaccucaaacucaccaccugacacacuggagucaccuucuaaugcuccucucucugugacccucucagugggugggaccaccccuagucaccauccccacagcucagucuccugguuccacagaugagcccucuaggccuucugaaccucucccaucccaucccaucccacccacccauccauccaucccacccauccauccauccacccauccauccaccccacccauccauccauccauccauccaucccacccauccauccauccauccaucccacccauccauccaucccacccauccauccauccaucccccauccauccaucccccauucauccaucccacccauccauccauccauccaucccacccauccauccaucccacccauccauccauccaucccacccauccauccauccaucacacccauccauccauaccacccauccauccauccaucccacccauccacccauccaucccacccacccauccaucccaccuauccauccauccauccacccauccauccauccaucccacccaucccaccuauccauccauccaucccacccauccauccauccauccauccauccauccaucccccauucauccaucccacccauccacccauccacccaucccacccacccauccaucccaccuauccauccauccauccacccauccauccaucccacccacccauccaucccaccuauccauccauccaucccacccauccauccaucccacucauccauccacccauccauuccaugaccuucacucuugaaguccagcugccagcacuucacauccagguuccugcacagccuucucauagaguugugugcuuccacacggcccccuggaauccauacuccccgcaacagcuagacuagaaggaucucucuaaacaaaacugcagcccugccucucugcuugaugauuacuuauagcucuaauccuaauccuaugagugcugaacuuggaaaugggggacaucacaagcuagcuauuuuaccuuaagccugagacugaguaucucucucaaccucagguucuccauuuguaaaauggagaaaauaagaucuccagaccugaaccaucaacucugaggguggggcccagcagcauguguuuuaauaaggccccuggaugacucugaugaauucuuaagcaugagaaccacugguacauucuaauucacaguauuaaucacacauacgaaaugaguucuucuggagaauaauuuuuguguggcuucaauuuucaucaucaaaacaaccaacugucuacaugaaaacucuccuagucugcuccuaaaauacucuggcgucagucaugagaacuuaaguaaauccugugaucacuuugaaucucaguuuccucacaugugaaaugagaggagaaaacuagaagugaggucggcaaacuucagacuacaggccacugccuguuucuguaugaucugccaauugagagugauuuuuacauuuuaaaaugauuuuuaaaaaucaaaaggaguauaauaugugaacacugcaugaaauucaacuugcagcgccccuaaauaaacuuucauugaaacccagccaugcccauucauucacguuuugucuauggcugcuuuugcaccauaacggccgaguagcugcgacagagaacauauggccauggagccuacaauauuuauuaccugaccuuuuaaaguuugccagccucggggcuagaagaugacuacauucuccuccagcuccauauuucuacaauccuauuacuuuacagauuuuacuguguuccuaucuucaaauaucgcuagcuauuuacauagcaauacaccuagucagcaagcugaaguuuugaaaaugcaauuacugcucuaggucauuaauucuagugaauaaaccauguuaauguaaagcuguauuacuuuguuccaacacuuaaccauugcugcggcauuuuacauaauuccaucucgugaacgagguccuaucagugagaacaagcagugugcugaggcuuccggaacacgcucuagcccauuauccuugcucagaacauuaaggcacuuucuuuuuuuuuuuuuuuuuuuuugagacagagucucacucuguggccaggcuggagugcaguggcacaaccucggcccacugcaaccuccgccucccggguucaaaugauucuccugccucagccucccgaguagcugggacuacaggcacacaccaccacgcucagcuaauuuuuuuuauuuucaguggaguugggguuuaaccacguuggccaggauggucucgaucucuugaucucaugauccgcccaccucagcuucccaaagugcugggauuacaggcgugacauuaacgcacuuuuaguggcugguuugcuguuuacauuucccgugccuaaaucuacccuauucaauaaugguuucaauaaaggaauucuuccugaggaucgugcaguggggaggggguaccaccuucaaugaagagaauguauguccuguacugccccuuuccuggcucauucucucagauuccuaauuagccuuggcugccugcagaggaagaacagggggcuccuuggggaugcccccaagugauggggggaucaaguccugcucuucucaugaaaagaaucauauuauguuagggcugagaggcaccuuagagaacauucaguucagcccauuauggugaagccaagaaaguauaagugacuugcccaaggucaggcagccugucuguaguaaaucuggcgcuagagcccacaucucuugacucuaaauccagugagcuuugcagcaucucaaaauccuuuuuugaaacgcccgacauucuucuauuccaugucaaacuugagaauuuaagggaaggacccugagagagagaacacgcuggguaaccuucugggcagcagcugacaccaguucauuuuccgaggccugggggcgggagaagagggaaaucccuaggccagggauuccccaaugagcucagugaggagaaccagacuugauuuuaauucuuuuaaaauuuccaaucuauuguagacuaaugguuuuguggaguacaauaaaaaggaggaagcaguguuugauuguuuugaaaauuucugacucaauuucaguucuugccucaucccagaccaguaacaguuugaggaccguacucuggaaaccacacucugagccacauugaucucauccacagacugguguuggcacaaaggaugcaaaagaggccagaagcuuggaagaccauguugggaagcccacagugccacacuggcccccagugaaugggcccauggccaaggggacacuuucagcucuucaagcuccagcacagcugccucugacaggaaccuaaagccucugacaauaucaccgaggcucuucaaagaccaacuucuucaaacagugcuucuaccaaaaaggaggcacagcuucaucuuagggcaauuagaucuguugaaucacuaccuuguaaccuucuuaaaauacaagugcuaucgaaccaaggcugaguuuguaauaccuuuggaagacugggcaugaauaaaggauccugacaccaugaaacaggaguugacacguuaugaaucuuagacuuugaagaaccuagaagaccaucugccugaaguaagaguuaccuuaaucagcuuugucucaagcaagaacagacuaauggugaggauagccccacugugcaaaggaaaugggacagaggaauggaaauuguugaaaaucagaaucuuugcagaguaguaucuaugcugcauguggcucaaggccauacagaagcaccagcaggaaaacccacacugccacgcacacuguacccuaccucacccuaaagccguccuuaaaaauggguuuauuuggaaauaaugucaaacuuauaaaaaguugcaagaauauuacagagaauaccaacauacccuuuauucaaauucaccuacuguaauaauuuugccccaucugauugauuacgcucuccugccuuucucucuguguguguguguguguguguguguguguguguguacagaaccaguugacaguaagcugcaugcaccauugcccuuuuaucuuauaugcuacaguguguauuuccuaaggauaaaggcauucucuuacagaaccacaguauauuaccaacuacagucaauuucauauugaucuaauagcuucaucuaaccuacugaauuggauucuaaucuuguugacuggcccaauaauguuccuuucuucccacuccagaaaagauccuucauacuuaguuggcaugucucuauuuagacuucuuuaacccagagugauuacaagccaguuuuauuuuguugaaugcuauuugcaacugaauuaccaauagucuuaacggaagacauggaacuaucagacgcauggagguccuguucaguugccaucuuggguuuggggggcacacugcuguguuuucaggaaguuucuguuugaauggggacuuucuggugcucccagagacuaaaacccuccugguguggucccagaguaugucacguuccacacuguggugaggucuuccucaauuuccuucauauuugaccauucuugggauagucaaacuagccacagaggugugauggcauaagauugggcccacagcagcuaaguaaccagauucaaucacuacagcccacuuauuggcacacaucuuaauuagguuuuaaugcaaguaauuugauaacaacuccuggccguccgcuacggaaccgucaaugcugaaagcuuuuuauuuagcuccucuucuguccaaaccaaggcagccuccccgcugacccuugucaaagaaccccaucugcugguugccacgguaacugaaggcgaccaauugagcugaacagagugacucagaaauaaaaucugcagccaaaggaauucugcaaagagcaauaaaucauucaguaaaaggggguccuccacacacugaugaguguugggauaauaugauggcauaacucuuccagcuagaagguccaugacagaucagagugauuaggccugcuggagggcucauuugguuucuaguggguuccagcagcagacgagauggagccugcccaguugugugccacugugggggagaaggaauacgcggagucaauuuuuaauauuugggcugcaaaauuuugcuuuuugaggaguggcaagagaaccagucuaggcuuccaacaccccuuccucuauuuuucaaaaguagcacacguucacagaaugccccauuuuagcccaaaaagcaccuugagccuugaggaaggugacaaagaacaaauaccaagauugcuuugcaauaugccaguuuagcaccaucucucugucaucaaucaacuuuuagguguuccaaccagaaacccucugugugcauaagccuuggguccucgcgaaagcaggggagagccugggauucaacucagaggccccagaggaucucugaggaugaucugagagcggacgagggguuugucucuccccaggacugggucaguguugcuuauggagccccauacacauccuucccacauuaagauuuccugaguaagaggcgccggagggaagggggagcaggggccuucuuccaggcugcucccgguuacaguacacaguggccccucaccccucacaccacaggccaugggucccagucacagcccccacuccuggugagcaccugcuggguagacucggaaaccccugcaggcaauagaaagacccccgccccagacaugcuaaaccauccagacaguauucacugcuauauguccgucucuugguuguguugggagaagcaaagcuuaguggcggcgguagaacugcccugauagcaaaugacaacaggagaggggcuguaggacagggcucagggccugugcguguccgggaggggcugcaggacagagcuugggccugugcgugucugggggcggccugcccugccagcuccucuccucccaggcugaaugccaccuuuuacagaggugcauuggcaggauccggacauucccccaaucccugacccacauggcaaugggguacccuauuacuaagucaucccuagagauaauuuucugcuucagaaaagagcaacugcuaaacagaagguagauuuuuccccgauucuaaaugcugccaauaaaaugcuucagucucggaguugagugaaauuccguugacggaguuaggagcggcugugcacguucaggacgagccuccucccuuacucaaccaguccgaggaggagcgcaucuagccgagcccugcgcugccacgccgcgucccgggagcucccagccugccuuccaccccacgcugggcaauugugccucugcagguggaacagaccgcagggcuccacgugcgccucccgcacgccagcaccugcucucgggccaccgcggagcgcuccaggcaggagacaccccucucccucgccgggcaggguggccuaggcggccaggucucagcgcugccgggcggugcaccguccucucggccucccugcccacccagaccucccggcggcugcuucgacucuggauacuaggcccgggcucggccgagucccgaagccgcgcgagagggccuggagcccgcaccuggagggcagccggccggggcuuggggaggcugggugcggagcaucuggcucaggcgacuccacgggggcucgcagggccucuggacuuuggcagaaggagaggauuaaaccgggaugacgguugagaggaggagaugggugaaagcuucauuaacuccaugcucacgucccaaguucuuuccccugagaggcaaugaguaaaaagguugauuuccccgcgaugggaaaggugcugcgugauugcauuugcuuuucuuaccuuuuaauuccuuauuuguaaaccaaugaaucauuguuugucagugaucaugaaggacucaaauuuuaauaaacaggaaaaaaaaaaucuuggcuaauaggccaaagaaauacugcaacccguuuacauuucuauguuagugauuaagcuucucaugugacuuaauugaaacuggcaaggaucuugagaacucaaagaaguacucccccggcccccccccccccccccgccggcaacucuccuccaauaaccaaacucauuuguaagaccccuccuaaaaagugccauggaaaauggagcuuccugauuccauaaaaauauuuucaguaaguacugcuucaugacaguuguucagacuugaauucccuuccucucuuuacaaaguuaccguuuaguuucacuucugagcccuacuuccaauucuuugucucugcucacucucccgcuuucuccuccauauuucaauucccagacacucuugaacuuuugcacacgcugccaguuugagccugcacagaauaaucaguauauuaauuccacucggagacagugagauuuuucuaacacaaucugcccaaccugaacucuuuccuucagaaacacuucgccuuuaaaaagaaacuucccagcaugaaccucauaagaagcgacauguaacagacagugcauguggcgcugggcaugcagcucagaauuaaaagagaauuuuuuacuuuguuucuucagugccaugugcauaauguacauguggaugaaacugacaucagacauuuaaagcaagaagggguagggggagggggaugugaugguggcgggaaagagagagaaaauauguugauaaaaacaguaacuucuguuaaucuacauuuuucagucacugucuuaauuaagaauguuaggaaauauguugcaguuuaauugcauuguuucaagaaauucuaagacugacaaauuugggaccauguacacuuggaagguaaaagagauuaaaguagggauuucuuccaauugguggauaacaaucaaaauuaugcuuucuacagacacaccccccacacccccgcagagauccuaaacucggaagacaaaguaagaauauccuagcacuuaacauguucagcaugaaaugaguucugaaaauuuaaaaacguguuuuaaaaccuagguauaugagauaaauuuuaaauacaaagaauugacacaggagaaauaguacuuuaucugaaauuucugguggacauuuauguuuguagaaaauauuuaugaaggaauuugguaacaaucuucaagugauuuucagaugaccuuguuuaagauaguaaaaguuguuugcuggagucacaaauccauaaaaauaauaacaguuugaagacacuugagauuucuagacuuguguccuguucuccugcuggaguucagucacacauucuccagguuucauuucuuuuuuugaggaagccuuugcauuguuccacagcaaauaaauuagaauguauuuucauugcucgaaguaccuuugagggaagcugcaguaggcaugacagcuuccuauuucccacaguugaccauaggugacucauuuucagccuggacacagcugaccauaagugaauucauuuuuaaccuggaugcugcauuucuuacuugcuuccguuuuuggggucauugccugugagaaaggaggaagggcacucugcccccauggugugcagcacagaccagguacugaccucuuucuccagcccuggacuuagaaacagacaaacaaacaaaaaugcccaccagguacugaccagcuacucucagggacucaagcugaugacuuaauucaaacugguuugaugauuuagucagauaaauggacagguucuuugacugaaucaacuagccauuuuaucuuccauuaagcacaauguaugacacaccuggagccucaggcuuuguuaucuaccccagagaggaggcagaccuaacuauaucagcagcuaaagacacugcacugcaugugccaugacccugaaacaucaacaaaacaagaucuguuugcccuaaaaggcagcugaaauguccaaagagccuuccuaugagaagaaacucaccagaucuguucuaguugugaggucucacugcuucucccgccuccagccucccaaaauaagaauggccugagaaccugaccacaguugaaauacugcccauguguugccagccucacaguguuucaguucuccaauuuacaguauauucauacaguauuuaaauuauguauuagagaguagaauccugaggucucaaauugcugaguaaauggcaccugugaccuaauaguccaaugcuuucacuaguaugaaauuagaauaauuuuuuuuaaugccacacaugagguccaaaauagugaugcuacauauuucucaugugcuuaacaccuaggacgacguaaaacucccaguuaacucauuaagaaaugaaagauuuuccaucuccugaggcuucugggaauucugauggguggauacaucauccucccuccaccccccaaccccugauagcagggcagccuccuccgaaaaggccuuugucaagaggcacgaaaagcuggccugcugagccuggaccccccguggagggccgagggagaggacacagaagaggacuggggcauuauuaauuaccagauuagggacagaguagaguucaggcagacacagaggcagacagaacccacgagcguaauaaguugaaaaguuccgagucaagucucagaguucgaagaacauuaaaugaagaauacauaauacugggggaaaaaagggaagcaguacccgcccgagggccaauugccucuccagcagcggcaaggcuguuccugggcucgcaggaccauuuguuccauuacacaaucuccugaagccauuuagagagagcucaaacaacugccuguaccaacacgacacauggcuucccaucccgacucugcuaauccagacgcuccaaccaucuuuccuuaagaugccauaugguuggcagaagccuguagaucuagcagcacaucugcuuguacguuucuucuucccuccaucccccaacaaaagagggaucgagagacagacugaggggagagcaugcuuguguaccucugccuauacagauauuucuucuuaugcacucuaacaacaacaacuaugaaagagaugaccaggaaguauucagggcucgaucauuuuuaacuagagaacauagcgauuuuucuuuugcuuguugaugcuauagaagaagaugagaaaaacaaaggguggacagucuccuuucucccaaggauggugacuuuaaaaucacuucaaagcucgcucucucugggaauccuugugaugcugucuugccacaggagggggacagcacccuugccugaaucuauuucuucucuucuuuucggucaaggaagacagacaagcugagaaacuagcagauacccagagccugcuuuguuagcaagcacagcacggcuguaugcuaaugagucggcaccgacacagggcuuuuuuggugugaugagcaaagauuguugacaccguugaaauccuggcuccccuggccugugagugcacgggcugcuuccuuggaauccagcccccagugagacaggcugcaaaaaaaagaaaaaaaaaaaaaggaaaaggaaaaaaaaauucuacucuccuaaugacugaaaucuggccauuuguaacuuagagcaguugggaaaagugggggcauuagaaaaauauuccaucaggccagggaucaaaagacacaggugaaaaguauggguuuccucugaacuagaaacgaaaccuggugagcacaugugagugaugacggccaggaugcuuuaggagcaaaaacccaaaaggcggagugagggggauucugaggccccagccccgucggggcagcuggagcacuugcgccacaucugggcagaaggcacugcacacaugggacagccucguugguggcuucaucucagucaggugaaaggcgaagcaucugaucuccuuguaaaucuguuuagaccuuguguuguuaaccagacaugguuuuucuuguguguggaacuaugauccagugaaaaaacaaagcaaauauucuacuguugcuauacuuuuuuuuuuuugguaacaaagaaggguggaaaggggaguuacauauuuugaguauggggcauguuaucugaaguaccccuuuacuugccaagaaacucugagagauagguauuauuauuccaguuuaauagaugaggagacugaggcuuagaagacuaaaaaaaaaaaaaaaaaaaaaccaacacuuucgcaaagcccuguagcuaggaagggaccaaacugaaaaggccaugccuaucuccuuacaauacgcuagguuccagaugcacacaugcacucgcaggcagauacauuaccucaugaauaugcccaggguccaauaugccaaucugagcagaucacugugagcuggugagcaauaagcuaguuaucauuaguaugcaggcaggggcaucaaauuguaaauucaguuuacuuguaauccacaauaugaaugaaaauucauguaacugaaauguaaaaacaugaggagugacugaaaaagcacugaaaauuauaauaaaaaucagaauuuauccacucaaaaaaguaugcccuucaaauuauucaccuugaggacagcauguauauuucaaccacacugccauugccuaggacucugcugacauguucuuuuauuuggaacugccuucauagccaagggcuuagugguacaaauaucuuuuguagguagcuacauauacaaguuugugagugaggauguauuaagugcauuucaucaaaaucauacauuuuaacaaaaaaagcaugccauggaugcuauacuacucaaaaaaaugacaaaucagccuaaacuagauaauaugaguccaauucgaccguuaauaaagucaagaaacuauuauuagcaauucucaagguuaucaucauugauauguggcuuuguagaaggauaaaucugaauuuaaaauagaucugggucgaaaucugagcaugauccuaagcaaauccuuguaagccuauccuuucauuugcucuauaaaaucauacuaugucucucacaagauuguuaugagaauuggagaguauauaaagugacuggugcuuaguagauccucaguaaauaaacauacaaucauuauuauuuucacagggugcuucagagcauauacgaaguacuuuucacauacguuagcucagucaacucugaaacccagcucuguuauguaggaaguauuucuucuaucuaaugaaugagguaauugugauucaauaauaaaaauagcaaaagcaauaaacaauauguauugagcucuuucuaugugcaguuacuguacuaaaugcuuugucagccauuuuauuuuuauuaauuaauucuuuuagagacagggucuuccucugucaugcaggcuggagugcacuggcaugaucacagcucacugcagccucaaacuccugggcucaagugauccucccaccuuggucucccaaagcaccgaguuuacagguaugagccauugcaccuggccgcauuuuaaaaucuuaacaucaggccagguacgguggcucaugccuguaaucccaggacuuugggaggcugaggcggguggaucaccugaggucaggaguucgagaccagccugaccaauauggugaaaccccaucucuacuaaaaauacaaaaauuagccaggcaugaugguggacgucuguagucccagcuacucgggacacugagacaagagaauugcuugaacccgggaggcggagguugcagugagccaagaucaugccacugcacuucagccugggugacacagcugacuccgucucaaaaaaaaaaaaaaaccuuugaagaagguauuauugauaauauuaugauccucauuuuauggacagggaaacugaggcuaagagaugcuacaauaucuugccuaaguucacagggguaguaagugguaaagcuggaacacaaucccaggucugucuucuaaaccuauuauugcagcaacggcuggaaaauccugugcccuuuuguccauacaacaagguccuuggguggaacucacguagagcuacugggcauuugauaaggaaguuuuguagcacaaaaauccuuguccuuaccaaauuucuguguaugcuaccaaacuuuacagaguucaugguucaaucauccuauguauguugacauacacucauacauguguaugaacacugggugcucccuacagcauaguuaaaaauuaaggcaguguucuuuauaagauggcaggacgugacaugcguuucaaugcuucacacacaaauacacaccaacaaagcugucauuauauauguggaaucugauuuaacauaacuaaaauugucagaaauuucuuaucaagagaauagucuuucaguaaaaaugaacuauccagagaagccuuccaaaucaaaauuauuugcaaaggaugcuagaacauuuggagguuccugaucagaugcugauaugaagaaauguaaacggguggaucucaaauguggauuugcggugcacauaugugcuuaaccagacaacucucuccgaauaaagccacugggcuucucuugugaacucuccucuuguaucugaugauagaagaaaaggaugcuggaaucucagcuggguuguucucuaccauucuguucacucccucacuggugucuccuuuaucugacuggagcuggacugauugcuauaagccaagucucucucacugguucucuccucugguaccacagcuuccacacuccugauuucacugcugacuucaauccaguucaaaguggaacauggaacaggauuuaaaaagacaaacaaaaaaaugaaagccuuugcuaucccuccagugcuuccagauucaucaaucuuugaucacauaaucagucaacggucaauagcaguguccaggagggucuacgcacaauagguugugaauggagauguguuaccuggaauuuagcgcuguuugggcacaaggugccccccagguuuccaacuuuaaggguauaaaucuugaaggcaucuagaaaggauucuggaaugcagcaugaggaagcagcacuccuaucccuccagaguggagaccugcauauuaacugcuccacccagagugagaccugguuccccagugggagacacugucaauuaucugccucucauuaauuuaauaggcugcaauagucccggguuguaccgcaaaaacagaaguauugucauauucuaacuuugguaacaguacgggcagaaugaacuuucccugcuggacuugagcaccuuccuuagucagcuugucuacucucgauaggaccuguguaacaucaccucccaggcauaauacaggcucauuuccuauuacaggcugcuuccugugcuggacacuuuaaacaauucaccuagcuaauguuuguugaguacuuacuaugugcccugcacuguucuuaacauuucuguguaauaacucauucaauccuugagagaagacugugacacagguagcacgacugucauaauuuuacagaugaagaaguuuacucccauguuaaguagcuugcccuaaaaucgcauagcacagaaauaguagagacaggauuugaacuuaaacugucugaguucagaaccugcacuguuaacuacucuucucucuagugaaucucagaggcauuaaguaggaaaggguaugaggcccagccuaccagccaugggaaucugugacauuuagccucucuaggccugaauuccuucaaaguaaaauuuaauuuuaacaauacuucuccuauauacaucacaagguuguuagaagaucacauauaucaaauaaaucaaauauugauauauaucaaaugccaguucucaccaucuucaucagggccucauaaauugccauccuuuggguguuaacuggggcccccaaaaugaaaaccaaaguccuuugcuuugccaguugaauacaggagcaaagacuagcucauagcgcauugcuauuucaacgcuuuuaccaaaauggucucagaugaauugaauagguaaugaaauuagccagccccacuaagauagagagugagagucugcccuagaauaggcuauggaaaaaugagcgguaucuucucuucagaaagcccugaggucaugcuagucaucugccugugguacaccaggauauuaaaaauaauaccacaacaauacgcuggacacaguuaacaugaugaaaaggccgaugagauuauacauaaaaaagaaaugcugccuuucuguuagagacagaaaaaaguguuaauacaaaugaacagcuguuugggaagaaaacaucauuuccaaaacccagacaaagcucuguuuauuacauuucagagacauuuaaauuauagugucugaaaaacgauccuaucauggguaucugugacaccuaaauuaucugaaaaucugaaagguuaagccgaaacagaggcugugugaaagacuaacauacagaaaauucuuuuuucucaaaggaugaggugaauaaauccuuugcaugggauaacugaaugaguacuaaguuucaggacuaaacuuuuugaauauccaauagaacauaguacauucaaaauugauuuaaagauguuaauguaugcucuuccaaaauucgaaaagccaaauucacgacucccauuggccuguugcuguuccuguguucuucacgcugguucuccuggcucgcuacugccuccagcuccaggccugucucagaugcuccacagaaggccuggucagcucucucugcucacagugccaggccaggccuaucaugggagguguugggcauggcagccacugaagcaggcuugggcaggaauuuguucccaccagccccgacccucccaaaagagaccaugacucacccaugccuuuuccauggacuagcauguacccagccaucucuaggcauuucuagagaauaaacugucacacuuuaguaaaaaaauucuagcuaaggaaaaauaaaggaaacuguauuuaguuggcccuagggaaagugaaacaaugaucaaaugauugaucacacugggagucacuguuacaguccaguagagguggaaugcuguaucuuuguccagucgauucaauuaaaauacagacauuagaauggaaaaacaacacacagaagaauacucaagucuguaaucaccugugacauguacuggagcuuucaaucuagguauccucacgauggggugaccaggacuugaaugccagugggucauccagcaggaaggagucucacucacccuaugcaagcaugcuugccugccugccugccuuuucccuccaucgacuucuuguuuauuguccuaucuuacuuccuacacaccucacacgguguugugcagcuuaguuagucugcgaaggcuugagauuuuucugaugaaagguguuaugguguuauguaaauacacaguauuauuuugucuuuauuccagcaauacugguuugaaauaguucaauguguguaaauauguguaauaauguguauuaauuugauuuuuuuuagcaauuccuuggcaucccaguuaacuaaguggcagcaaccuuacuugccugaugaaauauuaaguauaguuacagaaaacuauuaacuggucuuugucccuuucaaaucaaaugcuaacuauauuagucuucuaagcacuuguaauaaucugcuugaauacuagacagaauuaccaaguugugaccucccaugaauaaaacagagguauaugcaaagguuaagguucauaacauagcaacuagcccaccccagaggaugggaacagguguguaagcuccccgaaaacaauucguguaacuggaaaaccuaagugaacaacauucagaaaaagcaccaccaaugccaccacaugcuucaaacucuaauuuacaaaaaucacuuuuaggaucaggugucaaacagggccauguuaauugugauagccacuuuuguuccccucuaggaacagcauuucauccaaccauguuaacaauuuugggucaagaggacaugagcacagcaacccaacuuucuacacaaggcucugaaugaaggguuauuuucagccgucucucuagccaauggcaccuaccccugcuggcucucacgggaacaccgagaguucacauccaucccuuggauggguauuuccaagagauuucaugauuuaaacagucuauguggccaugugcccuacuggcagaacggucucauuacccucccuaucgaagaugucggaguaccacccaggcaaacagagucaaaggugcaggcucuggacucaucacaaagacagggagaagaugucaguggauuacuaaaaacucaaaaaccuaaucauauggugaauuuaaugaguaauauuaccauggauuacauuuuuguuacauauauuauuuuuucccucccaagauaaaagucugguuuuagacccauauugugaguggacugugcuauauuaggcauuacaggaagcgguuuccaucaggcuggucuuggggcuggacagacacaggagcagcccuggcuggcugggcagucaggagguccagcaaggcacagaaucauguccucauauuggggaugucagggcugucagccagaagucaugugcuucuucucauuuugggucuuaagucuaaaauuguuuucuaaagugugcaauccaaaaaaauauuagaagagaaagggccuuauucuccucugcauacacugccucucccuagccaucaaguguugccacucuacagagcuccucuuggccuucucaugcuuaccuguuccuucuucugugcccuacccauggcucuuaccacagugcacuaugacugucugccuccugcacuaaaauguuagcuccuugagagucaggacugaauccugcugguacccauagcauccagcacaguguccaauacaugcagcuguugaaugaaagaaugcauuuuuaagaacagcaucaguggacuugacuguguuuugaaagcuccuauuggcccuggaucagaugucacaggguaaggggaaagauuuauuuaucuuuuaaaauaaacagcuuucagagaaccacugacaaaaccauuuccaccuuugguggaagcagagaguugguugcauguguggcagucauauacuuuuuuugucuuccaaagagccuaggguuuuuuuuuguuuuguuuuguuuuguuuuuugccaaaagaugagagaaggcaaauaucuuggugcagaaaaggccuuggggacuuucuagguaaacaauuucacuggcagcagcuggggacccaacagcacuaugauauugcuaaagcuguuuaaaugcagugcacacauaggugcuggugucuucuggcuguacaaaagguaggaguuuuaagauaaugugaaaaaaauacaauguaaauuuguucuacuauucaugcauucauuuuugcucagcaaauauuuucugagcaccuacaaugucuucuuuacugggcguugggauacaguggagaacaagacagccaagauuucacuccaaggagguugcauaguuguuagcaagaugacauuugugaaaaggauguguguaugacaguguuaggagggaaaccucacugguuacuguccuuaccuucacagccacacagccccuuaccuaaaaagauauugcuuucugucaugucuuuauaugcacgagaugacuuuugcuaucauuuguuuauggaggguuauuuuuagaggcagggaugauaggaacgagaacacuggagcucaccacuccacagguuccuccucuucuagaucaugcaucccagcuccugcaguugguugagccaggugacuugaguucuggcaaauggggaagggcagaaaguagugggcucaauccucggccuggccuccaaaccuuuccugcagcccccuucauucccucugugcuacacugaugcaggguugagaagugguggagagaggguaagguaaagugaaaucuuagaguaaagaaccaaugggauaagaucucauuccaaagauguuguguuucacuuaccugaaguccaaguaccucuuaugagcucugaucacaguggcuaccaaaauauauuagguauuagcccuuccccucgaagaggucaugacccauuugggcucggaaaagaccuuugcacaugggaacaagcaguaaauaugugugugagggcugugggccagguggaggugaaucuucuuagaauugagaagaggaauucauccaagaaaacaccucccuugacgcuaaagcucuguauaguauugaguuuuaaaaauguaccaugguacauuuagacgcaccaauaguccagaaauaaggaaugggaugaaaaugaaacagacugccucagugguaacaaagguuccaaugaaauaaaugucagaacucagcagaauggucauguagcucagcucugucugacugugccaagaaagagaaaacaucucucaucagugcaaauuuuuugaagaugaagaaaauggacuucugaagccucuuaaagacucugaaagucaugccacagauacaguuacaaggaacugguaacuccucaaaaccaugcugcggaauuaaagcaaagacuucagaugcuac[450 bp omitted]cucaacagcugacaauguucuaaguagcauuaaauagguauaauaauuaagcaauaagauacaagcgucagugccucacugggaauugugguuuucuucaggugugcugggaggcacaggcuaagaggccacagacuuccaccaccugagaaagggaacaagccgaacacgcugccgucaggggugcaacaaacagaaaaaggagaaaaagcuacacaggggagagggaagcuggggacuuauugguguggccacaacauuaccgaaauagaguuaagucaaugcccaucuccaguauuuccaucucuuucuucacaauaaacaugcuucagucacacuuuguuccagucagcuagggcugcucuaccuauagcuugugaaaauggaaaauugggcuuuugguccucugaaucaucuuuauccauuuuuaaauguccaaucagauguucuucaaaauggaccugcuucaacuuucugugaacaggaaauguccaguuuugacaugacuggcguggugaucagucacacugugaguuggguggacugugagugacuguucccugcuggcgccaauuccauuccugcgggucgccucagggaaggcugaccaacaugccaccagaauccucccggagauccuccuagagaaaguagugcucgcuacacacacuuuguguuuaaaauaagaaaucauccauuuugugaaaaaaaaaaucaugccucuuuaucucaauagaggcuucuauauugggugaccaaaaaauaauauaauguaugagcauuauuaacaccugauaaauuguucuaauaaauagauucuuuacaaaucuaauguaugucacacuggugaauaacaucauguuccacucagaucaauaacauuaauauugccaugguaacagaagggagaaaggcagagaaagccuuaaaaaagaacaaacaaaauaagaccuauaugcaauaaucccuugagugacagugacauuugguaguacaaauuuuccuaaacagcuuggaauuaccacgucaccauuuauuaccauugagugguaauaaaaaaaagcauuagcauacucagaagcacgugcaaacugauuagaaacuuacuagcuucucgaggccugggcaggaggaucacuugaggccaggaguucaagaccagccugggcaauguagugagaccucaucaccagaaaaaauaaaaauaucagcugaggguguugguacgccuguagucccagcuacucaagaggcugacgugggaggaucacuucagcacaggaguuaaggcugccacgagcuaugauugugccacugcacuccaaccugcacaacagaguuaaacccugucucuuaaaaaacaaaaacuuauuagcuuucuaaauauuuuaguaucaccuuccauucccacucuuccaaaagguuguguuuucuuucauuuuagguacaauuauuuccaccccccaccccccaagccuuucuguaauacaccuccguucuucagugacuuguuucuggcagaacgugcugaaccucuggccuccuccaccuuauugagucuugaaaagccccauguuagccacugauuuuccagguucaacaggaccaucuucucuuuagaggcagaaagauacuaugaacuuucagugagagcacaagcuuucgagucaggcaaaccuauuuaaauucuagcuuucccuccuaggacugugcagcuguggccacacuuccucccuccgagccuccacuuccucaaucauaaauuggaagaaaccuugaaagacuauuguaaagacuauuguaaaguacaguaaugucugagugaauugucaauaacuagggacuacuuuuuucauuaugggaaggaaaggcuuuaccaaauuguccuuucugucacucuuuuauuucagauuauugccccucugcuuuuucuucucacucuccauagucugccucaaauuuaagguaacauaaacacauuugaaacugguaauauuuuacuaucuccaccacauuuuucuccaucuaucagaacacaagaauuucccacauagagauauucaugcaauagcuuaaggcacguaucuugggacucaauucagaaacugaucagacgucccuuguaggaaaacaguggcaguuuaguggcaggaaugccguuuagagaucacugacaaugggaauauaaaacaaugccauaucugacuggaaucacaggaagcgcuucuaaaaauuuuuacuauuaugggagcuaaaauauugcuaagauucuucaaaucagcaucccuucuucccagaauuggcagccacacugcccagguucacguuuggcaucuaucacauaguagcugugugaccuucagccuguuacucaaccucacugugccucaguuuccucauuguuaaaauggggauauugcuaguacucgcuucauguggugguuaugaaaauucaguggguuuaaaagguaagugcuuagaagaggagcugguacauagcaagcacgcucuaaaguuagcugcugcuacuacagugaugagaauuacaaugacgauuauuauauauuuauuauaucuuacauaauuauauauuauauaauaacaauuauuauugcaagaggugucaggaaauuuuuacaugguagcaagaagcuuaacacaacauucggugcugucaaacuguggaaauuagggaaucaaggacagggccagaaccaagaauucuugaaacacaaaagcagaggccagggucccuggccagggaggcuaaaggaugguugagcuucuuacagcaaagaccuuaagauugugugugcugaguagucagaugucuucacgagaacacuucuaaaauuaguaacucacucugacccacacaaaagucaagaugaggacagaacuguaucuugugucuucgucauuuugggauggguccugaagguuucugcaggaccucuauccauaccagcacaccugacaauuauauuucugccagagagugaugccuaacauauuauagccaaauuuuaaaaucuguuuagaaaagagacgaaaacacauauuaacagacuagcagcaaugcugccucacaguauaagucaauaaaaucccugucuccugguuuccucauauuguaaaugguaauaaccacccuugauaaccacuuaacagagggauuggagagugccagcugaaauuugcaaaguacgcuugagguugcaauuauguaaacaucgaaaugaucucucuuuuaagaaugaauuuugagcgacuuaaaucaaaguguuaaggacaaaagcuucauaaaaugcaugaaaaauuggacuuagauacuauacuuugaaaucaaccaucagcauuacaaaugucacguaugcaccgacuguuaccagcagagaaguucaaaaguaaauacaccgcauuugacaaccuaauccucaaugcaugaugcuagucaauaaugggaagccacugcaaauauggaaacugacaggccaagcaaagcaaauauauuuuuacuuaaacggugaauucuuucuguacauuuucuacagggcuccuauaagucauuuaaaauauucgguucugaaugaccacuuuaaacagaaagaaugaugcuuuggaucuaaaaccgaugauuaaacaaugcggacauuuacaugaauuauuuuugguuuugugauaauuuucauuguugacaugacacugagaaugaaacuucuuuuauggcuucaggaucaacagaauagacacaugcuauucugaauaugaauauuuauaagauuuuuccuuaaagaaaaaaauaugaaauaaucaauaaauuauuuuuuuacaaaauaaggugcacucaaccaaaagagaaucaaagaucuguugauuccucagaaagcauuaauguuucuagcaugcgugauaaauaccuacgagucuuccgcccauuuuccuuuuuggaaguucaucacuguauauucugugacaaucugcuccccuagaauuuggaauuugaauaaaacagauuugguugcuuuuuccucagaugaaugcacaaagacccuuaaaaacaaauguucuuuaaaagugugaugccuguauuuaacauuuauuaaagauauagcaucuaccaaaagauuuucaagcugaacucuaggucuuccaucccaauucuacaauagaaaguuaaauaugaucagaauacaugguccaggaaaagcacaagaacgaagagauaaagauggaagauugcccccuaaauacaauaaaauaaaaaauaauccccuaccccuuuaccaaaaccaagccaauugcccucccucuacccccuuuuuaaaugcugggaaugacccacuuuaaccuaggcauauugguauaaaaauaaaagcaaaaaaucuagcuuucuugauguauuuauaugaaaauaaacauauaggcacagcuaauagcucacucuaauuucucucuaagcagagccucucauacagguuuacuauuacauucagaggcaugcauuuuuuaaaaauacuauuuacucugccacuacaucuccaaauuugucaucugacuauauuuguacagcuucguuaaacuaauccccagaagugucccacgucauuuagcuuuugauaaccugaaaagcccagugacccugggucaucugcaugacccaaagccagccacagaauuaauaagugaauuucccuaccaaccagggcaggcucaaggaugagagcagaacccgaugacucuucucagaccuaauuaugucaggcuuuccuguucaguaaaccaaaacagggagagaaaacugaggagaaaggcuuuccaccaagauaaauucugcaugcucccgguucauucgaugaauaaggaguuggaagauccagaaaacuaggaugauggagacugaacugacuggguccaugcucugagcucccacagccuguagaccagcgaucagcccacgccaacaguccuugcuccugcaacacgcaucccuucgguccagaggccauucugacccacuuguuuguuuccuuaggggccacagcgaugcccaaccaaauauuuggacaaaugagaaaauaauuuguugaguaacauuaucaaauguacuuugcacuugaaauguggcacacacagaggguucuaauaaaguaaaucacguuuauaugcauuacaaggggaacuuacuauaaugaauuauguugcuaagugaagaaugacuacuuaacuaauccauuuuguaaauauggauuuaauauguuggguuugcuuaaagugagauauacugacaacaguuuggcuuucuaucaagcuggauuuggaguaagauauuuugaauuaggucauuuauuaaauuucagagccucuagucucucaacaugaucaagugugaucaagauagauggaaauaggcuaggugcgguggcucucgccuguaaucccugcacuuugggaggccaaggcaggcagaucacuuggggugaggagaucgagaccagccuggccaacauggugaaacccaacucuauuaaaaauacaaaaauuaguugggcaugguagccgacaccuguaaucccagcuacuugggaggcugaggcaggagaauugcuugaacccaggagauggagguugcagugagcugacauagcaccacugcacccuagccugggcaacacagcgagauuccaucucaaaaaauaaaaacaaaaauaaagauagauggaaguaaagcaauuaacguuuagcaacuggccuacuuuuucauguuagggcaaaauaaaacuucaaaauucccuaggaauuuuuuguuaaagcuuucaaaaguuuucauuucuucauucugaaauagauuuccuccuuucaaaauuaaacuuuucuuuuaaaaugugcccuagauuuuccuugucuuaugaauuacagcauuuuaaucauaaguaguguauauaauuucaaaauuaauauugcuuuugguuauugaaaacaaaugaacaguuagaaaauuacgucaugguggaucuauucauuuugucaagcaguuuauuuccaccguaucugggaagcuuauucccaccguaucugggaaguuuauuucuaccguaucugggaaguuuucucugguuaccccagacaccgaccacaguggagggugcaucugucaugcugacugaaauccugaccaggugaacgguccacucuugcaaaaugcuaugcugcucacuaaacaagauaacagggacaaacagaagauaguacaggagcacaggcuuuagacaucucaguuguugaauaauguaacuucuccaacucuccuuuggcuccuuuggagaacacgguuauuauuauuauuaaccacaauaugugagauaacauaugcuuagcuggagcagauuccuauuagccacucaaaaacggcgaccucuucccuuacucgugcuuguuccgacaugcccaaacggguacagugauguaggcuguggugcacgggggcugugggguaaggaaagaagugcauuccgaguggaugcauuaccucccacaguuccaagauaaccaaacgugagcgaaccaggccucucugccuggcugaagggguaugagucccgggaagaggaaacucugauuuuaggccuguggaaaucaguucccagaugcucugcuuggccucugugucucaguuucauaguuucaaaggaagacaauacuaauaauucaucuugcacgguauauaugaaaagaaguaucuuuuucauguuuuaaaggucauugaauauauaacagcuagauaguuaaagcaaaauaccauauucaucagugaaauagaaaaguuuagcagcauucaucuguucucauuuuaaauuuaccacaguauguaaauuagaggauuuaaaaaagcaucaggcaaaaaucugagcuaggugcgaaugaaaagcacaaucagaagcaaauuugugacugcuugaaguuaagaguuugccaaaugggaugguacuuagauuuuacuacuaaucugaguuuauguaaagccaauagaaagaucccaauuauuguuauauacccagaguaggaauuugcugcuaaacugcuggagaauauaggucucagguuggcuuuuguaaacaucuuauuuuaugugcugaaauuaucacaggaauacuacacacugagcugaacuuuaaacacucaguccugguauuauauauacagucugaagaaaauaaaccaaauaaaauuuggauuacuggcugaauuaccugauuuuaaaaauauuuugcuggaguugagagaaucuauuuagccaggaagagcaguuauucuaucaaccgaacauuucaaaauacgauugauggcaaaaugagauaaccugaucauucuuaacaggauuuucuuacauccagaacauucacacuguaucagaaauguacagaggcggguuugugauucacacucuuguagagcucagugggccaauauguuacauugagacaucagccuacuauuuaaacaacacccugucugguuucuauggcacaaacuaccuucaaaaacaaaaugaaccauauuaaaugaagcccagggaaagucaagcucaggagugcugccauagucuguacuccgagucaggagaccuggacuuuuauguugcauugacccugcagucuugggcuggggccucaagcccaccaagaagaguguaauuuaccagccacugcagaguacagccggugggauggagacagaugcccaccugagugccaagcgaaaccugcuccaaauuuugugauccccagucugaauucccaaaguccuagaauacuguugaucaccuccugcacccuccaauaacaucaugauaucucaucaacuccggaaaaggagagucauaagauaaauguauuuucuacuucacaaugccuaaucauucagaacacuacacuuuuugagugccuacuauguuccaggcacuguucuaggcagcaggaaaucagugaugaacaagacggaugaaguccuugccucguggcacucacaguucagagaaggaaaacaacagaguaagaagagucacucaguucuucaacguuuugagaggcugcuaaaggaucagaccuagaaccuugccuggcacaacagaagcccucacagaauaauuggaucugcuucucagaaaagaaauaaguaaacauuaaguuuuauauaaauuuuaugaagguucacagcccaucuaugcauuucaguguaagaaucucauugcaggcugggcacggugguucacaccuauaaucccagcacuuuggaagggugaggcaggaggaucacuugagucuaggaguucaaaaccaaccugggcaacacagugggaccccauuucuaaaauauauacauauauauauagccaggugugauagugcacacuuaacagucucagcuacucaaaaagcugagggaggaggaucccuacaggccaggaguucgaggcugcaguaagcugugacugcaccacugcacuccagcuuggguaacagagccagauacugucccaaaaaaaaaaaaaaaaaaaaaaaaaagagaugagaucaucucaaggguagggagaagucaaaaagguaugacagagaaagagauagaggagucuaacucuguuugcaaggguuacuaggggagguaacaaaaaggggaagacgaaaaaccccagcugagccuguuacuguuugcauuuccuuuuacacaacuaacacaugcuuagugcagaaaacuuagaaauggccagaaagugcaguggaagaaggcacaccaguaaucccagagagcacuacuauauuccuuucugguguguggccuacugucugucugugugugcacacacauggaaacgccugagcaugcacacgcagguguaacgagauguaacaagagggacacaauuuuauucagcagcugugugguugucaaagggccuuugauggaaggguuuuuuaacugugggucaugacccuuuagugggucacaaaauuacuuuagcaggccgcaaucaacuuuuuauuuuauuuuuugagacaaagucuggcucuacugcccaggcuggagugcaguggcgugaucucagcucacggcaaccucugccuccugggcucaaacgauccucccaccucagccuucugaguagcugggauuacaggcacgcaccaccaagccuggcugguuuuuguauuucuuuuuuuguagagacgggguuucucuauguugucuaggcugaucucgaacuugugagcucaagugagccacccaacuuggccuccaaagugcugggauuacaggcaugagccaucgggccuggcuuaaauuuccuuuaguauauauacguaagugucuguaugcauguguguacaaugugugcuuacucaagaagcaggcuacucugaauauguccauuuaagacaagaguuguggcagaacuggaugguucugcauaauagaagggggugaagaauguuuggcuccuagaaauaugagaaggcaaagaauuagaaaguuauaggguuaaggaaagcgggagauaggacaaaaaaaaguuccaaguugggaaugcacccaggaaaggauuauggaggggagaacuaaguauuaauggagauuguuauguuguuucuaagggagguauggcaugaauguuuuccaucuuacaauaucuucaguaaaauccaugcugaucagcaguacauuugugccuaugaaaucuuuagggaaacucaaggagaugcugagcucuauguacaaacugacauggggcaaaauuugagucuacaugugugagauacacaagcuagaguaugaagaagaugugacauuugcaguacauauccaucuauagaucuauaacuauauaccuucuguguaugcaaaagaugaaauaauguauacuacuuuuacccuauuuccccuuaggggauauauuuugaacauuuugucauaucaauaaacacuucuuuuucaacaagugauuuuagcagcauuuuagaauuaaaugcuauauuaauccuaacgccuguaaucccaggauuuugggaggccgaggcggaaggaucaccugaggucaggaguucaagaccagccuggccaacauggugaaaccccgucucuacuaaaaauacaaauauuagccgggcgugguggcgcacaccuauaaucccagcuacuugggaggcugaggcagcagaauugcuugaacccgagaggcagagguugcagugagcugagauggcaccacuguacucccagccugggcaacagagcaagacucugucucaaaacaaacaaacaaacaaaaccagguuauauaacaaaacaaacaaacaaaaauaaacagguuauacauacccuaugcuguccacucauaucucuacuaaaacaggggcuagcaacgcuagaauacaugcuuucccacgagacaagaaucccuggaagucagugauugauuuaucuuccauaucuccaaggucugcagaauuccuaucauguaauagguauucaaucaccuuuguauuuuucgcugguuuucuguuucaaaugaaccaaacuauacagcagcuuaaaggaguugcaaaauagcuaaugaagccaggggaguucaaacccuaauggugugguggaaagaacugaggacacauauggaaucagccuauauuaauccuaaccauuaccuaacaacuuuuaaaugaaaacaaugucaguuccuagagaaucauucauuaauucaauacacuuccauacacugggacuucagagauugauaacacaugguucacauugaagaccucacaaucuaaugaggagagaaggacaucgaaggccaugaauacagugcucuaagugcuggaaaacagagacgucuaccauaggaacaaggucugacuaacugccuagaaucagggaauguuggccucuagagaaagcucauguuuuuaacccugccccuacccaaccucaaaaaucccacccugaaagaauaguucuggugagaaauuuggcaaucagauccaaauacguuuucaagcucuuccuuggagccauuuauugaaguggaaaagacagaaucccaagaugggaguguggaccuaaggggaaagggccaagggacugcccgaguugccacauuugcagucacugaggccucccuacucuaggcaaaaggccaaaaggagcccaggacuccaugguccagucgggccuaacaggagguaacccugcuagugaacacagaggcauaauucaaaaugagaacuacgaaaugcaacacuaacacuauguguuaagggccauguggaaaaacuggggcacuuccagacgucggucacaaaaauaaugauuuuaaaguggaagagauacagaaguuaaguauauuugguuugaacaagaaaugauaauguguuuccaaggaucgucuuccaagggcuguucugccuggcuaugugaaagaagaaacguguuucccagccucaagucuaugcuaucuccuucaucuaugauacagaaaucacuagcaauauguaaaaagccaaauuuagcugauuuuuuaaaaacaaaacugucacaaauuuugcaacuuaccaauuauucuuuaauguaucagccacugggggaaccaaaagcuuggaaaauauauaauucauuccaaaugguuaucauaaaauuuguaaagucagagucauuuauguaacugcuaacaaccuuagcaagucgcuccauuaagcaugaccuacaaaccuugaaaaauaaggaucaacuaauaacacaaugaguuguuaaauagccuaaguagagccaggcagccacuccaguuauaaugagaucaaagcauauuuaauagugugauuaacacuuacugaguguccacuggaugugcaucauuauacaauaaaacuauagauuuuuauuacuucauaauaguaauuagacacacauauagugaguagguuuuccaaacaugaagauauacaugagagguuauaaaauauuuuuuaaauguugcacauacacaucaaguucugcuuuugucucauuuuuacccuucuacaauuuuaggagauaaaaaggaugauaaaauaugaugauuuuuaaaaagaagauaaaaaggacuacaaauucauuuaguaaaugccuucuaagggccaggaucugaacuauaggcaagagauacaaagaugaccagaguaugguuucuguccuuaaggagucacagucuaaacaaguuggacagucaaagaauaauuauaauguccuguacauuugagcaaacugcugucugaacgaagugcugaguaacacagagaguggcauuaaggaagccuguacuggagaugauggcugaccugugucuugggaaauaagaggucucuaggcaggggaggaaaaggucuuucaggcacgagcacccggacugugaauucugagagacaaggguuaagucuuacacaucuuuucaaccccaaagccuaccacaggccccuguuaccauuguuagaacacaauacauaucugaagaauguauguauguagagugaaagaacuauaaauaaaauaaauacaugaacaaacaccaaccaccucucuacuuuuauucacacuugauucuagauuccugagaagaacggaacaacagaaaaucccuuuucagagcucaugaacuauaaagaaaagauguuuacucuccuuguuugcuacagccagauuuaguaauggacauaaccaagcccuggaggaccuguuucugucuaaaucuaugccuugacaaggucccagaagccuggaugaaccacaccucaagcuucaccuguggaugacaccucccauuguucagcaaugcgggugccugcagcagcuacagccaugagcagcucucccaacccaugaguuaggaagcaaggacucgggaauccugcugcacacuaugcuauaagggaaauaaagccaaaauaaaagccacgguugggacaggaagggugaaagaugaucacaaagccacgcagaaacuauuuagcuccucuaagaaaugccacaggaagccauuuacaugcuuaguuuggugacaugucuccaagaaccaccccacagggaaguuuguagcucuucacaccauauccccuuacccuucuuuguaaaguuuuaaauguuuacaaauauuuuuauuuauauuauuugaacuauaacuuaaauuuuaaaaaugguuaauaauucugaagacuuaucaaugcuuuuaauauccuaauguacauucugacucucuaaaaaguacauaguuuaugcaguauguuccaaaacuaagauaucaugcaaaccuuuuuuucaaagacuaucugugaaggacggauugucuguaaaacacauuugcaaaagugcugccccaccccuuugagucacaguguagcaaaggaguaaacaggcaguuauguaagauagugugugugugcgugcgcaggcacacacacacuauaaucaccaucuugauagauacuaagaccuaauuaaggaagaaaaauagaauggaugcucagauccccuuccucccccaaaauaaaaggaaaaguggaaggauuauauucacccaauuuagagagagaauaguuguucauuaccuauugauuuguucauuccucauuuagcgaugagacuuaauacauucauaaugccuuuuaagaaugaggcaugguuuuuuuuuuuuuuuuuuuuuuuuuuuugagacgaagucuuguucugucacccaggcuggagugccguggcgcgaucucggcucacugcaaccucugccuccugaauucaagugacucuccugucagccucuggaguagcugggauuacagacacggccacugugccuggcuaauuuuuguauuuuuaguagagacagggguucgccauguuggccaggcuggucuugaacuccugaacucaggugaucugcccgccucagccucccaaagugcugggauuacaggcgugagacaccgugcccggccaagcauggguucuuaauccaagaguuuccuaaacccauuugaagcuauuuguauuuucagccauacagucuccuaagaaaguaguccuuccaugacuuuuaugcaaggagucaaucagguccccauccgagaaagccuggcugcagccccaagcagccccaacugggcagcaggucaccugaaaaccuguacaugagguauauucuccaggcugaacaguggccgaugcuuuuauugccaaguagcuauggaugguuugcucaguauauaaaagcuccacuggcccagcuucuggguggggugaggcugauguucuuaagccaggaacagagaaagcagaaaggaaacagauaaaguucccuuucuucugccuccaaguuggccuuucucugacacaaagaaaaaaauuggucaggugcaguggcucaugccuauaaucccaaugggaggccaaggugggcagauggcuugagcccaggaguucgagaccagccugggcaacaaagugagaccuugugucuauaaaacauacaaaaauuagccggcaugguggugcaugccuguagucccagcuacucgggaggcugagguggaaggaucaauuuaucccaggauguugaggcuacaguaagcagugauagugccacugcacucuagccugggcaagaaagacagugagacccugucuuaaaaaaagaaggaggaaagauagugcauggagaaugcaaugcacauucuucuuaaccaguuauuauguuauacaucuuuacuugucugacucagguaguuccuuccaaaguacaguagaagcucucuaaauggagcaccacuuacccugaucacccaacaacuaacccuuuccuuuucccucugucaaacacaugaaugauguccacggcacacucagugcuauggccaaugacugcuacucaccagcacaaaugggcgcuugugcucccaacaguugugcucuacuuccuaaagucagccauguuucuucccaagccugugugugcugcuuacauaaacguaauuccauguuugcugaauucagaaguaugauuguuaaaaaaagaguugcugauucuaugaaaacgcaguggagugauuuagaagcauucaacaaagcugaauuuccaccccccaacacaaaaaguuuguccaauuaggugugccugaaauaaauguaaaagauuuggugggcaagggccauuaaaauagcaaauucugcaugaaggcuguuucccaagugucuuuauguccucacuuaguuuggagaaaucaaaauugggugcaauaaaagauguauuuuggguguuguuuauccagggcaaaugacauggcaugccaaaucaggugauccuuacacacaaaaaauaugccucagccccacauauccaucaccugucauguauuuuuugaccuuccaauuaaccauccaacuucuggucucaaggucacuggacaaaauagcuucugguaaacaucugauuauuuauguccauuguauauuuuccuuuucaucauuaguacuaguccaccucccuauuucuggaagcauauaaguuauugaguggguacaguagaaaacacuagaccugaugucagaaaacggauucgagucauuacuuguauucuuugggcuuccguuuucuuaucuauaaaauguggugcuggggauggggaugggaauggagggugggaguagacgacaagaggugaaguuggacuagauaaucuuucaggccucuucugauucuauaaaaugccauucuacauaacucgggucauauaagacaggcagagcuccuuaaaaauuuauuagucuuuagaaauacauuagaaaauaauauuuggaaaaauauguuuguuauuaaugugagaauaaguaaauuuacuugagauaaguagacuuuuuuaggaauuuuaauuuaaaagaagaaaauauaaaaguaaccacauauauaaaugauuaaaauaagauuuaaguugccaacauaaaauagaaauugauauccuuauaauuugagaauaagaaaagaucuaaaagauguuauaucuuaaauguccaugcuaucuauaacaaaaaacaaacuuuuagaagaaacuauucuuauuaauuuacaguuccaaaguggauuacaaaguugcauuucugagaauaccaugcaguauaaaauuaaauaauauucaguauuaacuuuaauuucacuaacaacaauuauugauugguggaaauaaauuacccaaagaaacaaaugccacuuucuuucagaucuuuagaucuggccaggcgcaguggcucacgccuguaauccuagcauuuugggaggcugaggcaggcggacugccugagcucaggaguuugagaccagccugagaccagccugggcaacauggugaaaccccaucucugcuaaaauagaaaaaaucagcugggcauggcagcaugugccuguagucccagcuacucagggggcugagguagaagacucacuugaacccgggaggugaagguugcagugagccaagaucacaccaccgcacuccagccugggcaacagagcgagacuccaucccaaaaaaaaaaacaaaacaaacaaacaaacaaaaaaacuuuagugccgcaacagaacuaaaauaaaguuaagccuaugacguaaucuaaaucacacuugaauuccuuuacuagcaauguggcuugucaaaaauaaguauuucuagauaaaaagaaaauuacuggagcucacuaccucacauauuguuuugcugcuucuuucauuuuaauuauuaauuaaaauggugucugaauuaccuucugugccacaaaaauuauacaaacuaggcucauauagaaacauaagaaguuuaaaucuaaguacacaugauccuuucaaauaaccauuugucauuugucagugggaagaauaaaaacaagcguaauuuucaguuugugugcugccuuggagucuauaucaauuucaaguuuucuuuuaugauucagcuauuccaagaguuccaagagucugaaaauauuucauuaaaaauuaauguguuauccacacaaauggcaaauauugaaaacuaggaauauaaauaaaaaauaauaaaaauaguaagucuacuaauacugaagaggaaggaagacaggaggggaggagagcaugugaaaaggagagagauuuuaaacauccgguuucuauucuggaccauuauggaaacagacagacacagcaagcggaagccaaauuuauucuugggcucugacaggauuuguuuucgaucuugucauuauuuuuacuauauucuuccuaauaauauuucuccaguguucuagauuuccugaccgacaauaccagucucauuaagagcuuacaaaugagaacuguggaggauucaggcacacugguggggucuagcugccuugcgagguuaccugcuggggcuuuaaaacuuucccaggaacucuucugcacuaaggcacacaauuaugugugugcacauggcccccauccuaugcaaccuucccaagucccauugagugauuugccuaggaccuaacacacaaccucuggcagagcaacaaccaccugguguaucauaaacaggugaagaugaacaaacaaugcccauuucacuaacacugguacaaaggcaauaaauuccccaugcaucuucuucgcccuuuuuguaugaauuguuccaaguuaaauagcaagcaaauacuuuccuuauucuaucucaaaccuuucccuuuacaugucacugagagaaaguuacacugcuuaucaaacaugcagccauggacacacacuuguuccuacaucaaaauaaaacacaauagagcuccucuacacaaagauaaugagggaacuauuuugaaaauaugaaagauuuguuuaaugcagacuagaaaaacaucucuuugcaucaaaauaagugucccucuuuauugcauacugauuauuuucuauagaauuuaaauuguacauaaaauuauauuugugccuuguuuaauguaaauugauugucucaauuauugggaaaggauuugaauuuuaauggacuauuuugcuggagauaugccaagcaaaucagcaaaaacucuaauagcucuagcuggagguacacagccaaacauuuaaaucaggaagaagaugugguuccaagaauugacacuaaagaaguagucugaaaagguuuguaagcuuuucuccaugaagaagaaaucagcuuuaacuuucaguguuggaagauucugugacugugaggcugucauuugguuucugucugaaaaaacuggaaagauccacacaugaguggaaagaacuuuuguggcuauacuuuuuuuuuuuuaauguucuuuuucccuacagauuagguuaucuaugaaaaucagggcuuuacacugaaggcagaacugacguaaaauccagaggcacugugucaugcaagcacugagacacacuugaaugggacgcuuccuugucuuugggaaggccacaccaggagguuggcuguagacgcaucacagccacaugccacguaguuacugcuugacaugucuccuucuuauaauccagagucuaugacgucaaacaaaucuccuccauucuuacuaucacaggcaagagccgaccuuagccaucuugcuacccagacgguugcaacauuuuuauuguucaauuacaaccagugauaccagaggugcagauacacaucugcugcaaauugccacccuucuacuaaaauccuuuucacaauuccucaaucucaagaaacacuguugauauagauguaaaaaucaccucuugggguaauaugaugaucuauucacuuacacagcaaaauguacaccucauuauuaaccaacaugaauucauuuugaaugcuaccaauuugagguauuuuguaaaaauacgaaguuuuauuauaauaguuuccaucuuuaaagagccucuuuuugccacagagagcugauaguacuaauauagacacacauauagauguuauaacagcacagaauauaaacuaagcuuugggccagugaauaaagauuucuucuguuauucaucaaacuuuucugaaugaauuucuaugauguuaaagaaucaagcucaauauaagacauuucuuucuauaacaacauucagaaagucuagaaagggucauaaauuaugaucaaugacaguugugacuccuccuaugugcugaucugacuuguauaaaacaaucucaauguuaagauacuccaaagucuguaugauauaucuguaccuauauuuacauauauauauuuuaacaaaccuagaguuuucugacaacuagauuuuugauuaaaauucuuuguucccuaauuaguacaucucagauuuuagguaauaaaaucuagccauaugaauuugaagaaaaugcuacuccuaggcacaccauuuaccauuuuacuguagaagagcauaaauucugaccacagauuuccuucuagaaaugaagagaguauucuagaaaugaagaaccaaagcaacaggaccgugaaaagagagcaggaaaguaauguaaaauugaggggaguaucagacaaagaaaaagauaaaaaaauagcagagaaguaccaugggcugguuagaaaacaauucagcaugaacagcacguuuggcaucuuaauacccauccauccccuguacccacauuugcagaggacugugugagcuucacuuagcagccagagucagcaauacaucagcuagauggaugccuacuuucuuuuaaugacacauuugccuaacauauaaauauuaaaauuuacauuuguuggaaaagagugacucaaaagccucuuuaaugcuguuuuucuauauucauacaaaaugccuuuaaaauaccggcuccuuaaagcugacuauuuuccauagauaagaaggagaaaaugguuuggcccauguucauauacaaaauaaauucuuuuauggauaauggccauuuuuaaaccaauuaauuucuagaaaacaaaagcccagaaaauaucaccaggaauagaucaucaagauauuaucacaaaaccaaacauugacuuuaaucugcucaauucccaucaccagcagccugcaugcuacacacggccaaaacaaugcacgaaacugcucuucccccuuaaauauacacauucagcucaacaaaggaaaacacucuucaaaagcacgaaaggcauugcuuuccuuauguaaucaccucagaaguuauuuuguucaaaauuaccaaagaaaugucaaaaagccaugguaucccacaaagcaguuaauucauuauguuugacugagucuagauuucaauccuuugugcaacaucaaaagugcacaauuggaacacugcugccuacagggccuuacacacagcuccaaccccaugucaaugccuuccagccauuucccagaauuccuggaauucuuccuggaacugacccauaggcucuccgacaggcaaagugaacugcccuucccaagucaggugaaaagggucugccuuggaacaaaaccucucaaaggcagccugaaauucaguguuuccugagacaaaagcaggguccugucuagcagcagagcuuauuuaguuuuaaaggaagaccugcuaguuaauguuuuucuuuuccuuuuuuuuuaauuuaauaaugauauacuauuaagugugaauugcagaauaaaaccgaagaacuuauuuuauuuaacaaaaacauacgucguuuuguacacgccaggcaaaugcuaagcucauuuaagccucauaacccuaugaggugggaccuuuuccguuuuucucuccuauaaugaagacacugacucacccaggggugaaguaacuugcacaaggucaacagcagguucaguggugggacuggcacuagaacccaggcagaaagcuccggaaacugcauaucauuaaccauuaugcaccauaugcuccauuagcaauuaaaaagucuuuuuaaaagcucauuuagucuugcuacaaccugggaagcuuucuaagacacauuagccugaaaggccccuaguagagagagaauuugacuuagauguaacaaacacugucacuuguaguccaagccccgcugagaggcuggcuugcuggggaaacucagguaguuaaaagcaugggcucugacaucagauagcccugcauuccuagacuaacaaugccacauauuagcuaugugauguuggguaaguuauauaacuucucagagccucaauuucccccucuagaaacagaaggcaauacuacuaucucuacagaauagcuccaaugaugugugugugugugugugugugugugugugugugugugugugugauggagucucacucuuguugcccaggcuggggugcaguggcgugaucuuggcucacugcaaccuccgccuccuggcuucaagcguuucuccugccucagccucuggaguagaugggauuacaggcacccaccaucccaccugguuaauuuuuuguauuuuuaguagagacaggguuuuaccauguuggccaggcuggucuugaacuccugaccucaggugauccaccugccuuggccucccaaagugcugagauuacaggcaugagccacugcggccggccagaugauuaaauuuaaaaugguaaacugggugcaguggcaugcaccugaggucccaacuaccugggaggcugaggugggaggaucacuuaaauccaggagguugaggcugcagugagccaugacugcacaacugcaccccagccugggugacagagugagacccugucucaaaaaauaaaaaauaaaauaaaaauaaaagaagaagcagucaccaguauuguaacacauuaucacacauuguuuuccauucuuccacgccucaccuuccauucccucacucucacugcccagggacuacagccaaaauaaacauucauauuuaauccuugcacagguucuaagacaguaggaaugaaggaauuggcagcaucuucauugaagucacucacuugguuaguuaacauaucuuaaaacagauauggaaagauacaaaccagaggaaugucauaggaauggaaguaguuggauaaugcgagcaaaaucacuggugaaaaugucaauaaacucagagaucagaaacaaacugcaaaguuaaagauaggccaugaucagcagaaaguuaucaggagccacucuggcucaccaaguaugagaaaagccucaugguacugaaaacgcuaacaucacagaaaugucuuucccuuguuuaaaacccuucaaaggccccucucagagugcucagaagaaauccuaaacauuuuuacaugguucaagagaaagacuccuccaggucuaacuucugaggggucuaccuccuacuaggagguaggcaggugcacgcgcacgugugcauagacacacacacacacacacacacacacacaaucacucccacucuaacaaugggcaaaagccagauaaucuucaaaaucauauuuuuucuugagccaaucagagagcugagguugcaagguaacuagcugauguaaauuccaaaaggugacaugacucucugaaggcagaacaauugaaccguuuuaucuuuggcauagcaaggaaaggggaaauggccacuguaaaaguagauaaaaggaaagcagccaaccuuuuaauggguucuuaaagugugggcuagugugccagccuggaauccaugggagccccaaacacaagaggacaagagaaaccugcacucauuauugaacacuuuuccacagccuuccuccccccggaugcgcacaggaaagauugaaggcggggcaaaaaaacccacgagcagcuucccccuccgagguggggcaugaggacauccacugcccacugacuagacuauuuuuucauaugaagcaaacgccucaagcucccgggggaggggcaagaaaccuucucaggaaaaaggcccacugccuccaggagaaggugagaggcaaaagcugucuuccucugggaaauggguggaaaccuguugcccugauccuaggaaaaaugugaacugucacugagggagggcaaaagcaaaauccauuaguggugugaugguuaauguuuaaaaaacagcuuucuggccggacgcgguggcucacgccugucaucccagcacuuugggaggccgaggcgggcggaucacgaggucaggagaucgagaccauccuggcuaacacggugaaaccccgucucuacuaaaaauacaaaaaaaauuagccaggccugguggcgggugccuguagucccagcuacucgggaggcugaggcaggagaauggcgugaacccgggagguggggcuugcagucagccgagauggcaccacugcacuccagccugggcgacagagcgagacucuguuucaauacaaaaaaaaaaaaaaaaaagaauuccuccaugucauuuuaggauuugacgauagauauuauuucucaaaagaauugugcccuguaccuccaaaccugggugacaugccagucugauguacacagagagcauccuggguuuacucuuaccguagucuauuacaccuguaugauuaccguauaccucccgcacuggauucgaagcuucuaaaggggaaauaucaugucuuuuuuccuuuuguaccuagugcugaaugcauguuaauaaauacagggauacauuaauaaguuagaaggugcaaaauaaagcaaaagacaggcaaucuagguuuucacauuuaauauucaauguuuaaaauuguagagucuaaggcaaagcaacaaacacaacuacagaaaugaaaaaucagauuuaauuuaaaaguucuaaguuaaauuuuaagucuuaagaguuaagauaaugaaaauucuaaucaguucuggaucuaccaaaaagauaaaccaaagagagaaaaucagcuuuagagagugaauugacugaaagagguuuacauuggauauauggaagaaauuuuucagggacuuucagcacugaaauguaccuuuuuuccccucugauauaagaacagaaauuuaccuauucugucuuuuugcgaaaagaccuuuccacagauagguguuuaauacucacagccucuugugguucuuuguacaaugcuaacauggguguagcaauuauuauuaauugaauauuuuuguauuauccacaguuaauuguagaaaaagcaaaaauaauaaacauuauaaaaauauuaaaauuggcagguuauagaugguuugucagaauuuuugccuccaaacaggcauuaguuauuuccuaguacuaauauaaaauuuucccucccaggaguagaaguuaaacucuguuagccuuuuguuuuucuguuccuaaagacuuaaugaaguuacaauuaggaauuuaaaaagaguguuccucucagaugaauguaguuaacugaucuuugacaaacagcaaaaguaguagaauagagcaaaaauagaguuuuuaacaaauagugcuaaaacaacuagauauccauaugcaaaaaaagaaugaaucuagacagagacuuuacacccuucacaaaacguaacuugaaauggaucacagauuuaacuguaaaacacgaaacuauaaaauuuauagaaaauaacauaggagaacaucuaggugaccacagguaggacaauagcuacaacaccaaagguacgacccaugaaaaaaaguuggggcaacccgcucgggaccccuuccaugcuguggaagcuuuguucuuuugcucuucacaaaaaaccuugccacugcucaaaaaaaaaaaaaaaaaguugauaaacaugauaugauaucauacagagcauguucaaugguagagauauaucauguguucguccaaaccacagaauguacaaaacuaaggcugaacccuaauguaaacuauggccuuugggugauuaugaugucccaaugaaggcuuaucaauuguaacaauuauaccacucuggugguggauacugauaaugcgggaggcuaugcauguaugggguauaugggaaaucuuuguaccuuccuuucaauuuugcugugaaccuaaaacuugcauaaaaaaauuuuuuagaguguuccuuauuccuaacuaugcugaaaauacgauuguaaagaagcaacuagauagauauaucccucuugaaauuuuacuuggggcucauacugaaaauuuucaccaucgaauagaggacacacacacacacacacauucacauguucacaaacacuuagaacaucauaggcauaucccaagucgugguccaaaaugucguuccauaaaucaguuguugaaaauucaaaaggcauuuugccuuagaaauaacauuauguaaacaugguauuuugguucacagacuaacucacaagagucaauuuaaccuauaauauaaauaaacaaccauuuagaaucuaagucucugaaguuccugcugcaaucccagaauccagaacagagcucagcauguauuaagggccuaauaaauauguugaaugaaggauaugaaugaauagcaaugugaaacauuuguuaagcacuaacguugugccaggaacuauucuaaagaccuuuuuguggauuauuuuaggcaguuuucacaaccuacaagguagcauuuuggagaucaagaaagugaggaagaugaaguuuaagauuaaggaauuagcccauggagcuacaaagcagcuacaaagaaguaaacugaggaaagcccagagaacuugguuuuaggaaggaugcuguuacguacgaugcauacuaucucucuacuuuuggcuuuaggucuuaaaaacaaaggacuagaucuugaagguagcuuaaagcauguaaguuccauaaggacaaggcugucuacguguccuuugauguaucccaagcacaucagcaguguauaagcacucgguaaauauuugaugaauaaaucaaagggugucuuuuucuuuuuccuggguagugggccuaucccaggcaaaaguguaacaucauuucuuuggcauugucccaacuuuguuuuguugccuccuuuucccacuuaauguucucccugguaaucaguuauagcagcugccuugucccagcuaagguaaaugcacagccugcuuuaaauaacucauuauccauucccagaucaaaauucuaacucccacagaguggcaaagcucccaacuuauugggagggcagcagucugaucuggccuucccaccacaguauaaacaaacgugacuuccaguccucacagggaguucucaaugcauacaacuggcucauuacaaagggacuguuugaaccccaauuggcuuacaauuuuugaauaauuugaaaaggauaaacuuuucuaugugauuucuaguauucgauugucuguuguuagaccccuuagaugagacagccucccuaauccaaacaugucagugguccagugaaacaaacucuagggauaacggaacauuucaaaacaagauguaauaagauucuuuucuagcaacauauacaucucuuaccauuucuucauaagaguauaauuuuauauuauaaaauaauggcauauaaaucuaauuuuguuaauuugcucuuaauagcauguuaucaguuacuuaaaaacaaacauuugcaaggagcaaaucaaaggacugccucucuacagcaaauugcugaggugguggcaggaggcagggaucauauaucugcuuuagcaaaagagauaaugggugauucauuucuguauuacaagucauacgggacuuaaaauguaguuacugggaaaccauuauaccacugaugcaaguaugcaauacugcaccguaggggguuaacaaaacaauccaaaacaaacuaaauuauugugaugaagcuaaauuaacagcaauuuauaauuaaaagcaagaagagcagcauuugaaaaugaagaugaccucagaacaacgcugauaaccuaguaauaauuagaauccuuuccccaaaucaucaaaagucaaacuagcagcgcuuauguuacaucacacaagcucugccggguguggaggcggccaguagaauauugcauuagcauucgcaguaaguuguuuuggcuuauaaaaaccaaauuuuaguacuuuuaaauuuuuuacuuaauagauuuugaaacuguccauaagaauugacaaaaacaccuauacucggggugagucuucuggucaucacuacccagggagcuugggucuacaccuugaucacuuuucuaagcaaaggaugaacaacucaagacugccccaggggcaguggaaguuuuugaccauacacuccaaaucucaauaacagaccuuuaggucuauauaaaacagagagaacaggagacuuaaacaaauaaacacuuuaagggcagccaacuccugucuagccugccaagggaggcugguuccucaggagagacuuucuucuugcaucuggguuucuggaggcauggcagcagccaggagugaccucccaggagauggcaggugcugccauggcuacucugcacugcaggauugcaauacuuaggccagcccaaacagaaaggaagucugcagccacgagagugcggcagaguauauccuuuuuuuuuuuuuuuuuuucuuuugagacggaguugcacucuguugcccaggcuggagugcaguggcgcgaucucggcucacugcaaccuccgcccuccgaguucacgcaguucuccaaggcagaguauaucuuuuacaucuuugugucuccaggccuagcacagugacugguacaaaacagaugcccaauaaacacagaauaaacuaagucuggcaucagguuaccuuuccagcaccguauccauaagccugcauuuaucagcucauauaaucucuucugcuacagcugcugcgauggcaacggaggaggugacccuucgcccaguucacuaucauuuucugcucagugcuugguaucccaacccaccucucuucucaggaaccuuauacgccgcacuuugucuaccucagcgucuccaaauuucuuuugacucucaaacccccuccauagaaacacauggaauuuauuaaaucaucucauuauuauauauaauaaagaggaacuuuuuaaguaaaagcauuucauuuaaaauaagcauaaguuugaacuuuguaacauaaaauuuuaauuuuccugugcaauaaauaaugccacuauuucauuuacauaaauuaaauccauagugaauuaauuaugaaagaaaaaggcaccauuggcuaauaacgucuucacaccaaaagauacucuaaaacauagauuugaaauuaaacccauguuauaaaaucaauaacaaauaaaaacaauuucaugauuuguuuugaaauguuugcuuuuugaauauaaaauucaacugcuacuguuacagcuuucucucuuuuuuuaauuuucccauuuuuuuaaaacuuuuaaguucagggguauacgugcagguauguuauauagguaaacuuguaucaugggagauugugaagagauuauaacugucacccuaguauuaagccgaguacccauuaguuauuuguccugauccucucccuucuuccaccuccuccccucaggcaggccccugugucuucuguuccccucuaaguauccauguguucucaucauuuagcucccacuuacaaugagaacauacgguaucugguuuuuuguuccugcacuaguuugaagaauaauagccuccagcuccauucauguuccugcaaaggacucuuuuuguuuuuaaauuaugagauaaagauuaagauuucaggcuucuauuuucaagcacuuuucugaaaauaguaaauaguguuaauuccccaaauuaaaaugucaaauuagauagaaaucaauauuauaauuuguauuuuuaacauuggcuuuugaagaaucaaauuucuaugacaaacauagaacuuacggauuugguaaagaucauccugaaucuaguuuauagaagaauuaccuauuuuaaacucauuacuagauuguuacacuucgaucagaagcugcaugucuuuagacaaugguuuuuauggauauacuuuaaacaauauauuaccauacaaaagggggaaaaaacuccuguaaaacuguguaauugacgaaacccccgggauuacugggagucggugacagugaacgcccagaugagaggacacaggugcucagcagugcuccacuggcucuggggcuuguccacucuguauacacugggggauuuucacacagcucuauuuucuagggagaaauaggugaauugauacuuacuuuaaaauaaaaacagaaaaaaaaaauggcacugccaucuuuaacaugaauucccuggacugccuuuguggacaccagggguuccaaaccaccaguugaaaauuuaacuuucuucguuuuuacaacuugaaugaucuuuaccaucauuugaacauuaaauucauggccaaaacguaacgcuugaucucaucccaaacccaggccaucucaaccccaaaccagcuucuuuagaguguucccuaguucucaguaaguagcagcacuaggcacccauugcucaggucagaaauaugggugucguccuugacacgcuccucuucuccacccagcacugccaaucaaguaacuccugcugguucuacuuccuacacauuucgccaguguuuauuucugucaccaauauuagcauuccaguccaagcaucaucauugcuugacuaaguccaaaaacucccuaaucguuuuucuguuuguuugauuuuuuagacaaagucucgcucuaucacccaggcuugagugcaguggugccaucuuggcucacugcaaccuccgccucccggguucaagugauucuccugccucacccucccgaguagcuaggauuacaggcgcucgccaccacacacagcuaauuuuuguauuuuugguagagacgggguuucaccauguuggccaggcuggucucgaacuccugaccucaugauccacacaccucggccucucaaagggcugggauuacaggcgugagccaccacgcccggcccauaacuggucuugagcaaacacgauggcucuguuccaaucuguuaucuauuguggaguuagaauacaauuuuuaaaugcaaaucugaucacaucuccucuauuuuuuaaaaaaucuuuugauuucuucccauuaguaacaagauaaauuuaaagguccaugauaaaaacauaaagaccagcccggugcgguagcucacgccuguaaucccagcacuuugggaggccgaggcuggcggaucacgaggucaggagauccagaccaugcuguccaauacggugaaaccccgucucuacuaaaaauacaaaaaauuagccgggcgugguggugggcgccuguggucccagcuacucgggaggcaggagaacugcguggaccugggaggcggagcuugcagugagccaagauugcgccacugcacuccagccugggcgacagagagagacuccguaucaaaaaauaaauaaauaaaauaaaauaaaaacaaaaacauaaagacccugccuuuagguccagcccuuuccuaccucuccaaccucauuguaugccacacuuucuguuuuccuuuauguuggacacacaguucuugcucuuccuccaguacuaugcuuucuuaucucaggaacuuccauuuuauagauuuucuuucucuagaacaggagucaguaaaauuuuuuaggagagggccagauaguuugccaauuccugaucuaaucccacugcuuaccgauucaaaugucauguucucauugaagcuuuucuuaaucaauguuaagugcccugcuggggacaguggcucacacaccuguaaucccagagauuuggaaggccgaggcgggaggaugguuugaggcgaggaauucaagaccagacuggacaacauagcaagaccuaguacccacaaaaaguuuuaaaaauuaggccaggcaugguggcucaugccuguaaucccagaggacgccgagguaggcggaucaccucaggucaggaguuugagaccagccuggccaacauggggaaacccugucucuacuaaaaaauacaaaaacuaguugggcgugguggcaggcgccuguaaucccagcuacuccggaggcugaggcaggagaauuguuugaacccaggaggcggagguugcagugagccgagaucgcgcuacugcacuccacccugggcgacagagugagacucugucucaaaaaaaaaaaaaaaaaaaaaaaauuagcagagcauggugguauguaccuguagcccuaccugcuuggaaggcugaggagggaggaucacuugagcccaggaguucaagguuacacuucagccugggcgacagagugagauauucucuuaaaaauaauuuuuuaaaaaacaaguucccuuauuaaauguacuuguaccacaaaauauauuucuccuucauagaacuggucauuacuguacaguuggcccuugagcaacauggggguuaggagcaucaacccccuguacagucaaaaaauccaugcauaacuuuugacuccucucaaauucaacuaccaacagccuacuguugaccagaagccuuauauugauaacauaaaugguugauuaacacauauuuauauguuauauguguuauacacuauauucuuacaauaaaguaagcuagaaaaaauauuaagaaaaucauaagagaaaauacuuuuacaguacuguacuguuauauauugaugccauaaguuuauaaugucuguuuauaagaugaaucaucugaaaugacaggcggcugcagcugcaaacuucaaucuaagcuacauauccugcaaugcaacuuuugcuuguaacgucaugacuuuucucugcuucuuggaaguacuuccaacaucacuaguggcacuucguaugggucccacgguguuauucaagguuuauguauugcacuaaacaugaugaaaaauacacaagagcugcaauagaucacuuguuauugcaauaagcaauuuacuggagagagaaacuguucacaugcagacgauuuaguccacacagcguuuucaguggauacuuacaauacuugagcuccucgcaauagcaacaggaggugguuacaaaauuaucacgguaguacagugugugcuacaguuaacuucaugcaguuacgaucuaauacugcaccuucacauuugacauuucucucaauugcagaugguaccauguaugaucuguguuuguguguguaaguuuggauaaauuuuaacuuuuuauaauagauuugcauauauuuuaugguagucaaugauaaagaccaguaucuacagauguuuuauguauucaugacauacuuaaauuuaaaacuucuuuucauuauuucuaggcuacaugguuugucugcagguuuuuucaaauuguugcaaaucuccaaaaaauuuuccaauaaauuuauugagaagaaucuguguauaaaugggcccaaacaguucaaaucuguguuguuuaagggucaacuauaauuaauuagacaguuaugaaauucuuuugcuaauauccaucuucccuauaaggauguauacuccauuagagugggaacuauaucuacuuugcuauuuuauuccagcaugugguagaaaaugugacacacagcagcaaucaaucaaucaaucaaucaauguugaaugaacgaaccauuaauuugccaccugaccuucauucggcacguuugucuuucuuaggcuuaguucuccaucuggaaauggagaugauaaaugcagcuacuuucaagguugcuucaagguacauaagguacuaugugugagagcauucuaggaacucuaaagcaauacacaaauguaagaaaauaaauggaaagaugccccaggugcacaggacuggggcaaaggcuggcccaauggccaaauccucuggcucauuuuguugguccucuagcuaagaauggucuuuacuuuuuccaaggguuguaaaaaacacaaaacaaggaagacuaugccacggagaccacguguggccugcaaaguccgaaauauuuacucucuggcccuuuacggaaaacguuugcagaccccuggccuacagaagugccugggcuuaaguaaacauuuuaauagugaaugaauaauuauuacuuugcaaguauauccauauuuugguauuuugauaacugacaagcagugccaucaucugacugccugucuucauucaauaaagcaaguaaucaacguaaaaauaccucccccccaccccaggcuaauaugcuuacuuuacauuuaaaaaaauacaaggagucuauaaauauuuucauuuccuucaauuauaucaagaacuguuuuugaaacagagaaggcauggauggcugggaaaugguguggggaugccgagcuggaggccacgcgaaccguguccacuggaaggguggcugcuaucaucgugcaugcgguugucauguggaaguccaagucuacagaaaccuauucacugucugcugugaaauacugagauuauuuucugcccagggaauccauuaucacacagaagugagaaauggcacauggauaaaaaauaguaagaggcuguguuuauugccaaaaaaaaaauccccauuacugcacaaaaagaaaaggauuuuggagucaaaagaucaagauucaagucugaacucuaccacuuauuccaucugucacuuugagcaaaccuauuagccucucugagccgaauuucuucaucuagaaaaagagaauaauaauuauugaugacauuuaguggguggccuuuaugagccaugugcuuugccauauuauauuugaucuuuccaucaaaaugcaaaguagauaugauuagcgccaauauauaggugaagaaacagucacucagagaacuuaagugacuugcucaaaguaacaccaccagaaagaagugaagguuuuguuuguagucaaguucugacucuagcaaugcuauuagugcaaccucugauaagauguuuaaccucuuuagaccuacuaugugcuuuaccuuacaaaaagcauauaaaaucuaauuucuaggagagauaauuugaaauuccuccauauuacaauauuaccaacuuacaccuuaaaggaaaauggcuuuccuccauucuuccauguuaaaucuaauucuaugucuucagagaauaacaaaaagaggauguacucuccucuuuguauauaauaagaacaaccuaaauuaaggaagcauaaauacauaaaauaaaguauuagauuuugagcaugucacaaguagcauaaugaugaugaauucuacuuauuccgcagcaauuccccuucaguguguaaaccaaacacauucaauaugcggcacaugaguugacaugaaaccuugauuaccuuugcuucaucgucucauguacucucccaugcuggacacacuguuccuccaauucuucauuucuucucuguaacuuucccaauuuaucauauguauaccuuuuuucuugacugaguugagcuauuucagaucuagaggugaaaacacaaaaauaauagauguuagaaguucuuauuacuagggcauauuguuauuauauaaccuuaacauuaucuuaaacuccacacuuaaacaugauagcauaaugaaaacuacauccuuugcaaaagaaaauauuucagaaauggcaagauacauuguagagacucauguguuagacagaaaaaggaauaacaacuuacucuaacagaaauggcuucccuaaggaauaagacaaacaugauaaugaucaaaucucuuuuuuaaaagacugucauucauuuaacaaauacuuacugagugcuuguuauaggccaaacacuaugcugucaaagaagaaacccuaggccuaauuucuauaacagaguuucuuuuaauuaacauaaccaguuuaauggcacacaguuaaaauaaaaauaguucuuuaaugguuaauuuuaugugucaacuucuuugggccauggugcccagacauuuggccagacauuauucuggacauuucugugagggugcuuuuuagaugauauuaacauuuaaauuaguaaacuuugagaaaagcagauugccguccaugcaggcaggcuuuauccaauccacugaaggucuuaauagaaaaaagauugaccuccccugagcaaaaugggaauaucuuguuuuucgugucuuagaugacaauccaagucucaaaauuugaagaucagaaagauguuuauccaagaaaaauuauauuccuuuccuuguauuaaguaaacucuaaauuacugccuacugccaccaucuccucaugcccuaaugccuaaucaguuagaauggaaaguuuaaaacucuuguauauuaugagucguuuucagguuaaugauuggauuguuuucugaagacuccugacauaaaauuaauucccuucaaagaaagaauucuuccaguaggcaagauagccuuuucuuccuggucagaaaaggauuuggauuugcuaagggaaaucuuacuuuacaaauuguucaucccaaggaccaggcugcucacguguauggagcaaaaacucuugcuuuuaguucaccucauucuucauuuuguuuucaucuugguucaaaugucauccaaaaggaagcuugcccugauugauaccuugcaguucucaauaugucagcacguuuuuugaagcuaccucuagccuuuaugcauacauuagcuuauaauuuauucuuuuaaauugugcucugugccuugucuuuccuaccauauucuguaugagagcauggauuaucucauuuucaaguucagaucaagugcucaaucuacauuugcuucuccuaauaagaaucuacccauauuugaaauaguccgaaaggaguuaauaaugacuuacguuucuccuuucagaaucacauacaauacaaaagaauuuagaggcaguuaugauaaauuuuugaucugguaucccuuccaagauuaguaucuccuaucauaccaugcacuaaaauaaauuucaaaagaagaaaaaaaauccuuaaaccagauuagaaaaaaaugcagaacauugaucuuuucccaggcacuuuccaagcaaaaggcacuuuuaaaaagaaaaaucacaaagaaaaaaauagauuuuacaauauaaaaauacaaaacuuuuaugcauaaaaaaaucacauuuaaaauauaucauagguuugugugagaguauucauuguagcauuguuucuagaaacaaccuuucuuugcaacccauaaucuggaaacuuaaccaagaaaucuaucaacaggagcuugguuauguuacuuauuauucugauaauguggcuauuuauaagugauauuuauugaucuaaaacugugacauauuaguaacaaagagaaaacauuaaaagucagcauguguaaugugauuucauuuuauaauuuagaaaaauauuuugacaugcauaccaacuauuaauauugguuauuucuggaugguaggaucaggaauguuuucucuguucuguauucauccuuuuccauacuuucuaaauuuuuaaaauagauauguauuuuauuuguuuuaaauaaauucauucugauuuugaaaaaaaucauaauaaaacaaaauguagaugucacuggugggggagguuguguguggaaggaacagggaauauaugggaguucuguacuuucuguccaguuuugcugugaaccuaaaacugcucuaaaaaauaaagcuuauuaauuaaaaucaauguaaacaacaggaaauuauuuacaaaaauaagacaaacauuaaaagcauaauuuaaugaaacacuaacugcacucuccaucaaaauuccaauuaaaaaguauaagaaauauugaaaauaucuacagaagaaacacaaaugaucaauaccauuuauaacauauucaauuucacuauuauucaaaaaauagcacaacaaaaccagauacuaccaccaaauauuuacugcaugccaccguauaacaaacagugaaauccauccuuuacauucaugaucucaauuaauccuauaagguacuuguaaggguuucuuuucuuuucucugugagguaaacaugaaguugaauaauuugccuaaggucauccaaguagucaagcccagauauuacuuaguccaccucuaaaggggugguuccacccaccugugcaauauugccucucaugcuuuuuuaaaaaaaucucacuucuuuguaauguuauuuacuaauauggcuacauauacaguuauuagaaguuaguguaguacuucagcaagguaaaacacaucaacacccuuaaaaggauuaaucgucuuggaccagcaauuaaggaaacaaucaaaaauuuagauuuagguacaaaguuuuuguuguauuauuauucauaaacgguuaaaaauuggaagcaucuuaaaagccuaauaauucuuauacacgcaaaucauuuaauaaaguuuuguuuucagaguauuuacugauauagaaaaauguucauuagauaucaaaugaaaaagcagacgcaaaacuguauauacgguauaaucucaaucacacuauaaauguacacagacauacacaugaaaaaugacugaagggaaauauaucagagguaagaauaguuaucucuagcugguaguggcacaggaaauuuuccuuaauucuucuuuguauuuuccaaauucccugcauugaggaugucuuacauaaucccaaaaauauaaauguuauuuauaaaguacacaucacuaucaaguguguauugcaacaaucuuuuuuucugcuucacauuuuuguuuuuuucuuuguuuauaauuguaauuugccuaccaacuuccauuuuucaauaaaaauuugacauauaugccugcacaucauccuuuuucugucugcagcucacgauauguuccuagaacuaguaguuugcaaagcucaaagaguaaacuuacaaguuuucuguuaguuaggagauacauuucuggcaugauuauccugugucauauaaaaggauaauugacucuaauccauuuucauagaaaauucaggcaauuucuggcuuuacagaagcaugaacuuuccccuguauuuuuauauaccaguuauguugcauaauugcauuugcaugaaauauauuuuacuacuauaauucggauuaaaaugauaauugcuuucaaagggaaauacaauaucuuaauuuuuuauucuuuuagguucuaguuugacuuuugguaacaauuagcagaggccaauaucagucuccucuuguagaaaauauaauuuuuauaguaucccaaccuaacaucaucuaaacaugcaaaggaaaaaaacaguucaaccggguguguguucuucaccucaauuaaacucacacaguuggauaccuacuguugccaaaacaguaauauaauuuacacauuauaguccacacaguaaaacuacacuaaaagucauuuaacaauauuuauaacaccauaaaguauaguguuaaaauauaugaacugcaauauguaccaaaauuauaaaauuuguuucucaucaucagugauuaaaaccgggaucauugcucuagccucaauacucacaacccuggugacagauuagaauucaaaucuuaaugaucaauuuacaauuaacaagauagaagugaaacaaauuaaaccaaccauuauauauaacgagaccccauggacucccauuguuccucuuaauuacaaaacgcaaaucacaaauacacaaugggcaguguuagacaucaguccacaagccucacaacccagaaagugacaaugacagaaaagaaagaagcaaaaccacauagacccugguucuaugcucuauccuguucuuuucagugugcaagagguggaagcuaaaaccuagcacacacuucucuccacucuguggcuggcagaggcucacucccugccagcacccaauccuuccagcucucccaggccagguguuagauagcacugcaaaccgcacugcaacguuuuacugcugauucaucuaagcgcguggggagagagaacacuuccuucacuuugauaaagaaaaaucacaguuguaccgaagauauuuaaauagcuccguuuaccuccuucaaaaaacaaccccauaacuauaauaagcucucagaguacuggggaauacagaaggaaggauagcgaaaguuuaugugagcuucaacuaaaaucagccagaaugucugccuggugccaauuaaaagcaaaauggaauuaauucucuugccugauggucaaaaacaagcuauacaacaugcacagaaucggcaguucauuuuaaguuuuaaaaugggacgugccauucacaaaccccgggguuacagacaccacuacgugcaguguggaguacacagagcgcgcaaacuacugugcuaaucacuauggaggcuuccagaaaacagaagcagucgucacugccauaaugcgacuuacggucuccuuggggagaaaacacauacaacagacacacacacggagguaccauuucaaaacauuuucacagagcaacagagcagccuagcaugaagcuggggcagagaguaagggcguacgugcacgccgagcccaugcucucagcuuucccgucauucugcaugggcuucagucaaaugacuagaucugugaguuuaaaaucuuguuuuaaaugguaggaaucuauuuguuuaguugguauuuugaaaaacaagacucuuagaguaauguugcuaguaacagaggaaggaaaaauaugucuuaauuauugcucaauacaaaauaaauacacuuacuuuucaagaagaauuuuacuguaauacucugaggaaaagcuggaccaaaauuaccauauggauugcauaaguauaaauuuggagacugaguuuccacaaugacaaaacuuuagaaacuccaagauuuuccuuaccucaaagcacagggaaaauuauuuaucccaauaguuuggcaugggguaugcagaggcacacuccuggagggcuucuucagaguuuacuacauuaauaauuuguauuuuaaaagaagcaguuuaagcccuucaaguuuuauaggugguuucaaagcagaagguaacaucaaaauggaauguaaaacuuaacaugaaugaguuauugaaaaugucauaguaagaagccagggagaaaugaaacuggaacuaaaagaaauuaagaacaaacaacccuaaaaucaaaauuuguccuauucacuaccuucuugugaggcacacaaaaugcacuuuucguaaguuuuaggggcgcuugagaguuuuaaaaauaguaaguaacaauuuaucaaguguuuacuacuugccaggccuugguugagucaaauuguaaacuuagaguaggugccugcuuuaauucaucagaguuacaaaauacaacuagauccacauuuuccugaucuggcuguuuuaaaaaggcuuucauuguggcauagacuuauguccgucggaaaaugacagucagacuuucccuggcaaagacaauagcuauguaaagugauacccaaauuaccagucaagacccuuaaaaaugccaccagugaaaauaauagcagcuacuguguauuacuaugugucaggcacugugcuaggcacuugauacguguauguaugcguaucuauauacacaauucuaauucccauaacaauccugcaguguggcuuuagaaauguuuuuacagaaggagaagcugagguuuggggaaaugaggccauguacccaagguuacaaagcuccaagugggagagugagauucaaaccuaguuccucugaauugccauguguucuuuacugcacacugucagccaucaacaaugggacagacuggcaucagaagucagaucaggaggugcgaauagcaccacaccuauuuguuucauucauucaucauuuauucauuaaaugccaucuaugucagauacaaaagaauacauccaauuuacaaaguacuguucaggagcuggaggaaugagaagcaggaggagcaauagagguucugaguuagaccaguacaggcuaagaugacagaucuagaggaggaaaaagagggccuaggggcacagaguaaguuaaccguuacaugccaaggacgcuuacuucuccacggaaauuuaaaggugaauuuuuccuucccaaacuuucucaucauaacuacuguggcuugaauuuucuuuagcaauagauguaaaauacuguaauuaccauaagaaagaacguauacuuuggaaccagaaauaccuauguuagaaccguagcucucccacucaccaguuauuuaaacaguuuugguuuccuuaucuggaagauaauaauuccugccucaaguuguggugagaauuaaauaacauaccaagcaccuuuuugucucuuuuauauaauaaauuucccuaauuaggucuccuuggagagcaagaucacuaaucauucacaaaccaauuuuagaccuaauacauuuauauaaaacccagauugauaucauuuuaucccuaaaugauacaaucuuguuuguuugcuucuaacaaauuacuuuuggaucuauguggugcaaaucaaguauuucugguuaagaauagcuacuguugauauuuuaugggucucuuucaugacaaaaucauuugguuuucuuggucaaauuuccuugaaauaucugguauuuuggcaccuagguuuuccccuaccaaaauacaaucuuaguauacgcuaggaaggugcgcaugucagaguacauucuuggugguuacaggagccucugccuuccuggugagcagggagaguuggaugcacgagcccucugauuccccaaaagauucagggauggggguucuaucagcuaagacagcuuguugaugcaggauuccaagauggagcucagagugaucagauaugcccugauacucccagaaauccuucccgaaugaaacaucuaggucaguaguuuguuugcugagccauauuuccugcucucaauagaucuaugugaguuucagaaaaaugcagaaaagaagacacacaggcaauuuuuucauugaguuaucauauaaaguaguauuugacaucuuaucaguuaugugaauauugccuucuauaguucaauuuaaagugauucuguccaaugucuuucauuuacaaaagaagaaacuauaguccaaguaggucaaauacauuuguccaagauuauucaguuacugucggagcugagauggggagucgggcuucuugcaguuuagaauaugaaauaauuuauucauugagauaaucugacuagaaaguguauagaaaaaagucauuaagauuccaaucaauggauuuauaaaagaguaguaugcuauaaaaugaaugauggcuguucuauuaaaauauaacaauuuuaggagaagggaagaauaguuuugguuuauuuauuucaaaguaccaucuacuuucauuuuuauauauacacauuucaucuguuaucauuuaaccuaaagacagcuuuuguguucauggugaauuguaacaauagauuaaaauguguuaaccauaccuauguaagauuuuauaacugcuugauuuaucugcauguuuauguuauuaccauauugauccuucuuuccugaaauuucacaguuuucaauucuaaacauugaaaugucaaauaauaguacauacacauaaccaugaaaaaacauaaaagcguauagacaauuaagaaaauguccauauguagaaaauauuuucaaagaaaacaucagcagauaccuaauuuugacauuagacuauaaaacagugcaaaugauguuuuuuaaggaaaaauuagaguaaucacacaaacagugcucuugaaaguauucuauaacaucaccuaccugguuuuuugagagauuuguuccaguuucuuggcuaauguacagcauucuuccuuuaacuuugucaaaaauguauucugggaggucagcaacaaauacuguucauuuucuagaaauaacaauaaacccccaccaacauaagauguuuaugguugucgcucugcagugcuuccauacauagagugguaaagugcuuagaccccuacacauuuccaauaagccacuagaucaccuucaauguccuaagucaaaggacuuaucaucuggaaagacacucaaucuugggagucauuuauuuucaacauaauuauacaccagaaacauuuuucaucauaccagcuugguguaacauuuuaacauguuaauaaagugucaaauaccucaaguggaagaauagaugcuuauaucuuugcaauaugcaagauauuauauuuuuauuuugacaauuuuacuauaaacagagugucaaaaauuaucacaaccagauaacucaaaacuaaaaucaucgaggaauucucuucuacacuguaauucaugcuuuguuucauauuugcacacaugguuuacuaccaccaccacccccaaucuugcauacacuucucuaauuaugaagguaaaaauguguauuuucuuuagaauuuuaauuucauugucaacagcaugagcuucaauggagaucuggucaaagaaauugaaaacagugugauuuuguguauguguguacaagacaaaaggaaauguucuuaaggcgguuuuaacaguuaaauacauucuaaucuagugcuuagauucugcccaagacucugaucacuaggaucaugcuagcagugggggcaaaaacaauaauuuauccuacaauugccucuuuuuguuuuuagaggaaaaacuucuacuaaaccuggugaauuuucguuucuucuggccaaaugcuguuggaagaaaaucucuacugaaagugauagagggaauuaugugagucaauaugacauuugccucuucauaaguaaauagauuauuuaaugacuugccuguuggcaauuuuucacccauaggauaagaaauaauuucuuacugugucaucaaauacaauauauuaauacauuaaaucauaugaaaauuaccucuaagcauaaguuuuaagaggccuuuauuucuuuucaauuuuagccaaugauuggcaaaaagcauauagcauacaaaucaaaauaaaucaaggcacuaaaauuaagcaacauuuuucuggaagagacaggaucaauuaaacuuuuguuuuaauaguacaaucaguguggaguaugugguguggaauuauaaugacugacacugucuuguuuugacuaacacugucugugaacacacaacucaaaagugaaagaaacuacauaaugcucugacugaacaaaucaaacugucuauuuucaaagugcauuuuacuuucaaauuaaagguaaagaguuacuggccaacucagucugcagaauagugccaaugugaugaaagauggcaauuuuuagccaagcugccagcuguggucagugccuuguauuagugaauuuuaacagcaguugugagaacuugaagaaugcaaaggauuaaacaucacucuagauuggguugggggagguggggaaaucauacaaaugcuaaaaauguucgaagcugcaaagauuaaauaaaggaacauaucaauuuggagccacugaauuacauccagcugcgacagugaauuaagaaccgauuaauggcuaaagcuuuucuccaguuuggaugcugaagcaaacucauuaggcuuuuagaguagcuauaauguguguacugugggaacuguucaaugcuauucaggagacucuaacuguaagcucagagcauuucccgcagagcuucugaugcuauuuucuuuauauaacaugugugccugaaaacccagccaaaaacaagcccuuuguuuuucuacuuuguuguggucucucucagcuuuacguuucuugaacacagguaaauaaacucauaauccagauggugcaacagaugugagagcagcacucugaaaucaacagacagugggcaauacuuuccauuuucucuuuuaaacgcuaacuaauauguaauucggaaucuccgguguaguuagcaucugcucccuucggccagccaaagguuacagguguuccugaugucauuucacaguaaggcgugggccugacuugugagcuagugcccaggcucuaaucuuucccuaccaccuaccaguuuugucaugcugggccuccauuugcuguaucuucugugucagcuccugcucucuuugcugggccugaagggcuugggccuuugcuuccuugcuaaagcucugcugaaugcuaucuuuuuccugucugcaaaacagagaggagacauacagaaauuuaaucugcagaugcacaaacccccaucauguccccuauagaccagagagagcugauacguaguaaauuguuaagcauaagaagacaaggaccuuucuaaugacccucccccacuuuagggggaagauccaaacaaccuuccauacaguguuaaauacgugccaugaauccaaauggacuaaagugugcagugucaaaacaucauaacaacuaaauaaugguauuuuguaacuuuaaaacacaaaacuuuuuucucuaauauucuuaauguuuuacacuaucaaugaauguuucaucuucugaguggucaaucuuucccagagauacuggaacucuaggaacaaaacuuaaauucuuaaaacuaagcuuuguagaccaccucuguuuucacucuaaacuuaaaauggaaucuuaaauauaaugcaggagccucuaucuagaggcgaguaaaugauucugcagugccacauucauguuuucacuaaauaucuucacacaucaggccauauaaugugaauaugaauacaaauaugaauacgaauaacuucccccagcacuucauaauaaaaucccucgugggucacauugaaagaaauugcaggaugaaaagcuucuguagucagacaacaacccaucguacugugauaggacacugaccuaucccacugggucaauaaccaagcacaguggcuccaaagagagaaacuuccuaaacaauuagaaccuggggaaugcaaaggaccucaaugcuggcagcacuguggauacugacagugugugugugcauguacaugugcacacacacacacacacacacacacacacauauuagaaugguucuucaaacucuaaauauggguaagugauauuaggguuuccuucaauuaacugacuuaguuauuucuaacuccugaucuccuugcgggcauuucucauccaugcugcuuuaguuuacuaauugagauauuuacugcuuagccuuugccaaacuaaaaauaaacaauuccauaaagcuaucacuacuagucuauguaccgcuguggaacuucaauucacuggcuucuaauuauaaagcaacauaaggaaagccuguauuaaaauuggucaaugcauguggucauguuguaguauaaaauucuggaaugaaaauacacccacaccucacucaaauggaaucaucggggguccaugcuaaaugugaaauaagguccugucugguacuucuaauaacaacaccuccccccgggaugugguccaaggucuugcgucgcacucgguuccaaaccaguauauacaacaaauggauagucagacuaggcuacuuuuugccuccccagucacaccauguauuuucuggccauggaucacugcacaugucucuuccucuuccuggaaagccccuccaccugcccacucaaucccccuguaagauguauacauacaacuacccgcuucaggccuaacucaaaauucuuccccucuccuuccucucuccugaauuaacuauucuucccucaaugaccucaauauauguuguguacaucguacaaagauaguauuuaucacacuuuaguuauuguuuaacaugucugcuucguuugucaucuuuaucucucuauacccucagcccagccucagugcuuggcacacaggaaguggguggugaauauuucaugauuggauguuguuauacucuugucauaggggaaaggaaggcugcuaucuuaacguguagcuggagaaucugcuuaagucuuacgagaggaggcaaaaacuuuucagacguguuagaaaaaggugcuuagaagagaaugguucuaauggcucugccagcuggagaccgugcugcuaaaggagucagcuaaaaaaacaaaaagcccugucagaccauccccaagucagacccccugccggggcaggagccagagauagaaaucuggggcucugcaaccccuaacaauugggugacauaaaugcauucuccaacaccaauacccaucugaaagugaaaggggcacuauuaauaauuauaccaagauaacagucacaacugaaacuacccaucacaaacugguacuuacaguuccccaauguaaagggguugucaaucucaccaucauucuuuagaauaagcugccuaauuacugauauucuaaauugacuauaggucaggcacgguggcucacaucuguaaucccagcacuuugggaggccaaggugggcagaucacuuaaggccaggaguuagagaucagcauggccaacaaggcaaaaccccaucucuacuaaaaauacacaaauuagcugggcgugguggugcaugccuguaaucccagcuacuugggaggcugaggcaucagaaucacuucaaccugagagguagaggaugcagcgagcagagauugugccacugaacuccagccugagugauagagugagauucugucucaaaauagauaaauaaaaauaaaaaauaaauugacuauagaaaagaacuacugucauaauugaaguccuuuuuauaaaauaaaacaauuuaaaagacuucuaccaacaaauguugaguuacacaucaacugauguuucucgaauccuuccccaaauuucccucuauuugggaaacuauacauuauguuucauugccuagaaacaugacauagucuugcuuuccaaccuccuuuccccuuccacuuuccuauguugccuucucuccucucuugcagguucugacuugguaggcuuuuuauaaauucccagaauguuagaacuaaaagggaaccucaaauguguuucaucaaacccucucacuuuacaguuggaaaaaaaaaaccuacuuaaaaauccccaagggucacaaagaauuugaagucugcuuauagguugcauagugaaugauuuaaaggcagagguaggauuaaaauguuuuuauuuggggaauccuauuuuauaauacucuagagcagggguaugcaaucuuuuggcuucccugggucacacugggagaaucgucuugguccacacauaaaauacacuaaaacuaauacuaaugauugcugaugagcugggaaaaaaaaaaggaaaagaaaagaaaagaaaaucacacaaaaaaaaucucauaauguuuuaagaaaguuuaccaguuuguaucgggcugcauucaaagcuguccugggccgccaguuggacagcuuacucugcuugcggccuggaugguuuugaaugcggcccaacacaaauucauaaacuuccuuaaaacauuaugagauuuaugcacgggccuuuuuguuuuuuccuuuuuagcucaucagcuaucauuaauauuaaugucuuuuauguguggcccacaauucuucuuccaguguggcccagggaagccaaaagaucagacacacugcucuagagguaauacgauaauggauugaaaaaauuauaaaaagcacguaggcauucaaggagcaacuagagaagaauguaaaucaaugcauuaaguauuuaucauaacucucuuaugugaaaggcacucugcuaggcacugggucaaauaaagauagauaagacaugcuccuugccccuagcagggaguucaaaauggccaaacagaaaguagauggcaaaauacuucguaagaaagguauaaggggaaaauuuaccaaagcauaacaaaaugagagucaaauccagcugggugugagagccuggugaaggauggucaagccagucucuccaauugguuugcuuuaauucccacucaaaacacugaguaaaaaagaauuucuugguaguuauggggcugaaagauuuauucacaaucacucaaaacgggaaacaacuuaaacgugcaucaacuguucaauggauaaacugugguauagucuaaccauggcuaggaaggguagaaauaacaaggaacaaugccacauacagcacuuggcugaaccucaaaagcaguacacguaguuuaaaaagccagacaccaaagacauauauuaugaugucauucacaggccauucaagaaaaguaaacacuaagggacagaaaguagauccgcguugccaggauuuggaaguaggagagggguaccagggagcaaaagggcacaaggacauguuuuggguggauauaaauguucuucuauguuaugacuaugaucuuuccacaauucuauauauuugucaaaccauauuuaccugcacaguuagaaauuggugauauuuuauuauauuuaaauuuaccccaauaaagcugaucuuuaaaaggagcaaaucaguggcuuacaccuguaaucccagcacuuugggaagcuaaggcagguagaucacuugagcccaggaguucgagaccagccugggcaaccuggugcaauccaucucuacaaaaaaaacuacaaaaauuagccagaugcgguggugugugccuguagugccagcuacucaaggagcugauacagaaggaucacuugagcccagggagguugaggcuacagugagccauaacuacaccacugcacuccagccugggcgacagagugagacccugucucaaaaaauaaaaaaauaaauaaaaauaaauaaauuaaaggaggagcaaauggucuagaauaggaacauccaccuuuauucuccaaguuauucacaucaccuguaauccaggcguauguaggccaugucaauguuuucuucauaaaaauucagaauuaaaggagugaacaaguacuggcuaggccucaaacacagauuacauauacauggaagcauagucauuccuuuuuaccaauuauaguucugguugauugcauuuucuaaaaauggucacaaugauauuuaccaucccacuuuuuagaaacggcacugaagcauuaagcuuauauuuuugauacucaacuuuuucauaucguuuauuauuuuaaaucuugcaauuuaaaaaauguucaugucacagagcaaaaaugauuuguuaagcagauuuuuuaaaguacauuuucuaaugauguuaaauuuagcucaacaaugacccugggacagaaaaaaugaaaggcucaagucuggaacaaggaccugguaguugugggguugaagcaccaaucccaccuuccauguuccuacucaccuuuuuacugaugucugaaguuccaaugugagacauacaacucuuuuggcuaaaagguguuucccuuuuaagauaaaauuuugugagcuuugugauaguagcauauugguaugaaaaaacuugugagaauuuauaacaugcuuacuggcugaaaaucauuaaggaauacagacagaaggggcagggaggugcuggguaccgaugugaguuuagacagaaaauguacaccugucccaauauuggugcuauuagcuuugauagcuugauuaacaucauuggugugccagacgauauuuaacaacagggcuccaggggacaggaaaucccucuuugguaguauucaccaauuuucaguguagacacuuccaccaugcucuauuuucagcuaccaaagugacaucacugaauaccaaguugggaagaaauacacauaauuggcucucaugggcugguacaagucagacucagcaaaacagcaguuaggugagcugucccaggccucucuacuguaaaguuacuccuuuccucucuguaucagguuggcacaaaaguaauuacuuuuaauggcaaaaaucacaauacuuuugcuccaaccuaauaaguaagagguaauuuguugggagaugccuagacuaugcaaacauccuauucuucaucgagcucucaucuaauaguuuuacauccaaaaaugacuuuuuuacuccauuauucuuucucuauuuuuuaguuaacauuguauuauaagaaagagcuuucccuucucucucauuuauuaauucauuaauaucagcauggagucauggauucauaucuuauucaguggguuauaauccauuaugauuauuauuuuuaugcucaauuuauccuggauuuggccagggggaacccuuucaaggugguuccuacgugacaugucucuauuguucacguggcuuucuaucuccacaaaauguugcaggcucaucuuguaauguccuuguaccagucuuggaaucagcauuugaccaaggagcuguuuuugugccuuuaauggagaaugguauuuagaaaucaggaucugucacuagguggugcucacugcuacugcaaaaucauugcuucuaggucaccuugguggacuaagucuggauaugaauauacauguaaguguauaaaugugaauauaaauauaaauauuugucuguauccuauaugaauauaugcauacacauucauacuggucuuuccaauuacaauccaacaacauacauagaaccuugucucccuuuuuuccauaauuguaauuuuuuccucaauaguaagaaacuugguuccuauuauccucaacauacuuguuuguucaaacuuggaauacacagaaaguaguuucaaaauuaauaaucuauggaaagcaaaucuacuaguaacuagauuucaauauuugcuuauaguuuuguuuuguuuugccuuguuuuuuaaacaaauguauagguacuuuuugaguuuauucucuuugugcucugggaagaugacaccuugagaggcaauggaguacagccaaacucacagagcuagagggucagaguauggcaucuaccaccuuaucaccugugugacuauagacuaauaacuuucuuccuuuaauacugggguucuucauucaagcagaacaaaaagaaaauccaaccuuaaaggacuaauccuuuuaagaagcuacuaauuacuaauguuuacacauaagcuaaggucuuuacaugcauucuuuuauuuaauccucauaccaaccauauaaaguagguucucuuaguaucuucacuuuauagauaagaaaaugggagccuagagagguuauacaguauguccaaguucuuuaguuauuaaagguuacagccaggaaauccagggcuaucugacucuaaaguccacagugaaucacuaugcuucagucucuucuuuuaucagggauguagagaaaugagagaagguugaaaggauaacaagugucuauuucaauuaucuauaugggagugugccauuuaauagccauauuauccaucuugacagccaaaucccaagcuaguucuccuucuucuuucccuguuguccccuaagcuauuggauuacuuucuccuacaaugacaccaucaauuaguuguguccuucucgaagacauauauucaccuuugcaaaaacauugaaagguaccacaaacacaucuccugccucaaguggccacagacucuagaaaagauaagacaugugcaucaaucuggaaucuaaauccauggagaauaggaaccuuuguuuugcucacuaauuuaucccgaaaaucuggaauagugccugguacacaguuguguggucaaugaacauuucaugaaugaauaaacgaaugaaugaaugaucaacuacuaaaagacggaaaguacuaaguauccucacagguguaaguaucauccugucuacugacuacagucagagaauaugauaagauaaucucuauuuuugcaagaauuuauuauuauuauugaaaauaaaacaaaacaaaaacaauaauaaaauugguagacagcaugaugucuuccauguuucagaagaacccaaaauucuaugcuuauuuacagcuaacaggggcuguauucccuuauuugagcaaauguggaacuacugagaagaaacagaaaggaaaacacaggaaugagauucuggaaucucuacuuccuuaaguaugcaaaagacuuaauggcauauuuccuggaguaaauuacuucuauuuucuucauugcaaaguaugucagaacuucaagcacaauguugaaagaugaguuaucagaucagagaaugagucacuucuagggaagaaagcagaaacagaaaggaggucaacuucuuucaagggaauauacacaaaagaaaggaaauauuuaacagaaacaucucuaaaaauaauuuucccuccaaaaauguucuuacaguaucuccaaaauaauuugaaaacuuaccuucaaggcaaaagacaauacaguagacuagcuauugccuguuucuauuacauaugcacaauucccaucuacuuuuaaaacaaaaccacagacucuaucaacuccaguuacuagcgcaucacccuuugcaugucuguacuuucuauuuuaaaaggcacauucaaaugcaccgaccucucuauucuucauaacaucucuguggggcagagagauggaacagauauuccuguuugauagauaaagugucucaaacucgggaauuaagagauuuuucucaaagccaugcagcuaguaaguagcaaagcuggaauccaaaucugucuucucacuccaaguccaguguucuuuccauuccauggcacugccucacaugauggguuuguuuaaucaaacaguggauugcgcauccauucaacaaauacuuaagcaacuacuuugugccaagcacaaaaguauggggaugcaucagugugcaagauguagacccuggccucagagagucuauugucuagugaacaaaauaaacgaguuuuggggaaaaaaacaacucaugguacaguaaauauuaaaguagggcuaaauuccugccaugauacagguggaaaggauaggaauuggggaguagcuggggacagggaggaaggauuucaggaagcuuaaaaaaaaucagaagcuuaaaauaugaguaguaaucugccauacaaagaauauaaagaagauuauuacaagugaaguggacaguuugugcaaagacacaggguggagagauaaccaggugcccugagaacacugcaaacaguuuuggcaugacgggaugcuggaggauauauguuguggggcagcagcgcacaguugguggaggggagauuauugaagaaagacgagacuuggagauguaggcaggagccagaacaugaagcuauuuuuaaggcccucguccugagggaaauagggagccaauguaggguuuuaagcagcggaguguugugaucacacucgugcuuuagaaagaucacucuggcugcaguguggggaacagauggggaagggacaacauuagaaucagggaaagcacuuauuacuacagcaauaguaagagcaauuucuguaaugguuucuuuagauacgguagauaccauagguagauacugagacugaacagccucagugcauuugacaaugcacacuucauuaauuuucagucuucaaauguuuucaauagcucagggugccugaugcauuaagugauugcauggggcaaagauccugugagauaguaaagcacuacuguauccuauuauacaacacccugagcccaauucaucacccuaaauaauaaggccaaauaugcuauuaccuaaaauaaauucgaucaugauuuugccuuuguaucuucauauuuucaaaaauucauauuuuccauuucaauuugucuguauaaacuaaugacuuuuaugcauucuuggcuuucuucucugaaaaauaucacuugaucuacaaauucccaguaacuaaucccucugaugaguaacuucaaaucagguaucaguaggaucaauaugcauucuaguggcguuucuauaacaugucaauggaaaugcauuauuagcaaauuguagcauaacaguuucuauucuauucuauucuauuauucuauuauuaaaauguuuuaggaauuaauuucuaggauauaauauuaaauggggaacauguugguucccuuguggcuauaaaauuuauucagaaauauguauaauaguaagaauuauaauuuauauauuuuuuauuauauuuuaucucauaaguaugacagaguaaugcaugcauuauuuaucuagaauguugagaauauguuccacauacgagaauuuuccagguauuagauccacagaauucucgccauuuacaauagaaauaugucuaaaauguguuaauuaugucugcuuucuuaagcaaacuauaccaaauacaauaagcucuccuuaauaauuaagguucauaauuuaaaacaagguaggcauacuuacuguugcuauuccuuuugcuaguaagugccuauggaucguugcucauugccagaucuuuaagggcuuaauagaguggcuagaaacagaaggcauucaauaauauuuauugcaaggaaggucucagauguuauucuaaagaaccaaaagcauacuggucuucuuauaauucuuuauugguugguuugcugugauuugcugccauguuuuuuuauuuuguuuuuaauuuuuuuccuuuuugcuuuuuaacaccuaaaaguguguuaggauaguuccacagaugcugcacagaaaagugcaagggcuuugugauaguuacuugcuucuuaaaaguacguuuuaauuuauaccucaauuuacagcuauauuucaaacuagcaagaagucuaaguuugggacaggcacgguggcucacaccuguaaucccaacacuuugggaggccaaggcaggcagaucaccugagaucaggaguuccagaccagccuggccaacauggugaaaucccgucucuacuaaaaauacaaaaauuagcugggcauggugugcaugccuguaaucccaguuacucaggaggcugagacaggagaauugcuugagcccgggaggcggagguuguggugagccgagaucaugccacuucacuccagccugggcgacaggguaagacuccaucucaaaaccaaaaaaaaaaaaaaaagaagaagucuaaguuugaguaaguggggaacuucuguaauaaagauaguagaauuuucauuauugcugagauggugugccuuuggucaaacauccaaugugcauguauacagaaauuacggcuguauucuauggacuaguaaccuugacuuggcaacaagaccacuguaguccauuuuuagaguuugauugagaacucuguaaccucuccgucuuugcacacaauucuggagguaaaaagcacuacaucuacagaagaaaaaaacugacgugagcccaaguuuucugauuccuacuccacuauucucauuccucuaaauaagaaaauucuuuucuugauacaauaauuaagucacuuucuucaucaaaacauuuugccuuuuagucauuuuaugauuuaacauuauuucuauuugacuuuguaauacuugcuuauaacuauucuuaucuacauccuuaauuauuuccucugcuucaauaaccugugucugcuggaucuuucucuuccucuagccauuucuuagucuucguccucaccauuccuguagcuacagagcggcccuuuccauuccuggaaaccugcugcuuccagccuucuaaaucuaucuucaaacuaauuuccacaagguagccugcccugacuauauccaaacugaggacuuugugcucugagaaaauaaauauaagcaacugaaauccuaaaauaccccuaaaaacaauaggauacuuucagccuuuaucccuucgcauguaagcuccacugccagcagggcaucuguacacaaggaggcagaaguuuagagaacaggcuuuggugugugcuagacuuagcaucaaaguugcaauuccuccacuuagcagcugugugcccuaagucagugguccccagccuuuuuggcaucaaugacugguuucauggaaaacaauuuuuccacggaccaggguaggggguguggggaugauucgacugcauuccauuuauugggcaguuuauuucuauuauuauuacacuguaacauauaaugaaauaauuauaacacucaccauaauguagaaucagugggagccuugagccugcuuuccugcaacuagacaguuccaucagggggugacgggagacagugacagaucaucaagcauuagauucucauaaggagugcacaaccuagaucccucacaugcgcaguuuacaauacgguuagcgccccaugggaauccaaugaugcugcugcuccgacaggagauggaggucaggugaccccgaguugggaacuccugcucuaaguaagucacauaaccuacgacucaguuuucuugaaugaaaaauaagguuaauaacaguaccucuccucauaggacuaugaggauauuacauauaaaauacuguuaguacagcacugacauauaguaaguuaaaaaauauuaauuaguacguauuauuacuauuguuauccuuauuauuuccuagaagaugacuacucaaacugaaacaaucaauauaauuaucucaaagacagccuugaggaaagaauaaaaauuuuccucaauuuccugacauaagcuacacagggggagguagcauuggccagcguugcacacacagggcugggccucagcccuggcuccaccaugugcuagcugugucacgucaaggcggaaccucaucucaaucuaagccucuguuuucucauuaauaaaaugauauuaucaggauuaugugggaagcuccacaugaggcaaccggcaacguccagcccagaucaccauuugaaagguuccuaauugucuaaauccaguuaacagaucggcaucuaguuauuuaacugucaaauuuauuuucaacaacucuucaacauauaacggcaaagaugggagaguaagauauagaagaacuuauuauaaugugaugcugguauauuuaaucacucaucugcucuucaaguaauggccaguaagugguagcuuccucucucuuccuccuccuccucaaaguggcgauucuucagaaaaagacuaaucaauaugaguccuggcuacugccuccaaaauucaagaaaaagaugacaugauuuucuuguuuuaauaaaaugguucccauuuuuguagaaacaauucaggguuuaagcucaugagaaucuaacuucaucucugcugggcauugugggaaagcuggaaaacugaguaacaaacgucuagggcugugacgucuggaguggcagccacuggccacgugggguuaguaagcacuugaaauauggcuagguuggaucaagacaugcuguaagugcaaaauacacaaaggggugugaagacuuaggaaaaaaauuuaaaauacgucauuaauaauguguuauauaaaucacauguugaaauacuauuuucuauacauuggguuaaauaaauuauguuauuaaaacuaauuucaccuguuuccuuuugcuuuuuuuuuuuuuuuuuaauugagacagaguuuugcuuguugcccagcucaccgcaaccuccgccucccggguucaagcgauuauccugucucagccuccugagcagcugugacuacaggugugcgccaucaugccuggcuaauuuuuuuguauuuuuaguugagacaagguuucccgauguuggcuaggcuggucucaaacuccugaccucaaaugaucugcccaccucggccuccuaaaguguugggauugcagacaugagcuaccgcgcccagccuccuuuuacuuuuuaaaaugugguuauuugaaaauuuuaaaugacaugugugguuuacauuuuguggcucccucuguauuucuauuggacagcacuggucugagugccacuccuuugucuaccacccuauagcaaagcagcauuuuaaauccugauuccacaaauaaaaauaaccaggugcccaaaacuacuaaacguaagugccucaugaagauaucaaaacucauaauuuucaaaaacuauuaaaaugaccuuuuuuaaccuugauaaguuucucauuuaauucagccacucaccuaugauuugaaaggagaaacaaaggagaagaauucugauagaacacuaagaacaaccgaagcugaaguagucaccauaguauaccaaaaugauccccuucauuuuuuuuuuuuuguaaaucagauuugguuugaggcaacucccaaaaaacauauucacauuuaaaauuaaauuacaaaguauuaugaaaaaguuaauccauacagccaagcuggcaaauuauuuuuaaaauguucaguuauguaccugggucacagacuccuuccuaauaagugaauguaaauaaaauuggaaaaucuucaucauuggauaguguuucuauaauuuuuaaauggcaaauagacauggauuucuuuacucaaucucuaguaaucauccuuauaucauucauuacuuguuucuaguaagaaacgacuaguuucaaaguucaucaagaggaccuugcagucauauuagcuugucaaucaaugugucagccaguuuaguaagcuaucccacugccuggggauuuaaucuguugccuuuguaguuuucgcuuauucccaaacauuuucugcaccuugaggaauacaaauaagccagugaaugguuucaaacuuuaauaaaaauugcuggaguugauuuauugaaggaaauguaauuugagaacccagaaagcagggcaggugggaaagcuaggagcacacauaguaagucuucaugagaaucacaauuccagucguuaucauuacaagaugguuauuuauagaaaaccucaccaguagaaacugcuugacauaauuauaaauuauaggcaccuccaaguguauuuacagaaaaauuagcacauuaugagugcuaaacuucccgacuuccagagcuuauugcccaugaguugcuccauuucuuccuaacacaggaaagaauacacauaaaagggaggaauauugccauaucauggguugaaggaaaauaaaaucuagugcagucugacuuaguggcccauacuucaaauuugugccaauaauuccuggcaggagauugccuaaaacguuuauacaggagagcauccacaauaacaucuuauucuaugaaaucucauucagagucaugcuuuaaaaggugucuaacuucaaugaacugacuggcaaucuaguuauguaauugucaaauuuguuuucuagaauaaacacauaauuuaaaauaaauagaauuaucacauaaaggcaaaguugggacaguaagauauggaagaacuuggaacgugacucuggcacagcuaacuguccagcuacucuugaagucuggucaaagaugcuuccccaccccacacccccauuuuagagaaaugacuaaaugaaaauugaaaguuaccaaccuaucuacucuuuccaugaacuguguguguucuaaugaaagugaaguugcggggcagggugggauggaguaggguguugcagaggcacugaugagauacaauaacgaauaauccccauaugauaguuuucagcaguccuacuacaaauuaguuuaguucaguuuuuccccaaguguauuccuaaaaacgugauuccuggaagauguguggagauuugauagaaaagcuuccauaagucauauaaauuucggaaacacugaaaacuaaauuccuuucuaagagagucacagugugcacuaacauauuaaaaacgcugagaagcccuacugucaagaaaccugguuuagccuguugaauacaacuuuccaaaaggaacuggugacagaaguuauuuuucacaacauccaccaucagaggcaauauaguguaauggauaaaaucguagucgggagccuagcugccuaggcuucagugccuacgccaccacuuagcagugcugugacuugggucaagguacuaaccucugaauaccucaguuuucuuaucuguaaaauggggcuuauggcagaaucuaccugguaggguuauguggggauuaagugaauaugccuauuacaggguaagcagcguuuaugcgggagguuaucuuuacuaccacucccagagguaguuccaagaaacgggcugagugccauggcucaugccugcaaucccagcacuuugggaggccgaggcaggugaucgcuugagccuagucaggagcuugagaucagucuggccaauauggugaaaucucgucucuacuaaaauuacaaaaauuagccgagugugauggugcacgccuguaauccuggcuacucgggaggcugaggcaggagaaucacuugaacccgggaggcggagguugcaguaagcugagaucacgccacugcacucuagccugggcgacagagugagacuccagcaauaaauaaauaaauaaauaaauaauaauuaaaaaaaguucuaagaagugaacuucguaauuacuguuugcaagcuaaagaaccuuuguguuuuguuuguuucaagaaccaguaaccgugugccaaaauccaaaaauaauuuuuuuuuccuuuccaaaacaggcugugaaagacuugcacugaaggguuuuaaugggguuucucagacaagucauaucaucaaugagaacaaagaaguauaaugugggaugcaggaagagcacuagacuuagagaaaggaaacuuagacucuacuuuuugcugucacucaaccaccguugguauuaggaaaaucacuuagcuucucucaacauucucacacauuauaaguguugagcuagaugagaguuucaucaauucauuuaagaugaucaugagucacagaaaguuuauaaauuuauauacuauuuucuagauuuuacacacacacguauguguauauguaauuacauaaaccuugucugguagguugcaggauacuuguggaaaaggaucaugggcucuuuauuuugaaaauuuacauagugccuagugcagcuagaacagaacaugugcucaauaaauguugacugaauaccugcuuagcagcaaucaacuuguuaucccuucauucaaaaaaauuaaagacucauaucacaaaagacacuuuacuagguacaacuaaauuuacauauuucugggaagcuauugguucuaccuauaagaaguuuacaauuuaauuugugauaugacuaucaaaugaugacacugauuguugcaguuucuuuuuacugucuuucaauuugaaccccguaguucaagugaguuuuauguuauuauuuuaaaaagcagcaccaugcuaguagcauuauuauauaaauaaauuugguaauuaugauggaagagauggcaaaaucaguacacuauaaucaaagcaaggauacuccaaucgauuuuauauaaaauuuuagauuaauaagaaguuauuagauaaaaauuccuuaacaagugggagaaaaaaguacauuuugcagaugacuuuaaaauacaggucaucaacuuccuuuuacuagaagaaaucacuaaccauuuuuccuucaaaauauaguuguauauugccucauccagauuaaaaaaaaagagaccaaaauugaugaucuugauauacagcacaggaguaaaucaacaucuucuauaacuguuaaucugauuucaauucuuuauauuuacugacaaaagcaugccacgaaucacagacauucucucuaaacucaaaacauccagccuuaaucaaacguaaucuauuugauccaggcaguucugagaaaaggaaugucaauacaguacucauuuacuuuguguguuuaaucucugugagcagugugcagaaacuuuuguggauuauuuacgagaucuuuaaaaccucaaaauaauugugcauugucaucauuuuucccggugauagcuucuuaauagcuccuccucuauuggcgucucuuugucagaaauguaauguaguaaaauuuucaaggaaaacugugguagacaagggcccacauaagugguauguaugaauugaccacacagaguauuagcagggcuaucucugguuugcaguggagaaaguuacauuuuaauaggucuuagaaaacaagaaaguccucauuucuugcuccacuguaugcguacuguuccuuuuguaaauuguacuuggguuugcaggugucugcccaaaggcaggucacugaaagucaaugaaaaucaggucaaccucagcagcagaaauuaaccugcagauuguggccagcaaauguguauuuuaaagagcauuauuccuacugaaacaaucaaaccggacuucacaaaaugaacagagauccaaaacaacaaaagcaaccaacggcaucuauucuaacauugcaaauuucuuagauauuacagaugucacccaacagugcaugcauuugcuuuccauaugugaacaaaacugaggcaucacaagauaaauuugaauggaacguuaaccuucacuuuaaauuuuuuucuuuuccuagcugacgacauaauuuuaguauuaucauaauggagcuucuggcuggaaaaaauuaaauuaauggauggauuuaaaaaagcuuagaaacuuaaaaaaauaaacaacuuucaaauaucuauacuggauggugucaagagccaagaugaauguauuucaaucgcaacuuccaaacuaaacucacaaauuacuaccauuaugcuaaguguuagcuaccccacugugcaguuuugcuuugugaauuuuuaccuuccucuaugaacacuuuuagccacugaucgcacagccuuucaauguuuucugccuuuuccuuuaaauaaacuggcucuggcuccuuccaucugguuccccuuccgucagcaacccugcaccuguucacaccuccucuccuguuggauuccacugaacauuuccuccucugccagggcuauucuggcacucgcaaccuuucugucauucaauccaucugucagaagugaacuuuguuuaccgcaagcuucugcuuucuucuucaagaagcaaagccccucaaggucauugucaaaugaacugucggcauggauuuaaauccucuacugcuaaccagcagaagaugaaguucuguuguguaauguacuugugaaaauuacuuuuggguucaggaagacaauaauuuggagucaaaguaguaagacaugguguuuuaaugaucauuuguaaaaccagacagcugauauguauuuucuucaugugugucugcacuucucauuauacugaguaugaacuauaugucuaagaagcaaaauaaaaguuuuaaagugaaaucaaaauaucauaaacaaguuuacacuauauaaaaauugcaucauacuauauagcauuaacuugaggaauaaauauuuucacuaaugaauuagccaagggagagaguauuccaauuaagaaauuuuacacugaaaggcuuaaaauguacaaauauguaccauuucaauuauaagcuauauauuaacacacagcuccauuacugcuuugaaaaacuuaacccauaauauacaaaucaaugcauguauauuauaaauuccaucauuuaaaaaacaaaguucuguuucacuaauguucaaauauaugcugccaagcaaacacauaaucuaucuaaagaaauguaaguuguaucaauagucuaguucugugaaaaaaauaaacucauagaaauuaggugaaaauuauacucucaauugaauuuauuuuguggcaucuauagcuaucaaguauuuacucucccuucauaaaucagacaugaaaucacucuauguugaauuauuuacugguauuuuagauaucauauucuuuaggaaaagggcaaaccaaugacucaauucaaauuucuuauaagaaaauggaagaucauuuuuuaggagaaaauauauggcaaaaaaguaacacuguuacaaaugugaacuuaaacgugaaccuaaauggcacuucauucauaaggcugcuuuuauauuuugaaggauuaucccaaaauuuaaucuuauggcagaugcuuguaucaaguaaaaucaaucaagucuguaaaauuuucuaaauuuuuagaaaaaauaaaaauuaaauauuucuuauugauauaaaauugaaugucaaauuuauuaacaaaagcaguggagaaaacguggaauuuaaaauuuaaaucuuaaaguucugacugauuaaacaguuauaauuuaugaaaaggauuuuaucaaagcaguuuuucagacauauuuuuaaaaauugugaggcuaaauuaaaaacagaaacaaaaucaaaaagauagguuaaaaucuaaguacugagacaugcuucuuagcuauaauuucaauuuuauugcugaccuucaaaauacccagugucauauaaaucauucucauguaauauauaauguaauuuaauguauggauuuucuacucaaaauaugaauucuaggagguguuuucuucuucaucuuccuaaaacauccuuucuaaauaauuucucuucauguggaggaaauuucaaaaauauugauuaaguuuucccagcaaguuuguuacugcuuuucuggauauuuuuccuuuaguguaaucugugcuugacaguacuuuggucaccuggaucccugcuucugaauagcagugaaacaauccugguaauuugaucacuuccauggucugauuugcuguauaaaagaaagaagcauuugcaagaugcuaguuuaauagaggcugcuuaaaucaccgugaaggaacucuucacucugaguaaacugcguuucaaaaacacacuaguagccuucuuuuggauaauuuguaugauacgaacauaaacaaaugaaaagcacucaguuuuaacaucacuuccagucacacacagacacguaaaugcgauacacacauacacuuuuccauaaacacgcaagaaaaagaaacgggaaacgaaaucauuacuuuuauaaauggacuaauucaggaacucagagaacaccguuaauauuuaccugcuuaaugcgucauugcuuaucuuaucuuucaaacagaaaaacuaggaaaaaguuuagauaguuugauacuaacaccugaaacacaaauuuuacaggggaaaaaaaaaaaacagaaaaagaggcauugaagcaauguugccagguuacacuaccgaagaguaaagccguuucuaagggcgcugcuaggugaaggcgaagagcugaugucacucacauucuuuaauaaucaguuuuccuaaaacagcauauggacguaggauggaagguaaaauauuuaaacuccuuaauaaagaacugaccuuaauuuaucuacauucugaaugagacuugcaguucuguuuuucuaagaacuguaaaugaugaaaauacuguaauuuucucugguuuauuuguuuuucugccuauauauuuaugaagucuuuuaacgacagaggauauucauuuuuccacccccuuccucaauuaccuuaaggcaagaccuucuuucagauguggaaauauuuucagggcugcaggacaaagaacugggauauuuucauagaguugaucaagggggaaaaugaauuugcgagauucuguuaagaguaagaagagacuaaaugacaacuuuaaaucugccacaaucauuuacuaaugugcugcuauaucaaauaagucuaauuuuuugacagcaccaaauuagauuuauugcagaaacugcugcauaaauagcauauggcuauguuauaccaccuauuucaaauccuguaauguuucccccucccccuccaaaaugaauaaauugagccaaguuauaaaccuucugcaaaaaaaagaaauagacaaguucaaaagcagauguaggagaucuggauuucuuuguuaaagucgucguuuuaauacaaacgucccaacucuauacuucaagaaccacgacuacuuaauaaguuaucaaauuuuaacaggucaguuuucucuuuuauuugcagaaugaguugguuugauuuuugucuuaagguuuuuggcucugaauuaugcuuauauuuugauguucaacccacaguuacaugggggaaaaaagaagggcaagugacucugaaucaaacacagcuuaaaugagcuuaugaaaaauuauuaaguagaaaugccuguaucacaugguugcuuuuaguuuuucauuuugugaaagacauaugugguagaaagcauauaaaaaaaaucuuuucuaauuuuaacuauagccuugauacugcaaacuuuuugaugcauaaaauguauaaagugaucauuccaugugccacacuguauacauuagauugccagaaccauacaaacagcaaaaaucaagguuccaugguagcuggaacugaaaacucacaggacaaauucagagauggacaauucuuccuuucucagucacuaucccaaugcccacccccacccuccaaguuugacacaauucaacucaauuuuccuuuuugaacaaaguuucaguucuucuguagaugggaaagacauugcaaggucuuaucucagaccaaugggcacaccacugcaaacaucauggcacucggcuaccccgcagacucccucucuguggucagucuucccagcugcccuaucuguuacugucugauuaguucugcuaaggagccccuccccugccagcuuucggugccaucuguucuacacaagauggcugcugcccagcaaccuaacacugcccuccuaccuggcacccggcuaccauccuuaccccaaagugcuaacacagguucucacugcuggcagagucaggauuucauuacuacuacuuugacaagugcaggguuguuuguaauuucucuuuuauccugauuuugauuguacaaccaccucccacugauucaguuugcuucaguuuuguugcucacagauuuuacucuccacauuaaucucccucuggcauguuacugcaucuguucccuuuuuuauuauuaauuuucaaauucccaccauuuuugacaaaaaggagguaaucuacacucuguuucugcccauuucauuuucuuuaauuuggaagauaaguaugaaagcaugccaaagaaguuaauucuccguuaacaguuuauuugcuggcaucccucagccuuuguacaugaaaaacagauaggaauaaauguugacugaaucacagcaacauagucccaaccauuccugcauuuaaugaaaagcaaacauaugaaacggcaucuaaaaaguugauuaguuacgugaguugucgcaugcugccauucuuuuucccacuuuuaacagauaauucuuugugcaaaucaguuugaguguaggaucugaauuuggguuccuccacaguucugaucugggcucgauuuucacuguagauggauuuuauuauuccuuaauaucauuaucaucuuuccucaaaccaaacguuguuaacuaauucaauagugaaugauuccgaacaaaugccugacuucggaaauaggcuaagaauagagaacugccaucacuguaacaaagcagaacuuacagagccccuagggcacagagcugcuuccauuagauauuguuuugacaaagaguugauaucaggaauggcaagauaguuugccuucuaaagacaaagaggaucauuuaagauguagaaagaacaauauauuacucugugccccaaauagccuugccauaaagagcuucagucagguggucaugcccuuaauugcucuaaaguuuucuagacggaucaauacacugacuacucauuaauuuauuuuaccugaacucauauuaaaaucauuggaguaccugaauagauaagccucagauuuacaaaacgcugaaugaguuaaaaugauuuugcauacucauauauauccucauaaaaucacaguuaaggucuguaggaaaucaaguacaauaggggauuuuccccaaggugacaaaaaauaaucagaaauagaacuaggacgacugucaagcucaagcaacguccagccuggugagccacacuucagaugagcuaccaggcaaaggccuggugagccacacuucagaugagcuacugggcaaagggcaaauccggaacacugcccaaaccacugcccaaacccacucugaaugcuucaccuugaccgccuaccacccccaccuccugcacacauuccaauagugacuugcucuuuauuuuguuuaccucuuuuguucauaugguucuaaugguuauuuccucaacacuggguucauucuuuugguaaaucuccuggucaggaauaggcuucuugaaguuagauacaggaaaggugucaaagggaugcccugcuuauucacuggugcccacccuggggaaggaaucccuuugauauucugaaaaccaagcagccuguggcucucucucucuacccuccauggcuuggucaaggcaggagaugcucagcccuaucacaggugacccugccugcuggggagaggccacacagagccaagguggagcacacucuuagcucagcuagauggcaagcugcuuccaaacauuuucugaccuguuuggugccuacucucaucucccgagacugacugcauccuuugcuugguggcucuaacagaguugcagcauaauaaaaauguguuuacuugaagugggcccuggucucccaugagacauggcuugggagagggcacugaggagacugaauauucccuaagccucuuacuugcucaggauccuuaaaaugagcuuuaauuccaagauuuaucaaucaacaaaucacgauguacuuuguggguaucacggaaacauuaaauaacaaggcaguaaugccuaacaacugauguaaagaacacauucacuaggaggagguguuuaagaagaaacuaaauaucaaaggcgggcacaguggcacgcacaugucaucccagcuacuugaaaggcucaggagggaguuccgcuugagcccaggaguuugaagccaggcugggcaauacagcgagacugugccucuaaaaauauauauaaaagaaugugaauuaauuuuagaaauuuaccggaagaaauuaaacaucaaggugaugggcuuuuguuauauuccuuuuacuuuaaaaauaauauuggagagcagaacuuucuuuuagagacauacucuggcuuagggcuacuaugagaacaauucuauguuuuugcuuuuucuuuccuauuuucauugaaccugaugcucauuguuguugagucaggcaaguggugugggcaauacauucucgguuuccucugggcuucuucaggaaaugaguuggcugccgcugccaccaugcuccaggcugugggccuauguggcaggggagaugagugcauccccaguggagauuuucauugcauucacauuugggcuucacagaacugagaggagcgagccagggaacguuaagcagaaccugcaaacacacauuuccuggcacugccugacuuucgaaccucucccgccccgggccacacugagaccaggguucuuagcccuucaaacagguggagcagagcaggcucaggcagugugguguccaccagagcaaaaugaaaugccuuuucuuuucuggcuuucugacagccuguuuucucugauacugggugggggaaggaaaagaggacgcaauuuaaaacagcaccaaggccaucuauuucaagccuugaagauguugguugcacauauauccauuuaaaauuauuuuugacacauucucugcuuaauuuauucaugaaaggaguacaagaaaaaaaugagcuuaacuuugaaauggaaacuuuaggcuaaaaauucuugaauaaaacucaggaggaaaaaaaagauaaaguucacuguaaaauagcaagaauauacaucaauguuauaauauccucuucaaauaaacagauaaugaguuuggcuuuuugaccuaagcuuguuguuaucuuaagaugaguuccccccaacuuuuuguuuuaauuuucccaauaauaaagagcaaagggaacuuuacucaauguuuauagaaaaucugcuaaacacccagugccugacuuggugcugggggcacagagaugaaagagaccugcuuccuggucugggugcugagauuuuacaacaccaaaaguguuucuaucucaguuugaaacaagcuuuugcccuucauccccugccuacucuccucccuccuggaugcccaaccucaagcuuccccuucggaggcucggcuuccucaucuauaaaggacuguuuuuucuuaggcuugcuggaagcagugagaagcauagcaucucaagcuucuugugguaaaugaucagcauauuuguuuuaauuucuaaucuuuugcaaauaguuuuuuaaaacacaauaaaaaugaauuacuagaaaaaaauuuaaaagauacucccccaaaaaaagcucauugaucaugcgcuugaaaauugugacaauuuaaaauugauauaaaauuugccaaauacuucuguagauuccgguacuuaucuugccauagacacuaacaagcagccaucaugggccacagcuggaacagcacuaugcagaaaccaagcacaauacaugugcaugcuagagauuuagcugugcuucuuucuuuuuauauucuaagaguuuucuaaguaaaacaacaaagagacccuguuguugugaagaacugaugaugccucuuuggacuuaucacauguugacaauggagaauaucauuuuccaacauacauggacaaaaaugugcacuucacuccccucucuccacuugaaaccauuucuuagaggaaaaaucaggacuugcauuuuuauuuauuauuuuuuuuuugggggggggaggggggacagagucucgcucugucgcccaggcuggagugcgauggcaaucaaagcucacuguagccuuaaacucccaggcucaagcagucuucccaaguagccaggacuacaggcacgcaccaccacguagccucccaaauagccaggacucaggcacgcaccaccacguagccucccaaauagccaggacucaggcacgcaccaccacguagcuucccaaauagccaggacucaggcacgcaccaccacguagccucccaaauaaccaggacucaggcaugcaccaccauguagccucccaaauagccaggacccaggcacgcaccaccacguagccucccaaguagccaggacccaggcgcgcaccaccauguagccucccaaauagcuaggacuacaggcaugcacaaccaugccuggcuaauuuuuuaauuuuuuuuuuuuuuuuuugguagagcuggggucucauuauguugcucagacuggucuugaccuccuggccucaagugauccucccaccuuggccucccaaggugcugggauuacaggcaugagccauggcaccugaccagggauuauauuuuuaaaaagacaacaagggcaacagugcagauacuugguguuuuacucacccaggaucccugacaccuuuccccuaguaagagcacuuccccuuacuuagugaaacuuucuucccuuauuccaugugguucugaagaggcuaccagccacagcacccaaaagugcgugugugugcccaagggugauccuaaccaaagguuuugaaauuggaagugaaggagcuaggaagucacauucuuacaguuugaaaucaaagguauuuccuuuaucaucaauuucagaaugaaagauguuuuacuucaugguaugaaagaaucugaaagaauuagcaaaauucagauagaaauugagcccuguucuggaaaguuagaauaugauagcaugcuggcuccaggaaacccugaguccagcugcaccuggauuguacauggucuaguuauaaaaauuuaucaauuucuccuuuuuggauuucaguucacccaaaaaguccugacucguauggauaggcugggaggucaaacaauuaauuucaagaaaauaucuguacuagaggccgggcacaguggcucacaccuguaauccuagcacuuugggaggcuaaggcaggcagaucaccagaggucaggaguuugagaccagucuggccaacauggugaaaccccgucucuacuaaaaauacaaaaauuagccaggcaugguggugccuaccuguaaucccagcuacuugggagggugagacacgagaauugcuuggaccugggaggcagagguuguagugagccaagaccacaccacugcacugcaggcugggcaacagagcaagacucuugcuucaaauuaaagaaacaaauaaguaacuguacuaguuacuauguggaaacugaaagcccuggaaaggcagccucuaucacucuccccacaugaucuauccaucauaacagguuaaccuagugacuccucugcuguacccuuuucucacuuucaaaaagacacaaauccuauaggucaaguugcugucucucuaggucacaggucagaucuucccaucuggaucacaaaaguaggucacaguauaauaccuguuugguggacucucacuuagauuccugcucugagaaauucuuugaaguacauacauauuauuaaaaagaucauuuauguaaaaggagaaauaagaauuuuuaagguuuuguacuuagggcaauccgaguucuaaauucucuggauaauaaacaaaagaaagcuuccugcaguaguuccccucaagaucagauacaagaaaaaaaaaaugcaggauuuaaaaaaauguguuucaguacaugggcaaaagguauggaaaagaaugucucaguaagcaguuaauaagaaucacauaaacgguaagaagugguugcuuuauucagccauaucguaaauuaacccaaccacguguguauaaaugguagucauaugagcggcauaagccaccgccccuggccuaagaugaauacauucuuaaccuccgaggugauaccuauagcucuuuacagauauuuggacaugucaaaaauaaauacuugaaaaauuucuacuuuuuaauaaaagccucucuuucuucuugggugaaaauuaaguaagggaguaaaguagaaugacaauggcauuauaauauguuuaaaugacaauggcaaauaaugggccaagggaaacuauguuucuuaggaaaaauucaagccaaaauucaccgucacgugucaugcauaagggagcagcuaacacuucuuuccuuucuuucuuucucucucucucucucucucucacuuucuuucuuuuuugagauggagucucgcucugucacccaggcuggagugcaguggcgcaaucucggcucacuguaaccuccacuucccggguucaagagauucuccugccucagccuccugaguagcugggacuacggacgugugccaucaugcccagcuaauuuuuuguauuuuuacuggagacggguuuuuaccauguuagccaggauggucuugaucuccugaccucgugauccgccugucucggccucccaaagugcugggauuacuccugaccucucgcgaucugccugccuuagccucccaaagugcuaggauuacaggcgugagccaccgcgcccggccggaagaagcuaacauuuauuucuauuauaaauucauguuacugauuuucuaaguugucuuuuucagaacaacugcauuaauccauuucucuaguaauuuacauagaauuacagcuuaauggauaaggguacaagcuuugcaggcaacuuacugggguucaaaaccugcuucgauaacauaucagcuguguaaccuuagaagacuccuuuccuucucugugccuuaguugccucagcuguaaauuacagaaaauaggagucuguaccuuauagagcuauugguaggauuauaugagaagcucucagcuugguuccuggaacagcaggggcucagcaaauguuagccacugcuguuagcuauaacucuauuauuuuuuaaagagcugcuacauguagcgugguaccacgcagauacuaagacgaauauauuguuguugguggugguguuuuugagauggagcuucacucuuguugcccagucuggaguacaauggugcaaacucagcucacugcaaccucugccucccgggcucaagugauucuugagccucggccucccgaguagcugggauuacaggcuugcaacaccaugccuggcuaauuuuguauuuuuaguacagaugggguuucuccauguuggucaggcuggucucgaacuccugaccucaggugauccgcccgccucggccucccaaagugcugggauuacaggcaugagccaccgugcccggccuaagaugaauauauucuuaaccuccgaggugauacuuguuaggugucuguuugaucgcuguguguacuguauuuaacuuacucuuauacauacaugcacaccucccaaauaccaucgauuccccuacacggaaugcccuucauucccauuuuccuauauccaaauccuaccaaaaucaguaagaaguaaucugucucucccccuguaauccuuuucuagaaccucccuucuggaucuuaucauuuaucuuaccgacuacauguguauguucuuuuucuuacuuuuuucuuuaauuuuagagacaaggucuugcucuguugcccaggcuggagugcagcagugccaucacagcucacugcagccuugaccuccugggcucaagccauccucccaccucagccuccagagcagcugggacuauaggcgcgcaccaccaugcccagcuaauguuuguauuuuuuguggagaugggguuucgccacguugcccaggcuggucucaaacuccuggggcucaagugaccugcccgccucagccucccaaaguccugggauuacaggugugagccaccacacccgaucuacucauguauuuucuucucuuccccgcuagccuguaagcuucugaagggcagcagcugaggccucuuuaucuuucuaucucccuucaucccuagcacagcgucuuaugacagaaaaugcuccauguagaacgggugaauaaauggaugaacauuuuuaaauguaccugaaagucuguuauggaaaaagaagaaguuguuugaauaauauuaacaguaauaacuggaagaaagcagccuugcuuuguuuucauacaugcuaggcuagacguguuuagugaacaugcuuacgaggcacuuguuucaaauacugucauuuuuuuuucccccagagaugcggucaugcuauguuacccaggauggccuugaacuccugggcucaagcgacccuccuaccucagccucccaaguuucugggacugcaggugugcaccacaguacauggcuuccacugucaucuuuuaauuaugcggaacucuaguuuaagagugagugugugugugugugugugugugugguuuuuaaacacguacauguaagugagaggccuggugcacuuuacuaaaccuacuugcauuguuuguuagaaugauuaucauuugauucugauauacuuaaacauauauauuuacacaaaguuaaaaauuuaaaaaagugauuauuacaaaaucauaauauaguaucauagagacaaguaaaauucucaauaaaaaauuuuagccuuaucaccuucuuauacuuuguacucugauauuugugagaagauauuuauuuguauagcaguacugagcuugaaagaauagucauacauuuggaauacagucaccauuuucauuaaugacuuacugagcuccaacucugcaaagugaugagccaggggcucugagaaauauaauacugauaagaccucuccuccuacuugaagaauaacacauuccagaagcaaaaaauagcaaguacacaaaaaacuuccaaauauuaauucuuuuuuuuuccacauuuugcuuuuuccuccuuugaguaauucauuuacucaaaugccaucagcucaaagugggaagaaggauucaaggggagaagcgcuccuuucugacaagaaucaauggggaggccuagguagaaaaaucaggauuucagggagaccuugguaagaagguaagauuauaauagagcuagagaaggucagagggguauucuagguauagagaacagcaaauggagggaaaaaggggagcuauguguacugacauuugucuggaaaucagcagguaagaggguuucaucuuagaugaaauaagacuggaagguugagagccuaucaggaugaccucacaugccauguugucauuugccuuucucuaauagaguggcaccauggaagguuuucagaguauagcaacagagucaaggcagaggcuuaugaauauucaccgggcaauggucagcaaaagagacuggaaggguguugagacaauuuugauaaccuuugugagaggucagcagaaccuaaguuacaaugaauuuaaguggugggucugaaggucauuucaaugaacuuucugaaguucaaacuaaggaaauaccuuaaacaaaagaucauccaagcaauuuaaaugccuaauguccagauauaggaacuuaauaauggguugucuuaaaucauuauuagaaucauugauuaucagaacuggaaggaaacuuauaaaucaucuagccucaccucauuuuauagguacauaagcaggcccaaagaguuaaguaauuugucaaaaguugcaaagaaugccuggagugaaugccuacagaagauacuauaauucagguuucuucaauccuaggcugucuggggaccuccccuaagaaaaguauaugguuuuaauuguuacugcccccugaaaauacucuucgaaucauucuucuuuauucuuuucuuauauauucgaagaccccauuucagucuuaucggcugguggcuguucuuccauuguucuuuaaaacaugauccuuucuaugugcuuuuaaccacucccuuagcuacaaugaauaccuuuauguaaaagggauccagaucuaagccucuagucaugaccuucuccucacaccaagccaacauuggacaucuccacugggguugcacaaugaaaaguauucuuuuccucugcuaccucuuuuaaguuccucaguuggcuuaacagauccucuagucaauuugggcuagaaaacuuacagucaccuuuaauuguguccucucuuauucaugacuccaaauaccuucugaagauacuacuuccuuuccacuucacgggacagccacagccaagggcuucauuacucucccccuggacuauggugcuuauauucuaacuggggucccugccagucaucucuucucaacccauccauuuuucacaaagcucuucaauuaccuucuuuaaauacauauuugaaucugucauuauucaagcccucuugacuucuuacuugaacuaaacagccuccugaggaguugguacacuuuucuguaaagggacagauaguagauauuuuaggcuuugaggaccauauucaacucaagugugguagugccauacauaauaaaugaaggauaaugguagcauuuuccaaucaaacuuuauuuauagauguauaaucuuuaugugucaaaaaauauuguuuccccuuuuuuucauccacuuaaaaauauaaaaaccauucuuaguuaauggucacacaaaaacagaugaugggucagacuugacccauggguugcaauugcugaccuugggcuaacuggucuuccugucuccuagaucaacucucaaagcucacuuuccacacugcucucugaguccagcucccaacccagaaagucaaucauguugacgcuccugccuaaaaugcauuaagaguaacucagaaugggcgaaacuccggagauggcccauaaggcucuucugcuggucccugcuccccuuuccagucuuaucuccuaccaaacaccuaaucugauaguagaguuucuguuuucucccaucuuuaugucucuguauauauuggucucucuaccugggguacccaacccacuuucuuccacuuucagaauucuuacucaugaacucacuaaucaagauugcugccaaauaucuccaccucccugacuaucccuuuucacugucagcuuucccugauaucagcuuucuuugacuaucgccuucaccuaugguguagaaugggccaaucccccucccuaugugcuccugugguaaucaucacuuuuaucauugcacuguugucacagucuauuacauuugcauauacagauguagcuucuuuacuagaguaugcgcaaucuaaggguagaaacugaguuuuauuuuuucucucuaugccuaggaccaagcaaaguacuuaaaacauaguaggugcucaguaaauauuuguugacuaagugaauguuacacucacccauuuggguccuuuaauuaaugcuaaauuucuauuuuccauuuuuuuuuuuuagagacagggucuuacucugucacccaaguuggaguguagcggcgcaaucacagcucacagcaggcuugaaccucagaguucaagugauccuccauccucagccuccuaaauagcugggucuauaggugcaccaccaugccugacuaauauuuuuuguuuuuuuguagagauggggucucauuguguugcucaggaugaucacgaacucuuagccucaagugauuccccugucuuggccucccacaguguuggaaugacaggugugagcacugcgccuggccucuauuuaccguuuuaaaaucccauaaggagaaacaccaaaaaagugguaggcuauuuuucuuuuagguugauguacagaucucuacuacaguuuuuaaauuuucuuugccucuaaagauuuggauccuuauuucaucauuacuuuaaacacgguuuucauauucaauuuuaaacuuuguuuagaauaugccauuugaaguguuuaaguugagacugugugguaagguguuaucugcgugggaguuauguauuucagcugaucuacacugaaaaagaacgacacaacauuucucagucacacaccugaguauacugaaucaauaaaguauggugagggguggcaaacuucaaaaaaaaaccaaaaaaacaaaaaaguacuauauaucagaaauagcccaacaaccaaaucacauugucagugcaaaggggagauauacacaguuccuugcauuucuaauugucaucuuuaaauuuaugaauguggauuuuauaaaacaugaauauagacuaagcauaaaaugcuuacaaaagaguaccgcacuuagaaaauaauuuuuauuuccuguaaaacuacguuuaaauuuuaguagaauugguuuaaauaaagcucaacaaaaaaaaaaagcuuucuauggaaccaagcaaaaccguuuuucuuaagaacaaaggaauuaguuaccacucguccauuuucagcaguugcugcaucuuaauaugcucuacuugcaagaaauugaucuugucaaacacuauaaauugauacuauacgggaaaacucucuacggacuuugacuucagaaauuaacucucugaauaagacagaauggcaaaaggggcaaaaccagcauuaauauuuauuuacugaagcucagccacacugagacauuaaaagcuguccuauuucugagguuuagcagugcuuagcacacaaaugguugguucugaauagaagucugacagaaaagaaaaacuauuaacauuaccaugaugaagcuaaauucugaaacuucuaagauuaaauagccacaggaauuaugcuaacguuauguucucaguucuacaaugacaauaguuuaaaugagcauuaaaagaacaguuauuauucugcaauauuaagcaauuuuuuucucauauauguguuucaucuauuaggauuuuuuucuagauaccagacauguauuaauaauuuauuuucuuucuuugcuuucucuuucuuuccucuuucuuuuauuguuuaaaagggaagaugucaaaucauuuggaauauuaucauaacaaaauguuuuauacaagguuugauuuuaacagaaccagaggcaucuuaacacucacccaaaacuuugggagguucaccaaccucuagaauauuuuuuucuccaaacgcaggcuguucaaguggugcuuuucuccaucuguuagcauaccgugcucagaauuacauugucauauuuaauguaaaagggaucaguccccuuucauaguuuaaauucaacauauuacuaugauuggaagaccaauguuuuucuaauuuauaaaccaaaccaaauaucaugaacuuacauguuuauuuaaacaaaguucucucuaaaaacugaaaaacuuuaagaacugagcaaccccaaaggcuugaugugaacacugcaaaaucguaauaaaacucaaagugaaaagaaaccacauaugauaaagugaaauaucuacuuucucuuuugaauuuuucuuuccauguguguauuuauguguguguguauguguguguauguuuuuuuccaaugcagcaaauucacaaugcuuacaaccuaaagagucuuacuguaauuuagggccgagcuacauauuuacuaaaguugaugacaaugaugaucacaucacaaaaucucaugauggaaaugaaguaauuugaaaccucaaugguguaagccugguuauaauaaugauuugaacaugagcagugccaaucuauuucaucucaaaauuuuacaccuccuuaggaugcagauuccuuauuuuguaucaguuccauuucaauuugcaucuuacaauuuauuuacuuugucucucucaccacugacaguauuuuauuauuuuccuaaaugaauuccucacauccuucaguucaagauuuuuauuagacguagaauuagcagaagagguaguaguggugguaggagaaauaugucauuucgcuuauauugauagagaaucaccuaaauauuugagcauuguagaugaaagguuuuguaaucuaucaguaauucccugccacacuuaucauucacaugucuggguguuuugcuuaccacaucuccacuuuucuuaauaugccugaaagcuaagugugaauugaaugacuaagacuaacucuaacaacuguuuggaagccuguggcaaaaaucaguggaaugaaaucggugcuauggcgcauaaugggauuagggaguaccuggugaggugcaguuggugcucagauucgcccagcaguucuguuagucucaggcacuccucucuggccagggcugccuucugcugcuccuguuccaaguguuguuugcuuucauccaguucuauucucaauuucucuauuuccuuagguagagagaaggggaaaaagcauccauauaaaauacaugcacuugaauucaaaauuagcucauuuuuauuuuuugccaugaauuucaauuugauaaaaaauuauuagaaaauuuaggcuagcuuccauuuuaugacaaaaggaauuagcacauccaaaaaugcacaugaaugagguuuuauuuuggauuguaaaaugaaaucuaauuuuaaaaaugaaaugauuaaaugagaguagucaaaguggauaauugcacuuucauucuaagagucguucccuuuaaaaaguaauauuuacuuaaaauaccacugccuuuaaaaaguaacauuuuugugugagauucaaucagacacaugcagugauuuacaucaaguauguacuuuuuauucuaaaagauaaauuuauggcuucauuuggguguuucaaaacccaaauuaaagguaaaauaaauaagagagauuuucgaaaaaugugagguguaaaaaauggcaugauuaugauguucaauauuacuuggaaaaaauaauccaggaaaaaaaaaagcaugagaaauuuaagcauugagaguguaugagauuucugagcuaaaauaauauuuccauuuaaauuugcaauuuaaaaagucaacaagaacacucuaagacaaauaugaauauauaaaauuuaugaagguuuauuuuuugguuucgggaugaaauuauccuuaucuuacugaaacucaaauauuucaaagcaaaaauaucuuauauaggccauaauuuuaaauaauuuauauauuaaaguagaaauauuuauuuaucaauagaacaucuguaaaauuaagccaaagaaaauaaaagaugaaccuuuaaaaauauuuaggcuauuaaaacaagaaaaaaaaaaagaaagggcagaaacauuuucaaauucagcagaaagcaagaagcaaauuugauacagaaaaaauugcaaccuccuuuuggaaaacaaaaucauguguaaguagagggauuuaaauuuaguauuuaaauaaacuuccaaauuuccucauguccuuauucaauauucugaacaaucuccaacuacauuugauacaucauggaagauaaauuaaauaauucauuuacauuuuuucuugaauucauaacaguauaaauauucaguuuaucuccaucaaaaccauacauuaaccaacaauauaauaacuuaguacaguucucaaauauuggcuuauuugaaaaacugugaaauaauuguaucauuuucauucacuguagauuuucuguaucuuucaaauuggaauacuaaguuaaacugacuuauuucuuuaaaauacuguguuauuaaaguuauacccauauauuuccaauuucauaauuaaauauaauuaaagagauaaaaauaauaaagacuauuaaauuuguauuguuuaacauuuauaaaauuaacaaaagcaaagaaauacagaauuggaauuauagguuaacuuuaaaacuucaaaaauuuauucauuaauuuucuuacacaguccuauauguaagaaacuauacuaaauaauaugaugaauucagaguucccaucucuaaacucaguaguuaauaauucaucuggguaaaugagacauagauacacaagaagacuaucaaaaugcaaagcauauaaaaacaccaacugaguuauagagaaaauucaugccucaguagccagaugagggauauauuagcaugagcaagaaaagugagaaagaaguaagggcacaaaagcuccggagugauacuuuagaucacauuaugaaagcucuuuaauuguagauuaauaacgcuacauuuuucuuauagauaauagggugacauuaaugguuuaaacagguaugcaauaugacagagguugagcuugagaaaacuggaucaauguguacaaucaguuuaagguggcaaagaauggcggaagggagaccaugaaaagauaauugcaguauuccagacaugaggaguggagggacuuaaaacagaaauauaaagagaaaauggugauuuuauggaaauaaaaggagaggaaucagaagaccaaagauuacuccggaauuuugaauugagagaagacaaaagaaugacagaauagaaaauguauaaaauucaaaacuuuuuuaaaaagaaaagauacaauuuuuguaagcacuaugcaacaauaacaacauauguaccuuacacugguaauuagguuuuaaguacaaauuagcugcuuucuuuuccucauguaauaaaaagucaaggguugcguugccaaaacaguccaaacacagagguaaagaacaugggucuaacagccaacgcaaaucagggcuccagacacagcucuggcacuuuucugugaccuuggacaagucauuagacuaucauacaguuucuuccuccuaaaaucggagugauaacaagcuucuaaagcuguugugaagauuaaauuaggcuaggaauacuuagcagagugccuagcacauaguaaaaucugacuaaaagacagcaaauaucauuauuacugauuuuucccucugucuuucaagaacagcaaagugacaagaaaaaaugacccaccuaagaauauaugacuaucucuaaagaguucucaauuuaauucauaaaaguucccccuucucaaugaagcaguauuuuggugaaaacugaauaaaacuucaucuauuguaauuucaaaaugugaaaugcauuuuuguuaggaagauggaaaauuacugccugcuucugauuauccaugccagugaaagagcuuauuggugcagauaaucaaaaucaacaaauaaucuaaccagcuggaccagggcucaacacuuacucccugagucaggaaaaucugccauggcaccaaguccaaccguuagaagagaaaucucuugccagaaaugccaugcucccacuggcaggauaacccuuugccucacccaacuaggucagggcugcuucccuggcuguauauaguagcuuggggaugaaagaccaacaacagccauaggccaauuguacauuacucucaaagcacacuauuaaccugcaugucuacagugcaguuugauguggccaucuuuuggcuaacugggcaaaggcagguccagauagcuuuacaccuuaucaaaagguaucuuucaagucaugacuauaaccaccagaacaacucaaaguagaaacuguuaaaaguggucacugcaagaaaacaguacuggggaucgaauuuggaaaagggagacuugaugcuguucauuuauaucccuccacacuguaggaaguuuuuuucuuaaucaugggcauauguuaacuuucuuuuuauuguugauuaaauuugcccaucaaaguaaugcaccuaauuuaaguuacauaguauuaaauggcucauaacaaggaacagcagugcccauggucuaccuccccgauuucaaaccuaaucuccaauggcaugcaccauuaguucuucugauguuuaucuucacauuuuuaaaagacaaacuuauacugcuauuucuuaaguuuucaauauuagaccuuucuuacgugaagaagggugacaauuuaggucucgcaccacccacccuacauacccaccucaugcucccauauaaugauuuugguuaaagcauuagucaguaguucauuuacauuauaaugauuaugaaaaauuugcucacugcugagacaagcauuaucuuguuuaaauuaauuuucuuauguaucauuuuauuauuucuagaauugucuaguuuuuuaauaguuuguuuuucuagauaacugacauuuucccccaaauauucaaacauaucuguuaaacaaucaucaauaauuuuuuuuaaaugaacauauuagauaaaguguauguucuuuuaagaacuggauauauccuucuuggcaccuuauguauggccugguugaucucuaucuucugucaagccuucccuaugcucuuuuaggguucucuguuuucugugucauaagucaucauguuucucaauuuauucccuuuuuuggucgaaguacaaucuccagguagcuuuaauaagaaaagguacacgaaaaacacauuuucgaguauucgccugccugaaaaugcuauuauuguauguguacacuugauuguuuggcuggguauaaaacucuauuuugaaauuaguuuucauucaggauuuuuaagaacuauuccacugucuucuagauccuaauaguacaacugaaaaucccuaggccauccugauucuuaguacuuggucuaugauuuacauuuuuuucuuucuggaaacuuuuacagucaucucuuuuuccuugucauuuugaaauuuugcaaugcugaaucuuggaauggagcuguuuuucauuccuugugcgcaguuuucagugaguccuuuucaaucugaaggcuuauuuuuuucaguuugaggauguuuucuucuacuauuuuaaaauauuuuaaugccauacacuuuagcuccaggacauuaguuguuggauugauuaucucauuuucuuauauuuuccaucucugucuucugauuguaacuucuggaagauuucuuugacugaugacaccucauuuugaacguuaagaaaauuuucuacccauuuuguauuucuaugagcuauuucuuguuuuuacggacacuuuuuuacauagcaugcuaauuuuaaucuaugaauauaauauuuuaccuauuagaauauacaguauuuaaauguuuuccuuugcuuauuauauguugccucaguuuccuccacauuccuuucuuguuugucugauuuggacuuuccauuauguuguagguuuuccucaaauacaggauaauacuuggcuauccuuuuauauuuaagaaugaggcaguuaauaaacguguggguuuaauaaguuuugggguaauaugauaguuuauuuagacuguuguucagcaaauauucacucccaucucccuuccacugagaguggaauaccuuaugucuccccagggacuuugggcuuagccauauaauuucauuuggccaguggaauuugcauggcuauaauguaagcaaaaaucauaaauagauuuauguuuagcucauguucuggugauuaaccaugagaaguguaugcacuggguagccgcugccccuuuggcuuagaccacagaaagaauacauggagaucagauccaaaccccaaccauggcccagacaaugcacaacccacgaccugaagcagaaacacccagucaaauacagcacagaucagccaaagcguaccugaccugcagacucauaaauauaaauauacaugauuguuggugcaagccacugaguuuugucaauauaaaauuauuacuugaaaggaauaaggaguguuacaacuauacaucaccuuagaauucuauuugauauuugaaacaacugcaugaaacauauagggcagguaucucuguuuacacauauaagaaauuuuggguugaagacauugaaaauugucuaaagcaguacacucaagccuugaaccagaucuucugacuucacugccuucaccacaucguacaauaaauuaugcaguugcuuucaaacauuuuuuuggccaagauccauaguaaaaaauccauuuuaaaucacaauucagagacacacacacauauaaauguaagaagcauuucaagaaauaauauuaacucuuacuaugugugaugugcucugacauuuccuauuccaucuuauuuuauucuacuuuuauuuuaucuuaucuuauauauauauuaagauauauauauagauagauauagauauagauauagauauagauauagauauagauauagauauagauaugguucccaaguagcugggacuacaggcaugugucaccauacccagauaauuuuuuuuuaauuguuaguagagacaaagucucgcuauauggcgcaggcuggucuugaacuccugaguucaagcaauccucccaccucagccucucaaaguguugggauuauaggcauuagccacuaugccuguccaauuccacuucuuaaaaaaaaacauuucuugcuucaaucuauaaaauugauuucacaauccuacaauuugagaagcauucuguauuucagauaauuaaaauauauuuuuuacauaaauuaaguagaaccaaauaaaaaguuucauuaaaagaaacucuacuauacauuuuuccugauuuccuaagaaaaaauauccaaagaaaugaaugcaaaaccuauuugaaaaauuauauaacaucuuaauucaaaaggauaaauuugccuggaaagaaaaagaagcauaaacuauaauaccucaaugguagugauuuauuccugcuaguaaacauuaugugacuuaaaaauuauuucgccaucuuuaauauagggugacuuguuuguguaacagaagaugagaauggggagaagaaaaauuacagaacaguaagaagacuagauccaaaaauccucgcaaguuaaaagaaggaacugguggauuugaggcugacaaauuuugacaaugugaauuuaucacucagaagccaauggaugaauucaaagaauauauuuccaaaaguaagguaguauauaauacugaaaauugaaacauauaaucuaucacuugggagaaaauaaucauuucuauaaaguucgguguguguaaaauaugaacucauuggaaauuuaguauuuacuaguucauacuuuuauuaacuuauagauguuaagauugauuuugucaaaucauuaguaaauuuuugucuagagcugcacuagcuugcuuuggcuauuuaaauuuaagcuaauuaaaauaaagaauuuaguuccuuacuugcauuaaucacaguauaagugcuugguauccacauggugauuccauggcuaccauauuggaaagugcagguauaaaauauuuucaucaucacagaaaauuuuuuggcauagcacuggucuagaauauagcaaaauuuauuucuaagacucauucuccaagcuagacacuuggggaaccagccuaugugaacaaaaggauauuauaaguagaaacucauuuuagaaacagccaaaaaugauuauccucuucacuguagcagaugcagaagguugcugauaccauucuagaaauccuguucacgguuaccauuguugauugcacauaacgcugacuucaugcuuucacuguggacuuaauaguaacacugauaccagcuaucacuuuugagugcuuaccauguaccaagcacugucuuagcauuuuauauuuuaaaauuccauucuguguucaugacaaccauauaaaaauaaguauccuauuccuguuuuacagaugagaaaacugaagcucacagauguuaaguaacuuacauaagauuauacaguggcagagcugagauucaaaacggaguuagucugauuucaaguccuauaaucuuucuacuacaccauauugucucccuaaacaauccuagauacaagagaaaauaaagaggaaaugacacagucugccuucuaaaaccucuuggccuauaaugugacauagguggaagacacaaauagcacagagacaaaggagaagauacaacccagaugacaugggucaaguaucaugcuaccaaacacaaggaucucaaugugcaaagcccugggccugguucacucugaagaagcauuucugcaggagacuuuagggcuagugacuugaagacguccugagguuuggauuugcuuagccucaagucccacugucuacaccuuuuacaacaugaugaacuccacgccagccuaagaaucaacgugcaacuuaaccuuucagccuucccaauaaaauaugcaacauuuuuguggaacuuuucaguuuuccaauugcuuccaauguggcuauuuaaucaauccuuacucuaagcaaauauucuuuaaggaauuuuaagaaacuuuuuuuuucuuugcauaauguuaacagaaguggcaucaacugaucacuuaaauucagaagcacuuccucagagcuaacguagcucucagccaaaacaaguguucaaaacagaugaaauggaacuauggcaagaaagaagugccuuucuaaaaguaugugucuaaagaagagaagaauuucagacaucugauauaaagcugacuguauuacauugcgacaauacggcagacuuuuugacuaagccaaguuuacaccacuguucugucaugccaggagauucaguggcaaaagaaucauuacaacucugcggucaguuuacaaaaaugaguucaggugauaucucuacuuuuuugggacagguuuaauaaagacuuuauguuugcuaaaaauggaaaaaaaauugcuuugcacucuuaugaauguaaguuucuaaucaucauagacaaaauaucaggccauucauuaaaucugcaauuuuuuuucuuuaaaauaauauagggccuuuucugccccuaauccuaucaugcuuuuucaguguucuaaaugaguaaaauauuaacaauguucaagguauuguaugcugacauauuugcauacauagauagagaucuugacuuuuuaugucugcugaugcuaggagcagacauaaaagguguaaaggaacauuaagauagcccuggaugagggaaaaaucugaaauaagaugugauuguuggaaagcuauaaaagagaggugaaacauuuuucaaacgaugcauugcaaaagaguuguuaggguaaugugaauaucgccaagaguaacugggagagguagauucagauuacagauugaaauggauaaagacaacccgaaauugugaguaaaaagagaugaagugaaaaaagacaauguugaaauaaauagaaaagucuuaaaauaaugaaggagucaaauauauaaaucuccuaauuguugaccacaccaguuaucaucugucaaugguguggaguuuuaaaauugucugacaauaaguuuugcauugguucaauaccagaaaauguaucaagagcugaacuauaaaagacagccaucaaucacaauguuaaaaaccuaccacuucagaagcacaccugucucuugcccagguuguauccuucauuucuuacuuuuaagguccccuguuucugcucuugaguuugauguaaauggcucucaagagaugcaaucucuuaucacccugcuaugugguacauuucauccuugucuucaaacauuaccaucauaaaaucagaugguucauaguuacugcaauaggaacauauaguagaguugcaacauguaacagaaagagauaaauggaagaaguaugggugacuccauccaccauucaacucaaugagugaaugccuuggagugagcaugaagagugagacaugacuccacugagcccuuggucggucacaguacauguguaccuuucauaguaugaccaucugacaacacuaugugguaauuucaucuaagaaacacguauauuuuucauacaaagcacaaacauugccaaacacaagucaacuuguuuaucgacuccccauuugauucaacagcaaucuaucccaacaaugaaaguaaagugauagggguuaaaaucuuugagauaggguaugaaugucuccaauguggcaggaauauauggcucuaaaugcacauaaaaucaauacagacaaauccauguagaccauuaaauuaugaggaauuuaugagauuuuuuuaaaguaauuuggucacaugcaauauucaaccuuuuaggcugaacuuggaacauaacccccuccugaaaugucacuccacugggaugaaauacacugaguuuaucuuaguaguaggauuuauuucacuggcuucacaaauaauuuuuauucuaaguuuauaaacauuccagagguugaagggacccguuauaccuuacuacacuuacuaggagaaauucauuguuuuugccuucacuugugaagauuguagauuugucccuacaaauaucaagggucugauaucacuguacagauuuugaaaguggcuuccuaauuccgcucuucccccucacucagcugggaguugacuguuuuuaguaucugacuacuggaggacuacaauguuuacuguaucuguaggaaagacaucccaggaauggugcucaaugacuuacaaacccaccuaaaugaacuaucauccaagagaauguuucuauguuuuguucagagcuguaucacaagagcuauguuaacgaagguaauaaacucaaaacauuuuggauauuuggcaguuccuuguuuugcaaagcugguaauucuauggcaucuauucuacugcacauacuauaaaaugcuauauugggacauuuaaauaugauggucuuauaauguuuguggagagaacauaacuaaaaagacuaauguagaccuauauuccuuugcuugguauacauauaaaaggaauccuuuaauaugcuaugaccacccaaauguuaugauuucuaaagaaagaaaggcucaaaaaaguaacaguuuggcccuucuuuucuuuucucuucuucuucuuuuuuuuuuuuugagacagggucucauugucuuagugucacccaggcuggugagauuacaguucacuucagccuuaaccuccccggcucaagagauucucaugccucagucucccaaguagcugggacuacacgucugugucaccaugccaggcuaauuucuguauuuuuuuuguagagacgggguuuugucauguugcccaggcuggucuugaacuccugggcucaagcgauccuccugccuugaccucccaaaguguugggauuacaggcaugagccacugugucuagccagguucuuauuuucuagaaggaaauuaugucagccauguacuugacauuccaauuuaaugaaagaaaaaaucauuuuccacuuaaaauguuaauauauaagacuaauuuuauacacauguauauuuacauauaauauuuagauauauacaucuauuuuaagauauacauauauauuauauuaauauuauacaugaaugcauauauuaaauauauguaauauauucaaguugacuuauaaugcuauuuaauaaaauagcccuuaguacauuaguaaacaaaaguaccaggaagaaacugggacuccuuccuuucuucccugagaccaagccaugaucccuuccuuggcagaaaagcagaaagagggugacuggugaagaucacccacuguuucugaggugaaagucaccaguguaaagguaccuuugaccuguguuugcuaacaaauuggcacaauuuuuuaaaauagcaacucuaaauuuacuuuauguaaaaaaaaaacuacaccuaacccugaccuaauccuucugaaagcacuucaaaaggauuuucucaugcuacacuagcuguauucaaaucaaaaauaaaccuggaguugcuucuuucaaaaugaacugcaaaaaaccaggaaaacaaucuuuucuggugggacaucuccauauaaaaaaaguagucuuuccaauggcgaauaaaaaugaaaaaucuaaaaaguauaaaagcugguagauaaaagaauuaccaaagaaaaauuaucuuuaaacaguuacccaaaaugcaggaaaacauaucacagcauaauaaaaggaauauucauuacaguuauugacuuuuauuaccauuugacaauaguuuuuuuugccaacugagaaaaaucauccaaaagcaaaaauaaaauauaauaaaauaauuccaguuuaggaaagcaaacuguuaauuuauucccuuaaacuauuccuucccaagcucucaauucaauacaauaaauauuuuugagcacauacuaugugccugcuaugugcaaugugccagacauuauacauauauauaugauccagauggccagauaauuuuauauacauguauauauaccuacauauacauaugugcacacacauauacacacuauauaugaauaauauccaagcuauuucacucuucacuuucuuuuguaacuauuaaaauauuaauugauucccuaucauuuugauaaaaaacaagugcaaguccaaugacacaucuaagguacaucauuuccuccucaaauuuacaaucaucugggcuacaguaaauaacagaaauuauuaugauacucuuauuuaguuuucauaaaaauuuacagcaggaaauuauaaguauuaauauuagggcuucaggacucaguaagugaagucuaaacaucauuuucacauuauguuguuauauuuugggcuaauuauauucacuuaugucuaaacauuaaaguuauuaauuacucaauagaguaauugcauugaaauuauauugaaauauaagauuaaaaaaacuuggucacauugcccacuacuaauuacagugguguagcuccugcaccauucccuauguguagaaauauggcuaaacacaaguaaaaaccaagacuaaauauaaaaaccacacuaaagcaauuuuaauaaauaagagaaugacaggcacuuucaaauaagauacagaugcuuucacuaucuauaaaaauaaaauaaauuuaaaugaacugaaaauauugcuauucauaaaguuauaacugauuuugccuuaagaaaacuucauaagucaauuuaaauacaagaaguuuauuauugacuucaaguuuagaaaauaucuuuuucauuauuaaauguauuuacaaugcucucagauucucaucaugagguuaaaaauacuuaaaaaccaacaaggaugccauucauaauccuaaauuaaauaaaguuuuugaaacaguuuguucaaaauugacacuauuaccuuaaaugaagagcagccuaaaggucauuucaaaauggaauuucaacaauuuucuauacuucuacauaugcuucagauggaauauuuucccagauacuaaaauuacaggaaaaucaacauacaugcaggcauacucuucaaagccaaaaauuuuucaguguagauauaaaaguauugacaacuacaaaagucacaauuuccaaagaaagcuggauaauuagucugcuacuauugccauaguaaauauaguuuuuuagauaugguaucugcuacuaaaaauuauuguguaaaagaaauuggcccauuuauucuuaaccagaacaaaaggcaauuuuuggcaaaauuauuuugucucuuagaugguguacacauuuuuauuacuuuucuacuaucacaaauuaaaacucuuauaccaaaugguacucuuacagaaacugucuagaaaauaaucaaauauucugauugcuaaagggaauauaaaaugaaacuuuuggcuuauuuuguaucuaacuuccaagacuucgauguacaguauuuacuuagcaaauacaauuucuguucuuuaaauacugugcugcuuauauuuuuuucuaaaguguacuccuaucuaaauggucccaaaaacauuugggaguaaacuucccugugaagauaaaauauuuuguuucauaaaaaacaaaauaggccuuuaggaaaaaaacaugcaguuagggacacaagacaccucagucaucaucuuaaucuaucgccucacuuuacaggugggaacgugggauccagugaaguuaaaccacucgcuaagcccacucaacuguacuagaacucaagcuccagacucuucgccgauacccauuucccuucaaauguggaauaaugccaagccacaacgcuaacucaguuacaagcauaaauaagcuucuauugguaauaauuaacuuuucaaugcaauaaagaaaacauaucgucuguuucuccucagacaacuguuaaucagcaagaacuuuuucguuuugcucuuuuauucucuuauuaguucugucaaucucugacaacuagaacaaauguaagacuuauucuuuuuuuuuaagcagcaucuuaaagccauacauacuauuucuuaauuuagaggaaaaaaaaugcauuuucuuagguuugguuuuugucaauauuacuguuugguauaggugcuaggacaaaagaaaauguuuauuuucucucaaaccaagaaaaccucaaauguuuuuccaguucaaacuaaaugauuuuguuuuauaggaaacuguauuuuaauuuuucgcuaaaugaacuucaaacaacugagaaaaggaagucauauucuuguagucuggaucacuuaauaguucagaccauggaauacagcuccucuucuugccuauacaaacacaccggcucuggcugaggucaccucucucuaccuaccuaccuacccaguuucuguuacuccuugguguaccuaauuacagagaacaucaguaugaaugcucugguucccaaauccuaaggagaguagcagagguaaagcauuacuaaaaacauaccuaaagcauucucaccuauaggcucuuacuaacauuuaugcuuggaugcaaaauauucugaccacccaaacagcaugucuguguucaacuuaccuuuaagcuguuacucugcuuguuggugacacaaaauaauuccucuuccacuggaaaacuggacaauuuaaccuuauuuuguuggaagguuuucaccaaaauuaaugacauguucuuaugugaagaggaaacagcaauuuuaacaacaaaacuagguuuauuuauagagacauaacugauugaaaaaaaaauccuucuguacugagacaugguguacgugaucucaccuuauggggaguucuuagaaaacucacuuuagcuguggguuauguaaauauuucuguaaaauucuauuugaggaacuuaagaauuuauugaacuugguuuuaacucaaaaauaaccuauauuuucuaacuaauuuuagcaagcagcaccaaaaugugaaguagauuuuuagcuaauauuuugaguguguuauuuuaaauuaacagcuuccacauacaaaggaguaaacucaucucuucaauuuauugacaauccauucuauuccuauguauguauacagcuuuucauaguuuagaaaacacuuucacauacauuacugaauuuauaugcugugauaauuagaaaacuagcaaaauuccugcuuucacccauuuucauaaagaaaaauaaaauaggcauagaacagagagauauaggguaaaugauuaggacaaaagacuuuaaaauggagaguaagucaauagaaugaauaggagaaaucucaaaaaaaugauuuuaagacucaaauuuccaauuuagcccauuuauccagguuaucuagaugaacaaaauggaauuucagacagccccauuucaauuuugaccucucauugggaguuucccaacacggguuuauauccugccaaacuacaaaucugcuccauauuuacaacggcacuuugauuucuuagccauccaugcccgauuuccucauugcccaccaucaaggcaagcuucugucacaugguucaucgguaucuaggcaagcuacuuacacacaguaggcauaaaaauaauuuuuuuauuugacuagaauuauuuugaagaaggcaauggucugguucuuaaacagaaaaauaaacaugaucugguucuuaaacaucaauuagaacaaaucacauggaagacagaacagcaaauaucaaauuacaaggaagcugcaggucauaggcucugugaugcucucugugcuauacuauuuagaccacugacuuuaaugaggaugccaccgaugugcugaucaaaugugucugugacacaaaccucagaggaagaauuuauuauggcaauauguugaaaagaggauccaagagagcucggacaagcugacacgacaggcccaaacgaaaaugaccaaguuccagacagguaaaugcaaaugucuauauucaccacccaguuguaggucagcagaugcgugccaugagggguuuuaauugaauuuuaagcucaauaagaauuuacaaugagacauauuugauaaacaauaaggcaaaugauaguuggcucugaugcuagauuaacauaagcuuaggcaauagcuccacugcuaugcacugggcaguucaaacuagcagucucauauucaguaaucaucacgacucuggaaagcaaugugauaaaaugggacacagaugggagagagaugaagguggaaaagcuaaggaucacaguauuaguaaaacuaguaauuauuaguguguauugagcaauuauuacaugucaugcauuguacuaugagguuaacauagaugaccuaaaauuuuacaaaauccuauaagguaggcauuguaucuauccucauuuuacaaagaggaaaacugaagcuugcacauuuucaguaacuuguucagauucauuggguaguggguaguaaaaugagaaauuuacuugaggcagucacuuggccaucucuucaccuaccuauccauccaguuacuguguuacuugaggcagucacuuggccaucucuugacccaccuauccauccaguuacuguguuacuugaggcagucacuuggccgucucuucacccaccuauccauccaguuacuguguuacuugaggcagucaacuggccaucucuugacccaccuauccauccaguuacuguguuacuugaggcagucacuuggccaucucuugacccaccuauccauccaguuacuguguuacuugaggcagucacuuggccaucucuucacccaccuauccauccaguuacuguguuacuugaggcagucacuuggccaucucuucacccaccuauccauccaguuacuguguuacuugaggcagucacuuggccaucucuucacccaccuauccauccaguuacugugacccuaauugcaaucagggcacuggggcacugaauacaaaagagaauaagacaaguaaaagucucuguccucaaacaaccuacauuuuaauggaagaaacugauuguuuaaaagcaaaugaacaauaaaauaauaaaaaacuuauaauaagcuccaugaaggaggggaaugaggugcugugagagaauaacagaguauacauuaguagccagugaaguagagacauugaauuggaaaccaaaagaaagaaaaagagcugguuaagcaaaggaagagugggaaagaauauauguggaagauguuuguccaaaggccauggcaugucugagaagcuaaaggcaaaccacggaggcuccacugaauggacaggggaaggguggaugagaagaggguggaaagacaggcaguggggagauuaugcagggccuuauaaacuguagaaaggaguuuggacucauguuucuaaaugcaaaugggaagccauuccaaauugcuaaauggaagagcaaugcaaugcaaugcaauucacguuuugcuuucgcaaauguguugaguaugaauaaagagggcauaacuuuaugaagcuaagguugugauaaggaaagaugauaauaaacaaaugaguaagauauggaguaaaauaaagcagaaagggggcaggaguacucggaaacugguuuacaacauaaaacaagguagucaggaaagucucacacagaugauuucagcgaugacuugaaggguuauuuugugauccacaggauaucccagagaacccggcgaagaaaagagcaaguccaaaggcucugaaguggucgugggggcagacugguuagcaccuugcuaaccagugacauaaaccugagaggaauaauuuauuauggcaauauguugaaaagaggauccaagagagcucggacaagcugacacaacaggcccaaacgaaaaugaccaaguuccagacagguaaaugcaaaugucuauauucacugcccaguuguaggucagcagaugcgugccaugagggggucacuguuugacuuugccuuugacugcuacugagguaggaaccacuggaugguuucagaagggugacaagaucagacauagguuguuuuuuguuuguuuuuuuguuuuguuuuguuuuguuuugagauggagucucacucuauugcccaggcuggagugcaguggcgcaaucccggcucaccgcaaccuccaccacccggguucaaacgauucuccugccucagccucccgaguagcugggacuauaggcaccugccaccgugccuggcuaauuuuuauauuuuuaguagagacaggguuucaccauuuuagccaggcuggucuugaacuccugaccuccugauucaccugccucggccucccaaagugcugggauuacaggagugagcuaccucaccuggcugaugaaaguuuaacagacuuucucuggcccuuaugcugugaaggggcuagaugaggagaagcagggagccccaguuaagagacuguugcuggccaggcaugggggcucacgccuguaaucccagcauuuugggaggccgaagugggcagaucacaagcucaagagaucgagacuauccuggcuaacacggugaaaccccaucucuacuaaaaauacaaauaaaaaaaaauuagccaggcauaguggcgggugccuguagucccagauacuagggaggcugaggcaggagaauggcgugaacccaggaggcagaguuugcagugagcugagaucgcgccacugcacuccagccuaggugacagagcgagacaccaucucaaaaaaaaaaaaaaaaaaagagacuguugcaauaacacagcugaagacgacaguaccuugaacuagacgguagcaguggauauaugugaagaagauauauggacagaagaaaagcaucugaaaaaaugcucaguaccauucaucacuagggaaaugaaaauuaaaaccacaaugagauaccauuauauacuuacuagaacaacuaaauauaaaaaagacugaucaaacauuuucaacacauauaacugcuaaaauaugaguaucauuauaaaaggaguuauucucaucuugauucuaaaacuuuccaucagacauagcacaacaaagacugaccuaggagugagaagcucagucaucucauuuagauacuaucacuaaguauucaagguuuguucuuagcucacuaugcauucacucaaucaacagauaaauaucugccguaggucuccucugugccgaguaccggacacacaaugaaggguaaguuaagacccugacuuuaaggaccuuacagccacuucuggcaugucauuucaguuuuguggggcucugucuuuccuuccucaucuguugcacccgcuugugcccuccagguacacacagaacagugccuuugugacucuguccuguuuuccugaauggccuucacuucccacucuuguucccuccagacugggcuaaaauaugacuuggaugauauauuuuuuuucuaaaauaacaacuuuauuaagaucauccacacaccauagaauucacccaccgaaaguauacaauugaauaguuuuuaguacauucacggaguuuaguacauucacugugaggccgccaugacuauagugcaaauggcaucuguggaauugugcagugcacagccuguagaacaguauggagcaagccuguucaucuguauuagcaaugaaaucaauuuuagagaauguggcucaaaucuauggguaaguaggcuuccaaugauugaacuucagaauuggacugacgugcuaacacucuagucaccaagaggaaggaggaaggugcuggcuaacacuccuccuccuuaguuacucuagggaauaaaucucuaccuggacaugaaguucaggacugaggaaauaaaauaguugugcaacuauuaccacaaccgauuuuagaacauuuuaucaccccaaaagaaacuccaugcccaucaggagucccucccauuuguccccaauuucagaccuggacaaucacuaaucuuucugucucuauagauuugcccauucuaaacauuucauauaaauugaaucauacaauauguugucuuuugugacuggcuucuuucaucuaacaugauguuuucaauuguaagucuaccaugcuguagaauguaucauuacuucauucuuuuuuacugccauguaauauguaucuauauacacacaccccacauuuuauuuauccauucaucaguugauagacauuugggguauuggcaguuuggggcuacuaugaauaaugcuaugaacauccguguagaaguuuuugaguagcauguuuugauuucucuugaguauagacccaggacuggaauugcugggucauaugauaucucuauguugaacauuuugagaaacugcccgaauauuuuucagccuguaugacuuuaaauucuaccagcaacuuaugggggaguuccaguuucucuacauccucaccgacacuuguuauuaucugucuuuuuuauuacacuuauccaaaguagaugugaaaugguuucucaucuugguuuugguuugcauuuuccugauagcuaaugauguugagcaucuuuucacauguuuauuaaucauuuguuaauaauauaguuauuauuaacauaucuucuuuaaaaaaagucuauucggaucuuuugcccauuuaaaaauugaggagucuuuuuauuauuaaauuguaaauguaccuuacauauccuagauacaagucucuuaucagauacaugaguuaccaaaaauuuucucccguucuguggguugucuuuuuucuugauaauguucuuuaaaggucaaaaguuuuuaauuuugaugacauucaauuuaucuauuuuuuuucuauuguucuuugugcuuuuggcaucauaccuaagaaaccauuaccuaauccaaagucacuaagauguaugccuauguuuucuucuaagaguuuucuaaguuuagcucuuacauuuagucuuucauccauuuugaguuaauuuuugucuacacuaugagguaggaacccaaguucuuucuuuuaccuguggguaucagguuuucccagcaccauuuacuguaaagucuguuugcucccuauugaguuuuaauauccuugcugaaaaucaauugacuguaaauguguaaaaucuuucuggacccucucccgccacaguaggccacacccuuugcugagcccccagcacauuuaacuuccucaccaaacuauaagaguuguuaagagcaguaaauauauuuuuauuuuucauugcaccccugugcguauuuguuugcaacacauaauagguuaucacuaauuauuaguuaaauaaauggcugcauggaaauaagguaauuacucccagcugacucacagucucaucauauacagaauggaggagguggacuaaguuauuaaagucuuucugacccuuggugcccaccaagccauugcucuuuauuaucugaagccuuuccuuccauccuuuauauguggccauugaaauaggaaagacuaaagacaaaaguuaccuucuuuuuuuuuuucuugguuuuuugagacagagucucgcucuguugcccaggcuggagugcaguggcacgaucucagcucacugcaaccuccgucucccagguucaagcgauucucuugccucagccucccagguagcugggaauacaggcaugugccaccacgccuggcuaauuuuguguauuuuuaguagagaugggauuucaccguauuagucaggauggucucgaucuccagaucucaugauccacccaccucggccucucaaagcgccgggauuacaggcauaagccaccacacccggcccaaaaguuaccuucauaaauuccauugcuauguggguaagaagcaucuucugaaaaaugccaaaguacauaaaguuauuauuauauauuauuauuacuuuucagacagggucuugcucuguugcccaggcugcagugcagugcaugaacacaauuuauugcagccuugaccuucugggugugagugauccucccaccucagccucccauguagcuggaacuacaggcacaugacaccauaccuggguaauuuuuugauuuuuuuuuucuuuuuuuuguagagauggggucacaccauguuggcuaggcuggucucaaacuccugggcucaacgauucuccugcuuugggacaccugaagugcuaagauuacgggaguaagccaccaugucuagcaugaaguuauuuucgacaaucagcagugguuguaggggaaaagggauuuucauaccaguaaugguuuuuuaaaauccauuauugugguucccuucugaaaauccugaugcauuauuauacugauggauagguggucauguuugccucuucugaguuauaguuuaaggugaaacaguauaaacaggaaaaaaaaagcccaauucuucuuaguauaaaugccuuuagaaugucuuccucuaaagucuuucccauuuucucuucccacuucccccaccacccccccgccacuacuuuucuuuucucuucuuguuuuuauaacuaaagauaauucuagcaucuuucuugcucuccuagccauugaaguaagucuaugguaugucaaauucagcauugagauacuucaaacuucagguucugcucaagaaaaaucauuaguaagucacaguaagguuauagauuaauaagauauauagaaagcuauauaucuacauauagauuuaaaaauacauacagauauuugauguauucguuagucuguguugacgccgccuuuaaaaugaaacaugucugguucuuauuauauaaaaccuugcauagcuuaauuugcuauacacauaguggaccuucaguauauuagggaagaaacacugacccuccuacaguucuacgauaaauuuaguugaaaaugacacccuaaaguuucuaaugcaaacuaggauaugacaaucaccucuccauaugagugaauucagauuucuuugcagaacauucuaagcaagcuaaagaagaauccacaccaggugcgguggcccaggccuguagucccagcacuugggaaggcagagguggagggauggcuugagcucaggaguucaaaaccagccugggcaacauagcaagacccugacucuacaaaaaaauacaaaaagaauuagccgggugugguggcaugcaccuguggucccagcuacuugggagguggaggcgggaugaucacuugaacccaggaggucaaggcugcaauaagccgagauugugccaccgcacuccagccuggacaacagaguaaaacaccaaaucccaaaauaauaauauuaaucauaaagaaagaaagaagaguccaacagaaaagguagcauuugaaauaaucuuucgaguagaacgauucuuucucuuccaucucaagaucuccuuaaaaguuuauuuuuaccucccucguuuccuuggcagccacacuuucuuuaaagauaugagcguccccucgcacuuuaaugggaauuuucaaugacagcuugacucaugaagaaaggcuaauacuacuacuuguauaauuuauuaccauggagagaggguaggggacagagagagagagagagagagagagagagaagguaucaggacuucaguuguaaguagagagauuuuauacaaagaagaauuuuccauuccuauaggaaacuccagaaauuuucagggauggcagaaggcaggccagaaauaaagacccugcagcuuucuugucuuuuuccuaaauguaaguguaacaaauccacuuaaguacagauguuaacaccaaaaagaguuaaauuaacuugaccaucuguuaagaagaguaauaugaaaacucuaaacaccuugcaacucauuaacacucaggagcagccuagaguuagaucaggaaucucuguguagggugaucugucucacacugugugucuaacacucaugaacagccuagaguuagaucaggaaucucuuuguagcguggucugucucauacugaacuccagugagggucagaaaaacaugccagggaucuguaaaaccucuaagacaauugcaaaauuguuuuugguuucauuuugauugauuuuaaaaagaacucccagagcaaaaucuuaagaugaucauauucuaggucaucuguguccagaacuaccacagcuuuucauuccaugcuugcauuuaugagggcaacaagugaaaacagaaagugaaagcauuaacuauuaauggugcguuucucuagugggaauccaccaauguauuccugaucaucauaaguucacacaccuaagaaacucuggccgaagagauuuacuuucacaggucuugcaaaagcugguuacucucgcacaauacuaccuuugacaguuugccagugccucaaaucuuuccaguagaaauuuuaauucagaguggggcuuuaauccuuguugcaaauuagaugaugucugucuuguaaguaaacuuaacucuuuacaaggcuagacauuuuauuguucuauuaccaaucauaacgaaaaugucuaaaauugcagaugacagucaaaauucauuuuuauaaucuuaacaaaagugucauguuuauaaagugaaagugaauaacuggaaaauacagaauaaaacuugaggcuccaugcaauuucuguugauuuuaugaauauuuaauucacaauuaagaggggcaaagaaauacuuccuguguuucuagaaaugcaagaauuuacagcuggagaaaacuuuugcuaccacuuguccaagcuucucacuucacugggaaauaaacugaggcucugagagguuugcucaggaaauuagcuggaaaagcuaaaucagaaagucaugacuuuguacucaugguccuuaaguaaaguaguacccuguaugaucuguguuucaccuuucaucaacagucaugugcuaauccuccacaaaucaagauaauugucaauucuuuauuucuaggaaaacaauccuauaugacucuaacacuguaaauaaaaugacauuuuauuuauguuaucugaaauuugaaaaaucuuaaaauuuuuccauuacauaaaaccuacuacaaagcaaaugaaauacauaugcauacauucccaaacgauaccaugacuucugugccugacugcagggcauacaguauauuacaaggagacaauuauauugggauucugaguguuacuaaaacccauuuucuaugagcaaucuauuacaacagagaaguggcacuugaaauaauggaggucaguuauacaaaaaugcuauggaaccaaaagacacauauguucuuggaugcacccuccuuuuucacccccauuccuuugcucaagcugccauguugaaccuucuaaccaaauaaauuucuucuucuauccgugcugggcaacauucuuuuuuuuuuuuuuuuuuuuuuuuuuuuuuuuugagauggaaucuugcucugcugcccaggcuggagugcaguggcacaaucccagcucacugcaaccuccgcuuccuggguucaagcaauucuccugccucagucucccgaguagcugggauuacaggcgcgcgccaccacacccggcuaauuuuugaauuuuuaguagaugcacgguuuuaccacguuggccaggcuggccucgaacuccugaccucaagugaucugcuugccucagccucuuaaagugcugggauuacaggcaugagccaccacggcuggcccuaggcaacauucuaaccacccugcaaggauguuaucuuuccccucccaaauucccaugccuuuugcauuuugcugauagcuacuauguucucuuugacauauauuuauuggcauaccugguuuacauacuccuuucugacagaaauugauuauagcuaaguagagugcacauaauauaugguuauugaauuaaagcaacauaugaaguuuagggcaaaagggcucuaaaucugucauaguggcuguucucaaaaucuaacuuacuaucauuuucccuuacagguauauguaaauggccacaguaaagugaucacuaugaagaauaaggagcaacacagaaaaaaugcuuaagauaauguuaaaugaaaaaagcaaaaaccaaaacuagaaucuauuuauauuugcaaauauuauagaugcauauguacaaaaaguggaagguaaaacagaaaaauaaaaacaauuuacacuguuugggugauggaacuacuggcuucuguuaaugugcuuauguuuauacaauaaauuuuuuuaaauguaugcauauguaguaauuagugauauuuauauuggauauagguacuaauauuucuggacuauaaacaaaaagaaagcauauguaguugucuuaugucuaaugucucucagcuuguugggcugcauggacacauuuaaagaacugucacuaccugguagcuaccagaacugcagaguugguaccugagaaggcacuuugcaaguuggcaguuggcugguaagucaacuuuuacagucaaaacaagcaugcaaaaaaauguucaaagaaccaaaacacaugucauccacugaaacugaaaauauagcaaacauuauauuucuucagggcacacaggaauauucuuagaguccaguuuacaguuuucuauucccauccaaaggcaaauauuuauuucuuaauguuucuccuauaaggcauauuauuucuaagaaagcuuguuuuauuuccuauuuguacucuuaucuucuaaauauaccuaaauugcuauuuucagauguguugucucugcuuauacauuugauuuuguaaaauaaauuauuauguuaaacagcauuaucaucuuuguuggaaaaucaaauaacaagcagaaauuaauagauucuuuuuuugagcauguuaauugaaaagucaguguuucuaugaaugagguauacauacccugccucagaaaacaacugccuaaaucauuaacaacgugacuaaaugcuaaaugccccaaugaucuccaacucgguauuauucacuggauugauuuggaacugcuucuuuaugcagaaaaauugaauuauauuuuuuuacugcuaauuuugugauuuuaccaacaugaugauuuuagaugaagaaaguaauuuggcacagcauuuuagaaaaauaaguucaaucaauaacuuagacuuuuauuaaaugaacauauuuuaaauuauuuguauaauccaauaaauccuacuugucccauucaagcaucauccaggacaagaacaaaagaggcugauuuauuagacauauguuaggcugaagaauuuucucagaauucuugguuaggcugcgauaagaacacaaauuucucuaaguaugcugaacaaugcuuuagggcauacuuagagaagaugcuauaaaaaagcuuuauugcaucacacacauggaaccagauucucccucucaugggcuguagccagcaugaaguucacacuacauuaauuugcacuugucgauaugcugcuuugcaaguauucuuaaggcauguucuaauguguacucugacuccucaacuagaauauaaacucccuaaggguaggaccugggucuccuaguuauuacccccacagugucuagcauacuggucuggguaagccaagcccucuggaacugcuguugucuucguagggagcagggacaagaaugugcuaagucuacagacugaaagagggugugaagaauacuggagagcaacucugucaucaccaggaccgagugauuacauguaccaaaggcaggcccaaauggccccucucccagucauuuuguagagggagaagugagacugcaggugguaguuggauaaguuucugaagucuggcucuugagaagucauccauuaucuuagcauauuccccaaaaaccuucugaaaaagaguacacagcuuuaaagacacaaagcagagaauagaacggaacaggauuuuacuuuaaucuguaagugcuagguuucaaguagaaaagacuaacacugcuguuacccacuuuuaaaagauacaacgaugucuuucuaggacgcuuccagaaucaaauagaagacuggaccucagagguccaugagcugggucuucagguaaaucauauugcugcuacuauuuaaaacuaaaacuuccagggaaaagguuccauggccuguugcagcaauuucaaucuccuuacugucagaaaauucuuguuucaggcuauugugauuuguaguugcuguaguuaaaucccuuuguucuuguucuguccauauugaagacucaaaucagguguuuaacuuuuuccuugaaauaauuugucaaauccuugaagaugugaagcaauguugaagucuucucuaaguaaaagguacaauucuucaacuuuucuuuauugcuuuuauauuucucuaacuuuaaaaaggacugacauaggccgggcgcaguggcucacgucuguaaucccagcacuuugggaggccgaggcagguggauugccugagcucaggaguucaagaccagccugggcaacacgguaaaacccugucccuacuaaaaaacaacaacaacaacaaaauagcugggggugguggcgugcucccauagucccagcuacuugggaggcugaggcaggagaauugcuagaaccugggaggcagagguugcagugaaccgagauugcaccacugcacuccagccugggcgacaguaugagacuccgucucaaaaaaaaaaagaaagaaaaaaggacugacuuuuagggcuugcaggcaggccuucuucuccuuacacaaagccauacaauauagaugcacuucuuccaacagucuaguuaauucaacugaauuuaggcgauaauuccuguguccuuacacuccauccuuaaugucaguguccaagugcugaaucacugcuguagauaugagcaacccucaaauccuuuuuugcccucauuuuuccagccaaaauuuuuggaucuauuucuuuugcagagauaccccacccugaauauuugcuuugauugcuccauuaaagucauuucaaacuugauguuuucuacucaguaguagccacaacuccaaaauuauaauuuauacaaugccgguaaaaaaaaaaaaagaaagacgcuuucuauaucagccuucuuaucucugaaaaauaaaauuggaaccaaccuaaaaacaaaauuguaaauauaaaaucauacgguauuuacacucccauccaagccacuaguaagucaugugccacuaauaagaaaaugccaugauuaucagugauacacucgcugaguaaugccauuagauuuuuaagagacuaaagauguggcacauuuguuauacugcaaaauacucuaaaaccauuguuauuauuuaagauacaugggucuucaaacucaaagcucagcauccuaguaagucagaggaaacuuaaaaaauacaguuguauuucuauacucaagguagggauuggcaacuuuuucuguaaagggucagacaguaaauauuuuaggcuuugugggcuauauggucucuaccacaacuccucaacucugcuguuguugcaggaaguagcaauaggugauacauauaugaguagguauggcugaguucuaauaaaacuuuauuuguaacauagacagcaggccagacuugaccuaugagcuguaguuggcuaacacuuuuuuaugaauacugggcacauuagcauauugaauaugcauaugugucuguauaugugaguggggauauauacacauauauuaguaugcaaaaucuccauuugcccaucccccugguuauggcaguuucuugggcacgugaucagugcagucacacaugugcuguucagaaggguccuuacacuugcaguuuaauacucuguggucaaugucuugaaauuauuagcaauuguaucuuagaauuguguuuuuuuuuuuuuguuuuguuuguuuuguuuuuauccaagacaggguuucgcucuuguugcccaggcuggagugcaguggcgugaucucggcucaccacaacguccgccuccuggguucaagcaauucuccugccucacccuccugaguagcugggauuacaggcaugugccaucauguccggcuaauuuuuuuuuuuuuuuuuuguauuuuuaguagagacgggguuucuccauauuggucaggcuggucucaaacucccgaccucaggugauccgccaccucggccucccaaagcgcugggauuacaggcgugagccaccacgcccggcuagaauuguguuuuguagguguacucugauggaacaauggagacugaacuccuguauguggucucaucuuuccacugccucacugcagcccuacgcaguucucagaaauauacuccucuccagcuuccucuaucccgcccugcccugcugcuggggugggucccuccaccuagggugggaccagggcacugggggaggugcguaugucacugggggagguguguguucuccugugucuuuugccccuggcagaauccugaauguguguuuagagaggauugagucaagugugcccaucccugccaucuuagagcuggacagggagguaagaauucccgccccaggccgggcgcgguggcucaugccuguaaucccagcacuuugggaggccgaggccggcggaucaagaggucaggagaucgagaccauccuggcuaacacggcgaaaccccgucucuacuaaaaauacaaaaaaaaaaaaaaaaaaaaauuagccgggcguggucgugggcgccuguggucccagcuacucgggaggcugaggcgggagaauggcaugaacccgggaggcggagcuugcagugagccgagaucgcgccacugcacuccagccugggcgacagagggagacuccguccuaaaaaaaaaaaaaaaagaaaaaaaaaaaaaaugcauguccagccuggguuggugagggaggaggggcaaggagagagagacugaagaagaaaggaaaauguuuuauauuuuaguucuuuuuaauaucacuucuuuccugcuuucugaacaaaaggguccuguauuuucacuuugcacugggcccuaaucaaagguuagcggcuauaaagaaucgucuucucagauuaauuuaccaaaagggaaguugacaaaaaaacucuauuucugcaucacucauuucaggucagcucauccuugucauguuagggccuccugcaacauguccaaaucuuaaauacaaggcugugaaauuaaugcugaauuugggguuucggaugcgaggaagcuccuuuugggauaugauuaucaggaaugcugcgugguagccauuuccuucacauacuuugcuguaggauuaauuuauaccucuuuagaaugacaaugaggcauuuuauaaaaauaaagcauaaucaaaacauuauguacaaaauuuaacagacaacaacaaagaaagaugaaauuuuacuaagaguucuguuuauuuccuauuaaaaaggguaacaccagaaaauuggacauacaaaaacauacuuguucuccuaauuugaauaaaccaacuguaaaaucaacauuuuugagacaaagaaaugugaauauaggcuggguguuauuugauauuaaagaaguauuguuaacauuguuagguaugauaaugacauaguauguaaaaauauccuucauagauccacauggguauuuaugaguaaaauaacauaaggucugagauccauuuaaaauacuucugcaaaagaagaaaaagagguagaggaagaagacagaagaagaugaagaugagaagguggagcagaaaaaacaugacaaagaagaugaaggugacgaugaggacagaaguagagagaaaaaagugagauagauggaauaggauugaggaggaggacuggcaaaaugaugagugauggaauaggauugaggaaggggacuggcaaaaugaugagugauggaauaggacugaggaagaggacgggcaaaaugaugaguguaggugauggaaaugugaggacucauuacaauauucccuauacccucauacauguuuuuaaauuccccugaucgaguguguguguguguauaaccauugccuaaaaaaauuucucauaaaaaucaaagagcauauuucacauucuccuccauaccaaaugccucuuuuucuggugcaagaagcauccucugaggcugacaggaauucucuaagcugaagagauacaaaggaguugaugggaaggauaauccgcccaucgguuccugacacaauauaaagaagaaaagaagaaaguggguggaagcgacugccauuguuacucuccuaaccuuuccuucuaauuaugccagagccaaggcucaggucacaaggaaaauuauuuuggugguuaaccauuugcccuauuuuguauacaucaaaaaagcuguuguucucacacauuccaaucucacaguuucccacccacuuuaaaaauguaucaaguggucagaugaacuaaaauaugaauaaaaugacuauauuaugaagaacaccuuguuugcaaaccuacagauagccugcuugugaugcugaauuguaagauacacaacacuuaaacauuuaaucuacuuuauauuauuguagguauuucagauaaaugcucaacaugccccgcuuuuaaaaguuaaauguaaauuucucucuugagugcagaugguggccaagcaaaguaguucuuuggucucacagacagaaggucaggucauggcugaaagaccaaagaacaauugcugcuuugcuacuccaaaucauccauggaaugagacaccacgacuucuuuucugaaacugucuguucaauacaaaacaguuaaaaagaguaccuauaagauuuccucacauuccgucugggaaaaaaaaaugguaacaagcacaucacuucacaacacaucacaaacaucuuguaacuguucagagguuuuauuccuaaagcugugaccuccuaaaaaggcacaucucuaucuaaaaacauaccacuaaacgucauuaugaaaacuacuauuguuucacuauuaucagaaaacguuuacaaaugaaaacugcuccuuguaaauccugcaacuuuagccuccauaccaucacggauuaauuaaaaugagauuuaauacugcaaauacuucuaauauugcaaaugcuucuaaacaaguuauuccuuuacaagugauauuauacuccuauugucccugaucuuuuuuccucuagaaaauuauaauggaauuuuaaauaacugagacucuuuccugauguauuuuugcaguuaguccaaaauauuaugcugucagaaugcuguagaauaauacgaaaggccaaaaguaugccaauauauugauuccuuuuuaaaaaauuacaauauaucaggaaagaaaaguuaucugugauaaacuuaguagaccuaggccuucagucccugacagaaagcauuuuccauuccacuaucaggcacgcccccaacuggaugcaauaaaauguuucauuauuuguacauguuaauaauuaaaagucuucugaaaauguaaaacccauuacaacaccaaauauagugguacaaaagcagaauuuuacuuugguugccaggauuuuaauuuaguacuaaggauuucaguuaugacuugaaaagcuuuuuguucuagucuucauuaucacuuucauuuucaauacuuuucccaauugucuuugcaucauuuguuguaaagacuucauuggcucaaaagagaaaauauguuggaaaauaugaugaaaaaccucgaacuagaaacauauuugaaaaaaaacuuauuuggagcgaccuacuucuaaauucuaaaacaauuauuuuaaaauauugacacuaagaacccagucuuacuauuuuaauugaauaaacaaccugcuuucauugaauacaaagaaugaaaaccuucaagguccuguacuguaacauaaaaauagaaaaucaaaagucagccuauuagaacugccucucuaaaaacuuuauccauguugucaacuaaaauuggaguuaucuacuucaucucaauaaagauauaacauaaaacaucuguucaaacugaaauuaaaguacgcagcuuuuauccacuaacauuucuaaugucacuguauuuaggcuucaugaacaaacguauucaugguuaucuuaguuaaaacugguuucacucugccaacaaucaauuugauugacauauuuacauaucaacucaucucaucuuacgaauuuuaaacuuuuucauuuaaaauuggauucaaguuggcaucuuucaagaacuuuauguauguauauuuuagguucaaacugugcauuagaacauuucuuuuuacuuuuguaaguaauagauacacauauccaaauguauauuuaugaccugucagauuggaauuuuauaugcaugcuguuguauucucaccauucaugugaaaggugauaauuuuaggcaacuauaaaagaaauuuuccuaacaguguaaacuggaucaucccauuaguuagaaacaauacaaauaaauaaauuaggaauaaaacaacaucaacuugagaaagaauguuacucauaucuauaauugcugcaauuaugcuguguccucucuuaccugaucuuuaauuucaagaucccuguuaguuuuugcucugaacucucugugcuccuuuucugccucauccuucuccauguugguuuuauucagcugauagcgcauuucuccacacaccuguuagauuguaaaaaacuggaugauuaccugcuggaaucuaccaggcaaugccugcaauuagaucuuuuggugcccccuagaggucauauagauaaaauacaacaaaacuuuucuaagaaugccauuuucuauuagacuauucaacguagcuuguuaagauucagaagcaacaccagggauuauugauucuaacaacuugaaauuacagauaaauaaaugcauaacuaaggaauuuaaguaaugugcccaagauuauuuuauauaacaguuucaauugcauauuaucaaccaaaaugcacuaucaucuaaccuuuaaauagguaaaguuaguaguuaaaauguuaagcuauguuauuauucauucacauugauacaguuaaauauucacucuauauuacaaaguuuucuuuuaaagacuucaucaguuaugcucuuuaaaaggaaauguauaaaggaauuuuugucugcugauagauauacuauugauaucuaggucuguaauauccaguauugacugcaagguuugcagaugucaucuuaucauacacaauaugagguauucaaguuaaggaagauuuucuggcaaaagccauagacuggaacuaagcacacuaugcacuuaugacuguaacauucaauauaaaaggaaaauaugcauuuaaaugaaauaauuguaauacggcaccaauaaugaacacacauaguaucuuaaaaguguuguguaucauccucuauacuuaacacuaagaacuuuguuuuauuuauuuuuucgaaucuaggacugcuacagaaauggaaauauauuugaaaaguguaauuagcagauaaaucuaaacaagcaaauuaugggccuuuugagagaacugagaaccuauagaaaguucaauuaauguacaagucagcuaaguuggcuucuaauuuacaaauauauggcucuuaauauauuaucucaccguuaugcuuucuuggaacuuuucaaguauuugguauuucuccaaaaauaaugauuuuggaaacuuuagaaaucaguuucaucauuacugagguauuagaauagacuaagguauaaaaccuauaugcauuuaagcuggguaugguagcgcaugccuguagucccaguuccucuggaggcugaggcagaaggauggcuucagcccaggagcucaggacugcaguguacugugguagugucugugaauagcuacugcacuccagccugcacaauacaacaagauccugucuccaaacaaacaaaacagaaccuuaaaaguaauuuuaaaaauaaauuaaucuauguuuaaaagcuauagugacaagacagaagaaaaagucaacaggcuucucccuaguagcccucagaaagcuagaacaauaaugaaguuauuaaaaauucuauuggaaguucaaaugccuucaaugugagagaguuuauuccuccgauuucaaaaauuauaaauuuauaaaaacuauuaauuuuaaaccuaaauaaaaauuacaaauucagagugacaggaaaaaaaugaggagccauacuuuauuuucuuucucaauuguucacuauuaauauuuaugucuaugaauaaaauggaauaaaaccccgaacugauaacaucagaagauaauaauuauacaaccaugauguuuaaaacccaacaccaauacaagcugguuauguaaaaacuguuuaagcagcaggucuuauuuaaaauuauuuuaucccuucauuucacuccuacaguucccugcuuuacuacuuucaguucagcauuugcuauguuuauccacagcacucaaauucuauuucaaauaaauuaacacauuaaauugaaccagaacuauguuaucuccacguuggaagcaacuucaaggcgauuuagucuaaucgcucuucugauguauauguccuuucagcuaguucuugagacagagaacucucucucugcuguacugauuucaacagaaagcugccucucuauuaucaacugaaaacugucuuaucauagcuuucaccuauaaaucuagguuaaguauucccauccuucugaacuaauuccuucacuuccacccuaucuccacacaaaaauuugagcuucuuaaacuucuacauuagcuaauaggaauuuuuaaaagcaaauggagaauuauagaaacucaagaaaaaggguaaaauggcucccuuuccuaauacauguuaaaauuaauuuuaauuacugaauuauagagcaacaauggcauuacaaauaugucaaaauuuaggaaaauccauugaagaauaaaagguaauaugcaaagaguauuuuaagcaaauuaucuguguuuuuagugguaaaaaauaaauugauuuuauuaguuucuuaguuuuaaagcaauuaacuauugaaaucuagauggacuucuaguauuucuuacaauauguaucuuaaucauugccaguaaagaccauuaaacauuuuaguucuugauucacgaaccagugaugcccauagcacagacaauguaguauuuuaaaguauaaauuuaagcaccaauaagaucauguaguauuagaaucuuuauuuuaaugaccaagucugaaaaggaaaaggaaguggaagauuuuuuaugucaagcacaccuuuuaaguugucaauauaugucuuuggcaauuauuguaaacaccaaccuuaugcuaucuacggcaaaaacaaagcacucuuaauuaauuuagaaaaaugagguuuaucaaauauucaauaauuaaaguaauauaacucuuauuuauuuguaagucugucucugccacuuaacccuuaagcucuucaaggccaugacuggugucuaauucauccuugcacaugcaauacccacugaggggcugcauguaguaacugaauguuugcugaguaaccauuagguggccuuuuauuauucuugaaaucacaaaacuuuucuacuccaaacuuccuccugauaacaguaagaguuuuguacauuaggaaaacauuuuucaaaggaaauauuuccuuaaguaacgauuacacuaaaaucucuuucuguaccuuugugacauccauuucccgagaagccagcuggcuuugaauuuccuccaguugauuaauagcugaaaucuuuuccuuuguaaccuuuuccaccugggccuccaguugggcaauauucugagacaagaucaacaucuguaagggaaaauaaaaguccuaaacaauaaugucauuugacaaaucaaauacuaaaacuuucuugaauuaauagcgucucagcauagucacugggcucugugagccauuucucuguggauuggguauguucauuuuucuccuuccucuauucaccuaugcccagugaacugaaauauguacuucucuccuauucauuccccugaucucuaaccucauuuugaaaaauguauaacaagaugauaaagucaagguuuugguugaaacccuaaagugacaguuaucaaacacccaauuaaguuaugaaacagagugccauaaauaaauucagaggagauacagaagcauacaacucuuaaacccuucuuccacauggaagguauaaaaggacugauggggagaguuaaggaggaaguucuuuagagagagcaacuggucugcuauggcucccacuacccuucccgcaaaccaacaaagaagaggcucugugcagugcccuuuguugguaaaaccccaaccgccccccuauuaucuaguucucccucauuucucauguagguuucagcucagccauuaucuccucuccucuaggaagucuuccuugacuccaguucccagcacaaaauaggugacccuucccacguucaggguugauauucagcuugugugcacugagacagucaugccuguuguuuguagccuguguccacucucacuguuucccacacuguaaagauuaauauuuugaauaucacuauggcaugugcuccuacaaucucaguauauauaccuccaucacaccacaaccucuguguaccucaaccacaguacucaucccacuguuuuuaguugucuguuuccucauuagaguagaaguuccucaagagguaccaaauauuugaugaaugaguaaauacuuagaauaaauggcuuuccaauggacucuauggguauuagguucucaguuuuucuucucaagauuagaaaugcuuucuagaucuuagauuuauccuuuauaguuucugguuuccaauuauguuuuguucuuuuccaggaagucacucuucuaggcucuuaaugucauacuguacuggcaguuuuuaaaauguagaagcagcagaacauauaggaauaccuaucaauuuuuaucuguuaaaacaagaacuggugacacauuuuaaauaaugaugcuugaaacuuaccauuguaugcugacaugggugugaauucaguuuuauaacuuaaaucaauuacuaaaauucuaugauaaaaaucaacauugaaccaaaguuuuaguaaauuaagaaccugacaucaauaaaacgaagauaggugucugccuucgaacuacagaacuaguuaaaguugacccuaugaaaauaauuuaggcagauauauuaauuaacuuucugaagguaguggagaauuucauauuugacuuaugguuuuuuacacaucccuaucaucaaaggauugucuacaaaucuaauuuucacauacaauuagcuuuacuaauaacaaacuaaaaaauauucuugggcacauuacaauauaaaacuaagguugaaaagaaguuaaauauaacaucaaaaauaucaauuucauuucaauuuaaaauuucgaguucaugagcauauauauuaugaauguguaauuauagcuuuucuggaaccauaugacaggaacaaacuuuaauuaccagcuacuaaaaaucauauuuuacuuauuuauguggacauacauaacugaugguaaacaacauuguaugguuuuugaaguaaauauaccgacauuuauuuugcuaauuauaaauucuaguccauuucucuucuaaggcaugucacaaaucucuccccuuccuuaggauuccucccucugccacccaucauucccuuccucugcccacuagcugucugcucccuccugccgcccaccccacuuucugagguccucugcccacuagcugucugcucccuccugccgcccaccccacuuucugagguccucugcccacuagcugucugcucccuccugccgcccaccccacuuucugaggucuccccuccuguugucacaccuucuuuuccuccccacccaccaucuggaagucaacauuacacggcaggagcuucuccauccacaucuguugcagagccagaaguaacacagacacagcugcaacacugcuggauguccaggacguugacaucaggugaguccuuuaaacuuugacaggggcaaggaagagacaaggacacccagguugggagaggcugauagaaauuucugcagagcagucccuaguguauugaaccugguaugaagcuguacucccuaugcaagagauacaagaauuaaggauuuuaacaauggauacugucaaggaaagcaauugagaaaacguguggaccucagggggugcucaauaaauaaaugaucaaugacugaaugaaguaacaaagcugagugcucagugcaacaccaaggaccauuauugaagauaacacacaaacucacagcaagaacuguugauggggaaugauucaaaccugucuagguagaaggcaucuguucuccgacagcuucccacacaaauggaauuuaaaaaaaaaaaaaagaaaaguaagggaggaauaaaaaaaacauagaaagaaagaaaaucuauacguuucacaaguauuccuacaguuaggaaagcagagauucuuguucuagcacuaacuuuaacugccuagcacuuacaauguuaugauuaacuggucagucauuauguucuugggccaggcagugugauaugcauucucucuuuaaauccccuuagaaaggccgggcacuguggcucaugcuuggaauccuacugcuuuuggaggcugaggcaggaggacugccaggaguucaagaccagccugggcaacauaaugagaccccaauucuacaauuuuuuuuuuuaguuagccaggcaagguggcacacgccuguaguccuagcuacuuaggaggcugaggcagggggauugcuugagccaaguaguuugaggauacgaugagcuaugaucacaccacugcacuccagccuaugugacacagugagacccugucucuaauaauaauuaaauccccuagagaaggaauuauauggaauuaauuuucauuugaaaaaaugagauucagaaaacuaaguaacuugcccaaguucauucaaacuaauaaguaaaagguaaagcugggcuuuauauaaaagucugucugcuuuuacuaacaugaagggccaagaaaucuauccaagaaggcuccgucucucuuucucuaaaacaacagccacaagcuaaaauuuauuaaaugcccacgguaagucagacauuauauuagauauuuucuaaacauuaucucacuuaauccuaucaauucuugauguauuauuaacuuuauuuacuccucugaaacuuagagagguuaagugaauuguucaaggucacagaaaggucaagcuggauucaacucuaaauccuuuuacuccaaaaccacuuucugccauuuccuggugagagcugggaccucagugcuaggaccacugugagcucuuuauucauacaucuuuauuuagagcaggaucuugagaucaaaugucagccagggcuuacuagggacaaaaucaacuucaaugacucuagcucagauauguauuguaucgaauagagauccagaaauaaagccacacacauacagccaucugaucuuugacaaacuugacaaaaaugugcaauggggaaaggauucccuauucaauaaauggugcuaggauagcuggcuagccauaugcagaagaaugaaacugggcuuuuacccuuuaccauauacaaaaauugacccuagaugaauugaagauuuaaauguaagauaucaaacuauaaaaauccuagcugaaaaccuaggaaacaccauuccggguguuuccuacaugggccuugggaaagaauuuaugacuaaguucucaaaagcaauugcaacaaaacccaccaauugacaagugggaccuaauuacaccaaagagcuucugcacagcaaaagaaacuaucaacagaguaaacagacaaccuacagaaugggagaaaguacccacaaauuauguaucagacaaaggccuaauauccagaaucuauaaagaaaguaaacaauugaacaagcagaaaacaaccccauuaaaaaaugaacaaaagacaugaacagacacuucucaaaagaauacauacaaauggccaacaaacaugaaaaagugcucaagaucacucaugaaugauaugguuuggacuucugcccccgcccaacucucacaucacacuguaauccccgauguuggaggggggccuggugggaggugauuggaucgucggggcaguuucccccuggcuguucucaugauagcgaguucuuacaagaucuggcuguuuaaaaguguguagcgcuucccccugcucucucuuccuccugcuccaaccacagaagacaugccugcuucccuuccaccaugacugaaaguuuccugaggccuccccagccauucuucccguucagccugcagaaccaugagccaauuaaagcucuuuucuuuauaaaucacccaguuucagguauuucuuuauagcagugcgagaacagacuaaaacacuaaucaucauagaaaugcaaaucaaaaccacaaugagaucccauuucacaccagucagaauggcuguuauucaaaacucaaaaaacaacagaccaugcagagaaaaggacacuucugcucuguugguggaauguacauuaguucagccacaguggaaagcaguuuggaaauuucucaaauaacuuagaaccuaccauucuaccagaaaucccauuacuggauauauauucaacagaaaacaaauugucuuaccaaaaagacacauguacuuacauguucauuguagcaccauucacaauagcaaagacauggaaucaaccuaggugcccaucaagaauggacuggauaaagaaaaugugguacauauacaccacugaauacuaugcagccauaaaaaagaauggaaucaggucuuuggcaggaacauggacgcaaguggaggccguaguccuaagugaauuaacgcaggaacagaaaauccaauacugcauguucucacucacaagugggagcuaaguauuagguacucacggauauaaagauagcaacaacagaaacuggggaugacuagagaggagagggagggagugggguagggguugaaaaacuaacuauuggguacuaugcuuauguagggggugacaagauaauuuguaaaccaaaccucagcaucaugcgauauacacaaguaaaaaaccugcacauguacucccuugaaucuaaaaguuaaaaauaaauaaauaaauaaaugauacauaaaaaaugugcugcauuucugucaccaccuuuauucaugaaacaacugucaguaaaagagagguucuguuacauaugaaggcaccuggaauacugccaggcacacuucagccuucguuuuuccuuucuuaucaggaauucucaucaacauacuucuacacaguagaacuacucagcaaggcaaaugguuuccagcaaacaaccaaaaaauacaaauuuccuaggcgugaacaauagcugguguuugcuauugauaccauucucucucacacaacacucaauucgcaacuucaucucccuuccaugucuuauucauauugguuacagguggcguuccuucccccauacucugcguuucuaaaccccaucuauucuuggaagcucaacgaaaaugccauuuuuuccccaaagccuuccaugaucucuugcagacaaucaguucugauccucugaacucucagcauuuuagccauaacuucccaauggcauagggacuuuuuucuuuuccuuguaauucauuccuucauucaucuaauauauacugagcacauuuuacaugagaggaaugugccaggcauugaggauguuacaugcaagggacucacugaacuaggggaggcaagcuauucgacaugaauuuguaaugaagugagcuaugggagcccacaggagacggucccaauucagcuaugggaggcgcggagacgaggugguaccaagaaaaguucugggccacgcgcaguggcucacgccuguaauccuagcacguugaguggccaaggaggguacauugcuugaccccaggaguucgcgaucagccugggcaacauggcaaaaaccugucucuauaaaaaacacaauuagccaggcaugguggcacaccucucuagucccagcuaccugggaagcugaggugggaggauuaccugagcucaaguggucgaggcuaagugagcugugaacaccccacugagcuccagccugggugacagagugagacccugucucaaauacaaacaaacaaacaaacaaacaacucugaagaaucaguuaaagagggcagaggaagacuccucuaggcagagggcaaagcacaugcaauauccugcacuggaaaaaacaguauggaagagaggcauauguacaugcuuggggaagcacaaguaggucaguguggugagggugcaaagaagaaaaaugaaggaacauaagaccggagagccaaagagaggaacaauauuguagagucuucaugcuaugauaaaggauccuaaauuuuauucaagguugcagggagacgugaaaggaguuuuaaagcaagagacugacauauugagaaagaucaucccagcugcaguuuggagaacagauaggaaggaggugagacuggaggcaaggacaccacaggggcuauaggaaccauccaaggaugagauaugguagcaguaggauagagagacaaggcaauguaaaugcucaggggcuuaagucuuagagccuggugaugaugagauguguggggugagaaagacgggggagaaaagggugacaagauuucugugcuggauaacuggauaaauaguggauccacugggauaggagguggaaaguaaagcugguuugggagcucaguauacaguuaaggaucuagaaaucaaauagcuuuagucuugaagcuuuagguccuaaggcuauauauacauggaauucaagcuauaguacugcuaaagacaccuaaaucuuuagcucccugcuaaacuccagaaccuccuaucaagcugcuuucuggaugugucuccuuuauugucucaaaggcacuuuaaacucagaguaauguaaaaagcacacaucaucauucucccaaaucaagaauaugaauucaaagaaaucauagagaaucuuuuaaggagaauaagacugaaaaaaaaucaguaaauauaguguaaacagaucuucagugaacauagcaaugguaauuucacuggcuguggcauggaaguugaaaugcagugggcugaagaguaagugagaggugacaaaauaaagacaacauguauggacaaaucuuucaagaaacucgacuauuaagagaaagagucaaagagggagauggaauuacugacgugguuuccaaccuuggcugcacauuggaaucaccuaggugaguuucaaacacacugacaccuggaugcuucucucagacauuuugauguaaugggugugggguacuguuuggacaaucagauuuuuagaacuucuugcgugccaaaaauuaagaaccacagauuagaagaaagauuguuccuuucaacaguaagagacaucugaaaauauuuuccugaggauaagaaagagacuguagugaaggaaagauugauucagaaaaguggaacaaacaaauggaaugaguuccuugagggggugaaaggagacgagguccaugggaaggggaagggauuaggaagacaccuuucccauucagacuggguuggaauacaggugaaaauuuauuuuaaggcauggacaagagaaauaguugagguggucaucacccaacggcuuccauuuucuuuguuaguuaaguaaggcucucugcugagaauaagaggaaaaaugguauuauagagaauuugagaagaacaagugauuugaaacagucuuuaaagaaaugcauuuaagauaccaucacuucccaccuggacuacgauaaucaccuccagaccuggacuacgauaaucaccuccagaccuggacuacgauaaccaccuccagaccgggaccacgauaaucaccuccagaccuggacuacgauaaccaccuccagaccgggaccacgauaaucaccuccagacccggaccacaauaaucaccuccagaccuggaccgcgaaaaucaccuccagaccuggaccgcgaaaaucaccuccagaccuggacugcgauaaucaccuccagaccgggaccgcgauaaucaccuccagaccgggucugugauaaucaccuccagacugagaccgcaauaaucaccugcagaccuggacagcaauaaucaccuccagaccgggaccgugauaaucaccuccagaccuggacugcgaaaaucaccuccagagcuggauuaugauaaucaccuccagagggggauuaugauaaucaccuccagaccuggacugugagucaccuccagaccuggacuacgauaaugaccuccagcugaucuccaggcaucuauucugcuucuccuuccaauccacugacaaaaugauuuuucucaaauauaaauggcaucgugacacugacaaauucaaagccauucaauggcuuuccaucccuuuuuggacaaaauugaaaauccuucauauggauuuuaaagccauucaugauuccaucccaacauaauucuccaaacucauucccacuacucugcuccucucucucuaugcuccacccaucagggccuucuccaaauuccuagaaagugcgaugcuuuccagguccagagucuuggguguguuauauuccugggccugaaacccucuuccccucuucaccuguccauucaucaaugcuuucaggucucauuuucaacaucucuuacucaggaaagucuuucgugacugccuagacaaggucagauuccuguuacacauucccacgauauccuaaaccgaaccuuauggcuuuaucacaaugaugaucgaaaacucacuuaugaaaacauuuguguaacaucuacuucuccuacgaguuuguaagcuucaugaggaaacugcaucguuccugugacuacaacauucccagccccucugguuaauaucuguugaguguggaaugaauaagagagaggaaggcaaaagaggacugcuagaaagcacugaaaggaccguggacaccgaagaccuggagucuacagccaugucaucugcaaggcugugugauuuuuaccagcagagaucaccaauccagggcagagaagguagguaguaggguuuugacagacacaauuuuuaaaaauggauaagaagacaaggacauuuacaggaaaugccugaguuuacucuuauuaagacuuaaaacucauagggcagaaguugugauuuuucucuuuacauaucuuuaggccuccacauugcuuugcacacagcacauacucaguauauacuuacugaauaaguuaauuaucacacauugaaucugauaacaacauagcauuuagaguacaagcugugaguccacuuuuaaaaacaaacauguaacacaguuguuuugguuacuugauggaccacaacuugcucaauucgagucuaguuagcaauuuuaaagcuaggucccacucaacucuguauucuaguuugugaacuccuuuucaaacacugcuuguuucauguuaucuguuccuuuugccuuaaaucucucccuucaucugguuaccgucauuauucaucauguaauuugucagaacugauuucauacagagugcauaaucacuuuuucuugguuacucaguuccuuacaaguguuucaucuucugcauauuuaauuuagggguaggagauaaugcaggggaagucaucucuccuugauuuagccaagguugaaauaaaaucuggguaucuucauagcacgacucugggaaacacgagagagggaauccaacagaauggcaggauuuaaaguaaauuuuguaauuucauuguauggaaucuaacugauuauuuuauuugaaaagaucagcauaaacuauugagaaauauaugaaaagauaaaacauuuuuaugaauucuaaauuauacgaaauuuaacuacuuauauaauaacgauuuuaaaauuuaaaguucauucaagaacuccagccuauggaaucaucaauggcaucauaaaaaaccuuucuucugcaauguggauaacagcagaguccuuaaguaccuuugaucccauguacucccuuucuuucguuauuuccuuuuucaucaugucuuucucaauggcccuuuucucuugcugagaugcaaguucuuuuucaagucgcuccgccugccucuccagcuccuuccucaacuggucacacuggauuaaagccugccaggauagaacagauugaaagaggagguuagaauuuggaaaaaauauagguaaaaugacauaauuaagcuuuaaguauauuuaaaauagcaaaaacucacuauaaagcccauuagaauaauuuuuuauuguuuaucaauaccacuuauugaccuaaaagaguauccaaauguuacauuuauugacauauuucaauuuucaugauuaaagccauauuaauuaaucaaugacaaaauucagguaaugaaccuugaugacggccacagaugagucagaauuuuaaaaaagggaaccagaaacaccaaguguucuaauauuuucaauuauauaucauguuuauacuacacgaaauacguaaguauccaauuuaacugauuucuuauuugcucauggauaaaaauuauuggaauacuucaaaugauagaucaaaauacuaaaaugaaauguugaauauaucauuacacacaggcaucuuuuguuuaauacuauauaauaaucaaguuuccuuaaauauaacuaagagaaaauuuaguucacuccccuuaaacauacaacugaaguaaaaauuauguaauaaucguaaguuaaauggaaagacucaagacaguauucacuacuuaguuuuauaaggaucuuccacuucugguaaaguucaugauuguccuuuacuguaaauuucccacucugcauuuccagaaauaaaaaaucucuaacuucauuuuggccacuuuuacaauaucuuuauuuauaacacccaauaaugaaauaugacuucaaaaaucccaauuuggggaggucuuuuuuuguauaaauauaugggguacaaauguaauuuaguuacauacacagauugcauaguaaaaucccaauuuuuaaaaauccuaauaaaaguaagguacuauaguaucuuauagucuuauuccaguggcccuuauguacaauauccaccucacacaaccucucuuuuccccugaaaugguagaaagaaccccaggucucaugugacuuacaugcuguaugauuagaaauuucauagucacauuugauuuuaauggagauggaaauggccuuaguaagcacuguaaguuuuaugcauaguuaugcuucccucuggugaaagcuauaauaaauacagacaauaaauaucuaggauaugugaauuuuccucucuucaucuggaaagcauuaaacuccaguuucuuuuggucucuucugaaaaguuucuaugcucccaggcauaaaauauaaagguaaaauucaguugucucagauuaacuaauaaacaaauacaaugaguaaaaagugauucuucuagggaauuagucccaagucaaaauuccagccgagaaugccuggaaaaggaaauuuuaaauuagauauuaaaauaaaugaaaaggcauacuuuuucuauaauuuaagcccuuggagcuugaaauaugaaugaguuacuuuugugauucaaaauguaauugcucuugugaaaaauauuucacaugaauugaguaaauguucauaacucucccugauaucaugaaugcuacugguaugaauagacaaaacgcuuacuuaauauaaaccaauauauccaaucagaaaguuuucaacugaacaaaaacucaggagucaucaucauuaaguauaggaacagcagaagagacugaagaucuaaaaccaggcuaccaugaaaggcaccuacagaaucaauucaaagaacucagucaacuaaagaacaagcaacaguaaauaauccuggcaggauaagagguguaaugccaagauaggaugauacagugaaaagcacaaagugagaagcuguaaaaucauguaaacaaaaccacugcugaggccuugguuuuguggauggucuucucucuauuaggaauggccaccaccaauggcugaugaugaguaaugggcaacaaaacacugaauaaaaauauuagguuaaaaacugguuauuggcugggcgugguggcucacgccuguaaucccagcacuuuggaaggcugaggcggguggauugcuugaggucaggagguugagaccagccaggccaacauggugaaaccccguccuacuaaaauaugaaaauuagcugagccagguggugcgugccuguaaucccagcuacuagggaggcugaggcaggagaaucgcuuaaacccaggaggcggagguugcagugagccaagauggugccacugcacuccagccugggcaacagagugugacuccguccccaaaaaacacacaaaacaaacaaacaaacaaaaaacugguuacugaugucucuuagcguguaaccaacaauuccauauuaucaaauagcuucuaaggccgggcacaguggcucaugucuuuaaucccagcacuuugggaggcugaggcaggcggaucacgaggucaggagaucgagaccauccuggcuaacacggugaaacucugucucuacuaaaaacacaaaaaauuagccggguguggcggcgggcaccuguagucccagcuacucaggaggcugaggcaggagaauggcgugaacccgggaggcggagcuugcagugagcugagaucgcaccacugcacuacagccugggcgacagagcgagacuccaucucaaaaacaaacaaacaaaacaaacaaacaaacaaaaauagcuuuuacuuuuauuugcuuugauuuuaacguauauguccggucacagugaagaaaacagaaaagcguaguaacacuuggaaucagaaaaaugauuuauucuuucuaaagauaacucucucacacuggaccgcacauacuaaaagauuugggucuaguaaacaauuauuuauacacuaucuccauuaaagcucucucuuaauucuagaguuucuucuccuaguuucagaaucccugucgauugaguaccccuauaaccauucaguaaagacauaauaacugacuucucaaaggcuaggucaguaaacaaucaacuaucaucaaaugauuauaauuuuaauuucuacaaaauuauaaauuauaauuuuaauuucuacaaaauuauaaauuauaauuuuaauuucuacaaaauuauaauuauaauuuuaauuucuacaaaauuauaaauuauaauuuuaacuucuauaaaauuauaaauuucuauaaaauuauaaauuauaauuuuaauuucuauaaaauuauaauuauaauuuuaauuucuauaaaauuauaauuauaauuuuaauuucuauaaaauuauaaauuauaauuuuaauuucuauaaaauuauaaauuauaauuuuauaguaacugaaugcuauaaacaggcaauuaccauuaaaugauagaucuuuauaggugacaaaguuaauuuggggccugcggcuguuauuucucucaguaguucccaaguccuggcuucucucccuuucccugaacacggcccuuuccuugguggaaauggcuguaggucuugagaaguuggggaauuauacauuccccccacccagcagacucauuccugaagguaccuuuucuuuucugggaaauuucuuuagcuguggucauucuguguugacauauuaacacuuuuuuucaaacacaguuuauuggacuugauauucccaguccugguuuuauuaagccaaaggguaggcacuacuaucuuaggcagucaaaauauuuucgaaaacaaaauuuauaucuagucaacuaaaauuuuaaaacaggaaaccuauuguagaucauauaaaaguccuucccaacugcuaggguuaguuuucaagaaaucuuugugacagaauaauucauaacuaaggaauuaagaucuuaugaaaaauauacagcucacaccuuugaacauaaacuuuaaagcuuacaaacauuuuuauuuuuaugaauaaagcccacaaaauuaaaaagauuaacacauuucaaacaucuaacuuaugaauaaugcaaacuauugauuuuaauuuauaaacccuugcuaaccagaaauuuaucagucuaucccuauguaccauuuuucaagauauuuacacuucuuuugggacagauaaugugcaaaucaagaagcguuauuuucuauccuugugacuauaaccaaauagucaaugcuuuucugauuuuauuuuuaauccagguuucuaauuccugccuuucugacucccuguaauccaagaaacagaauaauuuggauauuugaaaagggagaaaaagucuuuguaaauauuuguucaaccuaccaggcugcuguuuuaaaaacuaaucuucagaauaucacauguaacccauaaauauguacaauuauuauguauacauaauaauuaacuuuuuuaaaaaguucacaccacuuacccacaaagauauauggcaggauaggucuuagcaaauuggaaauacauacuuuguucaaguuguuaugaguaaaaaagaaaauuuuuuuuuuccuuagaggguuauaucauuacagauaugcuuaugguaacuucaugccacagccugugccuucaggccuuuacacauaccucucaacaauuucccuuccaacacaagcaggcaggccuaaggccugguuaaccuuuucaucugcuucguguagcuuuuuaucaaggugugacugcacaagccucuacuuuuucucuccauuuagucccaggugaauucuuuuccucuuuuaaaauuaucaccaauugaaauaacuuccauuuucaaacaaaaauauuuauugagcaccuacuaggugccagauacuuugcuaagugguauacauggauuauuuaacccucucaauacauuuuaauugguucuuaucacucaauugaagaaacugguacuuugagacauucaguaacuugcccaaaucagagaccuagaaaguggugagaguagggaguuuauccaagguaguuccacacaagaauguuugcauggcauuauauacuucucaaguuauauauuuauuuucuuauaaaauccucaggcauuuucacugccacaaagaauguaaauauauaauuccuucuauuuagcaugugauacccaaaugccacacuagauggcaacaaacgucaaggaacuaaaccaaguaaccauuucaucacucaguaauauaaguaguuggguuuuaaauuaaaauauguauaccaccuggcuuuuuaaugcacuuagaaagcaaaaauucuaguguguuucaacauaccuucuagauaaaaaguacuagacuugcaauacauuuuguccuugcauucauuauuacuaauuuacugaaaaugcuauagauuccuaaugaacaauaguguugcuugcucucaguuauuaaauuuuuuaaaaaauuaauuacaaauuucacauuaauaauaauugacuuccacugaacaaacauuuauuguuaauuaagacguaaauggucaugugugaaauacaaugauagaugucacagaccugauuucaaggucuucugguggagaaaacuguguaaacaacuaccaaaauuauacaccacaucaacaggaauacagaggaaaaagaaguuaauucaaacaagaaggggcuggggaaaacuucaggaagacugccacuugaguugagccucauagauugaacagauacuucauagauuauuacaaggcagaaaaauacagcaugugcaaaucaaugaaaauggccaacugcaggucauguucuggaaacagugaaggugacaugaaagaguagagugaaagagaagacuagcaaaguuagaauggggccagauuugucuuuuauucuacugcaagaggggagcuaccuaaacagggagauuuauaacucaggaacuauaaauguuaugagagcacugugaaaaguaugcuggaauuagaugaaauuugagggaaaccaauuagaaagcuauuguaauugucugcauacuugguauaagaauacgugaaguauaccacuggacacgguggcucacaccuguaaucccagcacuuugcggggcuaaggagggagaaucagcugagcucaggagugcaaggcuguagugagauaugaccgcaccacugagccugggugacagagugaggcccugucucugaaaaaaaaaaaaaaaaaaaaagcaugugaagaugugaagccuugaaccagggcagugguauaagaaugaaaagguaggcauaguuaaauagaaauuugacucugaagagagagagaaagaccuugggaacugauggaaugucaagagcaagcauagggaagaaccgagauguuuuaaagaaugcaagccaggacugcggugaagauggugaugccuuuguuugaagacgaucauagagaaaaugguagaaagaaaaggagugguagaugggaaggcggagccaaugaacgguuugguuguguagaguuucagacgccagcaguguaucauccauaaaaaaagaucuaguagcagcaaaacacguagggcuggggcucaggagagcaguuaaagcuaaaggcauaauguggguguauucacugguaauauuuggccacgugaggagaaaugaaucccaggaagucaaggcaacaugggaggagggcugggaacuaacucugaggaacguccacacuuaagacuuguggaaaccaagaaacaaguuaaaagagacuuaagaguagacaagaaugguacaauguggacccaugagaguaacauaucagcuaaaucaagggaaagagaugguauguuaugauaggccaguuaacaggguuccaaaucuauagaguuuaaguccaaugaggauugagaugaggucacuggguuugguaaucaggaagugaccagugaucaugaagcgagcacuucaguaacauaaaaucaggcuacaguuuguucaaagccuggcugcgaugcacucagaagugaaaggaaagcuaccaggguggacaacuguugugagaugucugccagugaaaugaggaauggacgguaauaaacgaagugaaagaugaucacaggaaagcugcuuuuuguuuacuuaaacaaaggcugugggcaggaugagggggaaaaacaguggagagaaaaggauaaaggaugcaagaaaaaugugaugacauagaagugggagacaucaaaaacggggagaaagauguucaucuugggaaauaagagggccagaaaagaaaggagaaauaaggagaggagacauucgagggaugagaagaugcugaggaggcucuugucaguugguccuaaucuuaguaaagugagaaguaggucauccgaagaaagugacgugccagcaguggaguuggaaaagugaggaaaguggaguuccugacuagaguauauaaggucuucaacugcagagaaaagaauuguucaacaguaccuacaaccacugaaggugacuaguauuacucuucaguggaacucauuaaguggcuuuuuuuuuuuuuuaagauggagucucacucugcugccaggcuggagugcaguggcgugaucucagcucacugcaaccucugccucccggguucaagcaauucuccugccucagccucccgaguagcugggacuacaggcgcacaccaccaugcccaguuaauuuuuguauuuuuaguagagacggggucucaccacauuggccaggauggucucaaucucuugaccucgugaucugccugccucagccucccaaagugcugagauuacaggcgugagccacugcgcccggcuauuaaguggcuuuguuaaaugacuuccuuuagcaaugcuugggaggcuugaacuagcuauuaaaaaaaaaaaaaagugugauugggccuaauuuucacuggguacuuuugcuggcaaaguagguaagcuggaaagauaagaauaaaggcacuguagagugcuagugagaacugaguugcaauuuccuuccucaguggauauuuacugaguaccuauuuauuauguguugagaucuacgcaagaugcuacggauuuaacagugaucaggguggagaaauuccguaacaccagagauuuuguaaccaagggacuagugcagacugauuaaccauuguuuaaguuguuacagauagcacugagccaaaauugcaagucauguaguccaggcaugugcaaugggaaaaagcuuuaaccuccuaauuguuuuuacuuuauuuuuaauuuuuguugaguacauaguagaugcauauauuucugggguacaugagagguuuaaccuccucauugugauuaccaccacccuggcagacuggcugcacugguaucaccuggggcuacuuagaaacaccucugaaaccaaucuuccugaucuugccgcagaacgaggagacagauuugaguguggccucuugccuccuugccagucaacuugcaauaaagccuuuucuuuucuuaaaagccagugccguagcauuggcuucuaugugcauagggaagcaagcccuuggcuuggugacaauuuuaaaguuuaacagagauuucucaaagaacuuaauauagagcuaccauucaacacagcaaucccauuccuggguauauaccccaagggauauauaucauuauaccaaaaagauacaucaacucaaauguucaucacugcauuauucacaauagcaaagacauagaggccgggcaugguggcucacgccaguaaucccggcacuuugggaggcggaggcggguggaucacuugaggucaggaguucaauaccagccuggccaacauggcaaaacgcugucuuuacuaaaaacacaaaaauuagccaggcgugauggugcacaccuguaaucccagcuacucgggaggcugagacagaagaaucacuugaaucuggaggcggagguuacagugaaccaagaucacaccacugcacuccagcuugggcaacagaacaagauucuaucucaaaaaaaaagacauggaaucaacuuaggugcccauaaauggcagauuggauaaagaaaaugugguacauauacaccagggaauguauacauccauaaaaaagaaugaaaucaugugcuuugcagcaacauagauguagcuggaagacauaauccuaagcaaaguaaugcaguaacaggaaaccaaacaccauaugcucucauuuauaaaugggagcuaaacauuguguacacauggacauaagcguggcagcaacagacacugcagacaacuugggggaggagagaggggggcaugggcuggaaaaguaccuauggggcacuaugcucaauaccuggguccaccauauguaacaauccuacacauguaccccucuuucaaaacuaaaagcugaaauauuuuuuuaaaaguuuaaugaaggauacagacaaacaagcaauaauaauacauuuugauaaaugcuauauaaguagugguucucaaauggagguaaaugugcccaccagaggacauuuggcaauguauggagacaucuucaguugucacaacuugggggaggaggguaagcuacuagcauugaguagguagaggcuucuaaacauccuacaaugugcagaacagcauccaaagcaaagaguuacauagcccaaaaugucaauagcaccaagguugaaaaacccugcuauaaaggcauauaaaggguacaucgaaucuagacagaagagauaagagguuuccuagagggaguaccauguaggcuaagauaaguaaggcuaaaguaauauacaggcaguggagcagagaagaaugcacauggcacauacaaagacucagaggcuggagagaggaugggauaaucagcaggguuaucaccaccaccgcuauuuauugagaaauauuuugugccugccuggguuuguauaagauaaccaauauacauuuuaaaaugcaguccucauucacaauccuaggagucacauauuucuccauuuuacagaugaggaaaaacuggggcacagagaaguuaaaguaacucguccaaggucacacagccagugaaugguggggccagaaguugaaucuaagucuggcuaacucuaguaagcccauguucacccccuaagcccuccugccuuugacgauagcugaguguacugggagacagggcgcgagaggaggaaaaaagcagcagccuuggagggcaaaagggagccacauuaggacagaccacgggcaugggaaagaauguggagacugucuugaaggcagugaaaauucaccgaagaauuuuaaaucagagucacaugaucaaaugugucuuuaagaaagaucgcuucuggcugcaguguagggaguggaacgaaggagggaggcaagcuaggaagaaguguaauagauaaauccagagauuacuuagcuuccauaagaaaaguguuaaugagggaaagaauucaagaaaacguuagaaacucagaucuguacuuagugacugguuaaaaguuaggggugaaggacagggugaaauccaguuuucugaucagagcauguuagugaguaaaagugccauccaguaagagaauacagaaggggcagcagauuugggagagugaaugugugaguucaauuugagaugguaaaauuuauguuuaaaugggaagaaaagaagaccagccuggacacaacagauaaaaugagagauaaaaagaaagaaugcugaagaacuagaggugaaaaugaagacauggaguagauuuaacuuugauagggaggaaagaagagcaaaggcccuagucagagagugugguuucagagagaucuuaggggcauuucaguucaugcaggauguuagcguagaaguaggggauauaguagaguuaaggaagcugaagaguauuaguguuuuguguaucagcaacauggaaauucaaacauuuaaggaugaugaaagagauagaaugaagaggaaaaggaucagauguuaaaacuuuuaaaaaggggccaggcgcgguggcucacgccuguaaucccagcacuuugggaggccaagaugggugcaucaccugagcucaggaguuugagaccagccuggccaacauugugaaacccugucucuacuaaaaaaacaaaauuagccaggcaugguggcgcaugccuguaaucccagcuacuugggaggcugaggugggagaaucacuugauuccaggaagcugagguuacagugagcugagauugcgccauugcacuccagccugggcaacaagaaugaaacucugucucaaaaaaaugauaauaaaaauaaaaauaaaauagaaagggucaaagagagccuucucaauugagagauuuuauugauuagggaggagagagacaacacugauuucaaagaggagugugauaugguuuggauaccuguccucuccaaaucucucauguugaaaugugacuuccaguguuggagguggggccuggugggagguguuugggucauggggguggaucccucaugaauggcuuggugcccuauuaguuauccugaggucugauuguuagaaagggccuggccccucuccuccucgcucaguccugcucccuugugaggcuugcuccccucugccugcugucagagugaaaucuuccugaggccuuaccagaagcauauguuggcaccaugcuucguaugcagccugcacaacaugagccaaaauaaaccacuuacuucucuuuauaaauuaccaaucucugcucuuucuuuauagcaaugcaaaacagauuaacacagagcgguagcuuaauuucaaagaggaauaggaccugagaguaagugccaaaacaaagcccuggaaauggcagucaggagugaaguaacugcgguuuccuccaucacacccaccugagacgacuugacugacacaagggccuucacugaagguuuugaaacauggcauugagggacagcuagagcucacaacaaaugaagaaacaggagagucugaggaaacaguauguuggggaguuuggucauaacugaaccuaaguuucaaaaggcaugagggucaaacgggaagaguuauggaugaacuggauaaagacaaauggacauagcaauggcugacaagaggcuuaaugcagaauugaauagcccuaauuuuuuuuuaacuuuuauuuuagguucggggguacaugugaagguuuguuacauaggcaaacucaugucacgggguuuuguuauacagauuauuuuaucacccagguauuaagcccaguacccaauagugaucucuucugcuccucucccugcucccacccuauauccucaaggagaugccacugucugugguuuccuacuuugugcucauaaguucuuaucauuuagcucccacuuauacguaagaauaugcaguauuuggcuuucuguuccugcguuaguuugcuaaggauaacugucuccggcuccaugcauguuccugcaaaagaucggaucucauucuuuuuauggcugcauacuauuccaugguguccauguuccacauuuucuuuauacaaucugucagugaugaacauuuagauugauuccgucaauuucgguugauuccaucaauuccaucguuuacguuugcuauugugaagggugcugcaaugacaauucacaugcaugugucuuugcagcagaaugauuuauauuccucugggcauauacucaguaauguagcccuaauauuuuaauaaaacacugagauucauauaugguuuagaccagugcuauccaacaaaacuuuucaugauaaugaaaaugcucuauaucugcacuguccaauauuugcuacacguggccauuaagaacuugaauuguaugcuagugugucuagggaaaauacaugcaacuuuaacggauuacgguguggcccccaaauacaguaaugaaucaacaguaaccuccuauucuucaaagugccuauaacaccguccgaucacuaaguauaaacuguuauucucauuaaguauguuugaguuaccuuacaguaaguccagacucaaagaugcuacuaagaccgggcgcaguggcucacgccuguaaucucagcacuuugggaggacgagaugggcagaucaccugaggucaugaguuccagaccagccuggcuaacauggugaaacaccaucucugcuaaaaauacaaaaauuagcugggcaugauggcccgugucuguaaucccagcuacuugggaggcugaggcaggagaaucacuugaacccaggaggaagagguugcugugagccgaaaucgugccauugcacuccagccugggcgacagggcaagacucugucucaaaaaaaaaaaaaaaaaaaugcuacuaaauauguauauauuauugucuuugguauauuuggauuuucucaaaacuucccaauuauugaggaaaaacauuugucuuuagucauauacgaacacauacaaacuaaugccuggguguuaagauuuuugcagcauugcaaauuaucagcaaauaaaaagauuaagcauauaggucucucaaaguauuauacuguacuacauucucugaacagugauacaacaacaguauuugcagagcaguaagaauucuccaaauagcaaauuuguuuaauucagaaaagucaacauuaacagauugauaauucacuuuguguguuugaaaaacaaaguuuaguuauagaagaauaaccaaauaaauacucagaagaaaaaagaaaaaaaaaagaaagacacuuuuauuugcaucuuauuagacuugccuugguuuuuucaaaauuggcuuccucagauauuugcaaaacuuguuucaccuguucauaagcacuugcuucucuuugcugcguaucugccaagcugcuccuuacggaaacuagugcagacaucaagucaucucuuucucugucagcacaaaaagaacauucaaaacaagaaaugaucaaacgauccuguccucauaagucagggagagaaaagcauuaauauguauuagaagagccaggguaggccggcugagcacauaugaaauaaagcacaccccagagaaagacccucuguccucacuuggcgagcggcgggcggagcagccagaaaggcuaagagccuucguggcaggacggcaucugugcgggacaaucaucuauuguggagagggcugcaggggaaagcccagagaagagcaaauuaguuuuuuaaaaguggggggaggugcugaaaaggaaaaaugcagcaaaguagggaagguacgaauuguaaaucaagguagcagucaacauuuuaaggaaggacugaggcuuuguccaugcagcagauucuccucucauuuacuugaacaaauauauguccuuuccuuuuuaucuuucuccacaauccucuuuuuugcacuucucuuucaauuacauucuuucaguuacuuaugaacacuuguuguugcucaaugauuaguacuguugaacuccuccaaucuccuggcuaugcauauaacauucacaauuuaacacaaucuuaucccacuggguuugaucauugccaagacccacccuucuucagcaauucucagaaguacucuauccuaagcuguuuauugggaguagaagugaaccaaaugccaaaaugcucuggcauguaaaauagcaaggauacaaucucauugauuaaauaagucccauauaaaauauucuaggauauuugcaauuuaucaacugaauaaaaauauccaguagacaaagagaaagugaggcaggaaacuuucaagacauaaaaagcaaaaaauguaugcuggacuguuacauaugguguucccuguuuuguuaaagaguugaagacuaaaccacgguuucaaauucauuugaaauaaaugcuugcaguuuccuuuucauugccaaggucuaaacuaugagaaaagggccaacuaugauuuuuuuuuaauuagcaaguuuuaaagagucauaguguagaggauuauaaacucugcuugaauuacuuucagaauuaaccaaugauucaauuuaaaacaucucuuaaagguaaaauaaacuauuugugguauuuggaaagcagccacauuugaagaaacauguaauacugaacaaaguuacaauuauuagcaguuucauaaaagcccuuuuuguuuaaaaaagaauaaguugcugcaaauauaaaauucauggaagcagagugaucuucacuuuagaauuuccugauuuguuuuaaauugauaaaaauaauuuuucuuccaaggaaaugaaaaaagaaguaaauuguuuuaaucgaauauaaucaaacacaauuacuauguaaaaaaguggaagaaucaaggcaagauuaaauuauccuaguuaaguaaaaaaauaaacaccagcaaaauugaauaugugucuauuugcauuuccauaaaaguucuauaacguaaaaggggucuagcuuuaucaaggauaugcaauccaguuaggaucuaugauucuaaaagaaaagaaaaauucacucuuuaaggacagcaagucaauauaggcaucuuacagucaccuuucuuaaaucacuaagacuuaaugaagagcaaaaguaacuauucaaugagauucuuaucuguuccugauaccaugcagucaccaaagccaaaguuccaaggaaaaagaaugaacaaaaaaggccaggcgcaguggcucacgccuguaauuccaacacuuugggaggccgaggugggcggaucacuugaggucaggaguuccagaccagccugaccaacaugcugaaacucugucucuauuaaaaauacaaaaauuagcugggugugguagugcgcaccuguagucccagcuacuugggaggcugaggcacaagaauugcuugaaccugggagguggaaguugcagugagcugagaucgugccacugcacucuagccuaggugacagagcaagacuccaucucaaaaaagaaugaucaaaaaagcucaguguuuauaaguaugcaaacagacagauccacaacaggauaaaaaucuaacaaacuugcugcuuaugggaaacuuacguuuaauagacuuuaucuauuuucagaauauccucuugucaagaguaguguuugucacacaguagaugcucaacagaauaaacaacaagaaaacaaauaaaugaauaaagagucugcuauaggauggugucaaaagaggugagguaaagcucccucucaguucuaauauuucaugaucuaaacugaaaacauuaccuauuuugaauuagaaacuagaguucagucguucugguucaaaaguguuucagaauauuaacucaccaaauuuagacuauggaaccacagaaaauuaucaaagauaaaacuccaauauacagaugucuuguuaggcccaucauucaacagugagaccacaaaacgauuacacucaaacuccacguaaccacugggcugacacacuccuccuuucuguaaggcaaaugcaacgcaugcuucaagguagcuuugagcccaccugggaagcuugcagguagguagucauuuuggcaauuuaggauuaucuacucauucacucagguguuacuaaaucuugguuuugguuugguuuuguuuugacucagccaguccacauaacaaauagcagcaagcaaccccacaaauaauuuuuuuagaaagagcucugggcuggcaguccccucuccucaacacaaggccuugcuuccuacuccauuccuguggccaucuggcuucaucuugucugagcuuucauuuuuuagcccacuuauccccugggacuaacagugcuacuuauauaaucugccuuucagaaacagccgauuccagccacccaggguaacugcccaguuagcuacaguccugcucuagaucccgcaauccacagguccagcccagagccacaccugaaugaggcucucacaaugggaagcuguacagacacauguggcauaucaaugugagagugaaagggcaguucuccaaauuaccauccuccauggcaaauguucuaugagugcuuggaaacaccaugugaauguguugaugaauguaaucaaggagcuucuugacgcaaagccagcaacacuguguuaacccugcaacauuccaugauccagaugaaagagcagcugaggcagaaagaugacguaaagaucaugaguguucuggggugaaaagcauguacuuacacgcacuaaugagcauguaauauuuaagaaacuuagcgcagcaaucagggccaaaaggacugagaaagucccuuaacaaucucagccaaguguuuaagcaaaagaguuggucuaauguauaugcaugagcuccaccuugaaauguggaguggcuaagaaaugucuuauaauuucuaaauuacuccaguuauuauuaauuuuaagcauuauuagguaucacuaauaaguguuacuacaccguuuuuaaaaagaaagucuagaaggcugacuacaacauuucuuuguuccucauuucugggaaguuccugcuguagucuuuuaaagccagcuaugcagagcaggccaaugauccacuccaaaaucacaagcuggacuaaagccccagaaaaguacccuuggaaucuuuucucuuuuuugaaaaguauaaacuucuccaagguacugugagcuacagaaaggaauuuaagcaguuccaucuugguuaccaugugaagguacuuugaucauuaagcaagaaaaagagguuacuguuacucuuaccucccuuauggcauaaagaggccaagugaaaggcgaaaggucggaaacaauaugaagacuucaaaucaacauaaaaaauauauccaaugucaucaauaguuguuaaguauauucuccaaaaaguccuugaguccuaagaaaccaccagaaacauauggguggccuggucuccaagucaugccugauccccuccuugucaacuguacaagccauuauuuuuuuuuuuuuuuuuuuggagacagguucuuccucuguugcccaggcugaagugcaguggcgcaaucuuggcucacugcaaccuccgccucccagguucaagcaauucuccugccucagccucccagguaacugggauuacaggcgugcaccaacacauccagcuauuuuuguauuuuuaguagagaugggguuucaccaugauggccaggcuggucucaaacuccugaucucaacugauccaccugccucagccucccaaagugcugggauuacaggugugagccaccaugccuggccaucaagccauucuuguuucaugaauauauauucaaaauaguaaaugcuaaaggaugcaacaaaggagcugaaagcugcugucacaauaccacauuuacaaggaaacuuuugauuuaucauauuuaagguaucauuuuuaaacauuccauguuaaagucauucagguaauaugauaacagcuuauggagggggcaggcuucuaacuauacauaaaacuagaaauccaaacccaaaaggugcuggacacucuucaaaguuagcauagcacucaauauucagcacucugcauuaguuaaguuaggccaagagaaugauacagaagaagaauucauugacaauaaaagcagaauccgcucaguguuaauagguuuaauauccuuucugucauuaaugcagaacaugagacaaugauaugcugacaaggcagaaaauugaacuaaguagguugacauuuacuuuaagaggcuaagagcucaaauuuaggauagagacaaaggaauacauaacugaucaagaaucuuaauuucugaaugacugccaggcuuggaaguaaccaaaacauuauagcuuccuuuaaaaauauuuuuucauaaucuagaaggauaauauaaaaggcaacauaauaacuuguuauuucuuggcugaguuuuuuuuuuuaauuuuuaaauuuuuuguagagacaggguuucccuauguugcccagacuggucucaaacaccuggccucaagugauccuccugcaucaggcucccaaagugcugggauuacaggcaugagccacuaugccuggcuuauuaguuuugcuagacuaccuaguuuuaagcucugccucuuuuuauuugcaacuuuuaauaugcuuuccucuuucuaaaauuaauuuuuaaauuauauucuccuugcaaaauuaguuaccaauauuguuaaaggccuauuugacacccuuucaauuucauugccuucguccaccucucuagugguuaucucuguuaaauauuuaguguuuacacuuucaaauauuuuucugugcauaucuaugaaccucgaaggggaaaaauguaguaugguuguauauggacuuaaaaaauacaaaagguuucauacuagauuuaucuuuagccauuuuguuuuguuuucuugcaacaauauauuuuggagaugguccaacauuaauacacauagaacuacuuccguuuuucauacuaugcacaaaaugacauaguuuaucuaaaccauguuuaguuacucuccuuugaacgauauuuagguuguucacauaauuauaaacaaugcugcaaaaagcauucccuauacauaccccauuaugcauguacuugaguuuuuucuugaggguagauuuugaaaagugaagugcacaauuugaauaugaauggacaggacuaauuuacuuccaaaguauuuccaccaauuuaugaacccaccagcagagugaaaauacuuguguacucaugaccucaccaacucuugaaauuaucaaucuuguucuauuuugucagucugacggguuguucuuuaauuuuuuuauuguauuuccucaaauacuaauagaauaaauacauuuucauaugcugacaucuuccucuuuuauugcucacugauuucuauucuuuaccuacuuugcaacuaggcagcuuguccuuuuuguuuguuucaaaggaaauuuauucuauuggucuuuugucauguauagugcaaauauuuuuucucagccuuuuaacugaauauguaauguuuuauuguaagggaauuuauuuuuuaauagaaacaaauguaucuuuuuuucccuuaugacuuccacuuuucacgucauccuuaggacuauaacccacaauuauaagauauuuuuuauauuuauuucuaaugcuuuuauagucugaauuguaucugagccuuuaaacuaccaugaauuuauuuuuguaagguacagcucuguucuuguuuuucaaauauaaacaggcaaauuuuuaacuucucugaaccccaauuucccuagcuauaaaacggggguaauaauauguaccucaugaacgcuugaagauuuuuaaaaaugauguucuuaaaucuccuagcacagucguugacauauaauaaauguuuacuacauuuuuuaguuguaucugaaaauaguuaauacauguuuaauaguuauauugagacuauaugaauaaauuaacaacauauugaauacuuaaaauacuuaacaaaaacagaaccaagcaguauaggucauaaaaacuaccagucgggccgggcgugguggcucacacuuguaauuccagcacuuugggaggccaaggcggguggaucaugaggucaagagaucgagaccauccuagccaacauggugaaaccccgucuuuacuaaaaauacaaaaauuagccaagcaugguggugggcgccuauagucccagcuacucgggaggcugaggcaggaaaaucacuugaacccgagaagcagagguugcagagagccaagauugcgccacugcacuccagccuggcaacagagagagacuccgucucaaaaaacaaaaacaaaacaaacaaacauaaaaaacuaccagucaguccacacuggaaauucuauguucauauaacaauuaguagguuaggucaggugugguggcuuaugucuauaaucccaauacuuugggaagcugaggugggaggaucacaggaguucaagaacagccugggcaacauagugagaccccaucucuaccaaaaaaaauuuuuuuaauuagcuggguguggcggcacauguccgcaguuacucaggaagcugaggcaggaggaucgcuugagcacagaaguucaaaguugcacugagcuaugauugugccauuacauuccagccuuggcaaaggagugagaccccaacucgaaaacaacagcaacucacccccaaccugagugaguuagccauguguggaaaucacagcuagaagacauauugaucauucuugggaguauagaagguacagaaugguuuuaauauuuacugagcauuuacuauaugucaggaaguguuuuaaguacuauauagguuuucucuagugaccccucaagguaacucuaugaguuagguacuuaugucaccauuuuaaaaaugagaaaauugaggcacaaaaagguuaaguaacuuuugcaagguuccaugguaaguuggcaguagaaccagaauaugaacccaagcagucaguuucaaaagcaguacuucuggucacaggcuaaccugccuuaguaaaaucccaaaaaggucuuaaaucugaagaagcagguauuuuccuccaaacaacagaagaugccaggcucagagaagaaaaggaauuuguugaaggucaggacauggagcaaaaucggucugaccuuaaugaccacagaagaaaggaaccuaagucaguugaggacaaaauggggcagagcugaugagagacuucuucuaaaaggaagugaucugggguuauuuaagugagcacagcagauagagagaggugacacugagcacaaagaaaaguagggggcauggaagaacauacacuauaaacugccacuggguucuauauuacauaauaauucucaauuuccacagaauaaaauuuucacaggaaaaggccuccucuggaauagugaaaacaacaaaacagauguacgaagagaauuguuucacucagcuuagacgaaaacuuggacaacacaaaaggucaucuguaacuuguucucaguuaacccucaaauaucaauagugggauacaguggguccuuauaauacuccuuacaacagacacaugaugaagaugugguaauaacucauucuaccugaaguacagcagaaaaauccaagauauggcaaaaccaaaggaauuucuauuacacucaguuuugcuaagaauaguauuagauuuguaaucauagauucauagaacuggacagaaucguaaagaacugucuaguucaauucucucacuugaagauggacugaaaccaagagauacuauuaucuguucaaaguggcaugguuucuguucaaagugacauggugacauggcagaacccacccauuugucuucaaggaagcuauaaugaaggaaccuuuuaaaauccacuguauuugaagauuaacaauaaucacaugugacuuagcauagggcuagaagaacacaaugccccuuuaaaggcagaauuuuccauauugccaaagucuccgugcgcguagaagcauacuuacuuaaccagucuuucgauggucugcauaugaacauuaguauggguuugggaaagaacagcuucaugcugagcacauuucaaacaaagaccaccaacacgguuacaaguauuagcagccagaagaaauucuuuaugcuuuaguugcucuuuaagaucuucacaaguucucugauauucagcuaagucguuccuaaaaagagggugaaaaaauucuagaaaauggccagguaaaauuacaugacuuuaaaaugaaucaucauaauguuaacuacuacuaucguuuauggguacucaccuuaugcuuuaguuuacguccaauaccuuauuaauuuuuaccacgacccugaaacuuugguguggugauucuaauugacacguugaauaugaugagacuggaauaaauuacauaauuagcuuagguucuuguaagauuuuaauauagauuagaauccgccugacacuggcucucuugucccaggauccaaccuccauuaauguuauauuaaccacaaaacaaaaauaaaacuccaaauauaaaucccaaaucauuuuccuuaaaaaaggggugggguaauauaagacaacauacuugaggugaggaaaauacccuauuucaagcauuaaucucuuaaaauuuuuagagugucuuaaaaguucacauaaaaaaacauggauuuuuauccuugacuaguuuauuacugcccauuuuucuucaggaggaaaacauuacuguuagauagauaauuaucuaacgacaaacuucuacaaagaucuguuucaaaagaaaguaaguuacagaaggaaguuacauagaacuugccagucauaagauuucagggguaguagcuauuagcuggaaacauacaggcugcuaaagaaagggcuggggaauggugggggugggggugguguggguguggguguaguuuuuguuuguuuuuacuuuaucagcucaccucuggaugagguuuuucuccaaggugacuuuuuaaggauuaauugacuaguacauggguuguauuuuccuaccuuaucccaguaaagcugcgcuaaagucaccuuggcaacugagcuuccuugccuagaugguucuuuuguacuucaaaaaaaaaaaaaacaaaaaaaaacuuucuagcugaaaaaugagacuacugaaggcaggaacuuuaucuccaucucugucuacucucuguugucauugucaaagucuccacgcucaggugcuguggccaucuuaacuggcucacugucacagaggagaagccaacagccuggcugucagacaacuguugagauuuugggggcuuucaagcaacgcaggagaggcauaaaagacccacaggcaaucuaaggguuaaaaaaaaacuuuggaauggcauuccaaaguugaggggaagaaaaaugagcugcgucuacccuauccccaaaauaauaacaccaagaugauaaguuuucuuuuucaauaucauguagggaaugucugacuuucaaaggcuuuauaaaaagaacuugggaagcacauuccaaagucaaaggguccccauuacuaauuuuggucagcuccaaacucaaaacacucaaguagauuugguuacuagaaauggcaaaagagaaaguuaaaaagaaaguugaaaagaagacugauuuuauuuauuuaugaaaaugccucuuuaaauaaucuuaaauuauaguaaaagaaaaugaagaaacagaaggauucagagaacaaagucuaauucauuacaaguugguauuuuaauguaauuaaagaugaaauaucuggauucugaaugagacaaaauaagucacauucccuuaaguacaaugaucuagaaauacaucacuuuaaaaacuaaagaaucaagucguaaauaaaaucaaaauaaaauaaaauaggacaaaaaacaagaaagcaaaaauuagaguauuuuuuaaauguuaacauuucuuuguaaaaaaguaaaaaucucuaagagaaauccuaaaacuaaucaggguaaucuaugaaaaacauaagaacauuuaaaaaauaaacaaccauguacagugaaagcuaugaguuccagcucgguuuuuuuuuuuuuuuuuuuuuuuagauggagucucccucugucacccaggcuggagugcaguggcaugaucuuggcucacugcaaccucuaucuccuggguucaagugauucugccucagccuccugaguagcugggacuacagaugugugccaccacacccagcuaauuuuuauauuuuuaguagagacaggguuuuaccauauuggccaggcuagucucgaacucuugaccucaaaugauccacccgccuuggcuucccaaaguguugggauuacaugcguaagccaccacaaucagcugaguucuggcucuuaguauuacucuaguuaugucucuagauaggcuauggccuggaagauuuuaaaauuucaaauuggacuuauuaaaauaaaauuauaaacaauauuucaaaguuuauuugauuuaaaauuacuucauuacuacuauuuaaaaauaaucuuuaacaacaaaaauauuaauuccugcugucuuuuucuacucauuauacauaaaucacuaaugguuaaucuauaauauauaggucuuacugggaucucuaauaaauagauucuauaaaaaguacaugaauauucaucauauauacucaaauucaucauguauacaaauacucaaacuauuauauuaucauugcaauuuuaaaauuagaugaagacuaucuacagagaaaaaauacuaauaauuugaaaacuaaagugcuuuauuuucauuauuuuacuugaauaucauaauuucuauaagagcaguuagugauucuuauuucuuuuuuuuuuuuuucuuuuuugaaauggagucucacucuguugccagguuggagugcaguggcguggucucagcuuacugcaaccuccgccucccagguucaagugauucuccugccucagccucccaaguagcugggacuacaggcacgugcuaccaggcccagcuaauuuuuguauuuuuaguagaaacgggguuucaccauguuggccaggauggucucaaucucuugaccucgugauucgcccgcuucagccucccaaagugcugggauuacaggcgugagccaccgcgcccggccgugauucuuauuucuacaagaaaacacaaauauuuuacaacugaugaagaaaugggaacgugauuuggaaaagaacucaauuuuaggccuuucauccuuuaauaaucugaggaaauuuuuuaaaguguauuaaaaugucaucaaguaagucugauaaugacuaaaacuagaaguucagcaaacauucaaauauauuuuaagaucauuaugcuuuugguaugacuauaaauggacgauuucacuuuaccucaaaaacuucaauugggauuccucaauuucacacuuuuccucauaaguaaguuuuagcuucuccuauagaaaagaaaaauagaaguacauuuuucucuauguccuguauuuuauaaguaaacuuuaauuuuuaauauuaaacucaauuuuuuucuuuuuacccaacgugggggaaacaugucuucuuagaaaauauuuucccuaguccacuugaauuuuucuauuuuuauugugugaaugccugcaaagaaccgcugagucauaaaauugauuuucuuugucuuucaaaauugcauauaucaggucuuaucccuaaaagugugacucuggggaaaaacaguuauaacccauaagguccaugagggcaaagaucaaaucuuauuagaauccuucauuguggcuguugaauauuugacauauaauaaauaugugcuagaugaaugaucaaaaguaaaguuuuauaucacaugaugauagacuaacuccuacaagccucuguugguauccaguuauucuuucauucaacaaauauuuauuguguaucuaagaugaagguggcuugaacugcaaggaacuuacgaaauaucccagaaaggaauagaaaaaugaagaauuucaauuacaguugacccuuaaauaacauggagguuagggucauugaccccuguacaguuggaaauccauguauaacuuuuuuuuuuuugagacagagucucacucuaucaccaaggcuggagugcaguggcgcaaucucagcucacugcaaccuccacaugcuggauucaagcuauucuugugccucagccacccaaguagcugggauuacaggcaugugccaccacgcccggcuaauuuuuguauuuuuaguagagaugggguuucaucauguuggcuaggcuggucucgaaccccuggacucaagugaucugcccgccucagcuucccaaagugcugggguuacaggugugagccacugcgccuggccccauguauaacuuuugacucccccaaaacuuaauuacuaauagccuacuauugacuagaagacuuaacaauaauauaaacaauuaacacauauuuuguaugcuauauguauuacauacuauauuauuacaagaaagcaaucuagagaaaagauaauguuauuaggaaaaucauaaggaaaagaaaauaguauuuucuacucauuaaauggaagcggguccucauaaaggccuucacccuaccaucuucacauugaguaggcugaguuggaggaggaaaaggagggguuggucuugucuucucagggauggcagaggcagaagagaugcaggaguuaggagggaaggcaggagaggcaggcaaacuuaguuaacuuuauggaaacacgugguaauuucugucucacuuuguuaugcucuuuaauuucuccaaaaauguuucuauaugauaucuauccuucuuccauuugcuuuaguuucagugccuauauuauagaaggguccacgucauaaaagaagucaaaagcagucuugaauaaucagaacccuucugccagauuaucucaugucaauuuguuuccuggcacugauucuucuaugucuucuuccucauuuucuggcacugguucaggagcacucaucuccaucaacucaucuucuguuaaguccuuuguguggugucuauuagcucucgaauuucuccaagaucucuaucuugaaacccuucacucccaaccuuuuccaccacauccacaaucucuuucaugauuuccuugauugacuguuguaaaucuuauaaagucaugcaccacauuuggacaaaguuuucuccagcaggaauucauuguuauggguuugaugacuuucauggcuuuuucuacaacaauaauggcauuuucaaugcuguaauccucucacacuuucaugauguucuugcuacugggguucucuuccauuguguugaaaaugcuuuccauagaguacccauauguaauaagccuuaaagguccuuaugacugccuagaucuugaggcugaauuagagacauuguguuugcaggcaaggagaccacuuugaugccuuuaguguugaacucaugggguucugcguggccagagccauuguacaauaucaaaaaacuuuaaaaggcagucucuuacuggcaagguacuuccuaacuucagggacaaaguaucaaugaaaucaguguagaaaaagguuucucauuguccaggccuucuuguggcacaaccaaaagacuagcaguugguguuuaucuuuucccuucaagucucgugaguuaggagcuuuauagauaagggcaguccugaucauaaaccugaguacauuugcacgaaacaguagaguuagccuaucccuuccggcaucaaauccuggugcucacuucucuuccuuacuaauaaauguccuuugugacauuuuuucccccagaguagagcacuuacaucugcauuaaaaaccuauucaggcagauaucauuucuccuaaauaauuuucguccuuuuuuuuguuuuguuuuguuuugagacagauucucacucugucacccaagcucgaaugcacuggugcaaucuuggcucacugcaaccuccaccuccuggguucaagugauucucaugccucagccucccgaguagcugggauuacaggcacgugacaucaugcccagcuaauuuuuguauuuuuaguagggacaggguuucuccauguuggccaagcuggucuugaacuccugaccucaggugauccgcccaccucagccucccaaagugcuggaauuacaagugugagccaccacacccagccucuccuaaauaauuuucauaauugcaucuuggaacuugucugcugccucuuggucaacagaagcugcuucucuuguuaucuugacauuguuaagaccaaaucucuuccuaaaauuaucaaaccauccuuugcuggcauuaaaaucuccagcuuuauauccuuuacuuuccuuuuguuuuaaguugucauaaaaugacuuuuuuuuuccucaaauuauauuagagucuacagguaugcuuuucuuauagaaauccuguacccauauaaaaucugcauuuuccaugacagauaaaaaggcauugugcaaaaguacaaaguuuuugugcguguuggcacggcugcagugauggcucuacaaauuuccuuuucuuuuuguacaaugguccuuauauuggauuaauuuaucuugaaauggggcaacagacuugaaauggggaugcagacuucaaucuauggaacauaucaagcaauguaacuuuuuccuguaaugucaugaauuugcuucaugggagcacuuccagcaucacuaguggcacuuugcaugggccucaugguguuauucaagguuuacaguauugcaccaaacaugaugaaaaguacacgagaaccaccaagagaucacuuuuuacugugauaugcaauuuacuggaaagacaaacuguuuaugcagagauuaacuggugucacaugauguuuuaagcagacacucaaaacacuugaacucaccacaauagcaauaggaggugguuaugaaauucuuauaguaguacaguauguacuacauuuuacuuuaugcuguuauaauuuaauacugcaucuuuauguuuuuuugcauuccuccugagaaugacuccguguacagucugugauaguguacauaaguuuugaaaaauuuuaacuuuuuauaacagauuuguguauauuuuaugguaguagaugauaaaauagacuauuaccuacauauauuuuauucauuuaugacauaccucuuucuuaauuuuuucauauuucuaagcuacaugguucaucugcaaguuuuuuuaaauugccacaaaucucaaaaaaaauucugguacauuucuucagaaaaauacacauauaagugaacccacacaauacaaaccuaucuuauucaagggccaacuguucauaaauugcucuagugaaguauauggaaacugaaaaauuuagagaggcaggaacuccuaauucagccaaagauaaguaaagaaggccucacagaggaaauguuaagauuugaaggauaauuuccaguagagcagaaggcacagagguuguccaaaccauguuuggaaaguaaguagaucaguaucacaggaauguaaaaugugagguggagaggugauuggagaugggcaaaauagguaaaggugggccacaagaagaauaaaaauaucaagacuuuuauuugguacacaugucuccugcacuuucccucuagaagaaacacuggagggccacugaaagcuuuuuaucagaauugagucuuaaaucauaauugaagugugaagaaagggaaaccaguaauuacaaauacauagguaagagauaagcacaugaacaaaagcaaucaagcaguaggaacuaaaaagaaaggauuuaguauagaaauauuuaagagaaaaacugagaauuuuaugacagaauagauauaggggagaaaaauacacuaaaaauaauccuggguuucugaagugagcaaucaagugaauacugguacuaaagauuuuuuucagaccaacaaaaaaaagcaaaagggaaucauaaaaauaauuaauucauggccaggcacaguggcucacgccuguaaucccagcacuuuggcaggccaaggcgggcggaucacgaggucaggaguucaagaccagccuggcaaacauagugaaaccccgucucuacuacaaaaacaaaaauuagcugggugugguggcaugcgccuauauuaccagcuacucaggaggcuaagauaggagaauugcuugaaccugggaggcggagguuguagugagucaagaccauuccauugcacuccagccugggcaacagagugagacuccgucucaaaaaaaaaaaaaaauuaauucaaagaagacagaaaaagagguaaaggggaacaaauaagagauagguaaagaagaagccaaauagcaagaugguguauuuaaacugaguuguauaaauaaucacaauaaaugucaguggucuagauacccaaauuaaaaagcaaauauggccaggcacgguggcucaugccuguaaucccagcacugugggaggccgaggcaggcggaucaccugagguuaggaauucgagaccagccugaccaauaugaugaaaccccgucucuacuaaaaauacaaaaauuagucgagugugguggcaugugccuguaaucccagcuaauugggaggcugagacaggagaauagcuggaaccugggaggcagagguugcagugagccaagaucaugccauugcacuccagccugggcaacaaaagcgaaacccugccuuuguguggggagggagaaaaaaaagcaaauauugucagauuggauaaaaaagcaaaacccaacuauaugcuuucuauaaaaacccacuucaaaaaagauacaaauagguuaaaaguuaaaaguaaaaggagggaaaagauauaccaugcuaacacuaaucaaaagaaagugacauugaaucaaaauacaaaacucauguguuuuucucuacacuagcaauuaggaguuagaaaauaaaaauuuggaagauaugugucauuuaugauagcauaaaaaauaaaaagucaggaauaauucuaaugaaagauguaugaaaccuucacucagaagacuaugaaagguuauugacaaaaauuaaagaugacucaaauaaguggacugauaugcaguuuacaaggauuagauaauaucauaaaauguugauucucaaaugaccuauaauuuauaauuuaaagccaucucaaucaaaaucccaaaugacuuuuggaacuucacaauucugaacuguauuuggaaaugcuaaaggccaaaggauaaagaacaauguuggaagacuuggucugccagauuucaggcuauaacaaucaagacaguauaguauuagcacaauuaacuaaaacacaguccaguaauagacccaaauauauauggacaacuuauuuaggagaaagguacuaucauaaaggcaaaggacuaccuuuccaagaaauggugcuuggauguauaaacacauaggaaaagaacaaacuaugaccccauauacaaaaauaaauuccagguagguuguagaucuaaaugcaaaaaguaaaaccauaggccaggcaugguagcuugcaucuguaaucccagcauuuugggaggccgaggcagguggaucacuugaggucaggaguucaagaccagccuggccaacguggugaaaccccgucucuacuaaaaauacaaaguuagcuggccguggugggagaaucgcuugaacccgggaggcggaggcugcagugagcugagauugugccauugcacucuagccugggcaaaaaaagcgaaacucugucucaaaaaaaaaaaaaaaaaaaaaaaaggcagggugcgguggcucaugccuguaaucccggcacuuugggaggccaaagcgggcggauugccugaggucaggaguucgagacuagucuggccgacauggugaaacuccgucucuacuaaaaauacaaaaaaauuagcugggcaugguggcaugcgcccguaaucccagcuacuugggagguugagacugaggaauugccugaaccagggagguggagguugcagugagcugagaucgcaccacugcacuccagccugggugacagagugagacuccgucuuaaaaaaaaaaaaaaaaaagugaaacuauaauuucuagaagacuauguagaagaauuagcuucaugauuguaguuggaaaaaaacuuuuuuaaaaggacauaaaaaacaacuacauaauuaaggaaaacaaacugaaguucuagccaucaaagcaagcaagcaaacuaucaagagaguuacaagcgaagccacagagugggaauauauauuuauaauauguauacugacaaagggcuugcauucagaauauauaaagaacuccccaaauaaauaugucagauacauaccuuaauaaaaauaauaagaaggauaucugaauaggcggcucacagaagaggcaucaaauggacaauaaauguaugaaacaauacucaaucacacuaguaguuagggaaaugcaaaugaaaaucacaagauagcacuauaaguucaccagaaaaauugacaauacuauaugauuaguaaggauauggagcaaagguaucacucauguacuacugguaggaguguaaacugauaaaaccccuuguauggguaggaguguaaacugauaaaaccccuuggaagguugucauuaccuacucaaguugaacacagacauauccugagagcaagaauuccacuccaacauacauaugcaacguaaauuugugucauacacaccaacagaugaaagaauguucauagcagcacugcucacaauagcugcaaacuggaaacaacacaaacguuccuugacagcagauggauaaagucauauguucauauagcagacccaccaaagaaaaugaacaaacuucggccaauguaacaacauggaugaaucuaacaaauauaaugguggacaacagaaaccagauacaaagaauacauacuauacaauuccacuuauauaacauugaaaaaacagaacucaaaaguguuuaaugaugcauacuugaguauuuucagaaaauucaggaucaugauuagcuuuaauggcaugaaggggcaguaacuaggaggaagcauaaaguggugauaaucacauagguguucauuuacagauaaaucuuugagcuguaaauuuuuguuuuguguacuuuacugaauguuauguuaaauugugucuuagaaaauauaaaggaggaggguauaaucaaccaauguacauguuauacaaagcugcuacuagguuuagagcaaugaggacugauggcuggaagucauuaaugaccuuaaaaagagcaguuggggccgggcgcgguggcucacgccuguaaucccagcacuuugggaggccgaggcgggcggaucacgaggucaggagaucgagaccacggugaaaccccgucucuacuaaaaauacaaaaaaaaauuagccgggcgcaguggcgggcgccuguagucccagcuacucgggaggcugaggcaggagaauggcgugaacccggaaggcggagcuugcagugagcggagaucgcgccacagcacucccgccugggcgacagaacgagacuccgucucaaaaaaaaaaaaaaaaaaaaaaaaagagcaguugggguggacuacagggggacgaagcucaacugaagcauacugaagcaagaauaggagguaaagaaguggagacauaaauauagacaacugcuuggaaaaaguuugguaugaaaaggagaauguagauguagggugauaguuggaagugaauguagggucaggagaauauauuuuggguuuguuugcuuuaugggagcuauuaaagaauauauucugcuaagaauaaacuauuggccgggugcagugguucacacauguaaucccagcaguuugggaggcugaagaugguggaucacuugaggccaggaguuugagacuagcuugagcagcauggcgaaaccccaucucuaccaaaaauacaaaaauuaaccaggugugguagcacaugacuguagucucagcuacuuggguggcugaggcaggcgaauugcuugaacccaggagguacagguugcagugagcugagauugcgccacugcacuccacccugggugacagagcuagaucccgucucaaaaaaauaaauaaaauaaaaagaauaaaccauugauagggaaaagauacaagagaaagaaaagucccagaaugaaacccuuggaaaaagugaaaaacacuugugagguagagcacacaaaugcagaaauugaccuuuuucauaaacaaggaaaaaagaugagucuccaauagucauaaacacagugcuagggggaggcauaaaagagaaaggaauucuaaugcagaaaagggaagagagaaaacaugcuauucgggaaagcagaaugagagggcgcauuucaacuauacccugaagacuggaaacauuucaauagguagaggguaagaagggaacauuuuggggagggaggacugcauaaaccaaagccaguucuucaaagagaaaugaaaguggauuauaaauuuaugaagcagcaacuggugaguggucugcaugccuacagauaagauuuguaagagugacgggagaagagugaggccgaguacaguggcucaugccuguaaucccagcacuuugggaggccgaggcggguggauuacgaggucaggaguuugagaccagccuggccaacauagugaaaccccgucucuacuaaaaauacaaaaaucagccgggcaugguggcgcacaccuguagucccagcuacuuggggugcugaggcaggagaaucgcuugcacccgggaggcugagguuguggugagcugagauggcaccacugcacuccugccugggcgacagagcaagacucugucucaaaaagaaacaagaaacaaaaaacaaaagacaggagaagagugugaaacuaguucgaacauuaguuugacgcaaauuguggaugacuugagacauuggucuuuauccuauagguauuaaguagcuacuguaaauuauucagagagggaaaaaaaagauacaauuuacuuagucuuuccaauuuucuuuuuugaagaaggauacucuuucccaaguagaaugaagcuuggauuagggacuaagacaggagagggugacugggcagaaagaaucuuuagaaaacuauaucaucuguggauaauaaugagaaccugaacuaugauucauucuaucuuccccuggaacauuccauuuacaguguuaaucucacucuuucaucauuguugaucaacucugacaugucaaauuuaaugcaaagaagacuucagguuagcaagagaagaauaaacgucuguuacauacauaaaaggauugaaaaguauuauuuagucuuaaaauagaauuguuuuugacgcuuugggaaauuaggacguucaaaggcagcugugggggggggggggaauuuagaaagucacaguaugccuaggaaagauacacacucagaaacauccugagaagacuguaagcuuucaccuauggcugaucccuaggcucagagcaagccugguuaaaugggaaaagaaugucccagcacagacccaaucugaaaagacugggagagguggguuguucucucucucucucucucucgcucuuucucucucucucucucuccccccccccaccuuuuggggggaguggaggguguuuguuuucagcuccuggaauucaaggaaaucucugucaaacauuagcugaacaugagcuaauagaacaaagacuucaauaaucacacgauauggaauagucuucacaaaaauaguauggaaaugucucaaaacaaaaggaguauuacagccuucaaaaguaaaauaagacagcaaauucuagaaaagaaggaguuaaagauuuccagaguuaucacauuacaauagggaaaugcucaauuuucaacaacacaauaacaaggaauacaaggaaacaggaaaacaugcucacucaaaagaacaggauaagcugacagaaacuacgcucgagaaaccacagacaucagacuuacuggggaaagacuuuaaaaugacuguguuaaacacacucaaagagccaagagacaaacauggacaaagaacuaaagaaaaucaggaaaacacauuauaaaaaggaaccaaacagaaauucuggagcuaaaaaguauaauaacugaaauaaaaaauuuauuaaagguauucaagagcagauuugagcagguagaaaaacgaauugaugaacuuuaagaaacgacaauuaaaaugaucaagucugaggagcagaaagaaaaaagaaugaagaauuaccauaugauccaauaagucuauuucuggguauauacuuaaaauaauugaaacagggauucaaacagauucucauaugccaauguucacagcauaauuauucauaacagucaaaagauagaaacaaccccaauaucagucaauagaugaauggauaaaguuugguaacauacauacaauggaacauuauucagucuugaaauuuugacacaugcuacaacaaaaugaaccuugaaaauauuaugcuaagggaaauaagccagacacaaaaggacaaguauuguuuaauuccacuuaugucaaguaucugaaauaggcaaauuuauacagaccgaaaguugaagagaggucaucagggguuggcagggaggggaauggagauauuguuuaauacguccagacuuuuuguuugagaugaucaaaaaguucugaaaauggauaauguuuaugauugagugacaugaauguacuuaaugcagauaaacuguacgcuuaaaaaugguuauaaugguaaauuuuguuauauauauuuuaccagaauuuuaaaaaaguacaaaagagaaaaagaaaaaaaagauguauaagagaaaagcacccaaauacucaccaguucuagcugcucaccagcagaugcagcuuugccaaaaucugcauugucaugggaaaauggucuuuuggagguuucgcccaccccagaaucuucaccuguuguaauccaagaauugugcauguuucccuaaaauaaaaugugccaguaacugcaacugaauucaacuuuaaauaaacaugcauauuuuacaaauaaaauaccuauucuuaccuaugaugaaaagaaaaagcauaugcuucuacacuacaggucaagaaucacuucacauuuucaggcuauuagggucauauucuacaaguguugcaaaguaaaauuccuucagguacaggcaguaaucuaaauaugggcaaagagggcuagauuucagcgcauucaacaaauggaauuauucuuuacuccucugaagacauauacucuugaagcacacaccucucucuuaguuugucuuucauguuccauguuucauaaaugcauggcuaauaauaauuuuuaucaaaaugcugcuuucuauguuccagacccuguuuuauguaugucauauauauuaacucauuuaaucauuacaguucuaugggauagauagguuucauuguugccuccauuuuauacaggaggaaacugagucacauagaguagcugagggucacagagguaggaaguggcuaauaaguggcagcacuagaaucugaaaccugucaaucugaauccaaauauauauguggucucugucccugguuccugacacagaauuccuaaaacccuguaauuuccugagugacaugggugauaggagcaucuuucguuaaaauauuuggucuuagucccggguuucugacacaagugcuucuaagacccuuaggaucuccauggugauaagaguauccuuucguaugcuaauaagaugacugguggcugcaguccaugauuagaagacuagaacuuacagccccacucccccaccucaaggggggaaaggacuggagauugacuuaaucgccaacagccauugauuuaaccaaucaugccuauguaauaaaaccuccauaaaaauccuauaugaugaaguucagagaauuucuggguuggcgaaugcauccacaugccaagagggugguguacccaaacuccacagacagaagcucuucuacuugggaccagccuggacccugcccuacgugccuuuucaguuggcuguucauuuauauccuuuauauaauaauaaaccaguaauagcaagcaaaguguuucccugaauuuugugagccauuauagcaaauuaucacacauuaggaagggauuguaggaauccccaauuuacagacaaaucagacagaauuguggauaaccaagagaccuacuauuugcaguugguaucuaaaguagcaggcagucaugugguacugagcccuuaaccugugggucugauacuguguagugagugucagaauugaauugaaucacuggacaccuaguugguaucuacagagaaacagagaauggccagguguaggagaaaacaaacccaaacauuuggugucagaagcauuaugagaaaaaggaacaguuuuuuccuuuaaaguccuuuauuauuacgaucuucugccuuuccagaaaaauauuuaucuucaguaaaaagaaacagugcauguauggugauaaacagaguugacaugcagccugcaugccagggauucaaaaaggaagaagaguaggcucugugacaaaccacagaaauguguaccauccaaaggaagcagccacuacucaauuccagucaaucacugccauguggcagugaaaauucauauuaccagauaucugguccuucaugugaaacacuauuaaacacuggcucaaaauuuaucaaacaaaccaaacaugccugaguugaauuuaguguacccauuguuaguugcaaccucugucacccucucaacauucaauguaguaagcagcccaaugaucuggggaauuuauguguacaagaaggauuaaaauacguauauuaauuuaauucaacaaauaauuauugagcacuugcuaagggccaaaggauaugguaguagucacaagacaggacagguccccagacacugacccauacugcagugucgcaucaugcucgaacgugguaaacuacauucaccuaaaguaguacucugacagucuauuuuauauucuucuggaaguucaguuuagugcaaacauuuguguaacaccuaugguguucagacacugugcuaagagcuuggaggacaaaaaugagcaagaucaaucuuagcuccaaggaguuuacagucuaauaagggagacacacaccuaggcagguaauuucaauuuaauaaugugagugcuaggccaaaggugugcacaggggccucugccaaaacacaggagggauacuaagggcacccagaaauccaaggaagguuuuccagaaaaaaauugacacuggugugguaucuugaaggauaaguaaggguaagcuagauggaaagggcauucgaagaagagagaaccucaugauaaacaucacagagguauggaauagcauggugccugcaggggggucucagaaaauucagcauuacuagacgucaaaacauaaggugaugaaugucagaagaugaagcuaaagaaucaaguaagggacuugagaguauaccacaccauggaaugagucugcacuugauucucucgguagagucaaauccccuaagauaugauugcauuuaaaguuguuuuugagaucaaugaaggagggugguacuaauuuucuauggagaaauuggagggagcauguagaccacagaucacuaacuuaugauauaaaauauuaucauucuuuggaaagaauugcuagucuaacggacauuuuguucuuucacagauaguuuuaaaaaacuugaaugcuacuuaaccaagauguuuuuaaaaaccuaaguauguuaaauccuugaagaucauucaaaaccuuugauuucuuaauuggguggcaggggaucggggggcgggagcggugguaagacaggggaugaaaacaaacgugaaaaauauuggccgagaaauuuucuccuuaagaaaaaacuccuggaucuuuaaagaaggacacaugacaaaauguugaauaaauaacauguuuucguauuauuuugauuuugugaacucuagagaaaagcuuuccaugaggaaauauuuuaugagaaggcaaagugaugaaaaaucaggacaggaaugaaauauacuuugaauggcuugcuucuuuaacuucuaggucauaaacuagaccaaaaguugaaagucuuacaggcuaccaucaaaguccagggcuacaagcaggagacaauaaaaaggagauucuucucuuuucugccagggaaaacuucuauccucugcaaacaaagaugguuugguucaaugucgacaagcucuuccuaacuuaugcagaaaggcgguauaauuuaagguucuacgggguguauuuagagaauuagauaguccuggguuugaauccuugcuuugccauuaucuagcucugugacauuaggccaauuacuuagguuacuuaacagcuguguaccuuaauuuacuccucugaaaacagagauaauaacaccugccuuguguggguacugcaaaucugaaguaauauaacguaaauaguuugacacagugccucgcacauuauaaccauguagucaucaauaaauguuaguuauuacuauaugagaugguuaauacugagugucaacuuaacuggauugaaggaugcaaaggauugauccugggugugucugugaggauguugcuaaaagagauuaacauuugagucagugggcuggggaaggcagacccacccuuaaucugggugggcaccaucuaaucagcugccagcgaauauaaagcaggcagaaaaacaugaaaagguuagacuggcuuagccucccagccuacaucuuucuccugugcuagaugcuuccuguucuuguaccucagacagcggguucuucagcuuugggacucagacuggcuuccuugcuccucagcuugcagauggccuguugugggaccuugugauugugucaguuaauaaguuaauacuacuuaauaaacccccuucauauauauauauuauaucauauuaguucuguccuuugagagaaccuaauacaccauauaaauguuucaauuaucuuuuuuuuuuuuuuuugagauggagucuugcucugucgcccaggccagagugcaguggcgcagucucagcucacugcaagcucugccuccuggguucacaccauucuccugccucagccucccaaguagcugggacuacaggugcccaccaccacgcccggcuaauuuuuuguauuuuuaguagaguuggguuucaccauguuagccaggauggucucuauuuccugaccucgugauccacccaccuuggucucccaaaguguugggauuacaggcgugagccacugcgccuggccaccucaauuaucuuucuuaaaaggcauuaugaaacacugaaaaucuauauugaaaucagcaaacuucaauauagcaagggaagauuuagcaccaacauuuuaauugacucauuacaaaaaccccuuccccccaaaagaagauauuucuugauuuuuuauauuuaagauauccuaaacauuuuuauucauguuacaacuuguaacacagcaccaugcauguauuauugaaaugucugguuuuuuguuugucuuguuuuuauugaggcaaggucucacucuguugcccaggcuggagugcaguggcgugaucagggcuuacugcagccuugaccuccugggauccucugaccucagucuccaaaguaguugggaccacagguguacaucagcaugcucggcuaauuuuuuuuuuauuuuuagagagauggggucucacuauguugcccaggcuugucuggaacucuugggcucaagugauccauccguucgugugaucauccuuccaaacugcugaaauuacaugcguaagacacuguaucuggccuugaaauauuucaauucacuuacacagguaaaacguggggguaacaauucaacaacaacaaauaacagaagauuaacauuaaaauagauaucaaggucaucuggcauaucugcaguaaucauuucaauaccugcauuauauuuagcucacaugaauguuuaaaaaacaacaaaaccucucuaaaaccuuauccuuucuaugauucugacuguaguuuuguuuagcacauuuucuuugcucaugcugcaaggcaugugugcucugaccaucauuuccuuccccuuuugcauuacucauuucucuugcccucugauucacuugucugccuaauuuccuuucucacuucacuuccccuucuuccacuucuuuggcauuacauaaauacugaggacuaugaauaauugaaucacugcuugcuaagugaccacguguuuggaagaaaagcaaaugaauauuuuuaaaauaagcuacuucuaaguauuuucuauauggugauaucuuccucaaauugacauuaaaaucauaagcaacuaagauggaguuuuuaccacuaauaauuauacaaaucuucaggaaaaaguuauacagugaggagaaaagaacugaucacaaacuuaaaugcaauugcagaaaauuaaacugaaauacuaauuagcccacuucauuuaucagaguuaauacacuccuauacuucucaauagcaaacccuaacauauacaacuccaggauuauaaaccaacuaucaauucaaguuaaaaaaaaaaaaaacuucaaaaacgaaaauuagaggauaucccaaugaaacaucaagacuuucauguuuucuuaacagcugauuuacuaaugacgacaaagucaaaaccaccaaaguaaacugcaaagugaagcuggaauaggcaaguaugaaaacuuccacauggaaaguugaauuugucccaaaaagcagaacaagcugugacuauaucuuauagcaaaacaguuacaaaaaguuuaagacaaaaguacucugauaagucauaagauuuaagcacuauuuaaaugucaccacaauaauucucugucacagaauuauagagauaaucugacccaacguucuucaaacucugggccacugacauuagaaucacuuaggcaacuugaugaaaguuuagauuccuagaagccaaccagaccaagugaaucagacucacaggggauggaguccaggaauuugcacugaaaacuccugguauagguuaaucuucucaaauuaccaauaaagaaauaaaggacauacgugauuaagcuauguaaaaccuucuaaaauuacuugcuaaacaccagccuucuuagggaaaugggaagacuaacauuuugauucuuggauccuaaggccaacauuuuuucugcuacaucaugcagcuaauuagacuuauuagauuucagaccucaaggaaaauuuagagaaauccaacagaaaucuaaguuaaaguucugaacgguuucuagacuuagcaaaguccuuccuguauaacacacuuccugcuuucagaccggcucuuuccauaugguaaggcagaaacgguaugcucagagaggaaacuguagcaaaauaucacaagaucguuucaucugaggauucauuccaccacagugaaguuugauauuugaggucucaaacaaauaccaacauaguacuuuggccacacuucagggagaaaaucuaagcagcgaagaaggcgaggagagagggcagaagggaauauucacacuaaaauaaaauuuaugauuuaaaauaaugcucacggaugcauccagaaguguuuguucccucagugucuccucuugucuuugagauuuuagcuguugcuggagcccuucguuuucaagcacaacuacuuguauuuuauuuuucauuccagagaguuccuccuauaauaaacaaaaccaaacacauuaagcauuauuaagcaguguuuuuauuuguugauuauuagagggcacagcaugauauaaaguacggaagacuuauguucuccuuuuccugaaauauaauuauauguuuagacaaacaaggcagccuaacauuagcuagauaacaaagagaaggcugggguauauaguaaugggccugcugguggcauaucacagaagugugucguuucugacaauuuccuuuucuccaaggaaucgaggcucaaagaaaagccuuaauuaaaaggguuauccaagagauuuuaaagaauggaguagauucugaaaaauaagauauauuauuacucaugaucaaauaccaucaacuuguuaaaaacugauggaagauuaaauagagggaggcucugagauagaaaggcauagacgggagugaugauuaucuaugaaaugguagccaaauaagagagaauuguaguaaaacauuucauggagaauugugaaagaguauuuccuuggccucacaggguguaauauaaagaauuacaaaucaauaacaauuaaaauuacaggauguaacauaagaaauuacaggucaacaaucauuagaauagcuauugaguggcaccucagucucuggaaaaacguuucaauaauaucaacauaucaaucauauaauacuuaaccuaauauucacuacuagugcaaucaaaagcuauuguacaacaugugaaaauuccucucaauuauuauuuuuuaaaaacccaaagcuauaauaaaaagcuguaauuuaaaaaauauuguggacuuugaauuuucagucuggaauguaaugagcuuggaacaccucacucccaucuucccaacaggaaaaauguugaacaaacugaaaaucaacaacucuucuuagauccaucagagaaaugaagucauagggaaaacugcugccccaaaacugaagagauggguggacgcugagacacagaauuuacaggaggaaaucagaaaccucuguaggagguagaaaaucuaaaucauaauugaugacuugcuggaagcucagugucagcaaguuugagaguuaaaaauuccagaccgggcgcgguggcucacgccuguaaucccagcauuuugaggcugaggugggcagaucaugaggucagggguucaagaccagccuggccaauacggugaaaccccaucucuacuaaaaauacaaaaauuagccaggugugauggcacacgccuguagucccagcuacucaggaggcugagguaggagaauggcuugaaccugggaggccaagguuucagugagccaagaucacgccacugcacuccagccugggugacagagcgagacuccgucucaaaaaaaaaaaaauuccaggaagacccagucauagaaggacugccccacuuccccaauuuuaucuccaggacacuaccagguuuucacaguaaaaacuagaaaaaaauccccuuaugcaaccuaaaggaagaagaaaagcagccaguuugaaauaugcuuggcauguugcauuccuuguaacaggccugccucaagggaaacgacuuuaccagagccuaacugacuggagggcugcugccaccuaaccggccuaaaaaaagagaaauccagcuccagcccccucuugcauuccgugugggagagggggccuccggcuuccucuagcuaucucgucuaacuuaaagggcaggggagacugagaagcacuugugaacgucacagcccaaggcaaaggcuuuacuaaaagacuuagaucuagucauaggacuauugaacgcuucccucuacucccacaucuaacgaccacaucacuauggcucccguauacugacagagaaauucaacagaaagaacugcauaucucagacuauauuuaggaagaacucacuaggguaauccauagacaacagaagagacaagaccaggacacugaaggaaauuuuagccucugacauguacggugacagcaaacacagccuagcuuccagccagauaaacauaaaagcucaugcuaaaggccuacuuaccucaguuccuuuuaccaaauaugucauguccagcauucaucaaacaauuacaagacaugcuaaaagacugaaacacaguuugaaaagauuuaacaagcaucagaaacagucugagauaaggcaaagauguuaaaauuaucagaccaggaauuuaaaauaauuaugauuaaggccaggcacgguggcucacaccuguaaucccagcacuuugggaggccaaggugggaggaucaccugaggucaggaguucgagaccagccugaccaacauagugaaaccccaucucuacuaaaaaugcaaaaaaaacuagccgggggugguggugcaugccuguuaucccagccacucgggaggcugaggcaggagaaucacuugaacccaggaggcagagguugcagugagccaagaucacgccacugcacuugagccugggcaacagagugagacuccgucucaaaauaaauaaauaaauaaaauaauuaugauuacuauguuaaggucucuaauagaaaaaauagacuauaugcaagaacagcgggguaauauaagcagagagaugaaaacucuaugaaaagaaaaugcucaaaauaaaaaacuauuaacagacaugaagagugccuuugaaaggcucaucaguagacuggauauagcugaggaaugcauuaguaaacuuuaagaauugucaauaagaauuuccaaaaaagaagugcaauaaggaaaaaaacugaagacagaaaaauuauacaagaacugcaguacaauuacaaauuguguaauaaauauauauauauacauguauauauauauauauaaauaaacagggacacaaaaaaggaaagaaaggaaaagaagaaacauuucagucaauaaugacugaaaaauuuccugaauuaaugacaggcaccaaaccacagaucuaggaagcucaccgaacaccaagcaggauaaauaccccccaaaaauacacugaggaauaucauauugauacugcagaaaaucaaagacaaagagaaaaaucuuaaaauaagccaaaguaaacaaacaaacaaagaaaacccaaaaaucaggccgggugcgguggcucaugccuguaaucccagcacuuuggaaggccgaggcaggcggaucaugugagggucaggaguucaaaaccagccuggcuaacauggugaaacccugucucuacuaaaaauacaaaaauuagccaggugugguggcaggcaccuguaaucccagcuacucgggaggcugaggcaugagaauugcuugaacccaggaggcagagguugcagugagccaagaccucgccacugcacuccagccugugcuauagagcgagacucagucucaaauaaauaauaauaauuaaaaaacaaaaaucaaacaaacaaaaaaacaaaaaccuuaccuacaaagaagcaaggauaagaauuaccugggaguacuuugcagaagccgugcaaacaggaagagaauaaaaugaaucuaauuuuuaaaguguuaaaagaaaaaacccaccaaccuagaauucuggauucagcaagauuaaccuucaaaagagaaagaaaaauauuuucuuagacaaacaagaauugauggaauuuauugcuagcauauaugccuugcaagaaauguuuaaaaaaguucuucagaaaggagaaaaggugauaaagucagaaacugccaucuacauaaagaaaaaaagaguauuaaagaaggaauaaguggauauaagauaaaauauuuucuuauuaauuugacagaugacacuuuguguucaacaucauaauugcaauaguguuuguaguaauuuuaguuuaugaauaacugaaguuaauggcagaaauguuauaaaggaugagagagggcuugggaauucuguuauaagcaauuuauacuauucaagaaguggcauagguuuacuugaaaguaaacuuaaguuaguuauaaauauuuacugcaaauaacaacagcaucaaucaacggcuaccagcaaagaaaaaaaaaaagaaguacaauugaucaauugauaugugaauuggaaaaaaaugcaaucauacaaaaauuagcugguugugguggcucaccuguaguccuagcuacuaggaaggcugaggcaugagaauugauugaacccaggaggcagagguugcagugggccaagauggagucacugcacuacagccugggcgacugagagagacucugucuccaaaaauaaaaaauaaaaugcaaucauauaaaaugcucaaucaaagccacaaaagggacaggugcaguggcucacaccucguaagcccagcacuuuggaaggcugaggugggaggaucacuuggggccaggaguucgccaccagccugggcaacauagugagaccccaucucuguaaaaaaacauaaaaauuagccaggcauaguggugcaugucuguaguccuagcuacucagcagggaggcgguaggaggacugcuugagcccaggaguucuaggcuguagugagcuuugauuacgucacugccuagguaacagggcaagacucuaucucuaaaaaaaaaaaaaaaaaagccagagaaggcagaaaaagagugaauuuuuuuuaaagaaacaaaaaauaaagacaaugaagauaauaguaacaaauguguuauacauugauccaaucauaacaauaaucucuuuaaauauaauggucugaauauaccaacuaaaagauagagacugucagaaugguuaaaaaaaagaacaauaaacuauauguugucuacaagaagccuauaauaacugggcaagguggcucauaucuguaaucccaguuacuugggaggcugagaugggaggaucccuugagcccaggaguucaagaccagccugagcaauauagugagaccccaucucuaaccaaaaaaaaaaaaaaagaaaucucaaaacaaaaaaaaaagccaauuauaaauacgaagacacagauagauuuaaaauaaaugaagaaagauguaucauguuaacacuaaucaauagaaaguuggaguagcaauaugaauuuuagacaaagcagacuucagaccaaugaaaaugaucagagauaaagagguacauuacaugaugauaaagagguccauucaccaagaagacguuacaagucuuaauguauaugugccuaauaaaaguguaucaaaauguaugaggcaaaggaaaacacaugaauccacuauuacaguuggaaauuucaacauccccugucaaaaauuauaaaaaucacaaagggcacaauugaaaugaacaacagcaucaaucaacuggaucuaacugacauuuauagacuacuucauccaagaacagcaguacacacguuuucuucaggcucacacagaacauucaccaagacagacuacaauguacaaaccuuaacaaauuuaaaagaauaggaaaguaugcugucagacaacaauggaauuaaaccagaaaucaauaacagaacgauagcugggaaacuccccaaauacuugaugaugacacaacacucuucuaaaugacacacaugaaucaaagaaguaucaagagccauuuagaaauauuuucaacuaaguaaaaauuaaaauacaacugauaaaaagcuauauacuuauuaaaaggaugcagcaaaaggaguguaaaaaaauuagaaaagaagaaagauuucaaauaaauaaucuaagcuucuacuuuagaaguugcaaaaccaauagcaaauuaauuccagaguaagcagaaaagaacauauaauaaaaauuagaguaaaaaucaaugaaauuaaaaauagaaaaucaacagagaaaaacaacaaaaccaaaaguugggucuuugaaaagaugaauaaaauugauaagacuauauacagguuaagaaaaaaagagaaaauaucaauuagauucuaucauauacuaagaucagaagugaaaauggggcuaucacuacugaucccaugaacauuaaaaggauaauaaagaaauguuuaaaaaacaggauaacaaagaaauacuaugaacaacuccaugaucaugaauuuagucaccuagaugaaaugcaccaauucuuuguaagacacaauccaugaaaacucacagagggaggaauagauaaucugaauaaaccuauauuuaucaagaaaauuaaaucaauaauuagcaaccuuucaaaacagaaagcaccaggcccagguaaguucacuagugaauucuaucaaauauuuaagaaagaaauuauaccaauuaucuauaauauauuucauaaaauucaagaggaaguauuuccuaacucauuuuaugaggccagcauuaaccuaauacccgaaccaagugaaaacauuacaagaguggaaaauuacagaucaauaugucuaaugaacauagaugaaaaaauccucaauaaaauacuagcaaaucaaauccaacaauguaaaaaagaauuauacaccaggauaaaguaagauuuauucuaauuacacaacauugguucgacauuugaggaucaguuaauguaauccaucauaucaacaauguugagaagaaaaaucauaauuuuaacaguagaggcaggaaaagcuuuugacaaaaugcggcagccaucuaugauaaacacagauggucccugacuugugaugguuugacuuaugauuuuuuugacguuauuaugcugcaaaagcaauaugcauucaguagaaaccauaauucaaguuucaaauuuuguuauuuucucaagcuagcaauauguaguauaauauucucucaugaugcugggcagcagcaguggcagugagcuguagcucccaguuagccaugcaaucacagagguaaacaaccaauaaucuauaguauauucaaugcauuuucaacuuacaacgaguuuaucaggacgcaaucccauuuuaagucgagaggcaucuguacucucaguaacuaggaauagaggaaacauucucaacuugauaaagaacaucuacaaauaaccuauagcuaauauacuuuaugguaggaaaguaguuucccacuaagaucaggaacaaggcaaagauggccccucucacaaccauucaacaucauuccaaaaagucuuagcuaaugcaauaagacaauuaaaaaaauaaaaucuggcugggcacauuugcuaaagccuguaaucucaacaccuugggaagcccaggcaggaggacuguuugagcccaggaguucaagaccagccugggcaacaugaugagaccucaauucuacaaauaauaauaauaauaauaaaauagccaagcaugguggugugcaccuguggucccagcuacuagggaggcugugguaggaggaucacuugcgcccaggaugucaaggcuacagugagccaugauuaugccacugcacuccagccugugcacuccagcaagacccuuccucaagaaaauuaauuaaaauaaaugaaaaauuuaaaaaacacaaaaucuaaauauauuggaaaggagaaaauaacacugucuuucguuugcagacaauaugcuugucaaugaggaaaaucccaaagaaucaacaaaaaaugcuggaacuaauaagugacuuauaccaagguugcagaauacaaggucaauauacaaagucaauuguuuucuucuauauuagcaauaaauaauuggaauuugaaauuaaauacauaauaccauuacacuaaaaaauaaaauagguggcugggcacaguggcucaugccuguaaucccagcacuuugggagaccgaggcggguggaucacgaguucaggaguucgagagcagccuggccaacauagugaaaccccaucucuauuaaaaauacaaaaauuagccaggugugguggcacacaccuguagucccagcuauucgggaggcugaggcagaagaauuguuugaacccgggaggcggaggauguagugagcuaagacugcaacauugcacuccagccugggugacagagcgagacuccaccucaaaaauaaaaugaaauagguauaaaucucacaaaauuuguagaagaucuauuugaggaaaaccacaacacugauuaaagaaaucaaagaagaucuaaguaaauagagauauuccauguucauggauagggauacucaauaguaucaaaaugccaguuauucccaacuugaucaauagauccaacacaauuccaauccaaauccuauuuuguggauaucgacaaacugauucuaaaguuuacagggagaugcaaaagucccagaauacucaucacaauauugaaaaagaacaaaauuagaguacugauauuacccaacuucaagacuuaauguaaagcuacaguaaucaagauagagugauaguggccaaagaauugacaaguuaaucaauggaacaggaaagcccagaaauagacccaaaaauauggacaacuauccuucaaacaugaucuaaauguaaaauaaacaauuauaaaauacuagaagaagaaaggagaaaauauagugaaccuggauuugguaauaaauuuuuaaacacaaaguuaaaaguacaaucuaugaaagaaaaaaauugguaaguuaaacuucauuaaaauuaaaaauuucugcucauugaaagauacuguuaagagaaguaaaugccaagucaaagacugggagaaaauacuugaaaaagacauaucugauaaaggacuggcauccaaaauacagaaagaauuguugaaacucaacacuaagaaaacgaauaaccugauuuuaaaaaugggugaacgaccugaacagacaccucacucaaagauguuacauagguggaauauaggcauaggaaaagaugcucagcaucauuugugaucagggaauugaaauuaaaacagcaaugagguuccacuacacaucuauuagaacagcuaaaaucuaaaacacugacaacaccaaaugcuaaugaggauauggaguauuaggaacucucauuuacugcauaaugcauaacgguacaaccacuuuagaaaaguuaggcaauuucuugcaaaguuaaaauuagucuuaccauaugaugcagaaauugagcuucuugguauuuacuuuaaagagguaaaaacagauguccacacaaaaacugacacacaaaugcuuacaguagcuuuauucgcaauugccaaaacuuggaagcaacaaagaugcccucccauaggugcacagauaaaaaagcuaugguauauucaucuaauugaauacuacuuaauaauaaaaagaaaugagcuaucaaguuaugaaaagacaaggaggaaacuugaauucauauuacuaaguauaauaggccagucagaaaaggcuauauacagaauaauuccaaguauaugacauucugcaagucaaaacuauggagagaguaaaaagaucaaugguugccaggggaugggagggaaggggcggaggggaagagggaugaauaagugaagcgcaagaggauguuucagacagugaaacuauucuauaugauacuguaaugguggauauaugucauuauacacuugucaaauucguagaauguauaacacaaagcuaaugcaaacugagagacuuagauaauaauaauuuaacaauagugguucaucaguuguaacaaaugugccacacugaugcaagauguuaauaacaagggaaacuauuaggugagggaugucacugaaaggaggauacaggacucuauguguuugccauucaaccuuucuauaaaccuaaaacugaucuaaaaaauaaaguccauuaacuaaauaaacaaaaucuuucuaaaccacuuaaacauuauuuuaauucuauucuucucuuacuaaaauguaucaaauuuacacucugucugacagucaaggcuuccguaaucuuccauuuuaccaguucaggauuacuuucauuauuucuaugagacauucuccacugcaggaagauaaaguagauggcuuauggcccccacaaaccauauucauccugaauacuguguuucacuguugccauucucuuuaugaaacucaucucccuucugcugaucuaaaugauccuauuccuuuaagacugguuuaggccgggcaucguggcucauaccgguaauuccagcacuuugggagaccaaggcggacggaucacgaggucaagagaucgagaccaugcuggccaacauggugaaaccccgucucuacaaaaaauacaaaaauuagcugggcgugguggcgcaggccuguaaucccagcuacuggggaggcugaggcaggagaauagcuugaaccagggagucggagguugcagugagcggagacugugacaccgcacuccagucuggcgacaaugcgagacuccaucaaaaaaaaaaaaaaaaaaaaaaaaaaaacauugguucaagaucucucucucccauagaaacauucccaaagacaguagcuuuuccuaaccuucuucucuuauuauaauuauagcuuauaccaaaaaguaaaggccuauacuauguucucuaaugugcuccuuaugguguuaauagggaauaguucugucuucucaacuagauaguaaauuuauucugcuuuauaucuuucaaguuuuauccacaacaucuuagggauuaauagaguauuguuaaugaaauaguuccuaggauauuauuucagcuuuacugguaauccaggaccacguguauauuaauaacuguguccuccaagaacaaacaggaaauuacauguuaagaucagaaacuccccgguaaaaucaggacagugaaacaucuaaagccuccuuaaguuacauacuggccuugcaucuuaaaaugucaacaauauaauacauaauaucauauacuauauauaaaaacaugauacaagagauaucagugauuccuauaaaaauaucauacaaucgaauacacugauacuagaaagaaagaaagagggagggaaagaaagaaagagagaaagaaacagaaaaaaaaaaguaaaacacgacauacuucgggaagaugaaaaggcucuauuagcauuaaugacauuagcaaacugcacgcaguugagcauauaaccuucuagugucauaagcuauauaugauguguuugguuucuugaucauuacugucaguacccuaugaaccauucucauucaaagucaaaguaagagccuuaauacugacagcggagaagaauuggucuaccaguuuagaaucccugauugcuguaccacugcuccaguagguugacaaguaugggagaaugauugguauuuguauuccaaagcauuugccauuugcugggcuacagcaagcggggugagaaggaaaacuucugaaauaugaaagcauauuaugaaaucauuagacauaguaaugaacuacugggaaaucaagcaaucagaaaugguauggucaagagcaucauucccaagucugacaagcucuugugacacaucagucucucaaucacguaagaauagcaauugucaauguauugcuacaaacaugaagauuuauagcagcaaauuuuaauacaaucuauaguuaauauaagcuuucauuuauuuaguuuuaaauucuuaaugagaaacuuaccuugcagaacuuaacuucugccucuaaaugaugaauauauugagacuggucauuaauaguaugaacaaggucgugcauaguaggcauauugguuuccucauguucuaaugaccucuaugacaaaaaauaaauaaauaaauacauaaauacauaaauuuuaaaaagccaaauuaagcauguuuggauuuagcaaagaaucaguuguuaccuucuccauacucaauuuugcacugaugugauauaaacauagaaucgaucacaauguagcuuauagucuugauauaguuuggaugcuugucccccacaaaccucaaguugaaauguggcccccagcauuggagguggggccuggugggagguguuucggucaugaugaaugaaucuuggugcuauccucaugauaaugaguucuugcucugaguuuuggugagauuugguuguuuaaaagaaugugacaccucucccacuucuugcucuggcucucaccacaugaaaugccugcuccccuuucaccuuccaccaugacugaaaguuuccugaggcccucaccagagugagaugccaguaucacacuuccuauacagccugcagaaccaugagcugauuaaaccucuuuuuuaaauaaauuacccagccucagguauuuauuuuuagcaacacgagaauggacuaauacaaauacuugcuucucuauccuauaaauuccacaaauacacaagauucauggaugugaauaucauuuuuuuuaaagauggauggugaaagugguuauaaaaagcacauauagugaauggaaaaaugcugggguagcaguaguauaacuggcuuggaauaaacuauuuuaacaaauuggaaaaacaacauuccauucaguaaugcugagauacaagggacaacucucuccaagaaacugccauggaagaggauuugcuagcuaaaacugcagcagcuccgugaaggagagauucuuuaggaagcguuugaugccaagccagugucaaugcgaugaaauuccaucucaaaaaagauacauuagcaaaauguaguuuuugauuuuuggcucuaguauugaaggcaauucaaguguaugguguucuggagcauagaaccuccaagaguagaacccuaaaguagagacacacugcauugagggguccaacgaagagauuucaaaaaaacgcuaaugcuauuuuagcucuguagcauuccuggaacugacuguuaauguauagcuuaccuuauccuaaaauaguuuguaaaaucauauacccaucacauaauuuuuuuuuuaaaggaugaggaaaucaggaaaagguaaaacaagggucaaccaguuaaacaaagccagaggaaagcuugaaaugaggcacagugucuguuucucagccacucucuuucucagcacagcagacauuuuaaaugauaaucaaguaccagcuaucauggcagaauaaaauaaaauagagcuuugguuuuuugguauauuuaagaaauuuaaaaaccaaaguaacucuaauuaaaugaauuaucuguccugaguagaaaucaaacaauuauaaucauccuccauuaauagcaauagguucagaagauaggcaaauauaaauuacuacuaugaguauacaggaggaagucaaugugaaaaauaaaaagcucaagccaauauuguaugaaaaauguucacaugaaaucauuugugucuacuuugaagggcuuuaguuuagauaucuacauuuuaagacaauaaguaauaacuuuuuuuccaucucaacagugccucaguuuuacucucaauauaugcauguauuucuaauauguuauacuggcuaugaaagugcauucuaaagguauaaucuuaaaaagcuaauuauuacuauuaugguuuauaauuauuacauguaggcuguauacauauagagucuaaguuccauucuuuuacauagcuccauauaaauagacuuguguauuuuaaagugcacucuguauguacuaaacugauucucuuagugaaggucuuccugccugucuggauucaguaagcuccauaauaucacugcucagacuuuaaaaggcaaauaagcaugucugagcauucaacagauaaagcaacuucaucuaguagauuuaaaagcauuccaccagucugugcuuaagagcaagcuagaaaccagaugucaauaguaauaaauucauuaaaugaugagauguuuuacuaaaauuauaaaaucuguaucuauaaauuuagaauaugcauaugaaguacauuucucuaaaguaggaauuaagcuuaaaaguaugugucagccuggaauggaguguucguaugggagugauacucugauauuucaguggugaagaaaagaaagugacaugucuccacacuuuucagcauacaggcauuguauugaacuagaaaacacauugaaaaugugaggugguuacuugcugcuaugcauguuauguuuauguaacacuucauagguuucuaaagaauuuuaaguauguaaucuuaucucauuauuccaaaaacucugugagacaggcacaauaucuuagagaguaugugauagacccuagauagaacuaagcccuugacuauuauuuuguccacuuaaaucugguccagagugcuuucacucacaucuaucucagccuuuagcauauaaaaugcuuuaaucagaaauaauacacucugucaaagcaauaacaaacaacuucagaagaaauacagcaccacuucuuauauaucauacuauuuuauaaccauauauuuuaacauauagaacauuacauauuaaaacguauuauuuugaggccaggcgcgguggcucacaccuauaaucccggugcuuugggaggccgaggcugauggauuuccugagguucagaguucgagaccagccuagccaauauggugaaaccccaucucuacuaaaaauacaaaaaauuagccuggugugguagugcacaucuguaaacccaaauacuagggaggcugaggcaggagaaucgcuugaaccagggaggcagagguuguagugaggcgagaucaugccacugcacucuagccugagcaacagaaugagacucugucucaaaaaaauuaauuaauuaauuaaaaauaaaauguauuauuuugacacucaaaauuuaaaaaauauuacaaaguagggcuacaauuauaauuaaguaacuucuaaaaaugaucaauaauagauaugacccucuaaaaaagaaauuacuaaaauaaugacuuuaucuuuuacauauauucugacauauaauuuauuauauuaauuuauuauauauuauauauuuauauuacauauuuugcuaacaguugcaaaauaaauucuccaaacuauucccuugcucccauuuuccaagugaauaauaaauuuaaaaaaucaagauucccucugccauggaaaucuauuuuuucagccaaaauaaucagagggaagagaauuacuuuuaauguuuuucacuauuaguaugccaugcuuaaauuuuuucugcaacauguacuacaaaauaacacaauacaguaaaacacaggaaugcuuugucaacuuggaaaaguugauacuuaccaagggggacauuuuucuucuucuugacggagauacuucacuuuccuuaucugcuuguuggcgcaacaaaucuuugagcugauuaacuauagagcaaaagcagaggguuuauuaaccuuauuugagauccaugguuucuuaccacccauccauccuuccaacuaauaaaaauugcugauauauuaugcaucaagaauucugcuaucaacuggggauacaagaccaacauaaaaaaaaaaaaagaauuucuaccccuuaagagcuaagaaucuagcaaggaagagagagacacuaauagauauaaaauaaguuuguauguagaccuaaagcuaugcacagugcuacaagaagaggaagaagcuaauugugcuuguuuucacagaggagauaacacugcaaggauaaacaggaaggaguucaccaagcagaaaaggauaagaaaaauuccaguuagaagucacugcacaugucaaagcauaaaagcauagagaggagguuauuauaacuagaauaugaguugugagauggaugauuagcaugagaaguacacaaagaugagccgaagaggcagguuagagcuaucuuaggaaaacacuguuauuuuauaacuaagaauuuuggacuuuagccuauaagcauugggaagucaaaggaaaacaagauuaagcgagggaauuaaauuaucugauuuguguuugaggaauaacaucauagcagcagaaugaagaaugaauggaguuauuauucuacggaguuuaaaaaauucacuaugcaucauucagacuaggauugacauucacacucaccagcauggcucuguuguaauucgggccaggcuguccuggcguccucauuucccacacuggugcuaaaagaaagauuuggugcaucuucuccaauagugacaucgccuucuuucagggcacaugucaguuggugaaugcuucugcuggcauguucugcaagaacaaccugacgaaaguuaggacccauggagucugguugaccaaacggacacuuacucaggaaggcaguuuuuaaaggugaaaucauuauuucucguacuuuauggaaaaaacgcagaguucuguuucuagcuugcugagggaugugccaaagauggugagagaagauuaacuucaugguuuagagguaggacuugaugaucucuaaggccccuaccacuguagcaguugauuucacuacauauagcaccaccggcaaggauuaaaugacagaacucuucccaccagcucccauuaaacaauaacuugcuaagggaagugcucuccuucccaccaugccugacuccuuuaccaacuuggagacagagggggacgaaaggagcaguggggaggugggaagagccagcaaaagggacugcgucacacccaguuccaaccuagggaagccucauugucccuggggacaggaaaucccucccccaccaagagacauccacaugucuggccuaguuuugaucaaaauuugcauagcugaagugcuuauaguggcagccccggcgguacagcucuuucuauauacugcuggccaaccacaccucauagauucuugguuagugcaacugaccaccccuagaacacacaaaaacugucuaaaaugaaguauuuuaagguauauuacugugauaguucaucucuaaaaauagccuccaagggguugcagcgagccgagaucgcaccacugcacuccagccuggcaagagagcgagacuguuucagaaaaaaaaaaaaaaaaaaauagccuccaaggaacccagccucauucccuuguucucuucuaaucugaaacugacugggccuguaaucugcauuaaccaauagaaugcaauaaaaguuauaccaugucacacccaagccucaucuuuaaaaggacuggcagcuucugcuuccucuuggaauguuugcuuuugggagcccuaagccgcuauguaagauaucugacuacccugcuggagagaccugugaagagcauacguggagaggaagagagaggcccugagaccccaugaagaaagagaaaagcccuccccgcacugcaccccgcugccccacucugacagcccaguccuccagaggacuccagcaccagaggcacgaagaaagagaaaagcccuccccgcgcugcaccccgcugccccacucugacagcccaguccuccagaggacuccagcaccagaggcccucuaacugcaauggcacgaaagagaccugauucauuaccaaccauguauaaaaauacauuuauaaacauauauucuguaggaccuugaaaagcaguuuccauuuuguccaagugcacugauuucaaaguuuggaacagaaacaaaagcaauguuaguacuuaauagaaaaaaaaagucucuguuauacaauaucuaauacaguuucuuuacuugcagcaacucauuuucuacuuugauaaaagaaaacauguauuucaggucaggguucgacaaugaaauucuauuacucaacuauacaagagacacaguuaauuuaucaccauauuuuucuccauaccaauccuauguccacacagaucuuucuuugaaaugaauuuggcgcugauuacuaaugaaaacuggccuccucugacucaucaugaguuuaaggaaguucagauaagacgcauuccugguuuugggaauauaugaaacugugauaguuuuacaauaacuuaguauuagaaaauagaauagaaaagcgauuuggucauggaaaaggaaaaucaaaguguuacaugauaagcaauucaguucauggagcuuuagauuuaugcccuuaaauccacgaauaaaacacuuaucuuuauugaaucuauuagaaaggaacgagacaguuugacuaacauaaaaauguauuccagguaaaagcauugcaccguuggugauuacggaagaaacaggaguguggugugaccaugaggaagcaaaagaaaaugaggaacuauacaaccaugaagcaaacgcuuagucucagagaucagaggcuuaaagaaaaggauagauuaaaaccuaaagagaaagaaaagaaggaucccagcgcguuaaaggaaagagaaguuccgcaacaccuuuccugauuauuuugccaauauaauacacagcugggcccaccuuaccacauccucguugauaccaacuuuaucaacuuuuccauaaaagccaaacuggacuuagugcagucaaugaugggcugucugcaugucaaguguaucccuuguauaacugauuguguaauggcugaaauugagaaauuggggcagaaguauugaguggcucuaaggaucgccaaggauccaagauuugaacaauuaccauguacacacacaggaaccuaugcacaugacugcuuaguacagagaguaacucagccuaaguguguguaaguguuacauugugcccacaguugaccgggacuuuuuuuuuuuuuuucuugagagggaguuuggcucuugucgcccaggcuggagugcgauggcgcaaucucggcucaccgcacccuccgccucucggguucaagcgauucuccugccucagccuccccaauagcugggauuacagguaccugucaccacgcccggcuaauucuguauuuuuuuuuaguagagacgggguuucuccacguuggucaggcuggucucaaacucccgaccucaggugaaauccgcccgucucagccuccaaaagucuugggauuacaggcguaagccaccacgcccagugaccgggaccuuaaaagaagaauccauaagauuccuggaauuccuaucauguauauuucuuuuuuuuuuuuuuaagacggagucucgcucugucgcccaggcugcaguguaguggugcgaucuucacucacuacaaccuccgccucucagguucacgccauucuccugccucagccucccgagaaacugggacuacaguuacacgccaccacgcgcagcuaauuuuuguacuuuuaguacagacaggguuucaccguguuagcgaggauggucucgaucuccugacuuugugauccgccugccucggccucccaaagugcugggguuacaagcgugagccaccgcgcccagcauuuuuuuuuuuuuuuuuuugagacgaaguugcacucuuguugcccaggcuggagugcaaguagugcagucucagcucacuguggcucugccuccaggguucagaugguucuccuuccucagccuccugaguggcugggauugcaggcaugugccacagugcccagcuaauuucuuuuuuuuuuuuuguauuuauaauagagacaaauacuuuuguauuuuuaguacagaaaaauacaccucggccucccaaagugcugggauugcaggcaugagccaccgugccuggccuacucacuuuuugaugcuguuuugaaauugauauuuugucucauaaaaauuuuaguccaggcacaguggcucaugucugugguccugggacuuugggaggcuaagguggguggaucaccugaggucaagaguucaagaccagccugaacaacgugacaaaaccccaucuguacuaaaaauacaaaaaagguuggcagguugugguguugugugccugugguccuggcugcuggggaggcugaggcaacagaguugcuugaagccggggggcggagguugcagugagccgagaucacaccacugcauuccaggcugggugacagagugagacugucucauaaaaaaaaaaaaagaaaaagaaaaaaaaauucagugauggucaaaggguacaaaaucucagacaggaagaauauguuuuauacuuuuuuugaguucuauuguacaguguggugcauauacuuaauaauggaguauuacacauuucaaaauugauguucucaucacagaaauguauuggaaguauuggauauguuaacuagcuuuauuuaauuauuccacauuguauccacaauuuaugacaucacuuuguaacccauaaauuuauacaauuauaaauugucaauuuacaauaaaaaauuuuuguugcguuuuuaaagaagaaauguauuccauggagcuuucaaaugacuucaccucuaaggcaagggauaauuauuuauuuauaccuagucugaguaaaagcuaauaaacuauauuaggaaaaagaaaaaaaauauggaaagaauuugcauaguuaaaagccucuguaggcagaguucuuucaucagauuacaagaaaggcaggaguuuuuuuuuuuuuuggagacgaagucucccuguuguccccaggcuggagugcaauggugcgaucuuggcucacugcaaccuccgccucccagguucaagcauuuuuccugccucagccucccgaguagcugggauuacaggcaugcgccaccacacccaccuaauuuuuguauuuuuaguagagaugggguuucaccguguuggccaggcuggucucaaacuccuaaccucaggugauccacccaccuuggccucccaaagugcugggauuacaggagugagccaccaugcccggccuagggcaggauuuuaagagcacuuuucauuccuuuucuaauguucuuguuuaaucuuuuagaauuuauaacauucaaagacuacauguuaaauugcacuaugaacauaauauuacgugaaauaaugagcuauugaauucaacaacuaucccaaagaaaagugacacacaaggcuuuaggguuuguuuguuugcaacuacugauuucagaguuacuagggucagagaggaaaagcaggaauuugcaagaacugugcccuaaaacuaaaacuacagaguugacauuuuaaagucauuucaacgcuacauuucaaaacaugcuaagugcuuuucaaauacauaacaaaccagcauaauuauauacuauaacagauaaacacaguuaaugugaagaagaauaacacucagaugauucaggacagaugaaaucccauggcucuucaacuggagccauugcaacugaagcccccauaauccuuauuaagagcacuacuccccagaugcaguuaucugcuccuuacauuuaaggaaaccagauuagacagaagguuccaguuaccguuuccuauccaacugcuaaugggacacagcuuuaucuguuucuaaccaagagagagaacacacucauuuccucuucucuccugagaggacaguaaggguauuucacaaugaaugcauccugauuucuuuuccccagcaccaaccaggaacugacuauaaacuuaacuaugacuacagacacaaacaggaccccugaguccuacagaucacaugaacguaagugcaaguagauaauauuucugcuaaugcacuauccaaacaucaaucaguacaaugagcacuuaaaagguaccugagcuaauggcugcuagcuaauuucagucugucuuguccauuuucuuucuucuuuuuuuuuugagauggaguuuucgcucugguugcccaggcuggagugcaauggugcaaucucggcucacugcaaccuccgccucccagguucaagcaauucuccugccucagccuccugaguagcugggauuacaggcaugcaccaccacaccuggguaauuuuguauuuuugguagagacaggguuucuccauguuggucaggcuggucucaaacccucgaccucaggugauccuuccgccucagccucccaaagugcugggauuacaggcgugagccacccugccuggccuguauuguccauuuucuuaguaagaguuucccuacuuccuauguucuaacucuuaggucaccacugggccugucuucaucaagauguuuuugaacaaaaugcaaguaugucucagucuaggaagaaucaccacuuaaauacacacuaugaauuauuaauuucuucauucuccaucuguccugggagaugugaaagagaauugcccuggugacagggagggggaccacucccugcgaagcgcccagcugucucugagagaauaugcaaugaaccauuccucccgaggccgagauaugagaugcacugcagcucccagcacaagcuuugauuagggcagacaugcagaaaaauaaaaccacagugagauaagaaauacaugucuaucuacacuugacugggccucagccugguucagaagauugcugucacuguuuacuaggggaccaacagguaacacuaccaagauauaaacagcagaaucaaaaaaucagacaaugucggcuuugugaaaggcaauuacaauugugaaagagauuacaaguacuauguagaauacuuuuuuguuugaaucucaaagaaaauacuauccuaagacucuaauaacugaaaacaugcuaaagugguuggcgccaggaguaaaagauaaucugauaaagaauguaaacaucuuaagaaagcaaugucuggaagaccauuaaagauauguggguguuggcaaauccaggagauuggcuauaugcauucuaagggauacaccugguauuucuuuggcaucaguggagaggacugaugcaccugucacuuuccacugauaaaagaaguaaaccuagccaggcuggcaaagaacauagguaaaaucaccagcaaauacaaucuguauauccuuacuuguaauuacuguaaaguaggauucuugcagaucaagggcuacaagcaaagccuguacuucuagaucgugauuucucaaccucagcacuauugacaguuuggaccugauaauucucuuuuggaaggggcuguguugugccaguuuaauagcaucccuggcuucugccuaccagaggccagcagcacucaucuccacccccaauugugacaauaaaaaaaaaucaauaaaacaagacaguuuucaagucaauaaaacgagaucaauaaaacaagaguuuucaguguugaggggagacuugcuaucacucugaccacauuacauuguaaguguugccgccucuugauggaaaaugagcgugacagugagcuauucugccacaggagugcugguggggaggacacagccugagaccgacagugccaugaugggacacaucugauccaggugucaggaauagguguuauaucuaucagaagcaagagcucagauucauauuuagcuuuauuuuguuucagggccuaaaagcaauauuugcccuaaggccaucccuuuaaguauccagugggcuuugaugaaguuccgccaucaucaggauugcuucagccagugcacaagggcauuucuagcuaccuugucuacuuuuggacucugagaagaguuaucaucaaguaaaauggugaaaaucuuagcacaaacuggcaaugugaucagaccauaagucuuuaaacaucccaggagagaauauuauuacucucaguaucucaauaguuugaaaaaaacuuacucuauaccuauuucugacaaagaacaugaaaaaguaccccuacaaucuccuaacacugaaacauaccuuugauuuagauuauuccagggaugacuauuuacuuguagaacacucauuucuuuucugguugcuaaauccugucuuuugccaauuuuaucucaucaguaguaggaaagaaaaauugagauuguacuuuuaaguucuaguaaaauaaaagaucauaaaaguuaaaggcacuaagaagagccacaugaggccaggcacaauggcucaugccuguaaucccagcacuuugggaggccaaggcagguggaucacuugaggccaggaguucgagaccagccugggcaacauggugaaacccugccucuacuaaaaauaaaaaaauuagccgggcguggugguggcaccuguaaucacagcuacucgggaggcugaggcaggagaaucgcuugaacucaggaggcagaaguugcagugagccaagaucacaucacugcacuccagccugggcaaaagaauaagacccugucucaaaagaaaaaaaaaaagucgggcaccguggcucaugccuguaaucccagcacuuugggaggccaaggcaggcagaucaccugagguugggaguuugagaccagccugaccaauauggagaaaccccgucucuacuaaaaauacaaaauuagccagguguguuggcacgugccuguaacccagcuacucgggaggcugaggcaggagaaucgcuuaaaccugggagguggaaguugcagugagcugagauuaaaaaaaaaaaaaaaagaaaaagaaaagccacaugaauauauaaaacaaaagaugaauauguauaauuugaauuuuaucagcaaaaaaccccucauguuuauguguguauauuccuauauagugcauauggcaaacaauauuuaaaaauccagaaaauauuugagaaaagcaaaaaagaaauacaaguuuuauaagaaaacaggaauacuuauuugaguuacacauauguuuucuuaagacagccagaugauaucacugcuggcuaauacacugaccaaauuguuggcuaguaagacuaacacagcccuucuacaauugugagccacuuugcaggauuuggauagaugugcuaaucauauacaagcaaaacauagaaagucaaccuuaucuuugguuuucuugaacuacaucaauucguaaagacaaggcccaucccugagauuauauauuuucuucucauauucauccucucacuuucuguguaccugguucaacuccuuacucucauuuccauaagacaaaaacauagcccuuaaucauucaucugguccaaacaagugcugauggaaggaacauuaaugaucaaagggucagagaguggugucuaaaggggaaucaggcucuggguguguuuugcuuggcuuccuucuuggaagaaaagagggaggaaaagagggaaaaagagagaagaaaaaaaaggaagcaaagagggagggagcaaggaagaaauugaaauguuuuuagaaaaagcagaaacugcccaauuuggccauaagccucaucauuucccuuaaugucuuccacugacuccaucauaccuuuugaucauuugcuuggcaccuaaaggcaauaauucucacauccaguccaaacuuuucguuuuacaguugaggaaacgggaauccaagaacaguguguuucacuugccuaagguuacccagaugguugucagcaaagcaaaaguaagugcagugaccuggcucccagcuccacauucucuccucugaccccaccacacucuucccauaaauucaucuaaaggcugaaacaccaaaauguugacagaaaaagguaaaaccagaaugcaaaauguauauagaaaaucaugaguuccugucauacaagaaguuuguuucauuuuuccuuauacucacccaaccaaagguggcuaggaaugaggugaauaggugagucauguauacagguguuguugauaaaauuguuaucuauucccaacgcugcagcaagagaugagacaugauucuguuauuaaggcuaaaauacugcauuucuagcaauuuuucuccuuucugauauccccuuacacucaagugugcaguacuuaaaauagagccuggauugccuauaauuguggcuuuuuucacccuuucuuggcuaugaaauaguucauuucauaccucuuggcuuuauacaacgauguauugaauuuagagaaggcgcaugugcuaucuugcccacuuacaaauguaguucucggccauucugugguuguugaauuauaacuacccauagaguaaaugaacaccuaaccuuacugccaagagaccucccaaaucacuuccaguucuagauuaaauucugugguucccaggauacccaggacacauacacuuuuaaccacacuggaaacuuucagaccauuuacuauguaggaauaauacaacagaucugugggggcaacaaagccuuccgguuuuucugccagaacucucguuuugaagaagaaucauuaaaugucuccaauuucuuguaaaagggcauaggcgacccaaagcaagagauaucuuuagagaagucaaacagcaaauccacugaaaaguguaagggaauggaugaaaggugaauguggagcugcuccaagaucaucaaggucaaaaugaggcaaggaucucauuuuaaaagcaagaaaguaaacgcugacucaguuuucacauuacaacuucaaauuauugauauaccauaauaguaccaaaauuaaagaaaugaggaaaauaucuuuuuuuguuuguuuguuuuggagauaggauuucacucuuguuacccaggcuggagugcaguggcgcgaucucagcacacugcaaccuccgcccaccgcaaccugcgccucccaggcucaagcaauucuccugccucagccucccgaguagcugggguuacacgcgccugccaccacgccuggcucauuuuguauuuuuaguagagacaggguuucuccauauugcucaggcuguucucgaacuccagacgucaggugaucugcccgccucggccucccaaagugcugggauuacaggcgugagccaccgcgcccaaccucauuuuaaaaacaagaaaguaaaugcugacucaguuuucacauuagaacuucaaauuuugauauaccauaauaguaccaacauuaaagaaauaaggaaauuuguuuuuguuuuuguuuuuguuguuuuuugagacagagucucgcucugucgcccaggcuggagugcaguggcgcgaucucggcucacugcaagcuccaccuccuggguucaugccauucuccugccucagccuccugaguagcugggacuacaggcgcccgccaccacgcccggcuaguuuuuuguauuuuuuuuuuuaguacagacgggguuucaccguguuagccaggcuggucucccaucuccugaccucgugauccgcccgccccagccucccaaagugcugggauuacaggcgugagccaccacgcccggccccaggaaaagaucuuuuuaaaauggaaguacgaucacggaaaauagggaaagcauuuugcauuuuuaugcggccacuuccuggcugaauaucaaugaagggauauuaguagugacuacaugugcaguuauuuacaagcuagaggaaaaaccggugaggaaagaccaagacuguuuauuaggcuuccauuaaucauaaacuacgcaaggcauuuggggaaguaaugguggguagacaaaaccaaacaaaccaacaaaaccaaaacaaaauaagacauagaacuuuaaacugcauuuuaucuuacuacauaguaauacaauucuuaaauuauuaggcacacucaaaauaaggaauuuccacauaacuccagcauuguuuauuaaggaacagaauacuuuacuuuaaagggaauuaucagccgggcgcgguggcucacgccuauaaccccagacuuugggaggcugaagugggcggaucacuuaaggucaggaguucuagagcagccugaccaacauggcgaaacccagucucuacuaaaaauacaaaaauuagccgggcaugguggcgcgugccuguaaucccagcuacuugggaggcugaggcuggagaguugcuugaauccaggaggcagaggcugcagugagccgagauggcaccacugcauuucagccuggaugacagagugagacuccaucucuaaauaaauaaauuauacuacucaaaaauagcaauuuauauuugugaagaacuucugacuguacuuaaguucagaguuaauucuguuuuguuuccuuccagaagcuguuauauaagcuaacauacaaaaauaaaagugcuacuaaauaaaugauauguccugaaaaacccauaaacauuucagguuacauuuccugauucacuguuaaaauuaugaauacguuuuuuuuuaaguuguuuaacuuuuucuauccuucguauuugcucuuggugaaauguuuccacuaccuuauauuguuaucacacuaaauuuaaauuuuauuucaaacuaauuuuaaaauguauuauccuuaaaugaaaacccuucauucuguaauuauugaaagcaguaccacuaguauuaaacauauuacuauaacauuaauuuaaaaugaaccccuuuacugcgucaaaaugccuaauguuaaacagccuccgacaauuauauaaagacuuaaaauaaggucaaaggaagagaagcaucaggaaaaacuuucaaugaaaacaaaaaauuuuugccaaucuuaaaaauuacaauuacucauaucauugugcacaguauuuuucuugcuuccaaaugaaaaguuagaagugcuuauuuuguaucuaacagcucuugaaacaucaguagguugaggaagguguucauuaaaaccgauuuuuuuacuccugcaguuugaauacugagaaugucgacaguuuguuaacacaauugacagauguaacaauacauaguaacccuuauaaaaucuagagucaugagaagauaaacuuucuaauauugaaaaaccuucacuuugcuuuaaguaacaaguauaaauaacaauuaacauuuaaugagugcuugucuaguaagcacugaucuuuacccuuacuuucuaucauaguaaucuauaauuauuuuuuuuuuuugucuuucuccccaacuaauccagaagcuccauggggauaggaacuuugucuuguuccuuacugcaugccuagcaccuaguaugcuuaacacauaguaggaggcacugacacauaguaggcauauuaugcagaacaacacaugcuucauaacuuaguauucucaaugucgcaaacagucaugaccuagaggcuuaugaaaaugcaacagaauagaaagcagaguuuauuacauuuaguagaauaaaaauucuucagugaaacuuauaguuuauauguacacauaugucccauauaaaauuuauuucuuacuauagguaaacauuuuaagaagucuuaaaaucacugcuuuauggggauuauuucauuugcuccccacaauaacccuauggacaauuccauaacuuccauuauaacagaaucgaaauuucuagauguuauauaugcuguccaaguugacagcgccaucuaaaaguacagacauuaaguccaacagagcuuaaaggaaaauaaauacagacauuauuuguacagauacuugcucauaugguaaugugguaagaaaaucuaaauuaauaagguuuugauaauaguaauuauggcuugauuaguaaauacaaacauaggcuuugaaggcaagccugauaauaccuggcucugcaacuaaccagcugugugggcucuggccuguaauucaaccucucugagcuucgcuuuccccauguguaaaauauucacacgauugguguaagcugcagaugauuuacuguauguaaauagccuaaaucaauuaaaagggggcucuugugauuaaaauaauuauuaguguuuccccccacugaucccauaaaucacauucaauccacugugccauaauuuaaauguguaaaaacugugaaucagacuuuuauuggauuaaauagcaacguaugggaacugaacaaaaauggcauagagcuauccaagaguuucugcugucgccgguugagaaagaugccaaguuaagaucaaggaguugauugagguaacuacgggaaucugaggaaacaucguugcuuaacuguaaaaacuaaaucaaacuauuucauccuccucaagaccacagcaacauccaucuugcuccucuguagcguggacggggcagaacccagguguuaggaaacgcaccuggucugcucccgcccacuaggcccugggcaccucggggcuagggacagagguuuggagcaacucaccccggagacuccguugauacugccccagaaucuccuccaggguagaguucuccggggacuucgccaugcacgcacucuaggcccagagcugggaguuacguggggaaauguccagcuuucucccuuccgagaacaacaggccuguggccggggagcgcccgccugcuuccugccgcggcugucacaggggagccuagaaucccgcacagagcucuugggggcucuucccacccacu

SEQ ID NO: 191165 - RNA, 25703 nt, Homo sapiens
cuaguguuuacuuccgcuugaccuggcccggacgccagaaaauguuccacgugggauacccugcgugggguucacuguaguagcugcacuaggugauucuuggagcgggccugagagacaaggacauguggaucccaguggucgggcuuccucggcggcugaggcucuccgccuuggcgggcgcuggucgcuuuugcauuuuagggucugaagcggcgacgcgaaagcauuugccggcgaggaaccacugugggcucucugacuccucuccgcagcuguggcccgaaccggauuucaggaauccgccaaggaaggcgucuaaggccagcuuagacuuuaagcguuacguaaccgaucggagauuggcugagacccuggcgcaaaucuauuugggaaaaccaaguagaccuccacaccuacugcuggagugcaauccaggugaguccagcugaauugcauuuucuuggauguucaucauuuauucaaacguauugacccuccucggggugcuauuuuagauacuggggggucuuuuuuguuguucuuuugcuuugagacggagucucgcuguguugccaggcuggagugcaguggggcgaucucggcucccugcaaccuccgcguaccggguucaggcgauucuccugccucagccucccgaguagcaagaacuacaggcgcgcgccaccacgcccagcuaauuuucuuauuuuuacuagagacgggauuucgccguguuggccaggauggucucgaucucuugaccucgugauccuccccccuaggucucccaaaaugcugggauuagaggcgugagccacugcgcccguccagauacgggucuuuguuugaagcuccuuaguuggagagauugcccacuacauaagcguagagucuguaucguuaaugacaccacaaaguauuucuguagcagcuugcacuuuacacaauauuuugauaaaacaugcucuuagaucuuaucuccccaaaagaguugcaagccucugccagcugaaaaaaugauguuaucuuauucuuccgugcauucccuauagaccauagcaggaugcuaagaacacaagauuuauaggcuuuuugaaugauaguuuuuuaaagcaccauuucauaucacagggagucaguucuguuuaggcuugacaaucucuuugaugguuaaagcauccguguaguccgugaggaagugauaggcuagaggcaaucuauuuugcugugacuuuuuucuucuaagagguagugaaucauggugaugaagagugcaaguuuugaccuggugcgguggcucacgccuguaauccagcacuuucagaggccgaggcgagugguucccuugaggucaggaguuccagaccagccuggccaacauggugaaacuccgucucugcuuaaaauacaaaaauuagccgggcgugguggcgggcgccuguaaucccagcuacucgggaggcugaggcaggagaaucgcuugaacccaagaggcagagguugcagugagccgagauugccccacugcacuccagccugggugacagagugagacuucgucucaaaaaaaaaaaaaaaagagugcagguuuugcagucgcugacaaugauuucaaagccaagcugcaucacuuuugacgcuggagucaaauaaguauauauaaucuccuguuuccuuauauguaaaaaggagagugacaucuacuuugcggaugcugucagauuuaaaaaccagguaauaacgugugaaacaucuaaugaaaguuugguauugaaagagauuauguuucuuguacaaauaaacuuuucguucuguuaaugugccagguccuggaauccugacucaggcauuacuugaagcuggugccaaagugguugcgcucgaaagugacaaaacuuuuauuccacauuuggagguauauuuuuaguuucucaacguauguuauuguuuguucaacuaucugugagugguuuaaggaaauggaauuaagcacacaguguuuuacauagaauaucuuuuagggagccaucucugaaauaucuuguuuauucccaaagacuagaacacaguuaauauucagugcuguugaauggcugaaacaugaggaguucuaagacuuguuugcuaguucuaggucggcuacagccuaguugggugacuuugaacaaagcguauaacuggcaucccuaggcuuguuuccccauuucuacuaagcugcgcugugcuccuuucuucugugagcuuggaaucuaauuggaauaagugcuaauauuagguuaauggaucuguguaaccucuauauuuaggguuugaaaggcaagaaagguuggcauacaaauuaaguauuuuaucugaaaugcuugggaacacaacuguuuuggauuucaaauuuuuucauauuuugcaauauuugcauauacauaaugagauaucuuggggaugggacccgagucuaaaaauuccuuuuuuguuccauauacaucuuauucauaaggccuaaaggcaauucuguauaauauuuuaaauaauuuugugcauuaaacaaaauuuguguacauuggaccaucagaaagcaaaggugucacuaugucacccacccaugugaacaaucuccuuguuugacaucgucaucaucccugacuuuuuuuuuuuuuuuaagauggaguuucucucuugucacccaggcuggagugcaauggugcgaucucggcucacuguaaccacugccucccaaguuuaagcgauucuccugccucagccucccaaguagcugggauuacaggcgcccgccacuaugcccagcugacuuuuguauuuuuaguagugacgggguuucaccauguuggccaggcuggucuugaacugcugaccucaggugauccacccaccuuggccucccaaagugcugggauuacaggcgugagccaccaugccuagcuccugacuccgaauuuauaugcuucugauaagccaucauuuucuuacacuuauucacacaugagugcuuaacaguagaaaaaaugacauaccauuaguacaguaaaaaaaaaaaaaaaaaguguguucagagaaacuaagcagcacagcagcaucagaaucccugugucagcuguugaacaguggaaacacacagcggcaggcuuucagucuccugggaugcuguguuuucauugaaagguuacuguacaccacauuuuauuuuuucuuaagaagaaacaucagaagcagcugagggaccaggaagcggguccgucaaggcuaaggagacauucugccggccggcuuuuaaaaauguuuccugugggccgggcgcgguggcucacaccugucaucccagcacuucgggaggcagaggcgggcggaucacuagguuaagagauugagaccauccugaccaacauggugaaaccccgucucuacuaaaaauacaaaacuuagcugggcgugguggcgcaugccuguagucccagcuacucgggaggcugaggcaggagaaucgcuugaacccgggacucagagauugcagugagcugagaucacaccacugcacugcagccugggcgacugagcuacacucuuugucucaaaaaaaaaaaaaaguucccuauggagucaucugccuuauuaacagugguuuuugucuuagaugacucccuucgauuuuuauagacugaccucaucuucguguuguauaccugcauuuucacugcaagccugucacagaaggucgggugucaaauuuuccacuuuuggcuucauguugacacucaaaaaguuucacauuuuggagcauuucagaauuuuuggauuaaggaugcucagccuguagucagauacaguugcauagagugaaggcaucauccaaauagauuuuucagugauugugcuucuuaaaaagcagacacauuuacguaacaaugaagaaguggaaauccuuugggucuuuaaccagucucuuacucucauucuccuucccucuuuuauaaucuuccguuucaacuuaggaaacuuauauuucucuaugccaacuuugugaaaccaugcagaauggcuguauccaaaauugcaugacaacaaaaaauugugaaaaugucugucaaauccaguuguuuaauucuuuuaaaacuaugaguaugaaauuauuguuauucuaccacuuacuguuuugaaaagaguucaagguuuuagcuagguuauuuaauugauguuaaaucugagggaguuccaaaaaugugaagaaaaaacacauaauuguccgaagauuuaagauccugaaaugugauucaguaaacauagucaucuguaguuucaacuuggaaauuaaaaaugagaagauaacuuuuauccugauuugaggaaaaaaaaaagccuauauuuaaagguuaaucuacauauucacaaaguaauuaagauuguauuaaaaugucuuuguuucuauuuaaaguuuguuauucuguaacacaguaguugcuuuuuucuauaagaucuucaaggcugaggaccgaggcccaugccuguaaucccagcacuuugggaggccaaggcgggcaggucacuugaggucaggaguucaagaccagccuggccaacauagugaaaccccaucucuacuaaaaauacaaaaaauuagcugggcauggugguucaugccuguaaucccaguuacuugggaggcugaggcaggagaaucacuugaacccgguagguggagguugcagugagccgagaucgugccauuacacuccagccugggcuacaggagcaaaacucagucucaaaagaaaaaaaaaaccuucaagauaacaguuuaauuuuaaaacaauuguuuaaugaaaaaaggaagguuagggacuagagaauuuuugaaacaauaauuaugauaggaauaucaauaacaaaauguuucugaagcuauaaaugucagcuaaaaauauaaacaucauugacuaaauccagucuuugauuagaacuaguuuuuucucuauuaaggcucuuauuuucuacuagcacugacuuguacucaacccuuaguacauauucucucacuuuuuaguaaccauuguuaugauaaauugaaaagccauucaaauaaaauuuugugugaauuaaucuguuugccagagugaaaagagaaguaacaauagguaagcagaacucuuguggcucuaagucagggacuuaaagugcugcgcuuagcggauaaugcuucuggccaccuaaaguuuguuccugaaaacugaaaggaguuucaguggugagagcugggauuacaggugaccgccaccacgaccgacgaauuuuuuguauuuuuaguagagacgugguuuuaccauguuggccagacuggucuggaacuccugaccucgugauccgcccgccucagccuccaaagugcuaggauuacaggcuugacccacugcacccaguaaaugagacaaacuuaaugacuaacuuaaguaccuaacuuaaugacuaguaaaaacucaaggguuacuugccuuuucucuguuuuuucccauucuguuuuugaauccuaaugcaauccaguugaauuuuuaaaugugaucuguuguaugaauugaauuauuuauccugaagcuuugauuauuaucauguuugaauuguugaguguuaacugacaagugcuaaagcaagaauguauggugcccucucagaacauacaaguguauugaggccauaaaguguucauuguuuauacauuuucuuuuucuuuuuugagacagggucucacucccauugcccaggcuggagugcagugcugcagucacagcucacuacagucucaacuucccaggcucaggugauucucccaccucagccucccaagcaacugggauuacaggcacacgcccccacaccuggcugauuuuuuguauuauuaguagagacaggguuuugucauguuguccaggcuggucucaaacuccugggacuacaagcaugagccaccacaccugugcuguuuagcuuuccuuaauuacaaagauuaaacugccuuuuugauaacuugaaagauuauguuaaugcuauaucagggguguccaaucuuuugguuugccuaggccacccugaaacaucaacugucugggccauacauaaaauacaguaauaagaacaguggcugaugagcuuaaaaaaaaaaaaaguccaugcauacaucucauaauguuuuaagaaagaugacaaauguguguugggccacauucaaagccguccugggcuguaugcggcccucaggccacagguuagacagccuugccaugcguguugacugacaaucguaugcauuagguagguacucuuucuuuuagcuuccaugacaccacacucuucugguuuuccuccuuaguuguauucucaguuucuugucauuagacuuuggacauacucuaccuucagggcuaguccucuguuucucccuaguguagaccccugacuuaaauuaccuucaacaagccaaauucccacacauuuauaucgucagacuggaccacuccacugagcaccuuauucaggucugcaacuuccuaccuggcaccucuaccuagaucacauaguaggcaucucgaaauuaaugugaccaaauguguaugauuuccacccccagucuuucccuuccucuagucuuuuuaaaacuuccccuugaaagugauuguuaaaauguacuagauuuguuuguuuauuuacuuuggagauggagucucacucugucacccugacuagagugcaguggugcaaucucagcucucugcaaccccugccuccuggguucaagcgauuucucccacuucaccuccccaauagcuggaguuacaggggugugccaccaccccuggcuuacuuuuguauuuuuaguagagacaggguuucaccauguuggccgugcucaucucaaacuccugaccuugugugauccgcccucuuuggccucccaaagugcugguauuacacgugugagccacugcacccggccaaaauuuacuacauuuugagcuggacacgguaucacacaccuguaaucccagacacuuaggaggcugagacaggagcaucacuuaaggccaggaguuggagaccagccuggggacauagugagacucaucucaauaaaaaauaagaagaaaaaguauuuuacuagauuuagaaauaggauaauauagguugaauacaaaugcuuaagaaaaaauagguguuugcauuaauaacuuuaaguuacaucauuuccaaccuuaauaaauauuaauagaauuuucugugcacagaaacaucaguguacacauuaaaaacauaaugccuucuuacugauuuuuuuuuuuguaacuucgaauuaaguuuauggagucuauaacugauucuugcccuaacuaugaaggucucuaguacuacugcaagaugagcaaaucagagcagugagaagacugagauauauuagaccucuuccagcaaacaagguguauaguugcuucugucuuuagaaaaaguaaaugaaaauuauggagaugagcuaaguucauuuauuugguggauagcugacuagauuccccuagaagaaagauauucucuugaauccaucugccuuucacuuuuauauuuuaauuguuuuucuuuacugugaaacaucuuucauuuuuucuucccaugaccaaagcagauggcucacaguucucuguaagaggccaaccauggugucagaaucuuugcccagugcuucagguaaccacuacuaagcaggcagggaguggugugaaaagcuuuugaauagcugaagccauuaugauaaagaaaguaaguggggccgggugcaguggcucacaccuguaaucccagcacuuugggaggucaaggugggcagaucucuugagcucaggaguuugagaccaaccugggcaacauggcaaaacccuguugcuacaaaaaauccaaaaauugguggggcgugaugguaugcaccuguaguccuagcugcuugugggacugagguggaaggaucacuuaagcccaggaggucaaggcugcagucagcugggauugcgccacugcacuccugccugguugacagcuugucucaaaaaaaaaaaaaaaguaaacagauaaagaaaaauuuaugauaguuuauuucuguuuggggggcuuuuucuugguaauauuguacuuuugccacuuuucagguauuaauugauuuuuacuuccucuguuaaauuuuggguauguuaguaauauuuucuuuacauaguuauggagguagaaauauuuuuuguaaaaagguaauucagccgggcgugguggcucacgccuguaaucccagcacuuugggaggccaagguggacguaucaugaggucaagagauugaggcucuccuggccaacauggugaaaccccaucucuacuaaaaauacaaaaaacuggcugggugugguggcacgcaccuguagucccagcuacuugggaggcuggcacaggaucacuugaacccaggaggcagagguugcagugagccgagauggcgccacugcacuccagccuggcaacagagcgagacucugucucucaaaaacaaaacaaaacaaaacaaaaaaaccccagguaauugaauuauuuuuauuuuuacauuuuauuaugguuuuuugaaguagaguuuuuugaauugcugcaaaguauacuuaaugcugaaaauuuuuaacguguuaucuuugucucucuuuaguccuuaggaaaaaaucuggauggaaaacuacgagugauccacugugacuucuuuaaacuagauccuagaagugguggaguaauaaaaccaccugcuaugucuucucgagggcucuuuaagaauuugggaauagaagcaguuccuuggacagcaggucauuuuuggaauuuacuaaagcaaauaccuagaauuugccaggugucucuagcaguauaacugauuuguugaugaaauuuguguuuuauuuauuuguuuguuuucugagauggagucucacucugucacccaggcuggagugcaguggcgcgauccugguucacugacccucugccuccagguucaugugauucuccugcuucagccucccuaguagcugggauuacaagugugugucaccacaccugguuauuuuuuuguauuuuugguagagacgggguuucaccauguuggccaggcuggucucaaacuccagcccucaagugaucugcccgcuucgaccucccaaagugcugggauuacagaugugagccaccguaccccgccgaauuuguguauaauuuauauuauauuaauacaguuuaugagcagaugcucugacucugaauauggcauuuaccucaccuggacacagguacccaguuuauuuccccaaaagccaaguuucaugccaaggaaagauauugaggcuuaguuuuaauugaaauaaacuugaaauuaauauaguuuguuaacuuaguuugucucaaaaaaauauggacauaggacaaaaugcuaagaacuuuauucaaaucuuuuugcuuauauuccuaacagacaucccuuuaaaaguaguuggaauguucccaaguagaggugagaaaagggcacuuuggaaacucgcauaugacuuguauuccuguacuucuauauauaaauuuggacgaauagaaguaaauauguuuauuggugaaaaagaauuccagguauguuauuaacaaauaccuauuuuuuguucugagucuguaauuuuucucugaguacucuuaaucugugcgauuuuaauuuagggcucgugacauuugagggucuaagauuguuuuuaaauucugcagagcagucuuaugcucagguugcuuuuucaguguacaguugagugguuuuaacugcauucccauuguacagccauuaccaucaucugucuccaaaacuuuucaucaucccauaccaaaacucuguacucauuaaacacaaacucucguuucccucuuccugcguccccuaguaaucauuauucuacuuucugucucuaugaauuagacuauucucuuuaccucauguaaguuuacucuacaauauuucuuugugucuggcguauuucacuuagcauaauguuuucaagguucaucaauguuauagcaugugucagaauuucauuccucuuuaaggcugaauaauauuccauucuggccgggcacgguggcucacuccuguaaucccagcacucugggaggccaaggcaugcugaucgcuugaggucaggaguucgagaccaguuuggcuaacauggcaaaacccugucucuacuaaaaauacaaaaauuagccaggcgugguggugcaugccuguaaucccagcuacuugggaggcuaaaacaggagaaucacuugaaccugggaggaggagguugcuauaagcccagaucaugccccugcacuccagccugggcaacagagcaagacuuugucucaaaaaaaaaaucuauuguauauauauacuacaguuuguguguugauguaucaaugacauuugguugcuuuuaccuuuuggcuguugggaauaaugcugcaaugaacaugaguuuaccaauaucucuucaaguccuuugaguguacagcuagaaguagaauugcaggaucauauaguaauucuauuuuuaguuuuuuguggguuuuuuguuuuuuguuugauuguuuguuuguuuuuugagacagggucuugcccuguugcccaggcuggagugcagugacaugaucacagcucucugcaaccuggaccuccugggcucaagcgaucuucccgccucagcccccaagcugggacugcagccacacaccaccaggcccagcuuuuuguagcgauagggucuugccauguugcucaggcuggccuccaacucugggacucaagcaguccuccugccucagccuccuaaaguguugggacuacaggcaugagccacuguacccagucuauuuuuaguuuuuugaggaacugccauacuguuuguuauccgucguggaugcaccauuugauauuccuaccagcagugcacaaggguuccgauuucuccacagcauuacugagagucguuuucuggguuuuugguaauaccucuccuaaugguaugaagugguauuucauugugcuuuugauuugcauuuuccuaauaauuagucauguugaauauauuuuuauguacguacugacuguauaucuuuuaagaaaugucuguucaagacauuugcccauuuuuaauggguuauuuuguuuguugcugaguuuuaagaguucuuuauauauucuggauauuaaucucuuaucauacaugauuuacaaauauuuucucccauucuauggguugccuuuuaacccuguuaauuguguccuuugaugcccaaaguuuuucauuuugaugaagucaacuuugucuuuuuuucucuuuuguugccugugccuuugguaucauacguagcugggcgguccccaacaucuuuggcaccagggaccaguuuuguggaagacaguuuuuacguggauggcggcggggaugguuucaggaugauucaagugcaucacauuuauugugcacuuuauuucuauuauuauuacauuguaauauauaaugaaauaauuauacaacucaccauaauguagaaucagugggaacacugagcuaguuuuccugaaacuagaugguccuacuugcgggugacaggagauagugacagaucaucgggauuagauucucauaaggcccuugcaaaacccagauccuucgcaugcgcaauagggauuguguuccuaugagaaucuaaggcggcugcugaucugagaggagguggagcucaggcggugaugugaacgguggggagcggcuauaaauacggaugacgccucgccuguucaccugccgcucacuuccugcuguguggcccaguuucuaacaggacacggacugguaucaguucguggcccggggauuggggaccugugucguagcuaauagaucauugccaaauccaguguugugaagguuuccuuguguuuucuucuaagaguuuuauaguuuuggcucuuguuuaggucuuugauccauuuucaguaaauuuugcuuaugguuucaguguccagcuucauucuuugaucuaguuuucccagcaccguuuguggaaagacuguucuuuacugccauuaaauggcuuuggcguuggugucagaaaugauuugaccauauguguacgcguuuauuucugggcucuauuguauucuauugaucuaaauauuuguccuuaggccaagacaacacuguguugcuacuguuaccuugguaaguuuugaaaucaggggcugauucauccaaauuuauucuuuuuaaugauuguuuaggcuauuugaguuuccucgagauucuauauggauuuuaggcuggauuuuucuguuucuccaaaaugcguuaggauuuuccuagggauugcguugaaucuggagauugcuuugggugguaguggcaucuuaacaguauucaauauuaaaucuuccaauccacgaacaugaaaugucuuuccauuuauuuguggguuuuguuguuguuguuguuuucauuuuuguuugacacagggucucacugucgcccaggcuggagugcaguggcaggaucacagcucacugaagccuugaccucccaggcucaggugaugcuuccaccucaaccuccccaguaggugggacuacaggcgugcacccccgugccuggcugauuauugucuuuuuuguagagaugguuuuaccacguugcucaggcuggucuugaacuucuggguucaagugauccuucuaccucagucuccugaggugcugggauugcaggugugagccacugugccuggccuccauuuauuuguguuuuuaauuacuagcuuuuaaguuacuuuuggugcuauuguaaauggaauuguuuuucgaauuguccguugguagugcauaaaaaugcaacugauuuuuguauccugcagcuuugcugaauuuauuagguuuuuuguuuuguuuuguuuuuuuuagacggagucuugcucugucgcccaggcuggagugcaguggcgcaaucccggcucacugcaaccuccgccucccaguuuaagugauucuccugccucagccuccugaauagcugggauuacaggcacgcgccaccaugcccagcuacuuuuuuuguauuuuuaguacagaugggguuucaccauguuggucaggcuagucucaaacuggugaccucaugauccgccugccucagccucccaaagugcugggauuacagguaugagccacagcgcccagccagguuuuuuuucccucccuuuguuuuuaaauagagacagugucucacuuuguugcccaggcuggucucaaacaccugggcuuaagugauccuccucccucggccucccaaaaugcugggauuacaagugugagcuaccauacucagcugaauuuauuaguuuuaacaggauuuuuuuuuaauauuuaagggguauuauaauuauuuuuuuuaacuuuaaaacauuaaaagaaauuuuuuuagagacagggucuugcucuguugcccaggcuugaaugucgugguauguucauagcucacugcagccucaaacuccugggcucaagugacacuccugccucagccucccuguagcugggaccaccugugcacaccaccacacccagguaguuuauuuuuguagugacagggucaugcuguguuguucaggguggucuugaacuccugucuucaagugauucuccugccucggccucccaaagugcuaggauuacaguugugagccauuacaccgagccuaagauuugagacucuaguucaauucucuguaauggaaggucuuccugacaaccuugaucucgcuaugagugucaucuuucuuuucugcccagaauguuucauguuauugaucuguuaauccaguuugacgggaaaugcuuguuugucuugcuguguugcccaugcuggagugcuauggcuuuucacaggcacggucaucucacacugaacccccaaacuccuagacucaagcaguccccuugccucagccuuucgaguagcugggacuacaugugcacaccacugcacccagcuuuuuguaucuaauucuaguuuucucugcuuaaauuucuagaugcuauuaagauaguacuauuaagacucaaagaagauuaagauuuuuauaaugcuuauuuguauugcuauggauuaggauaguggggcaaaaaaugaagggaugauuugcucccccagacccauuuaguaaauacauauuugcuagccauggaaagacagcgagggccucaggaccuuggggcugugcauacgcuauucaacaaaggaaagacaaggagaagaauaggaagugcuguguuagauuccugcugcuaggguuauauuccacuggcccaugccucuuuugccguggaccuuuucacaugugguuucuugucugcggagugccuucccauucguugagguaaccucguccuuucaagucagccuuaacacuuguguguuguuguuuuuuaagagaugcggucucacuauguugcccaggcuggucuugaacuucuaggcucaagcauccucccaccuuggccucccaaagugcuggaauuacaagcgugaccccgcgugcccugccguugccccugccggagugcuguggcuauucacaggcacgaucaucucacacggaacgcccaaaugccugggcucaagcaguccccuugccucagccuuucgaguagcugggacuacaggcgugcaccgcugcacccggcuuuuugcaucuaauucuaguuuucuuuucuuaaaugucuagaugccauuaagauaguccuauuaagagucagcauuuguuuuuaauugauuauagauguguauaacauguaauuuuuauuuuccuuuuacuagaaacuaauggcagaucccggaaauccagacuuguaucauguauuaaguguuaucuggcaauuagcuugugagauuaagguucugcacauggugaguaaaauccuucuguuuaaaaacguuuuucuuuagcgacagggucucauuauguugcccaggcuggagugcaguggcacaaucauagcuugcugcagccuugaacuacuggacucaagugauccucucaccuuagccucuggaguagcugggacuacagccaggcgccaccaugccuggcuaaguuuuaaaauguuuaagaauauugcccagccuggucuugaacuccuggccucaagugauccuucugccuuagccucccagaucacugggauuacaggcaugacccacugcaccuggcucuauuuuuuauuuuuuuauuuuuugagauggagucucacucaagucacccaggcuggggagcagugguucgaucucggcucacugcaaccucuacauccuguauucaagcaauuccccugccucggccucccgaguagcugggacuacaggcgugcaccgccacaccuugcuaauuuuuguauuuucgguagagacagguuucaccacauuggccaggcuggccuugagcuccugaccucaggugaucuacccgccucagccucuuaaagugcugggauuacaggcgugagccacugcgccuggcccuggcucuaauuuuuaaauauuuacaauguggaucuucacguguucucgucacugcuuccgccugagaauaugcugaggucuucagucugcaccuugcuguauuuuuuuuuuaagcucaggaauguuaucucauuugauuuuagcuuuuguuccaauucuuuuuuuuuccccucaaaaacauuugagguucuuagguuggaucucugauccuugucuuucgugucugucaugcucucaucauuuuucuccauucccagaaucucuucacacuuagucuucacaucacugauucugcuuucugccugcacuguauauuguacucucaguacuauaguucuugguuucucuaaaauucuuccuuacccacugaucuugucucauucuguugacuuucaucucaagucuucuguccugguagcuuucagcuaguuucuucagagaggcccucugaggacuuuagcuugcagaauguuuucgucuucuuguucccuuaguauuugcuuucaaaggucccguguuagguuuugccauuuacuaaacuccagaaaggaaaggucuuucuggaccuaacguuucucagcacuugcuccacugugugucuacaucuguagaguaaguuguugaagucaauucccagugucuugcagguuuuccuccacugugcuugaugaggggaaagcuguugaggcucgaccaggcgugugggaaguggcaguacucauugugcacggcugauggugcuuuucuucccccacuuaaagugacauuccuggaacugcuaggaauuucacaauuuggccacaauuauauguuuuagccacucucauugccccugcaguuaauaauaaauuguuacuugacaguagccuuucagaccuuguguucaauauuguuuagucuuuuaagccuaugucagaucuauuuuaacccacucuuauuuuggaauuuaauaugguuauggguauguauaguuuuuuuaauagagaauacuuuuucaggugggucgguuuuuuauuuugagacacgaucucacucugucagcccagguuggagugcaccagcacaaucccggcucacugcaaccuccgccucccaggcuuaagcaauccucccgccucagccucccaaagagcugggacugcaggcauacaccaccacacccagcuaauuuuuguauuuguugaagagacaggguuucaccauguugcccaggcuggccuugaaccccugagcucaagcgguccuccucccucagccucccaaagugcugggauuacaggcaugagccacugugccugaccggaucaucucuuaaaauugccuuaugcacaaaauucucuuacaaaagauagauaccgaaaaauagugauccauuuuaaaauugacacuagguuuuuguuauuguuguuuuuggauagggucucacucuguuucccaggcuggaguacaguggcuuacugcaaacuccagcucccaggcucaagcaacccucccacuuuggccucccaaagugcugggauuauaggcaugaaccacagcaccuggucgacacuaguaucuuuauuuguuuauuuccauauauguucuaacauauucaaauaguuugauuaguaggcuuuuccacugaaguagggcaaaaagaaauccucagcauuaaucuaauaucccuuaaacugcugauucugacugugauauggaaauauugagugguaaaaauuauaacaaauacuuauuugcguaauugcauaacaggcgaagucauguuuaauaaggaaaagagguacuaguauuuggguagacuuuugauccuccuccucuuuaaaaaaauuaaggagagagauguguauuauuuagcuauaacauguuucuuuuaaauccaauuagacugaccauucucuuauuuaggcaagguguuuuuuaaggaaguaauaacuggggcacuuugaccaaagagaaauaaaagauguuguuuugcuuuguuuuucuuccccaggagccuuggucaucauuugauauauacacccggaaagggccgcuggaaaacccaaagcguaggguaagaauaaaauaauaccuuuuccuuuuucucccuacgugacguauuuuuuauuuuauuuuuuuaggacuauuugguagucuguauuuaacuuuuuaauuuuaaaauaucuagaaacauucuuuaaacauaucuuacuacuuuuaaugaaucaaaaguauuuuggaagaguuaucagcuguuauacaauggaugcuagcauaguaauaggcuuaaaaacagaaucugaguucucuucuuauaucuuuugaaaugaagguacauuucaaauuuggaaaauaaaaucauuuuaauauuuaucuaauucgauuaauuagaaacaaaauuuuaugacguauuaaucgauuagaaauuugugauauucaaggucaagagaucgggaccacccuggccaacauggugaaaccccgccucuauuaaaaauacaaaacuuagcugggugugguggcgcaugccuguaauuccagcuauucaggacgcugaagcagaagaaucacuugaaccuggcagacagagguugcagugagccaagaucgugccacugcacucuagccugacaacagagcgagacucugucucaaaaaaaaaaaaaaaaaaauugugauauuacuacucuuauuacaugguugaauucacugauagguacuucuugauuuuuacccaggaguuaggccuuuauuuuuguucauuuuuuaaucuuuguacguaagaaccaaagugacaauguuauaguccuccauuuaguuuaucucagggcuaguugugaaauucuaauaaaguagcuaaaguuucacaaaacaauuuuuugacucaauucagaaguuucacuuuagaauuagaugccugucuuuaagguuuggggcuuaaaaaaaaaaaaaacgaauuaaaugcuaacaauggccuaaucucagcauaacagcuuagucugaagaucuuguuuguuugcuuacuuauguuuuuuucucacacuugccacuaaaggaaaaagaaaauuaucaguuuucuuucaauguugugauuuuagagugaucagucaucauugugcuuuuaguucuguuugacuauuuauacagcauauuuauguagucccaaaaaacagaauaggaauaaugcauuuugucuaauacaguacauuuggauacuauuggggacuuauccaaauauuccacaaaugaacaauccuguauauaauauacuuucucaguuuuucagcaagaagcugaaaagcuuaaguuuuuuuggccaacuuaaaaauauaaacuuggccggacgugguggcucacaccuguaaucccagcacuuugggaggccgagguggguggaucacgaggucaagagucugagaccagccuggccaacgugcugaaaccccaucucugcuaaaaauacaagaauuagcugggugugguggcgugcgccuguagucccagcuacucaggaggcugaggugggagaaucaguugaaccugggaggcagaguuugcagugagcugagacuaugccauugcacuccagccuggauaacagagugagacuuugucucaaaaaaaaaaaaaaaaaauguguguguguguguguauauauacauauauaaacuuuuagggaugaagaugaaauaagcaaaugucauauuuuaugacagaauuuauuuuagauauuucacaugugucuuugauaucaaggugcucauauugcuauggaagcaguuugagacauuuaacagguuuuuagggccugucauuucuauccaaguuuuguuugagaccuacuuuuuaaauauccgauuaaaaauuuuagucaauaacuuuuuuuguccuuuggauccgauggugauguuuuaucuugaauauagcaaggacucaauauauguuaaugccauguuuggguuuuuuuuuuuuuccuuuuuuuauuuuuuauuuauuuauuuuuuugaggcaaagucucauucugucacccaggcuggagugcgauggcaugaucuuggcucauugcaaccccuaccucccgaguucaaguguuucuccugccucacccucccgaaugcugggauuacaggcaugcuccaccacgcagggcuaauuuuuguauuuuuaguaaagaugggguuucaaccacguuggccaggcuggucucaaacuccugaccucaggugauccgccuaccuuggcuucccaaagugcugggauuacaggcgugagccgccacgcccagccuauuuuuuuuucuuuuuuuaaaagacagugucucacucuucucccaggcuggagugcaguggcauaaucacggcuuacugcagccucaaacucccgggacucaagugauccucccaccucaaccucccaaauagcugggaccacagaugugcaucccacgcccagcuaguuuguuuguuuguaaagaaggagucucccuguguugcccaggcuggucgcuaacucuugggcuccagcgauccuccugccucggccucccaaaguguuggauuguaggugugagcaacccggccucaugucugggauuugauuuuacccuacuuacauguuaauaaauguuacuguuucucggauguuggccuaagacuccuggaucagacagaggauguucugugccucucuucccauggagugaugugagguggcucaguugggugccuugcauuuaguggacuugcuuugcagcugagaaguacagagcugggggaaucuaggucuuuuuuuuuuuuuuuuuuuuuucgaaucagggucuugcucugucacccgggcuggagugcaauggcguaaucucggcucacugcaaacuccacgcagcagucucaagcauccucccaucugagccuccuaaguagcuggggcuacaggcaugcaccaccauacccugccaauuuuuguacuguuuguagagacaggguuucgccauguuguccaggcuagucuugaacuccugggcucaagcgaucugcccaccucagccucccaaugaauccuccuccuucauagcaaacauuaagcaagccugcccuuuuguuuuuuuaagagaaggccuggcucugucaaccagccuugagugcaguggcaugcucucagccuccaccuccugggcucaagccauccucccaccucagccucccgaguagcugggacuacaggcacacaccaccacacccagcuaauuuauuuuuuauagagaugggguuuugccacguuguccaggcuggucuugaacuccugaccucgagugauccacgccuuggccucccaaagugcugggaucaugggcaugagccacugcacccagccacaggccugcucuuuguccuggagagagacguuaucuccucccucaagguuacucaucacaaacaacucugagaaauggcccaauucauugguaaagaccaauuagggcuuuguguucuugguguacacaauaagaaaaugugggccgggcacgguggcucacgccuguaaucccagcacuuuggggaggccgaggcgggcggaucacgaggucaggagaucgagaccauccuggcuaacacggugaaaccccaucucuacuaaaaauacaaaaaauuagccaggcgugguggugggcgccuguagucccagcuacucgggaggcugaggcaggagaauggcaugaacccgggagauggagcuuucagugaguggagaucacgccguuguacuccagccugggcgacagagugagacucuaucuccaagaaagaaaaagagaaugugaagacacucagggccuguggugauugugucuuucagcagauagcuugaaggaagaagugagcaaugucuuacucuggcaauauuuugugacuaaugcaauucauuuuuucuucucuccaggaauuauuagaccaauuacaacaaaagcuguaucuuauucaaaugauuccucgucaaaauuuauuuaccaagaacuuaacaccuaugaacuauaauauauuuuuucacuuguuaaagcacuguuuugggaggcgcagcgccacuguaauagaccacuuacggugaguaaaaagaauaaaagcaaguauaaaguagcaacgaugcacaaauuauucuuucaugcuagagaucuauuuuuauaucuugauugacagagugagguaccauguuuucccucauauuucuucaaaauaauuuguucucccugguguacauuuugaggaaaauauauuuuucccauaaucucucauugaguuucauuuauuuuuccuucuuuaaaaaaaugcccagauuguuuaaucuuuuugagaguaugggcuuagcuuuaucuuacaggaagcacuagcugccuaccacuagugggguggagagaaaucagcauuacuggaggcgugcccacacuuaccucucauugcuugucuucagugguucuguuccuuaaccagaguagggauagauaauuauaccacccugguucccuugcucuggaucaaauuuuguuuuuacccaaagcuuuguaaaaauaauagcuuguaaguaacacuacuugcuuuaugucuauauaagugaaaaacauuuuuuuguuguuguuagagacagggucucgcuguguuguccaggcugaaguguaguggcacagucucagcucacugcagccuuguccucccaggcucaagugauccucccaccucagccuccugaguagcugggacuacaagcaugcaccaccacgcccggcuaauuuuuauauuuguaaaaauauaaaauuuuuauauuuauauuuuguguuuauaaauuguaugccaauuuuuguagagaugggguuuugccaccuugcccaggcuggucucaaauuccuggccucaagcaauccaccuugcuuggccucccaaagugcugggguuacaggcaugagccacugcaccuggccauccauguaauuuguauguagggcugaugcacacaccucuguaaguagugcugggguuacaggcgggagccaccaugccuggccauccauguaauuuguguguaggccugaugcccacacuucuguaaguacagcucagguuaccagcaugagccacugcgccuggccaucuauguaauuuguauguagggaugaugcauacaucucuguaaguaguguugggguuacaggcaugagcucccgcgcccagccaucuguguaauuuguacauaaauccauguaauuuguauguagggcugaugcauacgucccuguaaguugugcauuaugccuuguaaucagcagcccauagucauucaaagucucgccagaggauggguaaaauguuaaaauaauuauuuuaacaaauuugaucauuuaauauuuaacucugaaugagcuguugacuagacaauauuuaucuaaaaauaaauguuaaaaguggcaauagccugggugcagugguucaugccuguaauccgagcauuuuugugaggccaaggugggaggaucacuugaggaggccggggauuggaggcuguagugagccauaaacucaccacugcauugcagugugggacacagagcaagcugaccuugucucuaaaaaaaaaaaaaaaaaaaaaauugggaggcagagagcgccaacaagacuuugagaugagccugggugacagagcaagacucuaucucuaaaaaaaaaaaaaaaaaaaagugguaauagacuaguaaaaggcaauagacuaauaaaaggcaaucuauuauuuuucaucuugccaccuuguggcuauuuugaaugaaaauaucaagaaaauagggaaauaaggaauaaauguuguaaaucauagugcaaaauauuaaaaaugcuccugguaaucucaguggacuagaaacauguuaccaagauucuauucaauaucaaaaaguauuggaauugaacagacagagagucucacucuguugcccagucuggaguacaguggcacaaucauagcucacugcaaccacaaaccccuugcucaagugauccugccucagccucuucccugaguagcugggacuacuaugcccaccacuaugcccagcuaacuuuuuacgauuuuuguagagauggggucucacuauguugcucaggauagucuugaacucuugggcucaaaugauccucccaccuagccccccaaagugcugggauaacagguaggagccaccgcacccagcccaaaauauuuuuuuacaauuguuguuguuggaggcuuauugaugguuuguugcuaagcugauacacaguuauguaccucauauuaugguauauaauauaccucauugauuauauauuguauauauauuauauaauauaccuuauauauauaauaccucauaaugaggcguguucguuauaccucguuucagucaguaguggaccaaauguacaauaguggucccauaagauuauaaagaugcuguaucuuuuacuguaucuuuucuauuacuuaccauuguguuacaguugccuacaguauucaguacaguaacaugcugugcagguuuguauccuuggagcaauaggcuaugccauauauccuaagucuguaauaggcuauaucacauagguuuggguuaaguacucuguaagauguucaagcaacaaugaaaucaccuaacagugcauuucucaggacauaccuccaucauuaagcaaugcaugacuguauaaggaaguuugcggcuuuauaauguauuuaccaaugaugguuacaucaaaaugugaaaaaugauucccucuuuguaaacugccaaacagcaacuucugcuguuuauaguuacugaacuuugacaugaaccaaaagaaguuaagaauauuuuuugcagaaaggaaaaggaugaaagagguaggcauaauaauuuuuucaaacggcagugauuaaacuagaauucgguguaaaaauugauuagaguaugugaaagccuaaaccugcuauuaauauuuucauuauagguuagcuaugaaacuuuagaaauaagcauaaaguuacuggaagcucuuaaacuaaauaagauugcuuauauauaauaaguuaggcuuuuuuuuuucuucuuauuucaauagccuuaggaauacaagugauuuuuuugguuucauggauggauuguugaagucugggcuuuuaguguacccaugcccaaauaguguacauuguacccaguagguagcuuuuuauccuucacccuccucccauccuucacccuccucccauccucuucccugcugauucucccguguccauuauagcacucuguaugccuaaguuagacauuuugaauucaacuuagaagccauuucugucaccgugaacugauagaugcaugagaaagaauuaaguacauuuacuuuguauuucuuuugcaguucauugacuccacuugaugcgagagauauauugaugcaaauaggaaaacaggaggaugagaaaguaguuaacaugcacccucaagacuucaaaacacuuuuugaaacuauagagcguuccaaagauugugcuuauaaauggcuguaugaugaaacccuggaagauagguagcaacuagacugucguuuuugguggagcgguucauuuauuuggaaacuaugacaugaaaaccaaauuugaaaacucacauccuuucagcagaagguaacuguucuugucuugcacaagccaggcagaucauuucuccuaagcugauaucauuggcuuauuggaugaaacagugucugcuauuuuauucacaauugaauaaaaugaaaacuucaauuaauuguggauuugaucagauugaauucguuuuguuucagauuccuauuuaaauauuucacuuguacuguugcugauuuuugcaucuucuugaagagcaagagucuguacauuauuaagcuuagaaaguaagcaaaacugauuuacugguuugccuuucaguuuguugaaauguauugucaaguacuguacaaugaaauuguuuaaauuuuaauaugauuuaagcuuuuuagaaauuaaaauauuuuaaauaagaa

SEQ ID NO: 191166 - RNA, 47309 nt, Homo sapiens
agcacuucccaugagcauuuuuauuaaauugaaacaaguuguugauucgauaauuacaagacuuguacaaaaauucacagcgccugugaggagccuuuggcuggaacuggugacaccugugccucuccggacagaggaaggaagucccaccccgccuuccagcagcagcgagccugugucuggcauucccuguuccgcugcucccacccucacuguggggcagcaguucuuuaggaacauucagcugucaaaggugagaaccagccccacaggccugggccucgcaggcuuaaggagcacuuguuggcacuguuagcucagcaccucucccagcuccagcccaucggcuggagaggaaaagggcagaaaacacaaaucucacucuagaaacacauacacacaccuacuacacagaugauaaaaucccacaaucguaucuguucauguuucuggguuuugcacugaacagagauuggaagggaguaaggacucucucccuucugcuuaacauucacaucaggaaaaagaagaaaacaaaguugcccuuucaucuucaucugcuuauuucagaggacacacggaggcagacugaccgagcaguggggcuucaucuucauucuugcacuucucacccuacaaccauuuagcaacagaaaccguggaaagcgcuggcuacggggcuccaggcagccaccccccuuauugggcaaaggaguuaaaaagagcaucaccacgaccucgcuacugguuuuuggccugucugagggagagaguucccgcggagccggccugggcguggcccgcagcccuacugcugggccugccucuugcaguaguugcuguaggccuccucgaacauggccuugcaggggaagcgggccuucagcuuggagcagaugaggaaggagccccccaucuuccugugcagggaguagguuuccucggguggggggacgagacggugccucagcaugacgggaaucagguuguggaucuucucgguggugcucugagugccaaaaucaaaaggcucaucagaggcgaaggccucccccaggaugaggauggcauccaagugggcgucuuccaugaccuggggcaagagaggaaggauaaauggcggcgagacaccagagcccuccaccagcccggguuccucccacagugcccggggcgcugaguucucauucaaagcucugcuguaaacuggauuacaucaugguaaugggcauaaacucaaacccacaggggccgggaacacgaggguaacauggacugggcugaugugauacaaaagggaguggcggggccuguggcagagugcagaggaugcgucccgccucguggcacucauacagaguuuuaacaaaacacuguucuggccaaaaagaacagaguccgugggccuaagcuggcagggccucccaccaugcgugucugagccugccagaguccacccaagacacacccagcagccgugugucugcccacgggaacuagcaaccuaaggaagccgccgccagcagagcaggggagaggagcugccgccagggacagcccaagguggucagagggacggggcggccaggaaucgagucagugcgaguggccauaaggaagaggcgggagagagcugcugcccgcugagcgcuuacagcugagauaaggggggcucagagauacugacaagccucaaaugacacuccuaugagacggcagacccaaggcuugaccuggauuucuuuaacuccuuccccacugucaagcagcaagcggaaaaugccacuuuguggguggcuucaggcggcaccagcacagaccguuccccuuuauuuaaaaggcuucuaagguuucuuccaacuccccccagggaggcucgaugaggggagggcuggggcuucccuucccacuugcucugcacguuggcucaaucgaggcccaaccccaagcccuaagugggcaagagugagaggcagaaacaagagcuucacgacaaguccccaacucacuggcccacucggaaaaucucacgcucagcagggcagcaugggccggggugggccccagcuuucagaccgugcccaaggaggcccgggcucugggggccccuugagggcagcugcccccugugcuuucauccauucuuacacagggagccgggcccugggucagcaggcccaggggaucccccgcaacccugcucaccuugaccucguagccggugaggaacuucaucucuauggauuucgcccgcacagucucccugucccugucggcagcagcccugaugaucuggggagaggcacaggaggggaccgugggcagcaugaaaagcucagcucccgacaucccagggagccaagugccacacccgagcccaccccacccucauccucucccugcacagggcccccggccagugcugugacaccacgccuggcagcugucagccuaacugccugcugucaccagaccugaggggcaggcagcgcagauggggacacaagggcaggaacccagucauucucccuaccccgagucccccagcauccugucccagccucagaaaaacauggaccaaggccagggccccucuccaguuaccugaauguagaggucggugaaggaucugucauauucccgcguugccccaaaauccaaaagagccaccuggggacagagacaccaggagaaguuuggcccuggugcuccauggugcggguguguggggccgggaagggggugcaacagagggcagugaggauccccacucccagagcccugagcucucugcugacuuucccaggacaaggggcaguccagggccucacgugccccauucggagaagcucucaggccuggcugcgggugcccccacccuggggcucaccuugugcugcugggggucauagaagaaguuggaccaguuggggucuguuugcaugaaguggaacucgaacagcucccucaggcacagaaccaggauguuguagcagaucuguggacagcgcgaagggucugugucaggcagcaccacacugccuggugcccugggagacuggggccagagaagccccugccuccuguuuuacccacccuacccuagggacuguuugauucccaguguuacuugggccagggaaggcagcagcuccccugugucccccuaagucccacuggugcuacuucacugccccucacccccagggagcaccucagggcuccaaguccccagcucacacuauuaggucaccaaacagccacacagcagggccacccuggccccaccugucugcuggcacagacaaaccucguuccgaaucuccuggcugagcccuucggccugguccagggggaagccagacaccagcucuguggucagcacaugugggcugcagagcucauccacaaucucaggcacauagaagaagggguggcccuucagcaggucccuggguaggggagggaggucacgcccuagccacaggcccuccacaccguccccccccccacacacaccccccaaccaggcagagggcccuccuucaccccaggcaggauauggccucggcccaggcugcaaccccagcccucugccccucagagcuggaggggccuucaccagcugcugaacauggucccuucugccucccuggugcaaacacgcaaggggcccggccgggggccacaccugaacuugcgggcacaggcggccucucgcugguagucacacuccagggccagcucccgccucagcacgucgaucaggugcucggggaacaggccugggccagggaggagggcaucagcgaggaagggggcucugcagggaggacccccucugguccccagaacccaacacagaugccugccacccacuccugcccuugacccaaccaccuagccucagaccuucuggaagcauguugcucauguucaacacggccaugagguuguugacaucacuguugaugcucugggccacgccaggguacuguggggguaugggugaggcaggggaguuagcccagggagacgggugggcccugccuggggcacucccccaacccccaacuggcuucccagcuguguccuggccccagcccacacccuggagaaccagagcuaagacccagccaugcugccgugaccuggaccccaucacagccucguuguccaccuacuccugccucaccucaccccugggaacagcucacggccacccucccaccagcucuggccccaaaaagcaaucacuuguccccuguccuugcccaccccaaaucaagcuugcugggggccccucugugcccccaaagucacucauuuagcaaauacuucccaagcuucuggugccguccaggcacuggggccagaagacaccacauauggcccugccaggagagagggugcccugcgggacgugggguguagaggccuccaugagccaggccccagcucugccccuugcagcccccauagggacaggcacugcgcaucaggccgccuaccuggaucuucauggccaccucgcggccgcccuucauucgggccaagugcaccugcccaauggaugcggcggcgaagggccgcuccucgaaguauuccaacuugucccgccaguuggggcccaggucguuguugagaguuuucugaagggcagggccagggaggggcucugagcaugcccugccugggccaccgggagaagccccaagucuguccccuccacccagugggggccgaggccacagagagugggcagagccccuggcuccucaccaucaucugcuucaguggcaugaaguccgcgcucugccgcacccgcucgaagaucuuagccagguggggguugauaaaggcaucaucuggaaggcaggagaaugacacagggcgaaccuggggauuaaagugugcgcccaggaccugggcgggcacacuccugggaugcccuggccaccacacccuccccaccaggagcacgggugaggccagaaagacaggagcccucgcacacacgcccucggccacucagcuucccgggagccccagccuccgcccagugaccugagaaggugggcuuuuuacacucaacaugcagaguuuuucauaauuacaaaagaaauuuggaaaauaaaacauaguaaaauguugaaaugaccuguguucugaccaccuguagagagcaauuuuuccucucugcucuuuauuccauguguuucuuuggacccagagccacccgucuggagaccaggccuauuaucuucuaagaucucuccccagccugcucacaucuugcccacugagcuuugguggggccacugcucccggcccuggaaguugacccccccagcagcccacgcagucccggggcagcagcccccgcgcccacucacccuggaugcucagcaucuggcccagcuugagugccgcaccacgcaccuugcagagcgugcgcacgauccgcucugcauuggccucggacaggaaaggacuggaacccagcacggccuucuucccugugggcgggcaagaggggucaccacggcacucgggggggucugggagugggauggcaagccccaccugauacagacggaggcucagacaauguccuuccucccaggcguccauaaaaccagcaacauaacuaacuacuguuccauguccaccuccccaagccugugugagccacaugcccaggcccuacgccagcgccucccaauacacacaggcaugcacacguacauaugugcacacacaaacgcacacacacaaagggccucucccuuccauauggggaccuggcgggccgugacagggccauggugcugccuguggcuggaaggggcgugggagugggaaccaagagggauguagggacccagaggaccccaggugaggaggugccgagccuuugcccugugcacccccacccagggcacugcacaaaggcccgcugcaccuguggggucggcaugcauuugcacauggggccaaguggcuucagccagagggcuguccucaagggaacggcgcucaggccaagggcagcacagcccaggggugcccgucucucccguccacccacagaggcccccugcagcucagugcagccagcuggccagugaugagcaugcagugaccccaagggugcagguggccuuuuuccaguccaccaaggggagggcugagggccgcgacucaggagcagcagaaggccggcuaagucaacugccagcaggcguguggcccagggcugcuggguccucucuagcuuccccccuauccugggccaucaguucagugcugccuagacauggaggugccccuauccagaggcagacagaggccugagcagggaucuggggcuccaagucuuuccaccuucccugaguuccucagcaccccuugucgccgggccuccagcccuugugacauucggagcuucuccugccuucuguccugugaaucuaguuagaucucaagccccaagaggucgcagugcggcuuccuccucucuggcccccacagcacccagcauuugccucaguucaaaucacuucaggccuggcacagcgcucggguggcacggagccagguccccagcaggggaagagagaggugaccgugccacugcccucugccccggagccgggugcagccuggccccugagaaaccaggguggggcgggccgcccugagaauggaggcccugcgggcccggaagaggagccucggagaagacccgcaucugcccacacaugcaggcagcuacguggaaaggggccaggcucacuccagggucccagacagcaggaagggaccugugaaggugggagauguuagcucugcgggaagaggcugagcugcccugggaggcugagcuaugacccaugggcagagcgaguccaagagggcugggcccagaagggucccucggccacccccuugccuuaggcagcagcagacgccagcaccaaaggaaaggcagucaauguccccucugcccccuaggccugugguacuugugggcugggggcuugggccugggucccuggggaggggcaggcagagaggcaaaccuugaggagaggccacugccccaggccagaggagggacagucugucuccucaugacacacagaguaggccuaggcuagcagcagcacuccugagagaugggaacggugccuggcccaauccgggcuuucccagguagcccauuggcaaagcuggucaaugccacaggcuggagguaugucccccacccaggcagggcuggcugugagaaugaccuggcaaguggggaugggcccagggcuacggcagugugcccccagcucaggaaagguccuuccagggcagagcucagccaggguggccgguguccuccaguccagagggugccagggccuggucaggaagcuggagcacaguuuggggcugcccagggccaccccacuccagccuaagccucgggucccccucucagggcuaacaaugccugggccccuuaacccccagccuggggucaccacugucccugacaaaggacacuagcuguaacugugaagccagccuggccucuucccugcuuggaugagguagucuggagaacagccagcuuuggagaggacaguaggggacaguaggggaaggcuggcuucuccuuccagagaaacccaggcuucauuucccagagagugucagcaccaacgcuaaaaauacccuugcuaagcccuccguccucagccccuuccaaggacgugcaugccgcccguguccccaggacucaguccgggccugugggauggacuagugcccuugccccagaaggcagcguuggugggugaaggggggcuguccggggacuggcagggcccccaaaggaggcuagcccaggcuggaagacagggcugugagggcugcaguguggccagacacugggugucucuggggguccccauggacggggguggaagggcgugauaccagaaugagcugacauucccugaaugggccggggccaggggacuuggcccagaacuccagaggcauugaggaagauccacacgcagacgguucccuuggcacugcucuccacaccccaggccccacuaacaggaaagccccugcugggcugaccucgcaccuaccuggcccgccccccgugccugaagaggccugaggaggagcccggccugguguucacaggcagaaggcggcagggacucagugcgccccacuccucaucacagcagcacgaaugcccaaagccucagcgugguccguucgcaggaccucuccacagagggcccggccacagcgggccaccaaccucagugggaugaguguccugaccugaccaccugccugacccuggcugugaccuucacgucagaggugaggugccucugcauagacuacagccuccccagguuacuaagcuggugaggagaagccugcagggucugccugcacaccucgccuguccccagccacaccugacccggccagaccagcgacuuccagagagcagggcagcagcaaaagguggguuuacaaggaggugugcggguguguggaggguaaggugugugggugugugguggguguguggagggguaaggaggugcaguguucagugggugauugguggguguguggaggguguguaagguggugugcagguaugagguggguguguaaggaggugugugcauggaggguguguaaggagcugugcgggugagagguggguguguacggagguaugcgggugugagguggguguguaaggaggugugcagguaugagguggguguguggaagauguaaggaggugugcagguguguggaggguguguaaggaggugggcagguguguggaggguaaggaggugggcggguguguggaguguaaggugggcggguguguagaggguagaguguguggagaguguguaaggugguguguggcugugggggguguguggaggguaaggaggugcaguguucaguggguguucgguggguguguggaggauguguaaggaggugugcagguauuugguggguguggaggguguguaaggaggugugugggugagagguggguguguggagggugugcaaggugugcggguguuuggaggguauguggaggguguguaaggagguguucggguggguggaggguggguggaggauaaagaggugugcaggugugugguggguggguggaggguguguaaggaggugugcggguguucagugggugcggaggcuguguaagcaggugugugugguggguguguagaggguguguaaggaggugugcagguaugagguggguguguggaggauguaaaaaggugcguggguguguggaggguaagauguguggguguuuggugggugugcagggggugugugacgugugcggguguucggugggugugcagggguaaggugugcggguguucggugggugugcaagggguguguaaggucuguggguguucggugggugugcaggagguauaaggagguguguggguguucagugggugugcaagggguauguaaggugcggguguuuggugggugggcaagggguguguaaggugugcgcguguucgcuggguguggaagggguaaggucugcggguguucggugggugugcagggguuguguguggguguucagugggugugcaggggguguguaagguguccaggugugcagaaggcguguggaugugcaggcagccaaaaagaaggggcuggguggccacuuugggcugggaggaggaagggccuccagccucacccccucuaaagcaggucaaucugucuguaugaacagccucaucaccccagggacgccacuuacguggaaccccaugcaaaugcggcccagcuggcugacacucccagagcacagguggggcugggggcugacaggcucaacccucccggggcccacccugccccucccacugaagggcccggcucaccugagggguccucggagcgcaggcucuucuuggcgaccucugccagugccccgaagcccaggcccacggccagaccugcaaggaggagggggcgggcacucagugcucacgcagggcuggggccacccgcucgcccacccacaaggccuggggcagcaccacacagacaccgcuugcaccaggggcccucgcugccacaccagcauuuugaaaaguggggaacaaggugggagaugccaccuguuguuuuaagagaacauuuggcucgagguagguguuucagugaaaaagauucaggaaucccccacuccacaccaucaccuuugauaauucacaggcucacgggcacacggacaccccaaaguaaugccagcugggaagcaccugggaaggacccagcacaaaugggaagacggaccagggaugguccacagaccaacgucaccccgaccacacagggcacccugagaacacaaccacccgcuucaggucugucugaagagccucccaucaccuagacuucccuaauucacuggaacaggaaagguguugccacaggcauacaaagcacuugguggugagagugagaacacuuuuggcucccccuaauccaagccaggggaacucgcggggcucaggcgcagcccucgcuggguaauggaaggcccucucgcccaccuugcccuuucugcggggcuggcaaacacugacaucugaggaccguggggugccaggccuucccauuauccucuuucacaaucuuccgaaucaagguccacuaacaccucauuuauccaaaaaucagucaaugaaugaucccagcugcucaagaaagccacuccccaccccugcccaggagcccagaaggugccacuaaugccacaccucacccagggccaguauucucuuccuuuauacccagcuguagcuggcuuuccggguaggcaugggugagcagaaagagggugaagagcaccuggcugggcacggugaccauggccggcagggcugagaccagagcggccgcacgaugagccggccucggagagccccgcaccccgcacccgggcaacaucgcagccccgcagccccgcagccccgaagccaggcaacaucgcagucccacagccccgcagucccacagccccgcagccaggcaacaucgcagucccacagccccgcagucccgcagccccgcagcccggcaacaucgcagucccacagccccgcagucccgcagcccugcagccccgcagccaggcaacaucgcagucccacagccccgcagucccacagccccgcagccaggcaacaucgcagucccacagccccgcagucccgcagccccgcagccaggcaacaucgcagucccacagccccgcagucccgcagccccacagccaggcaacaucgcagucccacagccccgcagucagacaacaucgcagcgccacagccccacugcccggcagccaggcaacaucgcagcagggggcuguugggggagagggcucacaccaggacgcucuguuuaaggcgcaaggaaacuggcaucugcuugcauguuuccaaauucucuacagugauuaugcaugacuuuuaugaaaaauacagaacuuguugaaaauuuaaugaaaaguacauuuuaaaacuaaaaagaagacaacucaauuuuuaaaaaaauguuuuugcgauacauuuuuacccacaccugggcaacagugcacccuccacguccccagcagucugggcagccccugccucacaggcugucgugcgggcgugaguagagcacucgccgggccaggaacacacaaaggccacacaagcagcugcuguuguucucgugacucuauucaaaaaggcugggccggcgcagaacaaaagaaauagaaggcaagccacacauauaauuguuacuuuucuagcagccacacugaaaaaggcaagaagaaacaugcaaaaugaauucuaauaguauaauuuacuuaauauacccaaaauguuaucauuucaacaaguaaucaaaauaaauauuauuagagauauuuugcacuugugugugugcacaaagucuccaaacaccauguguguuuuauacucagcacaucccacuguggaccagccgcauuuccaaggccccgugcggcuggcggcuccguacugggcagcauggggcaggauaagcugagccuccuggcccucaggagugacaacacacaugguacagaugucugcuguguugggaugggggugccuggcagguacaucagcucuuucucucgcuguagaaagcccugggcucagagcugggagacacaguccccguuuaaacauuaacucccugaugccugcccaccucugcccugccagcacucgagcacacgaucugacuuagcgaaauaaacggagacaggcaacauuagccugugcacugcagugaccuucaccaaugucucucugugucuggauucuucucugccugaagcaaguccagagacaagcccacgagaggggcagguggauccacagguuaccggagaugccacagcuguagggugggccacauugagcuccuccuucugcaggcagaggugugucccccucaucacccuccaucaggaccccccucaaacuguucucuggccacuuucaggcacacagcucuccacuggcaaggaccuguuauuaaacaaaugaccaaaagaacauuccacagaggaggccucaggccccacacgucccucaggaccgaccagcccagugccaggccaaggcgcugcccacugacagacaggcaggcuccccaggggacagaaaccagcccagcuggccagcaacccugaccuuggccucacgagcuccugcaccagugaacccagaauaaacugaggcccucccgccccagacucagcgcauugcucaggaacccaggccagccucugcccuccauuagaaccagccagcacuggaggcaacuccagaagaugagcaccucagccggcacuccccggguccucgugggaccccacucggcacccccacagcccucaggacaccucacaccucucccugcucagauccacauucuaagagcgcccccggcuuggcccacguggccagcaaggucguccuggaggaaaaccagccccagcacaagcuccaggcucuaaagccacugugagcagccuugcuucccuccuggccuguuccaggaaagcuucugacauguuucuccgagagaaguuaugcaaugaaggaaugacaggggagggaggggcaggcucucccccaggcaggaacacaggcugcaggccaaccuccuaugacuucuggagcccagucccccacaaggccccauccucccaaaagucccucuaggaggucaucagagccaaacagggcccuccugugggcagucacucggcuucugcccagauggacaccaggagguuaaaaaaagcaaaacaucaaacaacuuccaacaaacagggcccuuccuagcaggcugggugaaaagugcuuaagggcaggggugaguaaguaaaguuccuuggggcuuuggcuuuaccugccagaaacuaggccuguuuacagagaagggcucgggggaguuucucuaccagcaagggguaaagauacagcuaaacagcagcaaacuauaaaccaggcgcugcgcuaagcccagcuuuuacugaggcauccaacaauccucaucuaauagacaagaaauccccacagaaaaugcagcagcccaggaggcuucccuuugcuucaagguguuccugaauccccaguguucagucuuucucuaucaccaccuggcauccuccagcugcccccagccucaggggaggacagggggccuggggagggggcugcagcccccagcauggcaggaaggggcacgggaaggcgagaggaguuccuagcggcugcucucacagguucucaggaucugucccucuguucccagaacuggacuggugggggaagggaagcccuauagccccucuggggccuaauuacagagccuggccaggcucagacuuccacacacaccacagaggccugggcucuagucccagggaugucacaaauaaccauauggcccugggccauaugcuucuucuuggcucagcuuccucaucuguaacaggagagaauaagaaccucucucaucuccaacacagagcuccugaaauacacagaaaagccccuuuccaaggaggcuccugagaaggcaaaaaacuacacucccgcaccccugcugagggugcagaacucuuggaucuagaacacaucuauccugcugcaaaguggacccagaagagcacuggcacugcaggaagcauggcgugugcccucagcaaaucaggcuggcgucacugccugccacuugucgcuggccuuguaugcagcccugucaacaaaggggcaucaugccagcagguuagggcacacagugcuguugcaggggguccugaaggucccagccaaaggguccaacagcauugcugcugugggauggcucucaaggccacagcaagccacagccaggucucgaaccguguccagaaaccaagugauacugugagucuuucacaaaacuaaguuauuccauuuauucuccucugucuuaaagcacguacuuuauacuuuugcacuguuaaaauguccuuuugaaaagauaaauaaagugaugguauaaaguggugcuuuguuuuaaauguccuuacaugcaaaauuuuaaaaauaaccaccccaagcccauucacccaauguuuguuuuaaauuuuaccacugagaugagggacacaaaaguuuggggggauggggcacaauggucccagagagagcuuugcugcugguguauuaacaguauccgaaguguacuggcaucuuugggaaauuaagcaacaagagccaacagccuaagcaaugccuguuuucuaacauaagagaguuaccuuaccucuuaggaaacccaauagagucucauaagcuauauuuaaaagcaaaguauuuuucugggaguaagggacccccaaccuuuuaccuuuuaaaaauaauaggauacccaaagguccauucccucuacucuucauuccuggcccacugaccugcuuuuucucauaugagcaucuccuuguuuucacaggucaaauuucaaaauccuuucuacacagaaucaaauaauauuauugcuuccucuuucuuuacuuuuuguuuccugucuuccucucuccccuuuuccucucuccccuucugccuuaaugauguggauuguaaguuccugugugaaggccccaggaaccaccacagagcuaugcacaaagcagugcucaacuccuucuggcaagucuucucuagugccuccucuauccauuaaagucucacuucuguagguguccauuucucaauguauagguacagaggagauaagucaucuccucuaaaccugcaagacugaaggauaaauggaaaaaggcauggaaaauacagaaaagagcaaaggagacacaggggacagagggaaaagaucuaacauauguguaauuggagucccagaaagagaggagagaauaguacagauacaguauuugaagaaaugaucaaaauuuuccaaaacugauggaagccacaguucaagaugcucuguaaaccccaagcagaauaaauacaaagcaaaccacacucaagcaugucacagucaaacugcuagagaacaaaaacaaaaaggaaaucguaaaagcagccagagaaaagaaauaagacauaacuuucaaagaagcagcaauauaacugauagccacauuuucaaaaaaacaaucaaaguaagaaaacaauagaggaauauuauuaaagugaucaaaggaaacacauuuucaacaucgaauauucuacccagcaaaaauaccuuaaaaaaauaaaguaugaugauauauucucuuuuuucuuuuuuuucuuuuucuuuuugagauggagcugucauccaggcuggagugcaacgccgccaucuuggcucacugcaaccuccaccuccccaguucaagugauucuccugccucagccucccaaguagcugggauuacagguacccaccaccacgcccagcuaacuuuuuguacuuuuaguagagaugggguuucaccguguuagccaggaucgucucgaucucuugaccucaugauccacccacccugaccucccaaagugcugggauuacaggcaugagccaccgugcccagcuauaaugacauuuucaaaaaaauaaaaacuaggucgggugugguggcucaugccuguaaucccagcacuuugggaggcagagguggguggaucaccugaggucaggaguucgagaucagccuggccaacauggcaaaaccccaucucugcuaaaaauacaaaaauuagcugggugugguggcaugcaccuguaaucccagcuacucaggaggcugaggcaggagaaucaccugaacccgggaggcagagguugcagugagucgagaucacgccauugcacuccagccugggugacaagagcaaaacuucaucucaaaaaauaaaucaauaaaaaauaaauaaaaacuaaaagaauucaugauuaacagacuacacuguaagagagaggagaguuccucagagaaaaagaaaauuauaccaaauaaaauuauagaaaugcaggaagaaagaaacacaaaaaagggcaaauauguggguaaaucuaaauucauaugggcuguacaaagaaauaauucuugugguguuuaauauaucuuaauaucuaaaaaguguucuaagguauuagcaucauuggagaaguaguaaaaauaaucacuuauuuuuauauuguaauaagucaagaugcgugcuguaaucucaagagugaucaccaaaagaaccguaaaggaauguaaaacauaagagcuaacaaagagagaacaugcacggucacgcaucauguaacauuucagucaacggacugcauauacgacagugauagauuguaucauauuuuuacuauaccuuuucuauguuuagguacacaaauaccguuguauuacaguuaucuacuguauucaguacaguaacauguuguaaagguuuguagccuaggagcaacaggcuaugccauacagccuaggcauguagcaggcuauaccaucuagguuuguguaaguacacucuaugauguucacacaaugaugaaacugccuaacgacacauuucucggacugaauccuuguuaagacacacaugagggccaggugcgguggcucaugccuuuaaucccagcacuuuggaagguugaggcagguggaucacuugaggccaggaguucaagaacagccuggccaacauggcaaaacccugucuccgcuaaaacuacaaaaauuagccgggcauggcagcacacaccuguaauuccagcuauucgaguggcugaggcaugggaauugccugagguugcugugagccgagaucacgccgcugcacuccagccugggugaccgagcgagacugucuccaaaaaaaaagagagacgcaugacuauaauuuuaaguccuugauuaauuuaaaagaaggcaaaacaggugagaaaaagggggacauaacagacaggucaaauaguaaacaaacaaaaacuaagguaguagauauaaacuccaauacauccacaauugcauuuaaauguaaauggacuaaauauucucauuguaagauuaucagucuacacuuaaaacacacaaaaaaccaacuauauaugcugcucauagauaugcauuaaacauaaggacauuuuaaaaguugaaaguacaggggaaaaaaaaaagguaacaugcaaacauuacccaaaacaaagcuggaauguagcuauaguaauaucagacaaugaggacuuucacagagaugaaaagaggcauaacauaagaaugaagggucaaucccuaggaggauauaagaagaauucuaaaucuggccgggcgcgguggcucacgccuguaauccuagcacuuuaggaggccgaggcgggcggaucaugaggucaggagaucgagacuuaucacgcacguguagucucagcuacucgggaggcugaggcaggagaaucacuugaacccaggaggcagaaguugcagugagccaagauugugccacugcacuccagccugggcgacagagcaagacucugucucaaacaaaaaaaaagaauucugaaucuguaggcaacaaauaacauagcuucaaaccauauaaagcacaagucaauagacuaaaaguagguaaauccacaaucauagcagacuuuuuaaugccucucucgauagcuuauugaauaagcaaaccaaaaucacuuaaaaaucugaucaauaugaauaauaaaccagacuagauagacggaucacugcacucaacaugaauuauuuucagguaaacauggaacauuuaccaaaauauucccauuuggaaucaacggcaagacccuuauuuuacaaaagagaaaaccacgguagagcccaaggucacacuggaagcacaguuguaaucaaaggacagcuauuaugaugaacuaaaguucaguucugaccccauauccaauauaugacccuuucuuucacaccacucuuuaagaaaaucuaauauccacagaucauccugcccauagcaucacagucauaaugucccauagccaaauuggacuuaggacucaugccccgcccccauuucagcaucaaaaugagccccuggaauuggaaaguccuugacuuccacuucuauauagcugaauaccuacugccaaccucgcugaaaacccgucugggucccugcagcagcccuaccucccugagaccuagagcaaucccuuuccuucauaaccccguguaaaaacuuccuaaagucugucagucugcaccugaaaaacaccuuuccuccaugaagggaagaaaggcuagagguauuuucuaggagaacaaagcgcaacagugcaacuacaaacuguuuggaugaugacccaccaguaagcuauauauuucacauuguagugaagaacauacuuaaauaguauguaugucucugaaacuaaaauaucuugccauguguauaguucauuguaaggauguacgauauuaauucuaaucuuuucuauugaauuccauucuguuuaacuuguuuuuugagacagagucucacucugucgcccccacuggagugcaguggcgcaaucucagcucacugcaaccucucccuccugggcucaagcaauucuugugccucagccucccgaguagcugggauuacagucacaugccaccacaccuagcuaauuuuuguauuuuuuuaguaggaauugggguuucaccauguuggccaggcuggucucaaacuccugaccucaggugauucucccaccucggccucccaaagugcugagauuacaguuaacuuguuuuuuauaugcugauccugaugcauuaaauuaauuucacaguuacuaaagggucauaaccuacaguuugaaagguucaacugggugagccagaaggcccagaauuccccacuagggccagaacggcacguucuuuccugaccuggcuucucuuugcucccauccugccaucuccaagccugaaacaucaucugucaauugcuugggcaacaacaugagcaucucugaaucauagcugugggcaauccuccagcacacagacacccacagauggcuccguacaucaggcaggugucagcaaaggcuccagaggcuucugaugcuacaaagcacccaagacuagggcuucaacuccacuaacccaggcucccucuggcuacccauaaucccccacccucugaggagagcucucuaccuuuuucuuccuacacaucuuccuauauauaaccccuuccacaucagucucugucuuccuuaacccgucacccaaaagggucugacuacugccuccuucgccaggacuucguggugcuccaccagauucuaauucaccaucaagacuuucauucugaccacuuuucccuaacagccugcauuagcucuaccgcuucuccccaccccacaaagacuccgaagugaggacugcaccaguccugaaacacgucaaacucagccuuccagggacaggcucaccaagagucuagagugaaaggaagagggaggggacagagaaaagguaccgaugugaaaacaggguagcuccugcccucaauaucauggggaaagaagacagccuccauucaauauuuuaauaagaaauaauacauguuacccaaugacaagccaaugugcaaagcaaguaacaugccaagucuuccaggggauaaggaccacuagaggccaccaaggcagugauucucaaacucauucugacagcagaacucagggaggugugauauucuaugagggacugcuugaaauguuaccccaggaaaaggaaauaagcaaauacucuuggcugucacauagaugacacuucauacuaaauuccugaauggcuaaguacaguggaugccaaauauuaagguaaaaauuaugaaagaaaaccuuacugcugagaaaauucuauccaguuaaccaagucugcucagcaccuuggagaggggggccagccaucauucaaugucagaacccacacacauuacgcagcucccagaauaccaggcucucggggagcacaguacgugagccucugcccagaaccagucuugaacaaguaggaugggguuuccaaaagagaauaggcaggagcggaggaacagcauguaugauggaugguguaugggaggaaaaacauaaaccagcaaagagacaggcagacccaugagagugcaucuccaugccccacccagcaccagcaccaucauggaccacucagaccucugcugccuacagcccuggaacuaaccacucacccaaggucaggguccaaaucaagccaccaaaacuguggcuuccauuaauuauaucaccuggagaaccuacugaggacagcugaguguuaaagaaaugcaaucccaguaacuaacuuagaguguaccacagcaaaggagauggcacuuuaacaggaacaucugggccagcgcauuagcagcagcaugacaaacaugaugccaucaaagcagacacaacugcuauaaaccuucacuauaaaaucacccuucaacuucuauaaaaagagcgcauguguacugggcacaaugacaacucaaccccccaaaguacagacaaacggcuuuaaacagcagcagcuggaggccauggcaucuugucacuccacucaugagccgcaggccuguggggacccagcaaaugggcucccuaaaugucuggucccagggggaaagaaagcccugcugaguugcugaacagccccagggaagagcuuuuccucacugcccagccuccuuccugagaggccuccaaagcagccgacugguagugaaccugaggcaggggugaaacagagaugcugcagacaccgccuccaggcgaggccugccgggcaauccaaacucagcuccuggcacagcaucggcccuguaccaacccgcaggggagagccaggcagagcuggaauccaguaacugaaucauccucccaugaaaaacuccagcuccccaaaagcucaugcaggggcggccaccgccaccugcucccccaacgcccuccccgggauauugcuggguccccaccuccaugcaggccgcagcguggugcccaggcagggcaggugaggcaguccaggggcacacagccaccuuaccuccgaaguuggccagccggccaauccucgucacaggcaccuuccgcucccgggcaugcucgcugagcuggagggagacgagaaagagaccuguggaaucagccaaggggacaggaccaaccuucagaggcuccuguugcccccacaucuccucuccaccccacagucagcagcuccgccugacagcacacuccaccaagagaaggccaccacgcuccuaaaaaccccagaccacagcacccaggaaaagucccuagagcagagcccaaggccaucacugcuguggguggcagcuaccucggcccuccaggggccucccauacgcaccgucuguuugugcugcuuguucucggggcgagccuuagccugccgggccuucucaauguccucggcugugaggcccccaacaggggauugguccugguggaagaaccuucgcugaaagcccauggcagagaaugagucucugggguuugcaaagagccucccguuggcccugcccagaggggaggaggccuggccggggaacccggcuucucuaaaggguccacuggccacguaggcaggagcugggcccucgcugugggcaugacccagggaugggggcgcugacuggucgggagcggaggcugaagagaagucuguggaggcuccggcugcaugcgggacugagaaguggaacuccccuucugggccgccgaaguucucagcaaaauauucuucauguuuauccugacccugcagggagcaaaggccagcauuaggagagcaagagcgagccaggagcuccucccugccuguccccugcugcccaggacagcacaccaccagcaucccgcccccucccaccuccagagguggcacagugcugcaccugaggcccggcacccuucccagccugggagccgggaccugggcuccagcccugcuucuguuggggcucugcugugugguccuaggugggacacugagcaccuacugugugcccagccggggccaggccaagugcacacuacgcccgcagcggguuccucaccuauaaaacagggccaagaaggccuccagggcuuuggagaugguaaaccagggcgcaaaagacagggaaagcucugagaggugaacacacagccuaaggccagcaaggggugagggaagcacaccgacgggcccaccuaagcccacagcuuacugcagacauggaugccacccaccagccgggguaugcauguaagagauccucacuggagaggugguuacaaccaggaccaggccuggccgucccuaagagcucaggguacagggaaauggaggggcaggggagaggauacgccauguuuucuuugugauggucaccaaggccugagcuucgggcccagguccuuucugcuucugaaccaggagugaccuugagugagcuccugacccuucucugcuacuuccucaucugaaaauagggcuccucacagucacaguuacuggaggccacagacagggccaggaaacagcacccaggagccuauaauuagaacagcaccggcuucuagagggagaccaguggccuggauucucggcuucaacugaaacaaaugaaaugcgcaggguaugcagacagcaggauacccaagccucacguucugcugucuaagaugucacaggaugggagggaggagagagacaggcuguuacacucauuucaaaaacaggaaacugaggcaaagacggcugaugugcuggugaaggucaccaggcagcaaaugacagagccgggauccaacacccaggcuggcccugcuggcuguggcacuacucucagaguagaaacaaguuguauuuaugccagugcgauggcucacaccuguaaucccagcacuuugggaggaugaagcaggcagaucaccugaggucaggaguucgagaccagccuggccaacauggcgaaaccccaucucuacuaaaaauacaaaaauuagccaggcgugguggcaggcaccuguaaucccagcuacucaggaggcugaggcaggagaaucgcuugaaccugggaggcggagguugcagugagcagagauugcgccacugcacucuagccugagcaauggagcaagacuccaucucaaaaaaauaaaaaauaaaaaaccacagaagucauauuuaaauucacagagcccccagggaaggcuugacagugagggagccugggcagggcccuccuucugccccaucacucccaugaugguccccuggcccugugcuacuaacaccugucggugucacuguggaagcccaaggccaguggggggguccccagggccccgaagggacccggacucaguaaguaucugcugaaugaauguggaagcaaccuugaggggcuggagggagacaggauccuggaguccgugaccuuccuccccucgcgagaagggagacacggaaaagcgaagcacugagggagugaauggcagcgcacugcgggcagccacccugcuccggugccuacccugcucccgugccuccugggugguguggcucgucacucagcccuaccuccgagugacugauggggaagcccugccccuuccagacaugcuuugggagcagaggguuggagagugcccgaguaggaggcccugcucgccauuagggcuaaggccuguccaggcugucccacuccugggcaggcccaagugagcugggcaaccucacuuucugagugucccacaggcaaaacacccaagagcgaggccgaggccccacacucaggcaccaaaucaggcaaggggagggcaagagcauggaguccaggcugggaggggacaagaauucugguccugucacucguuaugaguccugcagcaaauugcuucaccucaguuuccucaucugagaaaugggugugaugguccaggcuggcccccaucccaggacaguggugaggcucgggggagagcacaggugugaggacuucugaacauuaaaggcagguaugcuuggugacagccacuguaucacugugggauccucccagagcggcagggaagggccugcagguccuaaaccugagacugagaugccugggggcugcgacggccucacagccugcaggagggcggugaccuuuguccagaaaucagccauccacagaacagacguggaaggagagaagcugcgacacaaccuccaaugcacacaugccuaagcgcacacacacaggugcacacgcgcaacaggcacacaaacaccccccacccugucuccuugacugucagggaagcugcuggcaacugugcaaggugacgccauggugggccgugcucugcuguagccagcccugucuauagucaccucuccagcacacgauuucacugaaaaucaccccuuggagguaagacaucaaggcuuccuggaccuuggcacaaaaggucaucuccuccccuagauggcacagggaugagagagaggcuggagaugaagcuguucuuggaagggcugugccagcugccaccaaggaaaggagggcccccagucaggagugcagagacccucagcaaacugaaggagaaaaaugaggccaggccuuggcggaggcucagcaggcucagugggaagggccuucgaaggcugagccaggcugauggacacaugggccccaguaaaaacugcauugugugucuccaaagugcacacacugaaaccuagccccuagugugauaguauugggagguggggccuuugggaaguaauuaagucaugagaaugaagcccuccucaaugggauuggugcccucauaacacaggcccuagagagcagccuugcccuccuccugccccaugaggacacagugagaagauggccaucuauggauuaggaaacaggcccucaccagacacugaaucuucuggcaccuuaauauuggacuuuccagucuuuagaacuuugagaaauaagcgugcauuguuuaagccaccagucuauggaauucuguuauaguugccacagccucacacaggggcccugucccacccuggaaggaccgugggacacauuagcuggugggcccucaggcccuggccaccaaagaccaguugccauggucacagcccuuggucucccccagagcuccaggucccacccucuuccugccagcaccccucccacugccaggcccccuuaccugcaccuuccccaagaacaugccaaucugcuccacagccguggacugcagggcccuggccgccaugaucagcuccccuccgaugcccaagugcugcagguggguuuccacggccgccugggucagcuugacaaggccuuuagccaccaugauggugucucccaauauggcagccauccuucagggcuggaagagaggaggccaagucaggggaggccccaggccucugcaggccaaacccacacuaccaacuccacaccaaacucugagcagaagguccagagggcugguuuuuccacugaucuccccuucugcuaagagauaagaaagggcccagggcucaagggaggcuccacgugacucuggacacuccaggggaauggagcagaauaaaggccguugagucaguggugcggugugcuugcugcuucccacacauuuccucaccugggccucacaagcacccuacggaaaaccugaggcacagacagguggcgugauucaugauucgcagcagaaccaggacuugagucaggcgcacagacucccagucuaggguucaucccucuggaccaaaacugccuguugggagaggagcauccaauucccaaagaacuucccugcaagguccaagggaccacucacggcauuggugcuccaacccaaacccacaggggcugaggcugccugucccugcccagccaccauugcucugcccagugaggccugugacggauauccauagaccaagggacaaccagagccccucccugaccccucagggucagcccacccucagcuucaacuauucaccaaaccaauguuuucaaacugcaguccagacccacagugcaauaauuuggaagauccuaaccaccauucaaaagaaaugaacaaccaccaccaccaccaagcaccacuaccaccaccaccaccaccaccaccaucaccaccgccacugccgccaccaccaccaccaagcaccaccaccaccaccaaguaccauugacaccaccaccaaguacaaccaccaccaccaagcaccaccaccaccaccaagcaccaccaccaccaccaaguaccacugccaccaccaccaaguacugccaccaccaccaaguaccaccaaguaccaccaccaaguaccaccgccaccaccaaguaccaccacugacaccaccaaguaccaccaccaccaccaagcaccaccaccaccaccaccaaguaccacugauaccaccaccaaguaccgccaccaccaccaaguaccaccaccaaguaccaccgccaccaaguaccaccaccaccaccaccaaggaccaccaccaccaaguaccaucaccaccaccaccaccaccaaguaccaccaccacaaguaccaucaccaccaccaccaccaaguaccaccacuaccaccaaguaccaccaccaccaaguaccacuaccaccaccaccaccaaguaccaucaccaccaccaccaccaaguaccaccacuaccaccaaguaccaccaccaccaaguaccacuaccaccaccaccaccaagcaccaacaccaccaccaagcaccaacaccaccaagcacuaccacaugaugcagaaucaaaaaggaagcaucaaggagcacuguggguagcuuucuuaguucacuuguccuacuuucaaaguggcaaauauauaagccaucuaaaaaaguacacacugaacaguacuugguugugucuuucuuccuaccuaaacaguugcauccuacauacccagugaacucccaacuggugccaagccccacccuagacaguggcgccagagccaggaagcagagauggugagcacccacuccgcuggaaggagggcccaauaggggaaauaccccauagauaugugguccugcauacugggaugcaaaaccuguucuucucaaaucaauaaacacagacugcuaauaaacagaugcugcuaauaaacacagucugucauuugugagcagacuaacauguagacucauuucaaaaccacagccuguacccaccccccuuugacaaauaucgcugaccuacuguuuaggggccacacccacaccuccccuuaccaugcaaagugaacccuucacaccucaucaacaucagguacuuuuuuuuuuuuuaagagaggggucucacuauguugcccgggcuggagugucaaggcuguucacaggcauaaucauggcacccuacagccucaaauuccaaggcucaacugauccucccaccucaggcucucaagcagcuggaauuacaggccugcaccaccaugccagcuuaagaccagguauuuuucugcaagggagucuacgcucucacagaaguagaaaggagggaaggggaauaacuaccagaaggaaacaucuguccagaacuuuucucaccuucuguuuucaaaacuuaggucuuaaaauccuacuucuaaugcaccacaaucccaaagugccucauaauucaacgaucccacaauuucgcugcaaaucccuuccagggguguaccaagaaccaggcacacagcuacaccaggagguauuuucaucaugauuuuaaagaaauaaaagcccucaaaccauguaauacacaaguuaaaaauccuaucagcaccgugacuucaucugcaaguaccaggcccucgcuaggaacaccagucucccaccuacccuacuucuuccugcugcuccaugagcacguuuugggggucucgccugugaguaacugaaaugaaguguuugggcucugugccuccuugguacagcagccuccugaaggccuccgugugccugccugcucuccucugaggaggggcagccaaaagagugaccauaaaugauaaagcagugggggugggagacaggugcucauguuugggaguguccacuagccaggcaugaaaccaaaauaaaaagucaaccggagguuccuucaacacaaguucacugaccucucccagggcucugggcuaguuccugcaggccccgaugaaccugcccuggcccagggcucauggcagcguggcaugcccguaccucuauaaugggcacagacaccagggagacagcuaggggccaacugaugcugacacgccaggaucggaggcagaguggaagcgacgaccuggagccgggacgugagacuccaggcccauacccaccagcugccgcugcccagcguguggcucaaccucuuccccccuccucaguagcucaguacggaagggcucugggugccucaucagaccccuuuucugguccuaaugugcuaaccugcucuaacgggcuuuugugggguugauagucuuuuuuauuuauuuggguggcaugacgguuauuuuuggcuauacuauggcgauggcuacugaggaguauccugaaacaugaggaucaaauauugacaucugaggggcuuuauuauuaggacuauuaauggaguugaugcugguucggugacuaguugagcacgauggaguugggaucacgauuaaaguaaauaaaugucuuuauugaagugucuagagagaaaaagaaccgugauaaaugcagcuucccaaccccacggacagggguuaggaaagcugcacaaggcuguguucccaccacaggaggguguuuucuggccaaacuuucacucucugaccuuucagggacaccgucucacucaugcuggagacaaggcuccgacucggggauccugaccugcacacgagcuggaaauuauuugggucauggggaccuucaaaucuagucuccaaaaccaaaagacacccccacgggcugucuaaccggccagauacaagaagauauaucaauaggaaaaugaguuguguccuuuuuaaaaaugaauucaacagucaauccugacagacggcagaugagauuaucacacacuguccacucaggacccaccagaaggaaggaauuuuacucugaggaucccuuauacacuccaaguccccccuucacagccaaaacucacugucugucacucaucuccucuaugacagcaggccagggacgucaucugcauuaccaagccacuguucaaucuccuccguaaauacagagcacagcauuauaaaccagcuccuccccagcaaagcauggugucuguucuaaaagccaaggacccacuguccugaagucucuugcagucauaucugccaccaaagccuagacaugacugguauaagaagcuagaagcaaguggcacaaaaagccuuucuucugggcaaagugugaaccagggaggugggggggggggggcagggagagugugaaucugggagaguaggagccagggagagugugaacuagggagagugugaaccagggagaguaggagccagggagagcgggagucagggagagcagaagccagggagagcggaagccagggagagcaggagccagggaaagugugaaccagggagagugagagccagggagagugugaaccagggaguggcagccagggagagugugaaucagggagagugggagccagggagagugugaacgagggaguggcagccagggagagugugaaccagggaguggcagccagggagaguggcagccagggagagugugaaccagggagagugagagccagggagagugugaaccagggagugggagccagggagagugugaaccagggagagugggagccagggagagugugaaccagggagagugagagccagggagagugugaaccagggaguggcagccagggagagugugaacgagggagagugggagccagggagagugugaaccagggaguggcagccagggagagugugaaccagggaguggcagccagggagagugugaaccagggagagugggagccagggagagugugaaccagggaguggcagccagggagaguggcagccagggagagugugaaccagggagagugagagccagggagagugugaaccagggagugggagccagggagagugugaaccagggagagugggagccagggagagugugaaccagggagugggagccagggagagugugaaccagggagagugggagccagggagagugugaaccagggaguggcagccagggagaguggcagccagggagagugugaaucagggagagcgggaaccagggagaaugggaaccagggagagugugaaccacggagagugggaaccagggagagugggagccagggagagugugaaccagggagagugagagccagggagagugugaaccagggagaguggaagccagggagagugugaaccagggagagugggagccagggagagugugaaccagggaguggcagccagggagaguggcagccagggagagugugaaucagggagagcgggaaccagggagagugugaaccagggagaaugggaaccagggagagugugaaccagggagagugagagccagggagagugugaaccagggagagugggaaccagggagagugggagccagggagagugagagccagggagagugugaaccagggagagugggagccagggagagugugaaccagggaguggcagccagggagagugugaaucagggagagcgggaaccagggagaaugggaaccagggagagugugaaccagggaguggcagccagggagaguggcagccagggagagugugaaccagggagagugagagccagggagagugugaaccagggagugggagccagggagagugugaaccagggagagugggagccagggagagugugaaccagggagugggagccagggagagugugaaccagggagagugggagccagggagagugugaaccagggagugggagccagggagagugggagccagggagagcgggaaccagggagaaugggaaccagggagagugggagccagggagaaugggagccagggagagugugaaccagggagugacagccagggagagugugaacccagggagugggagccagggagagugugaaccagggagagugggagccagggagagugugaaccagggaguggcagccagagagaguggcagccagggagaguaggagccagggagaguggcagccaaggagagugugaaccagggagaguggcagccagggagaguggcagccagggagagugggagccagggagagugggagccagggagagugaaccaggaaaagcgggagccagggagagugggagucagggagaguccacgcugagaagccuuccccagggcagcugucugcugcaagccuagcaccccaaccaccuauagguaccuccuauaggaaguacgucccaaacugaccuuaccacccacaccucauccucccagggcucccacccugaggaauguggccaccauacgcuucuuucaagccuccucccuugcccucaagcaucugauauucccacugggugaugcagcaaccguucaccauggcucugcccuucccuccacugccuuuagguuccagccaggccaacccacuccuggaaccagagaggcuuccuccugcaggccugugcagagggggcacaccuccucuccuccucccggaucucagcaccaacaucaccucuucugggaaggcuuccccaacaugccucccagcacccugugcccauccccuccagcacagcagugaccacuuccugaaucugccuaacucucuccccagucggauaucagccacaggacaaggacuacaaggaccaucagccauaggacaaggaccacaucugucuuccucucuccagcaccgaacaccaugcucaggauugagcagacaggucauuaauauuugccaaaggaaaugaacucagcuggucccuccaaaguuugagaaagccugcuauucucuggcuggcucacacuugcuggcaacuuuuacuccacauacagaaucaagggccucucaggaggcuggucugaggcacugguccucaagcugcugcgaacgucucaaucaccuuaagacgaguccagagugcugggccacaccccuaaggguuccgucucagcaggucugggguggggcccgggaaucugcaucucuaacaaguucccaggugcugcugacacugcaggucccaggaacuuacuuugagaaccccgguucuggaggaagagagggaaggggagcagagguggcccaugccuauggccaggcaggaugccuccacagagacccuuuccuaagagucucccccugaaacccucuucccaagagucuggcuuugcccuuaggcggaagucuuccaccugccccuucuuuuuccauuauucuucaagaaacagaaaaaggaaaucaaaagugaaugagcuuagagaccgugacccacagagcagaccuccaaaggcucucaagacugucaauucaaggaugcuuuggcaaggacuguuuaaugauauucaggauacccugaggggcuggcaguggccuucugccccccucccagccaggaacugucuuuucacuuugggcaugaacauucucaauuucuagccugugugggcacugaaacauuccuuuacguccuugaaauuuuuccuuuuuuacucuuagaaaaagaaaacaauugacuguuuccuccaaggacucacaagaauguauguguuggggcaaagacuucaaacuucugaaccaaacuccaugagucucuuuagauguaaccuucaccucagucuuuaugaucacacaccagggagcaucacucaaacaucucgggcaacucccggcuucuaucucgcgagguccagcuucagggucucugucaguagguccugaaauauccucaccugcuaccaguuuucaaagacaacugaacacaugaagaacccaggagaugagaaagagggaaaaaagccuccguccuucccccgucagugagccccagcacaggccugcugagugagaccuucacagcgggagcccaggagccuguacucaagagucuaccccagggcugggcucucagagcuggccccaaagagcacaucuuccaggaaguccccucuccccuucuccucaggcccugccuggcaaaaccugucaaauuacaucucccuaaaaacagaugugaacauucacuacaagaauguaaacaucacaaccuugccuaagauuaguuagcuaaacgguggaauagucauaggagggcauuccacauagucauugaaaaugacacugugggccaggcacaguggcucaugccuguaaucccagcaccuugggaggccaaggcugguggaucacgaagucaggaguucaagaccagccuaaccaacauggugaaaccccaucucuacuaaaaauacgaaaguuauccaagcgugguggcaugcgccuguaaucccagcuacucgggaggcugaagcaggaggauggcuugaaaccaggaggcggaagcugcagugagccaagaucaugccacugcacuccagccugggagacagagccagacuccaucucaaaaaauaaauaaauaaaauaaaauaacacugugaaagguguuuacugacaaauaagaaaguguauuauuauauauucccgggaaauaaaaagcaggucacaaaacuaucaucuuuccuuuuggagcaggaaaggagagaagaaagggagggaggugacaggaagcaaaaacaggaacguugcuuuucaugcaguggugggaagacaaaucuuucuuuauagaaagauuuguauauagauacagccuuuguaccuguaucuauauuuucuaaaauauucuacaaagaacaugaacuacuuuuacaauagaaaauaaauguuauaaaaauaauaucagguugggugaagcggcacacgccuguaaucccagcacuuuggaaggccaaggugggaagauugcuugaagccaggaguuuaagaccaacccgggaaacacagggacauccccaucucuacaaacaaaaaaauuagccaggcguggugcugcaccuguagucccagcuacucagaaggcugaggugggaggaucgcuugagcccagggauuugaggcugcagugagcuaugaucacacgacugcacuccagccuggguaacagagcaagaagaccugucucaaaaaaaauaaaauaaaagauaaauaaaauaaaaauaaucuuaaauaucuuuuauuaaaauuuuaaaaaguaagcaagcacacaaauguauuccccauccccuaagugcuuguccauagcagaacgggcaaggguuaggcagcagauuggaauggcauaaacauugccucuccuuguuuagccacuguccuucaucagaagacaacugcuccuaacaggccaccaggcggauggaaaguggcaccuccaauuuggagagagaggcucaacugcccuucucgggacaguggggaaaaaaaucacuuggaacaagcagcgggucugccugccuucccuaauguuggccucuggguuaaaagacggaaauaaugaaagggugcuuacccccgauccucaaaaaaacaggauccuaguuuagaacuggguaguaggugcagugaccacaucuuuugcaacaaaaauuaagacacauaauuaguguccuuccagggcagggguuagcaaaccaugguccucaagccaaauccaguccuacugcuugcuuuuuugucaauaaaguuuuauuggaacacagccugcucacccauuuauagauuacguauagcucauucguuuacauauguauugucccuagcugcuuucuuuuuuuuuucuuuuuuggcuacaacagcaaaguucagcaguugcaagaaagaucuaugacccauaaagcccaaaauauuuacuauuugucgacucauauucuagggcaagaguaaaaaccacagcugucccaggaaauuuggaaggucaccagaguugaaugagaacaccccaauaaggcucguguuggggcaaggacccccccauuauaguucugcuccugacccugagaaaugggcucaccucgccagacacagagcugcccaacacccacaggcccccaggugaagccagagaaaggcaagccaccugguacuguauuauccaggccaggguggccccuaaguacugcucaugaagggacaggccuggggggcugggagggguuguccaaugccaacuuucuguacagcucuccucccuccuccugucgcuucaggaggcucacagccuaacugcagacacccgcauuccccuccacguuguugguccacggcuugggcuugggcugauauaaaaucauccaccaucuaaucauuccuucaucccuccacuuucucagccuccuuuacaagaacccccuugcaaggcaagcacugacguggguguggggucaggggguggucaggggagacacagaggcagacagggacgcacgcugcugccuccaccccaugccccacauagagucccuucugacugcagggcguugguggccuccuggugagccacauacgcuggccugucugccccggcagagaggucugagcucaccauggcccucacacaggucuguacccacagccucuggaugucccagugggucaugccuuguaagaaagggaguuuccagggcucaacuugccuucuaggcuaaggacuucaaguucccuugaaaguugcucccagacuacugggguuuuucuuugaacuguuuaaaaauuauacauucuugugcuaauaacauaaacaagagcuuguugaaagcaggcacugaaucccauacugcuaauuuuuucuuaaaaaaaaaagcaagcaacuaggcacugacauucucccccaugaaugaaaccaguuucacagauguuuucauuuugugagcagcagaaccagcccaccaugccaaugauaacuacagcugcuuuugcuggguuuaguauaugccaggcucugggcucaguguucuacuuagcacaaagauguauuaacucaaucauuuucaaaagguaaauuaugcccauuuuacagaugagggugcuaaggcacagagugguuaaguaauuugcccgaagucacacagcuuuuaagaaguaaagcugggaccuggauccaucauggcucaggagcuaggcaaccuguuuaacagguaagaggagaaaaagagcaaaacaguguguuuuugaugucccaggcugcaaaccuccauucuccauccauuggaagauuaagauauucuuaggauucccugggugaguugcccuguggugagcacuggguugggagcugggcaggguugggggugauauaaaagcagcagaaggcaaaguuccagccucugaugauaguccagagaaggacccaacacugugagcgaaccugcaugggcucagagcuccaaccacaggcaggcaacagagggucccaagcagccucucccacucugugaguugauauagccgaugacacacaaggcuuuuaaaggccaaccagccaagcgcaagguccugauggcaauuuaguuuucugacuaaaaaccuagugaaguuuacugcuuaaaacauuuaaauuaaaauauuuggcucaggaagugauacuggugacaugguuaagaugcucugagguuaggugaucuggguucacaucaugacucugccacugacuugcuagugugaccuaaaucaagucaugugagcuuaucuuugugccucaguuuccucaucuguucuugaaaggacuggauaaauccauguaacagcauucaggacauauaguaggugcuuaaaaaccauuagcuaaugccauuauuauuaguaguaguauugcaagcacacagacauucuggaaugaaguucagacuuggugagaccaacgguuagggugaaugggaucagucuggauaacccgcaguuguuccugccaggcacagucucauaccugaguugggaggaaggcugggcuggggaggaccagugugguuuauuuagugcugugguaugaggcaucauucaggagaggcaguccaaagugcuggcagccugcuucgaaaccagggacacaaauguccacugguauuccuuaccacuucaccuuaaaggagaaaacagcaugggaggcuuuuguccagguacauucagggagaggcaguugggaagaaaaccccucuaacucccacaagcuccccagcuccgagccauggaacacucuccugccagauuccucucccuauaaaaaaacccacguucaucaugccaacgcguugcucaaauggcuccucuaccuguagacauguauguagacauauauauaaaacccaaacuccugcgccugaagucccaggcaucgaaaucaggcccccggccuccuuuccagccuccagcuacgcgcgagccaugugagcgcacuccacucugcagguccuacuuucucaggcaggcccgcucgccccuucaucucuguacgucugaaaacccacccauuagccaagggugagggccuuggggccuuggggcugggaaucagcucugcccugaccagcugggcugcuccaggcauauucucgaaccaucucugaccuguuuccucuccucgaaaugaugguauaaguuauuauauuguccaauauaaauggagggguggguggauauacuuugaaauguguuaaagcaccauauaaauucaagaacguauuccuauucaggcccuugauucccagcucuuccauauuuacguucuccugacagcugaucuaacuugcuggucagauuccuacauuguaaguuacucuucuucuugcacauggaccucucuucucuucaaacuauaagcuccuugugggaggcucuugucucagacaacucugacucuucccacuccacccacacacacagagugauccacccacacaaauuacaagcgcaagcguugacugaauucacgaaccacugccacccaggaagguaauuaaggauccuaaaguugagguugaaggguuucuuucaacguuucuuucagacgcuuacaggguugucuuuaaaucuggccaaaauacuguggguggcugugguaggcugaauaauggugucucaaagauacccauaccacaauccccagaaccugugaauguuaccugcaaaugggacuuugcagauaugaugaagucagggauccugagaugggggauuauccaggugggcccaauguaaucacaagggcccauauaagagggaggcaggcagggcagagucagaacgaggugaugggagacagaagugaggcuggagugaugccauugugaggaagaggccacaagccaaggaaugcaggcagccucuaggcuggaaaaggcaaggggucggguccugcccuugagccuccagaaaugaaccagcccagcugauaccuugauucuagccuagugagaccaauuucagacuucuaaccuccagaacuguaagaucauacauuuaugaugcuuugagccacaaacuuugugguaauuuaucacaacagccauaggaaauuaaagcagauccuuggguuggggagaggggcuguauucuagaauaauuuccagaccauucuucuaaauuaacuuuggucacuccacaaauacuacugaaugccaaccaagugcgaggcaccaagcugggugguagacuaccccacagacagcucagugcauuccuguucuuaaugacggaguccuguugacuuucucuauauugggcccauacuacaugccaggcagauagauauauauauauauauauuuuuuugagacagggucuuacuguugccuagguuggaauucaguggcaugaucacagcucacugcagccucaaccuccccaggcacaggugauuauccugaguagcuaggacuacagguggguaccaccacaccuggcuaauuuguuuguauuuuuaguagagacaggguuucaccauguugcucaggcuggucucgaacccccgaccucaagugaucugcccaccucggccucccaaagugcugggauuauaggugugagucaccgugccuggccucgguuuuauauucuuaaucuuucaaaacacuuuuacuucagguuuaauaucucaaugaaauaggaauaauaacaagaacagcuaccauuuauuauuccccucugucugccugucacuuuauauuaccucuaguucuuacaaagaccuggugagguauuauccccacucauugauaggauaauuaaagcucaucaaggcugagcaaucuccuaagggccaaagcugugggaugcuggacccuuccacaccugucugacucaggcuccaguccuuucuucuuacugccuaggaagcugagagauagcagagaagaacacugccccaaaucaauaacuccuuuuuuguuaaaucaauagucacucaauaugagacaucagcaagguuuacauccugaaaugugucuuccugguuacagaaaauugagucauaaaaauucuggggccagcugggcucucaaaggccaucuggccaaacucccugcucuggaaaguuugucagcugccaggacugaggguaucacaauucucagcaccagugauccuacccacuagaggcaaagcuugguuccagagccaguuugaucuuaaacauaaauaguggaaagaggcagacgcccuacacugaagacugccucugggugugcaagagcuaggaggagccaucgggcacacggcccucagucuugccacacucaacaccagcaccaaccuuuauuagcaucaccuccaaaugccacacacaggccagguguggacaugcacacaucacugguauggaaguuaaauaaacauguucugcccugaggucacacacaacccuuaggcacuacauguguauguaaaaccucgauagcuuuuaaaaucacccaguuaacccagacaaggggcaauccuagacagacaacaaccacacacgcaacgagaaaugagaagaggcucagcagggugcaaggggaccacagacccaggagagguggccaucuccuugcugaucuccacucucccuggucuggccuggccagcaaggcccuucacuguggagccccagacaccucugcagcgauaccucucgcuagaugccuccgugccccaacgcuucagccagaauggacccccggccccgcccaacacccacacagguuuuccagcuuccacauccugcucccuccuccccauggaauaucauuuccccugcuggaaucuuggccacccugcuggacugguaaaccccuccauaggcaagucaucuccuuuccucuaaacucccucaucucuuaauggccuaaggucaccucgccaugcccuguaugacucugugugugccugucccauuucccuuacugcaagguaagcuccggagggaggggcccucucuuucccaguucuguacccccaacggggucuggcacuguccucauacacacgaguuuauuagcauuaugagucagugaggcaggacccaggcacccaggcuccguggcuuccugagcucccucaucgagagcccaggacugaagagaccaccgaggaggcugagcaccaggggaaccugaauccccaacaugcacagccacagaaauggcagcagcacccuguucaaaaagugauuuuuacaggagcaaaagccagaugaguuuccaagccagcuucauaaucccgcucauggugggcacacagacccagggagggagcaggggacgcagucacugcuacugcuuccucugcgucacccccgucccugucuaagacugagggaaaagaggaggggcugaagccagcaggcagcuguuccucagcaggccaaucagcccuggcccaugaaccgugagcaccaagcagguguaaacagcagcuacaacaggcaucgcggcagcacaauguccaacccuugaccacaugcuggcuguaaacaccuuagggagcaagagccacaggauuuuuucaaucucgggaagauuagagauguuugcucaagcacgugucaaacaguaaccaccuucagcuuaccgggcaaucgacucuuacuuuuacccuccucugagccaguaucagugccaaacaaaaaaugugccaagcacagaacaaacacugggcuggggcccaggcucugagcuugaacuuuaacauuucuuuucauguggacuguccccaggaccccucauccagccccgugaacagcagggacuugccaccagguccuccaguucccagaugacaccgcauauauugugaugagggccgacggggaggaccaacagcaaggccaccaagcgcgggugaccucaggcacaccgcuucuccucuuggggccugcguuuucucauuuccucauguguaagugaggcgacugaccuggaggaggucuaguucccagagauuaggaaagggccaugcaucccuggagugcagaaagucagcaaggagagcacacacagggcuguucugaaagcugggauguaacggggucuagaaagaguaaugcucaaaacaacgcagauacugauccuucuagagauucuaugaaauagugagagguaagaggcagaccaacccugcugucuucagaaaggcagagaggggcgcuacagccucucugucucucaggaaacacaccucugggaaauggaaaauuccaguggacggugcagagguagggagagauaagggacugggcuuuuccaaaugacccggaaacaccuaccuuccugccucccuucuacacauacacacacacucucucucucucacucucucucucucacucucucucucucacucucucucucucucucucucucucucucucucucucucucucucucucucucucucaggguacaacuccucaaaggaugcugaggcaccuaaggcucuucaagcccccaccccuggcccucucacauuaaacagaaggccucgaccccucuuuagcggaccuuuguuacuccagaaaugggggcaaccagauaggagggcccgcacauucuuggccacaucucucagacccuuccccugccucuguccaaucuccucccacacugaccaucccuccuccuucccgcaacaagaccuugccccugaccuauuuuuuucuuuugccuucaaucauaaaagcccuccccugaagcccacaagcccacucucugcucuccuguaccaaacauuuaaauaaaccucccauaggcucugcuucuccuccacccucuggacauggcuaccaucucccaaggauggagugcacuugccaucuucccugcucccucggcacacacuuucuggccccaaccccaagcugccccucugugacaccugagggcucaagccagugggucuccucagccacccccugccccacaguguucccugcuggccccacacucuucccagaagcccucccuccucccuccucucuggccucaccuccucagcuuccucccccagcuccucuuucuccaccuacuccaaggccugggaguucccaggcugguccucgacaccccugccucccugccaucugcacuggcuccuggggugccagagccccuccacaggcucugcacugaugccuccccacacucaggccaggcaggaccucucaacaaccgaacccauuuccagaacaaaccaaguuacacacacacauaccgcaucaccacuucaaagacccacaggcaacuggaaaggggugcagggaaauuucggagggugaugaaauuguucuauagcuugauugugguagggguuaugugacuaugugcguuugucaaacugcgcagaacugcacacuaagaaggaugaauuuaccguaugcaaauuauaucaaacaggauggaaagaagucccauaggcucccaucaugucuaaaacuaagaugaccaccuucucccaaaccagcucuuccuccaucaaccagcuccucccccugauuagaaaucucagccauauauccagucagguagucagucuagaaauuccaccugcauaaauuucuuugaauccaugccuucaguucuaucuccccuuggggacucgggccauccucacuucucacaaaccaccuccguggggcucccaccccuccauaugugcaacuccagaaagagcaggacccucgaacucacucacucccaccagcucuccuuuccacuggcucucccgaguuccuggcuguugcuuaacaggaaugacagaaguaucuccagaugccacugucaaaucaagacaacucucugucuaaauauuccugucuaauuuugcacacagcucuuguuucaacggacaaagauaaugacucaguguccaugguucuuacuggaaaauuauccugccaaguuuugagcuucccaauaauagccuucuuuaaaauucucuuugagaaaggagaagugaccuuccuuccugauccuuuucuacaggcaacaaagggcacccaaaagauccccuaacugaccaaggaguguuacaggaaaauccugauacauccccacaggaucaaaacagcaagaaaaagaaacucacugaauaggcuuaggaugguuuuccuugcccugugcaagaaaucccuguuuuucaguuuuucugcgugccaaucaguuugggacuuagaaauuuggggcauaaauucuggauuacacugaaggcaaaauuuagacucagaaguaaagcaucuuucuccacacacacguaaauaugucucuuuggugagcaggcugaccaaaggagaaaagaaaaagaaaagguucacugaccuugacacugaugcuucaagcaacuacaaaagaacuccacaaaucauacccauguccacgcugcuguguaaaaauacacauacguauguuugaaaugcacccagccacucacucccugaagaugcaggcccagccccucccacaucacaagacacagagcugucugagcaaaaagugaggaugaauaaagcaucuccuugaagaaccacuuguggauagcugaguuagccuuugugccagcacucagcuuaagcauguuuccuauuuuaaaacuggcccauaguuauucaugugcaaauccccuagucuugcaguauccccgagaagcuaccagucuucuaauucuccagcacccccaacccagccagucacugccacacauuuagcaggcacaguacaugcccaugggugucuaccuccuaacuuucugcuugcagguuuugccucugcccuccuaggugcacagguagcccaaucuacauggcuuuuaccacuggguuagggcaggaggcauaacacuacccuuugccuaaaccucucaccuacucacgggcaggucccagagggaccccuggcagcacaggacaacucuuuuuagaguuuuaccucagugguucucaaucaagggagauuuugcccuccaggggacacguggcaaugucuggaaacacuuuugauggucacaacggcuagaagggguggggagcggugcuagucuaguagacagaagccagggauacugcuacacauccuacaauguauaggccaggucucccacaacgaagaauuauggguccaaaaugucauuaguccacagguugaaaaacuuugucuuagauaacacacuggcucugagggaggugcccauucugccugguucacuuuuccuuugaguugcucaacauuaggccccaaaucauuacgauucugcauaguccgcaccauuugcaaggcugaacaaaacacucuaagccauugccugagccuuuuuuuuuuuuuuuugagauugagucucgcucuguugcccagaggggagugcacuggcgccaucuuggcucacugcaaccucugccucccagguucaagcaauucucccaccucagccuccugaguagcugggauuauaggcgcccgccaccacauccggcuaauuuucguauuuuuuuuuuuucgguagagacgggguuucaccauuuuggccaggcuggucucgaacuccugaccuacggugauccacccgccucggacucccaaagugcugggauuacaggcgugagccaccgcacccagccgccugagucuuacagaugcugcuccuguagcuccccuuuugucucuccucgggagaaaggccuuccuccaaaagaagagucucccaagagcccuccugccaggaugaccuacccauccacagcgugacaacuggcaggcuggcaucaaggaauguucaaauccuuuggcaaucagguaggccuggcaugaccagcuacucaauccugucacguagauccaaggcccaagugaacgugcacaaguuuuucaacaggcuguaggcccgacucaggcuggaagacugcacacaagccucucacccuucaggaaccugacaucucucacccaaauggggagucccaacacccaaaccugccccugcagcacuccccaucgcccaaagaggguuuggcagaggggcuguuaccucugugcaaugggugagaaugagccucggaaagguucgaguuuaggggaguaagcccaaaccacucacaagaccccccagaguuuggagaagaggaaaggccaaagaaaagcgaaaggaagaaaggaucaaaaaggauccccugucccaaguucacacaaaauucccaccugcgaagcccaacagcuggcuccagccaaggaagucaaaguucucacccaaaccugcagccagcggcaacgagccuagagccccagacacacagugcaagggggucugggagugaagaacaacauuauuagaaagcgaagcaucaaagcuguauuggcgaccaaagggcaugggcaacgggcauucggcagcgggaaggcggucgggcaagcagcgggcguguuccagggacccaaggcucugcacguggcccucgucuccuccccgaagcaggaacgaggggcugagguggacccagggacgugagacggcugcagaggacccacccugcaacugaggcgcccccacugcguccggaccugaggcucgcggccagcgaaacucgcggggaagcugcgcugucacaugaagagaaugcaagaagggcugagguggguguugaccccagcucuggccgcagccagacggcgccugggcacgcggcgggccggcggguggcagccuuaccuggcugcaggaagcugggauccgcggucaccuucuagccgccuccgcgcccgccucugcgcgcuggccaccgcgcugacgcccgccacgcgcuccggaucuguuuaccaacucgcccgcuccgggggagccccagcucacaagccccgccccgcgggccgcu

SEQ ID NO: 191167 - RNA, 16664 nt, Homo sapiens
gaguugcggcgccuggugucucagagaggcuugagguucggguagucggugacauggcggaggccgcggcgcugguguggauucgcggcccuggcuucgggugcaaggcggugcggugugccucgggucggugcaccguccgggauuuuauccaccggcacugccaagaucaggugaggauuucgguuccuguuaggaaggagaaagaggcagacagguggcagcgcugggugcggaguaggucuguccggggcggggguacguuuauucucugggguuuucacucguugaggcugagaguuccucaguguuaaggugcuucgaauuguuacugagaccuuccuuugcuuuucuuuugugguggugguuuugccuucccaccaagagggagaaaaaaacuguuacaggcacuuagucccgcucacaguuacaaauacuuuguuucucuuucuuuauccguaaauauaauggucuucuggcaguugggccggcugauuuuuaaggcuccagucuucaccuucuuacuaugguuaugugacguguauuuuguccacucaucacacagccuuguuagccccagccuagagaaguaugucauauccaaacccaggccaaaggaugauugggaaggaaaauugauucuucuggucagucguugugaccaagcauucacacguguguccuguugagggccuggguucuuagggccuguuacguagaaguguucacuauuaauuugauggucucauuuguccgugcauauuugugaaaaccuaccagggacuuccagaguuacacgugagcuuuuacugaacuuucaaguaaguaagcuuuuaccagcuauaagauauuaaaccuguucaguugucaaaagaauuuagugguuucccugaaucuaauuuuaauguuggcacuugaucuagaacucuguucuuuccgcaccucauccgugcuuuccucggcuauuuccucugcuuacuauuuauaagcuuaacaaauguuaacacugcagucuagaccaaaauuuuaagagacuuggaucgauuccgugaagaagcaauguguguuugcaaauaauacgguuuuucacuuuccauguuuuccuuccugcucuguaauccagucuaaaaacuguaagcacaacuguuuuugaccaugaaaauaauugcauucuaauuccuuugaaaauaauucuuauuucaugaguacaguguucuuuucucccccucccccacccccgacggaguuugacucccguugcccgggcuggagugcaauggcgugaucucggcccacugcaaccuccgccucgcugaguucaagcgguucuccugccucagccucccaaauagcugggauugcagucgcccgccaccaugccuggcuaauuuuuguauuuuuaguagagacgggguuucaccacguuggccaggucuugaacuccugaccucgggugauccgcccaccucagccucacaaagugcugggauuacaggcuugagccacuccucccggccuaugaguacaguuuucaaacuugcugacaauugauccaaagugaaaccagaaaaaauaggaucuuaaucaugagguauguuggaaaaaagaauuuuuaaaucggaagcaagaaauauaggccaggcgugguggcucacgccuguaauuccaacacuuagggaggucgaggcgggcagaucaccugaggucagaaguucgagaccagcuuggcaacauggugaaaccccaucucuccuaaaaauacacaaaaauuagccaggcguggcggcagacgccuguaaucccagcuacccaggaggcugaagcagaagaaucauuugaaccugagagguggagguugcagugagccgagauugagccauugcacuccaaacugggugacagagcaagacucggucugaaaaaguauauauaaagaaauauaaaugaguggauucagucagaaacuuaaggaacaugaccauagcaaauaugaauagaaacacaaaagaauauuaguugagauacuggaacaaguaagaauagcucaaguucacaccuauguuuuuaaaaacaaaacuauucugagacaugaugaaguuaguguuaacucccacugagaaaauaaaaaucugcccugcuuuucaucaggcugggauaacagacacagauaaagccagcugcaaaguuuuuguuuuuuguuuuuguuucccccacacuacaccgauguacagcugcagaguuaacaggaaauggugaugugucauaaugucauaacgacccccacgaaggucugcugcuuucuuauucacugagaaaccuuggucucaaaaaccauagaauauauaagaaauuuugcuguuuaaaguucucucaauaagagggaaccuucccacucuugccuuguagagaagcauucuugauuuccaacccaggucagagcuucccauuaaggguuucuggacacaacuuuccacauuuaucuuaaauuuguaguuuccaaggaaagaggagccuucacaauccagaucugauguugacguuuuuauauacaguccugcuuuauuuugaaccuuuuuaaacacugcuugauguaaauuucaccucaacuccacccuagccccaaaucuuguaaugacacuccuuucuuuggguuggugagauacccaugacuccuggugugcaguuccccucguugcagugaaucaguaaguuugacagguuuaucucugauagccuuaggcugguugugcuaaaacacacaugauaauuuguguuugaagcacuuuacaaugcacaaaugguuaaaagcaguuaaauugagucuaaauguuguauccuuuuuucugcuugugacuucauugacaagaaucuuaaguagaaaaugcaauuuuguugaucaguuguuuuguuuaauaagccauucuguuuggaaaugaaguauacaucauuuucaugguguauacuuucugccuucauauuaauaucuuuuaaaauuauuuagaaauaccauacccauuagacauacaaaaggcuucuaauguguaaacauuaaacagauacaaaauguauuacauaucucauuuaauguuuacaacagcucuuugagguagacaguauuuuaaagacaagaauagucguucauguuaccucauugcagauagccugagcucccuugcuccucucucccgccauuauauuugucugggagaaccccagacagcauaaauccaucucuccaccuguucugcccuggcaucugggcagugacugugauagagaacuauaaucacauagcucagucuccauacauccaccagccuggugcugcuugguaauucuguauuuccuugguccagagugggcuuuuacuggguuacaggacugcuuagaguauugauucauguaggcucuggggcagcuacacagaaucuggggcugcccagcaucuuaggcuaucuucagcaacuuugcucauuuuugcucauuuuucauguauuuaugucuccuaugguguacuuauauagguguauuaaaaaccacacucuugacuccuuccuucucuacuucuuauuccuaccugcacuuuuuaggauugaggacuacuuuugauguucaauuuaauuuuaccuguuuaagaaagucagaaaaugggaccuccacaguuauuuaaucugaguccugcauagucuucuaccuugacucagauuaccuaucagagaagaagaagcaguuuuuguugucaccgcaaagacugaaguuucuucuauaugugaugauuagguaauauugggaaaaaauuauacccaaaaugcaucaugugaaaugacuuuuucuccuaguaguuuacauuuucaauucaacaaauauuaauugaacacccucuguuguaaccagaguaauaaaaagacagcuaggucccuucuuguaacaaacuuagauuauuaucucauaaaaggcauuaaaaaaacaaauuugucucuagaauguuccaguggaaaacuucuuugugaaaugcaauggagcacucauuaacaccagugacacagugcagcauggagcuguuuauaguuuggaacccagacuuugcgguggaaaaggagguaggaccugaacauugacuacuuaguuguaacacauuugcagucuuuauucauuuauuuucauauucugcugcugacauuugcugucuuuagccaugguauuaaauuaacaaccuucuuagucucuuuaguaugccaauauuguuuuaccuuaugaauucuuuuauuuacuuaaccugauuuuggacauuuucucucuuauucuuuuguuuucuuucuuuugagacacugccuuguuuugucgcccaggcuggaguacagugguacgaucacggcucacugcagcuuugaccuccugaacucaagcaauacucccaccucaguuuccccaguagcugggacuauaggcacaugccaccaugcgcagcuaauuuuuguauuuuuuguagagaugggguuucgccauguugcccaggcugucuuuuauuuuggucgaggaagaaauauugugugauacaauucccacuuuguucagcuggauagcucuuagggaaccuaggcucuaaaacuuugggggaaaauuagaugaagagagauggccauuauucuguucaauuugcugaauaaagaguuuuuuuucuaaaucuccuucugcuuuaaucaggauuuugucucguuuuuguaguuccaaaggaagucuaaaguuaccuuaggaaacacaauuguuuauaaguugaggcagauuaagguuuuguuuguuuaacacaacuacuaggaaagauaacaaagagcgaaaacaauauaaacaguuguugguauuucuccuaauguaguaacaugugaucccuaagcuuucucaaaaucuacagugauuugguuugguuuucagagagcugacaucucagacuauauccagcuguuugaaauuguaugauuaagaaugaagcgugggcugggcacgguggcucacgccuguaaucccagcacuuugggaggccaaggcgggcggaucaccuaggucaggaguucgagaccaggcuagccaacauggcaaaaccccgucucuacuagagauauaaaaauuagccaggugugguguuaggagccuguaaucucagcuacuugggaggcugaggcaggagaaucacuugaaccuuggagguggaggcugcagugagccgagauugugccacugcacuacagccugggcgacacagugagacucucucaaaaaaaaaaaaaaagaaugaagcauguggccaggcaugguggcucaugccuguaaucccaacacuuugagaguccaaggugggaggacaguuugaacccaggaguuugagacuagccugggcaagauggugagaccuuggucucuacaaaaaaaaaaaaauagcuagcugcaucgguacacgccuguaauccuagcaacuugggaggcugugguaagaggauccauugagcccaggaguucaaggcugcagugagcuuugauuacaucaagccauugcccucuagccuggaugacagagcaaggccccaucucuuaggggggauaaaaagaaugaaugaaugaagcauguuauaucagccaguggagcuuaaaauugccuuuccuucuaaacucauugaaaaaucucacuauauacuuuuuaaguucuuaaucugagaaucuugggaucucugugauuguguaaagcuucuuuuuuuuuuuuuugagacagagccuggcucuguuucccaggcuggagugcaguggcacgagcucagcucacugcaagcucugccuccuggguucacgccauucuccugccucagccuccugaguagcugggacuacaggcgcccgccaccacgccuggcuaauuuuuuguauuuuuuaguagagacgggguuucacuguguuagccaggauggucuugaucuccugaccucaugaucugcccgccucagccucccaaagugcugggauuacaggcgugagccacugcaccuggccuggguaaagcuuuuuaaauauucuagcuguacagguauuauaccgguaugcaaauaacuaacacaaggauaaauaauuagguuugggaaggcuagguauuuuaucucagaacuauaaaaugaaaggugaaaggcaugagguuaaaucagucuuuuuacuuucgcugccugaauuagaaccuugauguucaucuuuucuuaaaaaaaaaaaaaaagaaagaaaguagagaucauuguuaaucuugugauacagauuguuuucacaaauucugcuuuuauccauccuugaacacauuuuaaccugcuuucuccaaauacaucugcucagguuuuggaucuaugcuccgagcacuuggugcucagauugagaagacaaccaaucgagaagcuugucgggaucucaguggaaggagacuacgcgaugucaaucaugaaaaagcguaagaugcccaccuuuuuuuguguuuuugaggagagacauauacuuuccuauuaguagugauuauacauaugccacgcauauuggaaauggaaacuuaaaauauuuacauccaaauuuauuaucagauuuaaccuuuuccauaauuuaauaaucaucuuugggauuaaguucaguaccauaugcuaguaguaagcauggcucaccuuucuaagagaauaucacaguaugaacaagugcauuaauucgucagagacauuuuauauauaaaaguguauauguaauauaucuauucaguuauaucucuuccucccucauccccagaauggcugaauggguaaaacaacaagccgagcgagaggcugaaaaggagcagaagcggcuggagcgacugcagcggaagcuuguagaacccaagcacugcuucaccagccccgacuaccagcagcagugccaugagauggcugagcgucuggaggauuccguccucaaaggugagaaugaggauuccuuaguguguucagcuggcaccccugaagccagcuguucagacugcucuacacuacgcacaaagagcaguucuuaagcuuuuuuuagguuacagaugucugagaaucugaugaaaaccuuggcacuuuuauccucaaaaaugaacacaguauuuuuuuaaaaaagaacacauauacaacauuuggcuuuuuuuuuuccccccaaaacggagucuuggucuguugcccagagcuggagugcaguggugugaucucggcucacugcaacgucugccuccuggguucgagcaauucucccgccuuagccuccagaguagcugggauuacaggcacacgccaccacgccuggcuaauuuucauauuuuuaguacagucaggguuucaccauguuggccaggcuggucucaaacuccuaaccucgugcuugggauuacaggcaugagcccagccaacauuuggcauauuuaaccccugaauuccauggggccaugggccccagguaagaaaauuuuuuguuuguguuuagggauaagcuaagucuucagaagaugucuagaccucaaagaauuugcugccaguuuuaagucaguuuuuaaugugaaugauucucauuaacuuuuguuuuuagcauccaaaacauggcaggccuaguaugggaacaaucgaauaagaaacaaucuuuuugcaucaaaaagguuaugacauaacaggaaaaagacaaguguaugcaaauaacuaacgcagggauaaauaauuagguuuggggagggcuggguaugaacuugucagucucaagguuacaaauugugcaguggugcuuuaaaaaaucugcuccuagacuagaauguuuaucauuuuaaaucuguguaaauuugagauuaacuguauaaaauguugguaucuuaagaaauuuaaaucuggagcuguagauugcagcucuuuuugcaauccauguuauuuaugauuucuuuaaacuuagucccuauaguagaaacugaguuguuaaaauuucugguuagguaugcaggcugccuccagcaagaugguuucagcagaaaucagugagaaucggaaacggcaauggccuacuaaaucucaaacagacagaggagccagugcgggaaagaggagaugcuucugguaaguguuucacuuucguucccaauugaucuuugaggacugacuugagacauuuccuccuuguuuaucuggcauaaacacauuuuuguguaguguuuggugggagcucagaaaauuuccagagugcuucaagcuuuagguuucagugauugucacauuguacugguaaugguuucugcugugaaugccauuaauugaauguaaaggaugaauuuuuuccuuacacugaaacauaaaaauagcuuuauauuugaauuacuuuuuugguguugaagggguuuaacuuuuagaaauucuagguggaaaucaagcuguacuuuccaggugguugucugugguuuuucacagucaucauugaggucuuuggucacuuugccagacuucucuucaccacuuucgcacuugaggguaaaaagcacagcaguacuuuuucuuguccauuuuucugauaguucucuugucccucuaguugguccucuuguugccagugacuucccuugggccaaguucuugaaaauaaguuuauccccuuuggggauaaacagauaauuauuaaucaaagaucauauaacacuaugaguucagcauacaauguuuguucuuucugaaaugggaauuaaguguuccugagagaaaggguggugacacuaccugugguuuguauuuuuuuaaugagguuuauugagguauaauuuauauauagcaaaauucacccuuuuugguugauugguucuacgacuuuugaaaaauguauauguacuauauagucacguuaccaucaccacaaucuagauagaguguauuuuaaugaccugaaauaguucccacgugcccuuuugcaguuaagucccuuuuccccaccucuagacccuggcaaccauuggucaccagugugauauuuguuacuaugauuuagucuuuucuaggaugucauauagccuuuagugucuggcuucucucacuuaauauaaagcuuuagagauucauccaugguaguguauguaucaguaguucauucuuuuuuaucacuccguaucguuucauggugugaauguaccacaguuuguuuauccagucuccauuugguagacauuuggguaauuucuggguuugaguaauuauuaauaaagcauggguguuuuuuuuguguguguuuuuuuuuuuuuugagacagguuccucacucuguugcugagguuggagugcaguggcgcgaucucggcucacugaagccuugaccucccagguuuaagcuaucuucccaucucagccuccugaguagcuggggcuaggguacauaccaccaugcccagcugauuuuuuuuauuuuuuugugaagacaggguuuugccauguugccuaggcuggucucaaacuccugagcaggugauccucgcgccucagccucgcaaagugcugggauuauaggcgugagccaccgcguccagcccaagcauaggauuuauaaauguguguguguguguauuaauauuuauuauugggaaacaccucuguaaaacagaauaauuguuccuaggauuuucuuuauauauuuuuucaccaaucaaaucaaggggcggcaccgaauaauuuuccuucuuuuuuuuuuuuuuuugagacagaaucuugcucugucgcccaagcuggagugcaauggcacaaucucggcuuacugcaaccucugccucccagauucaagcaauucuccugccucagccuccccaguaguuggaacuacagccaugugccaccacacccggcuaauuuuuguauuuuuaguagagaugguguuucaccauguuggccaggcuagucuugaacuccuaaccucaagugauccacccaccucaaccucccaaagugcugggauuacaggcguuagccaccaugcccggauggauuuucuuuauaacuauuuauuauuauuauuauuauuuuuuuuuuuuuuuugagacagucuugcucugucccccaggcuggagugcaguggugcgaugauggcuuacuguaaccucugccuccugguucaagugauucuccugccucagccucucgaguagcagggacuacaggcaccugccaccaggccuggcuaauuuuuguauuuuuaguagagacgggauuucaccauauuggccaggcugaucuugaacuccugaccuugugauccacccaccucggccucccaaugugcugggauuacaggcaugagccaccacgcccggccaacuauuuauuauuuuaucuaauuuccaaccgucgaagguaauguaaugcgggggaagaaagcuuuaagcaaaaucaauuuugcuuuuagagauucaggacuuuagaaaggagauccucuuggaucuuugggacaguuggucccagucucauugaaauguuuuuuccuucuguuuauaagcucuagaauaucuuuuuccgaaauuugccuguucuccaucucaagcuagcagaaacagauucuguuuccugaacaaacuauaacucuuugcuuuauuuauuuauuuuugagacggagucucacucugucacccaggcuggaguacaauggcgcgaucucgucucaccgcaaccucugccccccagguucaggugauucuccugccucagccuccugaguagcugggacuauaggugcaugccaccacaucuggcuaauuuuuguauuuuuaguagagaugggguuucacuguguuggccaggcugaucucaaacuacugacuucgugaucugccugccuuggccucccaaaguccugggauuacaggccugagccacugcgcccagccaacucuuugcuuuaaauagaagcuacaaacgcuguuaaaccuuucuguugcuucugacagguugggcauggagggacuagagacugcagaaggguccaacucugagaguucagaugaugacagugaagaagcaccaagcacuucaggaauggguuuccaugcuccaaaaauugguagcaauggugucgagauggcagccaaauuucccagugguucucagagggcgagaguagugaauacagaccauggaucaccagaacaacugcagaucccggugacugacucugggaggcauauuuuagaagacucaugugcugagcugggggaguccaaagagcacauggaaagcaggaugguuacagaaacagaagagacccaggagaagaaggcagagaguaaagaacccauagaagaggagcccacuggggcuggacugaauaaggauaaagagacagaagaaaggacugauggggaaagaguugcugagguagcaccugaagaaagggaaaacguugccguugccaaacugcaggaaagccagccaggaaacgcaguaaguauguuuugggguugauaccuagagccaaaucaguuuaaucuccacaauaagucauuaaaaugaaaaugugcuuuugccccucagcugcuuagugaaaggcuuauuugauuuuaagaaguacagauuauggugaagcuugccuuauuccccaaaaacuuuuuaaguucuggcauuuauacuauguugccacuaggugguguccuugauuccauauugcaucaauuguaagaugcauguuuuccacauuuuagcaugucuaaaaugagauguguauaacauauuauaacuuaauugguauuguuuauucuuaguaauacaugaaugaggguauauuaugauagauggcauuuuagauuugaugaaaugugcucauuuuucccgucacuaaauugcuacucagcuuuuucuaaugugaggauagcuugaacaauaguuucagcugaaugugaagaccucuucuauagaagaggaaccuccuuuuaaauuuaucauuaaaucuuaaguacccacagucagccuuuuaaaaaaggcaucuucagccaggugcgguggcucacgccuguaaucccagcacuuugggaagcugaggugggcagaucaccugaggucaggagcuugacaccagccuggccagcauggugaaacccugucucuauuaaaaauacaacaacaacaaaaauuagccgggcaugguggugcacgccuguaaucccagcuacucaggagguugagccacgagaauggcuugugcccugggagguggagguugcagugagaugagauuguaccacuguacuccagccugggcgacagagugagacuccaucucaaaaaauaauaauaaaaaggcauuuucauaguacauucucucaaaaaguugguuuuucacuaucuacaauggacuggcuuccagcaaaaaucucugugcuuugaucuaaugguuugcuuuuuagaauaggugaaaccuaaacuacuuaauuuccuucgauaaacacaaaaccuaccauuuguuuagccagcaccuuccccugcccccaguaaguaaguaaaaaugcauaaauugcccuuucuggugagacuauuggaauuuuuuuaugcuaagguccuuacaaucucugaauuuguaagcauguaauuuuuguguuauguguauacagguaagagcuuuauccugacugaagucuuagaaaaauaaaaaaggaaucauaggauaaaaccugauauuuuucaguguuagccauggaguuuuguucuugauguuguaguaauagcuguuguauuccuaacaaccaagugugauucuuuaaacacacauaaguggcauuuuagaauuuggucauaaauaagccaagguuaacucccagaaaucuaacaaaacagcuuuuuuaagaaaacaaagaucaacuagaaagauagaguaugucuccagagcucuuuaauauuuuaaaacugugaaaguuauucuuugaauauaaaaaaucacucaaagauagacauuuucauucuuuucaagguaucauuagcaguauuuaauuuugucuuuuuuuuuuuuuuaaugacagagucucacucuguugcucaggcuggagugcaguggugugauuucugcucuaccucccagguucaagugauucuccugccucagucucccaaguagcugagacuacaggcacgcugagacuacaggcacgcaccaccacacccggcuaauuuuuguauuuuuaguagagacgggguuucaccauguugaccaagcugguuucggacuccuaaucucaaguguuccgccugccuccaccucccaaagggcugggauuacaggcuaauuuugucuuaaagucuauaaaggcacuugguggguagaacaguugcaagucuauugaacagcauuugaguuuguugaguuauauaagggagaggucugacaauuaguuuuaauuacucaauuagaauagaaagcauuaagauuauggaauuaguagauucagaggcaugggauucucauuaagcuuuuaggagugccugcucuuucugugggaauaguguggggauaggcuggcuauauuuuacuguuuagauguuuacuagaaaaaucggaaaagaaagcaauauuaaaaaucuguuugggaaugcuauacuucuguuacuguucugaaugcuuguuucuaaauguauagaugaaaaauuaguuauuauguguguugagaauacuuauggaauaacauguggauggaugaugauuaaaauucaguugcaagguauggcaaauuaaaugaaaauuucucaagaaauguaguugacaguuaaagagucuuuauucagaggaaggagccuguuuuaaauauuuucuuauuuuuuucccucagguuauugauaaggaaacuauagauuuauuggcguucaccucuguugcagaacuggaguugcuggguuuggagaagcucaaaugugaacugauggcccuuggacugaaaugugggggcacucugcaggagcgggcagcaagacucuucucugucagaggacuggcaaaggagcaaauugacccggcuuuauuugccaagccuuugaaagggaagaaaaaaugaguaucaucagagcugauuccuauuuguuuauagugucuaccauuuacaaccugcauaauguggacucuugaccaguauuccuguugauauuaaaagcuaacuuuuuaguaacccaauucuaacuauccccuuuuuccuugucagggcuguagaauuaaugucugaaaccaucugggccuuaaauuuucuuugucugguuuucuauaguguauuuaauaaauauagggcuauucacauuuuuugguuugaucuuggugucauuuagguaaugaaucuauccaagaaaucuauccuuuugacccagguuaucaaauuuguagacauaagguuauuuauaauggucccuucuuacccuuuuaaugucuuuaggagcuguguugauaauuuccuuuucauuaugauacugguaauuucuguucucacuuuccuaaucagguuggguagggguuuaucaguuuuacugaucugacuuuuuauuuuauuuuauuuuuuuugagacagucuuacacugucucccaggcuggagugcaguggcgcgaucucggcuuacugcaagcucugccuuccggguucaugccauucuccugccucagccuccccaguagcugggacuacaggcucccaccaccacgcccggcuaauuuuuuauauuuuuaguggagacuggguuucacuguguuagccaggauggucucgaucucuuuaccucgugguccacccgccucagccucccagagugcugggauuacaggcgugagccaccgugccuggccgacgauauaacuuuuaaagaaccaaccuuugguuuuauuuuucucaauuguuuauauaauuaauuucuguuauuuucuuucuucuauuuagcuugagucuccuuugaucuuuuuucuuuaguuccuuaagauaagccuuaggucauugaucuuagacguuauuuaaaauacauauuuaaagcuauacauuuucuuuuaagcauuacuuuaguugcgacuuuacaauuuuauuaugucguauuuuuauuauucaguucuaauuuucuuuuuuuuuucuuuuugagauggaauuucgcuuuuguugcccaggcuagagugcaaugguacgaucucagcucacugcaaccucugccuccuggguucaagcgauucuccugccucagccuccucaguagcugggauuacaggcuccagccaccauaccuggcugauuuuuguauuuuuaguagagaugggguuucaccacauuggccaggcuggucucgaacuccugaccucaggugauccacccacuuuggccucccaaagugcugggauuacaggugugagccaccaugcccagccucugauuauuuucuaauuuccucccucaguucuucuuugacccauggauuaucagaaguggguugucugaucagcaaacauuuguuuuuuuuccucuuaauaucuucuuguugcugauuucuacuuuaauuccauugaggucagaaaauauccucuuuaugauuucaauccucuuaguuuuauugagacucguuuuaugacccaauauguugucugucauggugaguguaccauacacaguuuaaaagaaugcguauuuuaggccaggugugguggcucaugccuguaauccagcaugagauuacaugcugagauuacagcuguaaucuguaauuugagaggcugaggugggaggaucauuucgagaccagccugggcaauguauagugagaccaugucucuaagaaaaacaauauguaauuugaauuguuggguuaauauguuuuguaauaucgaugagauuaagugguugauaguauuguucagaucuucuaugucuuuacugauccuuuuguuuauuucuaucaggugcugagaaaggauguuaaaaucuucaauuaugauuguggaauugucuauuucuuaaauucuaccaguuuuuguaugaagcucuaauaacuuaugucuuccuaauguauugaccauuuuaucauuaugaaauuucccucugucucugguaauuuggguuugaaaucuacuuuaucuuaugugaauauagccacugcagccuucuuaagcuuaguguuugcacaguauaccucuuucuauuaauuuacuuugugcuucugugccuauuuaaaguaguuucuuuaaacaacauauacuugagacuugcauuuuuaucuguucucucuguaucuuuuaauaaguuuaacauuaaauguaauuauuaauagguuucuaauuuacauguuuccuguuuagauaagauuauuuuauaauuguauuuuaauuuauuggcucuuuagcuauacuguuuuaauaauuuuuuuaaguuggauguucuagugauuacaauauacauucuuaauuuuucagucuaccuagaguugaugugccacuucacauaaaauguagaaaucuuguaaguauguacauccauuuaucauaccugucuuuuaugcuguaguugucauacauauuaaaucuacauauuuaaauauuguaaguccugucauaaguuacaauuucugcuuuaaauaaugauauguauuuuaaagaaauuaagaggaaaaaauaaaaucuuuuguauuuauucacaua

SEQ ID NO: 191168 - RNA, 4786 nt, Homo sapiens
guccuuucuagacagcccccuccuccaggcucagggaccugucuggcugugagcucccaggaggucccaggggugugaccucccucccucccucccucccucuucccuucaccccaggccagcccagggccagcuauaaagcuggcccagccuggcucucagcacacccagcugccugagacccuccuucaaccucccuagaggacagccccacucugccuccugcucccccagggcagcaccauguggccccuguggcucugcugggcacucugggugcugccccuggcuggccccggggcggcccugaccgaggagcagcuccugggcagccugcugcggcagcugcagcucagcgaggugcccguacuggacagggccgacauggagaagcuggucauccccgcccacgugagggcccaguauguaguccugcugcggcgcagccacggggaccgcucccgcggaaagagguucagccagagcuuccgaggugagacccucccucccugcuggccccggucccauggucgggggcaggccgguugugcccacucuggaggugucgaagggccccuggccuuuugggacucugugggaggcugugugagggccacgguccaaggagcagugaggaggagccgggccuggguccagggucuccagcugugcacugaggccccccuccagcccaggggaggugcaccaggcuagaccugcuggaaaaaccaagacuucagagaaggggaggguagaggagagaaaguagagcugggggagcaggugagugugugccucaaggcacuuggugcagcuggacucccaggguauguuuucacacugccacucuggucugagccugaccuugaguaaauggcuuuaaaauccucucuccaccaugugcucaucuggaacagggguaugacuaugucuucgccaucucccagcacugugaacgucaaagugaguccuuguggauagaagcguguuuggauaacugaaaaauaccuaaguagacuaccuggguuauaccuggcugucaggggugcaacugggccugaauccuccugcagccucucgccucccuagcuccucagugcccagagcuagagccagugccaggcaccugggugaggauucugcucccagcaucucagcugaggcaaacuugcuagccagggucccacaggccccccugccugcuggauggaaauuguuacuaaacaaggcccagauccaaggaagauuuguaaacuggguuugccccagagauagaacagggccggugucuccuggccuggcugccagcucaguggcccugccauccucagagcuccgcuggaguccggggaggcccugcugacccugcucuuguccccagagguggccggcagguuccuggcgucggaggccagcacacaccugcugguguucggcauggagcagcggcugccgcccaacagcgagcuggugcaggccgugcugcggcucuuccaggagccgguccccaaggccgcgcugcacaggcacgggcggcuguccccgcgcagcgcccaggcccgggugaccgucgaguggcugcgcguccgcgacgacggcuccaaccgcaccucccucaucgacuccaggugggggucgcgcgggcgcgcagggcaggaguaggaggcugcucggcccggcuugggggcggggacgcagggggcggugcaggguccucggggcccgucccaguccccgcccucaagcggcgcugggucuccgugucguguguaucaugucucaggcugguguccguccacgagagcggcuggaaggccuucgacgugaccgaggccgugaacuucuggcagcagcugagccggccccggcagccgcugcugcuacaggugucggugcagagggagcaucugggcccgcuggcguccggcgcccacaagcugguccgcuuugccucgcagggggcgccagccgggcuuggggagccccagcuggagcugcacacccuggaccucagggacuauggguaggugcaggacugggcagaagggaggcaagcagccacugagugguccagacccccguccccaggacugucugggggaccggaugguggcggugggcuagggguagggagagcgcggugcagacugucccaggaugccagcgauugcccacuacaugucaggguuucuaauggcagaaauuguauuguuggccaggcgugguggcucagaccuguaauccuagcacuuugggaggccgaggcgggcuggaucacaagaucaggaguuugagaccagccugaccaacaugaugaaaccccgugucuaccaaaaauacaaaaauuagccgggcgugguggcgcgugccuguaaucccagcuacucaggaggcugaggcaggagaaucacuugaauccgggaggugaagguugcagugagcugagaucacaccacugcacuccauccagccuggaggacagagcgugauucugucucaaaaaaaaaaaaaaaaaaaggaaacaaagaaaagaaaagaaaaagaaauauuauauuauucaggccaggcgcaguggcucaugccuguaaucccaacacuuugggaagcugagguggaggauugcuuaaagccaggaguuugacaccagccucggccacacagugaaauccuauccuuaaaaaaauaaauaaaaaaaaaaaguuuuaaagaaacgacaaaaaaaaaauuguaaggccaaguaugguggcucacgccuguaaucccagcacuuugggaguggaggccagcgggucaccugaggucaggaauuccagaccagccuggccaacauggugaaaccccgucucuacuaaaaauauaaaaauuagcugggcgugguggcgggcgccuguaaucccagcuacuugggaggcuguggcaggagaauuguaugauuuauuuuauuuaaaaauaucuuugacaaucuucaauggauuuuucuauugccauugacuccauauacacgauuguaaucaucuacuuucacuuuacccuucuccaugauuaaaucuuugaaaaauccuagcuuuagcuguuacuaggggcgaugagcuuuccuccugcuuuggugaauucuuucucauggacaaguuagcucucuggagcagaugggggcuguguagcacagugguuaagaagaggccuuggagccgguuggccugggcuccaucuagcucugccuuccacuggcuguagguccucuggcccaucaccgaacaccucugggugucaguggccucagguggaauggggauaaugcuggaaccuaccugaggaugaaaugcagacaucaccugagauaauacaugugaaguaccuaguucauugucuggccuauuaggagaccuuuaauuaauaguagcugauuuauuauuuauguuucagauauguuuauucaucuucucacaaauauccagcuuuuagaacauagugagagcuggaucauaaaccucccucccaggugcccacuaagcugugccccaggccuucugacuucagccucccagaugaccucugacccugcucuccuugcccacacagagcucagggcgacugugacccugaagcaccaaugaccgagggcacccgcugcugccgccaggagauguacauugaccugcaggggaugaagugggccaagaacugggugcuggagcccccgggcuuccuggcuuacgagugugugggcaccugccagcagcccccggaggcccuggccuucaauuggccauuucuggggccgcgacaguguaucgccucggagacugccucgcugcccaugaucgucagcaucaaggagggaggcaggaccaggccccagguggucagccugcccaacaugagggugcagaagugcagcugugccucggauggggcgcucgugccaaggaggcuccagccauaggcgccugguguauccauugagcccucuaacugaacgugugcauagagguggucuuaauguaggucuuaacuuuauacuuagcaaguuacuccaucccaauuuagugcuccugugugaccuucgcccuguguccuuccauuuccugucuuucccguccaucacccauccuaagcacuuacgugaguaaauaaugcagcucagaugcugagcucuaguaggaaaugcuggcaugcugauuacaagauacagcugagcaaugcacacauuuucagcugggaguuucuguucucuggcaaauucuucacugagucuggaacaauaauacccuaugauuagaacuggggaaacagaacugaauugcuguguuauaugaggaauuaaaaccuucaaaucucuauuucccccaaauacugacccauucuggacuuuuguaaacauaccuaggccccuguuccccugagagggugcuaagaggaaggaugaagggcuucaggcugggggcaguggacagggaauugggauaccuggauucugguucugacagggccacaagcuaggaucucuaacaaacgcagaaggcuuuggcucgucauuuccucuuaaaaaggaggagcugggcuucagcucuaagaacuucauugcccuggggaucagacagccccuaccuaccccugcccacuccucuggagacugagccuugcccgugcauauuuaggucauuucccacacugucuuagagaacuugucaccagaaaccacauguauuugcauguuuuuuguuaauuuagcuaaagcaauugaauguagauacucagaagaaauaaaaaaugauguuucacucug

SEQ ID NO: 191169 - RNA, 4786 nt, Homo sapiens
cagagugaaacaucauuuuuuauuucuucugaguaucuacauucaauugcuuuagcuaaauuaacaaaaaacaugcaaauacaugugguuucuggugacaaguucucuaagacagugugggaaaugaccuaaauaugcacgggcaaggcucagucuccagaggagugggcagggguagguaggggcugucugauccccagggcaaugaaguucuuagagcugaagcccagcuccuccuuuuuaagaggaaaugacgagccaaagccuucugcguuuguuagagauccuagcuuguggcccugucagaaccagaauccagguaucccaauucccuguccacugcccccagccugaagcccuucauccuuccucuuagcacccucucaggggaacaggggccuagguauguuuacaaaaguccagaaugggucaguauuugggggaaauagagauuugaagguuuuaauuccucauauaacacagcaauucaguucuguuuccccaguucuaaucauaggguauuauuguuccagacucagugaagaauuugccagagaacagaaacucccagcugaaaaugugugcauugcucagcuguaucuuguaaucagcaugccagcauuuccuacuagagcucagcaucugagcugcauuauuuacucacguaagugcuuaggaugggugauggacgggaaagacaggaaauggaaggacacagggcgaaggucacacaggagcacuaaauugggauggaguaacuugcuaaguauaaaguuaagaccuacauuaagaccaccucuaugcacacguucaguuagagggcucaauggauacaccaggcgccuauggcuggagccuccuuggcacgagcgccccauccgaggcacagcugcacuucugcacccucauguugggcaggcugaccaccuggggccugguccugccucccuccuugaugcugacgaucaugggcagcgaggcagucuccgaggcgauacacugucgcggccccagaaauggccaauugaaggccagggccuccgggggcugcuggcaggugcccacacacucguaagccaggaagcccgggggcuccagcacccaguucuuggcccacuucauccccugcaggucaauguacaucuccuggcggcagcagcgggugcccucggucauuggugcuucagggucacagucgcccugagcucugugugggcaaggagagcagggucagaggucaucugggaggcugaagucagaaggccuggggcacagcuuagugggcaccugggagggagguuuaugauccagcucucacuauguucuaaaagcuggauauuugugagaagaugaauaaacauaucugaaacauaaauaauaaaucagcuacuauuaauuaaaggucuccuaauaggccagacaaugaacuagguacuucacauguauuaucucaggugaugucugcauuucauccucagguagguuccagcauuauccccauuccaccugaggccacugacacccagagguguucggugaugggccagaggaccuacagccaguggaaggcagagcuagauggagcccaggccaaccggcuccaaggccucuucuuaaccacugugcuacacagcccccaucugcuccagagagcuaacuuguccaugagaaagaauucaccaaagcaggaggaaagcucaucgccccuaguaacagcuaaagcuaggauuuuucaaagauuuaaucauggagaaggguaaagugaaaguagaugauuacaaucguguauauggagucaauggcaauagaaaaauccauugaagauugucaaagauauuuuuaaauaaaauaaaucauacaauucuccugccacagccucccaaguagcugggauuacaggcgcccgccaccacgcccagcuaauuuuuauauuuuuaguagagacgggguuucaccauguuggccaggcuggucuggaauuccugaccucaggugacccgcuggccuccacucccaaagugcugggauuacaggcgugagccaccauacuuggccuuacaauuuuuuuuuugucguuucuuuaaaacuuuuuuuuuuuauuuauuuuuuuaaggauaggauuucacuguguggccgaggcuggugucaaacuccuggcuuuaagcaauccuccaccucagcuucccaaaguguugggauuacaggcaugagccacugcgccuggccugaauaauauaauauuucuuuuucuuuucuuuucuuuguuuccuuuuuuuuuuuuuuuuuuugagacagaaucacgcucuguccuccaggcuggauggagugcaguggugugaucucagcucacugcaaccuucaccucccggauucaagugauucuccugccucagccuccugaguagcugggauuacaggcacgcgccaccacgcccggcuaauuuuuguauuuuugguagacacgggguuucaucauguuggucaggcuggucucaaacuccugaucuugugauccagcccgccucggccucccaaagugcuaggauuacaggucugagccaccacgccuggccaacaauacaauuucugccauuagaaacccugacauguagugggcaaucgcuggcauccugggacagucugcaccgcgcucucccuaccccuagcccaccgccaccauccggucccccagacaguccuggggacgggggucuggaccacucaguggcugcuugccucccuucugcccaguccugcaccuacccauagucccugagguccagggugugcagcuccagcuggggcuccccaagcccggcuggcgcccccugcgaggcaaagcggaccagcuugugggcgccggacgccagcgggcccagaugcucccucugcaccgacaccuguagcagcagcggcugccggggccggcucagcugcugccagaaguucacggccucggucacgucgaaggccuuccagccgcucucguggacggacaccagccugagacaugauacacacgacacggagacccagcgccgcuugagggcggggacugggacgggccccgaggacccugcaccgcccccugcguccccgcccccaagccgggccgagcagccuccuacuccugcccugcgcgcccgcgcgacccccaccuggagucgaugagggaggugcgguuggagccgucgucgcggacgcgcagccacucgacggucacccgggccugggcgcugcgcggggacagccgcccgugccugugcagcgcggccuuggggaccggcuccuggaagagccgcagcacggccugcaccagcucgcuguugggcggcagccgcugcuccaugccgaacaccagcaggugugugcuggccuccgacgccaggaaccugccggccaccucuggggacaagagcagggucagcagggccuccccggacuccagcggagcucugaggauggcagggccacugagcuggcagccaggccaggagacaccggcccuguucuaucucuggggcaaacccaguuuacaaaucuuccuuggaucugggccuuguuuaguaacaauuuccauccagcaggcaggggggccugugggacccuggcuagcaaguuugccucagcugagaugcugggagcagaauccucacccaggugccuggcacuggcucuagcucugggcacugaggagcuagggaggcgagaggcugcaggaggauucaggcccaguugcaccccugacagccagguauaacccagguagucuacuuagguauuuuucaguuauccaaacacgcuucuauccacaaggacucacuuugacguucacagugcugggagauggcgaagacauagucauaccccuguuccagaugagcacaugguggagagaggauuuuaaagccauuuacucaaggucaggcucagaccagaguggcagugugaaaacauacccugggaguccagcugcaccaagugccuugaggcacacacucaccugcucccccagcucuacuuucucuccucuacccuccccuucucugaagucuugguuuuuccagcaggucuagccuggugcaccuccccugggcuggaggggggccucagugcacagcuggagacccuggacccaggcccggcuccuccucacugcuccuuggaccguggcccucacacagccucccacagagucccaaaaggccaggggcccuucgacaccuccagagugggcacaaccggccugcccccgaccaugggaccggggccagcagggagggagggucucaccucggaagcucuggcugaaccucuuuccgcgggagcgguccccguggcugcgccgcagcaggacuacauacugggcccucacgugggcggggaugaccagcuucuccaugucggcccuguccaguacgggcaccucgcugagcugcagcugccgcagcaggcugcccaggagcugcuccucggucagggccgccccggggccagccaggggcagcacccagagugcccagcagagccacaggggccacauggugcugcccugggggagcaggaggcagaguggggcuguccucuagggagguugaaggagggucucaggcagcugggugugcugagagccaggcugggccagcuuuauagcuggcccugggcuggccuggggugaagggaagagggagggagggagggagggaggucacaccccugggaccuccugggagcucacagccagacaggucccugagccuggaggagggggcugucuagaaaggac

SEQ ID NO: 191170 - RNA, 12654 nt, Homo sapiens
uauauuuuaucuaauauuuuauuuacugaucucucugaaacaugccaaaauucauauagcuaagggaacuuaccaugcuaaaaugcuguucaacaugacaaauuuauacaaaacauauuucaauguagugccuucauuucauucuugaggaaucaacauuacauuuagguggugaaauacaaauauaauuaucaaauaucguacuucuaguuuacuggaaaacauaacaguugugacagucacaccuaacaccuugguuaauuaaagacagaaaaugggcaggggugucacagaaguaugcaaggauuugacaguucaaacuaauccauagcccuucugagaaacuacagauggaaaauauguaguaaauauuucuguaauauggugguuucaguacauuauagcacagugaucaucauuccauucauacacucaaauaacugcugcuucugaucacugaaaacuagauucaaagucauugcucaacaagcugauacuacaaaucccuuauauuaacagguaguuuaaauguggaaauaaggcaaagcauacuuguuagucacaauuacuuucagauauaauugagacuacacugcuauacauaauuagguacacaguauguauaacaaugcauacuaugguguggaguuaauuccaauuaccauauuuuauauuuauuggucacaacagcauacauuuuaugcuccaaaauacauggaucugacaaaaugguuacauuuaauguucuuuuaaagaaagaugaacuaaauuuaagaagaauugguuuuuccuaauaucucauuuucaaauuacugauacaaauuugccagagaaacaauuacauguuuuaccuaacaucaaauaaucuccaguuucuaagacagaugcauuucuuguucaauuuccaaaaguaaauaaaggcuuucuaacugaaaacauuugcaucccuagcucucuaaaguaauuaaaaagaaaauuacaaaaaaugaccucuaagcuucugaacagcccacuuaguuacauaaaguacuuucugucccaacacuuucucuaauucaaaagauauuuacuuccuaaguacacgacaaagucuucauuucaaaccauucacucaguuuccaugguaacauugcgggcuuccuuggcuaccauaagucgcauuaguugacuguggaauuucucaaucuucuuuacaucuugagcuuggucuguuuuauacaccaaacacugucagaaauuuuagaaguacauauuaacuauauaaaacuagauacugacaauguagaaaacauacaauuggguaaaauuuugagaguuuuuccuaccacuguuuugcucuauucuccuuggaggucguacuagggaaauugcacucaaguuuccaagccuccagcaauuccaugucuuaaaguacaguaauuuaaaugccacugcuguggacaaaaaacugaaugaagucuauuagaagcuucugaaaaauguuaaauguuaaauccugcuauggucugaugagaagaacucaagacuuagaauuagauauuuucuuccuucgaauuagguauuagauuaucucccuacauauuuucucccagccauaaguaacugaguuaugcuggaaaaaaaaacacagaaaucuuaagaucucuuuuucuacuggugaaauuggggguuugauaauaauuuuuagaaaaaaaucuagaauucucuguguauagcuggucaacacauaaaccagguaaaucuugauuuucuuggccaggcgugguggcuuacgccuguaaucccagcacucugggaggccgaggcaggcggaccaccaggucagcaguucgaaaccagccuggccaauauggugaaaccccgucucuacuaaaaauacaaaaauuagcugggcgugguggcgugugccuguaaucccagcuacuuaggaggcugaggcaggagaaucgcuugaacccaggagugagggcugcagugagccaagaucaugccacugcacuccagccugggcgacagagugagauuccgucucaaaaaaaaaaaaaaaaaaaaucuugauuugcugaagguauguauuuuugagacagugucucacucuguggcccagguuggggguguaguggugcaaucucagcucacugcaaccugcguccugggcucaagcgauccucagcuuccugaguagcugggacuacaggcacacacaaccacaccuagcuaauuuuucuauuuuuaguagagacgggguuucuccauguugcccaggcuugaagauauuacuuuuaaaucaaaccaaauucuuccuuguuagcaguuaaauucuucacuagauacuuaagaucugcuuaugguuggucauaaagccaucuguuguagaaucuucaaaaacagcaacuuuaagcuggcagcccuuuccucauuuuguaguacagauccacuuuucuucagcccaucuuaaagguucacaugaguuuuaaacaacaggaacuaaugauccuauaauaaaagucaacaacuuaaauaacuugaaguucaaccucaucaugcccaacugauuuuuuuaagugagccuuuuaaacaacucacuuaaaaaaauuuuuauccacgcauuguacaaauuugugcggcaaucuuguaaaaaggccauauuaaucuucaucaucaaaauuuuagcacauguccuaugagagaauguacauaccuucucacugaaauuucugacagaaaaagauuuuagguccauagaagacaguauucuaaaucaauuaugggauuagaaaaaugauggauacaugggauuauaaaaaagucgaaguuaacauggauccuuaauuauauucaaucauuaacagggcaaaaagagccaucaauuggagauaaggccuuuuguauuaaaauucguucugcauuuauucccuuauuuuauuuuuuuugagaccgagucuaguucugucacccaggcuagagugcaguggcacaaucuuggcucauugcaaccucugccucccagucccagguucaagcgauucuccugccucagccucccaaguagcugagauuacaggcacccaccaccaugcuaauauuuguauuuuuaguagagacgggguuucacuguguuggucaggcuggucucgaacuccugaccucaugauccgcccaccucagccucccaaaaugcugggauuaccagcacgagccaccgcgcccggccuauuccccuauuuuuaagacaggacauagggguuuuucuucagcaaguauaccuaaccacucugugacaaucacaauuaaaauuuuucuguguggaaugucaagauuuaagaaguacuuagugguucacacccauaaucccagugguuugggaggcuaaggcagaaagauggcuugaguccaggaguuccagaucaaccugggcaauauaaugagacccugucuugacaaaaaaauuuaaaaauuagcugagugugguggugcacaccuguagucucugcuauucaggaggcugaagcaagaggaccgcuugagcccaggaggucgaggaugcagugagcuaugaucaugccacugcacugcagccugagcaauagagcaagacacugucucuaaaaaaaaaaaaaagcaaucaaccaaccaaucaacaaacaaaagaauacauguacucaaucuaccaaggguaagcacucauguuagauacuuucauauauuuuuuuacuaucacuaugauacuuuacagaugaggaaauugagaccagaaggcuaaauuuuuggccuaaacuuuuccaaggccaaaaugcuaguaaaugacuaagcuaggauucacaucucuucaaucuaugucuaguauacuacaucucgauucacucuuccuuuuccacauguuuagcuacucacuacauucaauugguucuuagaagacaugguaaucacuaaaaggucuaacuucaugcagucucaucauaauggaacccugaacacaaauacaauauaugaccaaagacaaaaagugauuuuuaaaaucacucuauaaaauuuucaaaagaacuaacuauuuaaaaaauguuuacugagugcucucugggucaagacaucauaguaggcaauggaaauaagacauguaagaauauuacugaucuaucucuauugucuugaagggcagucuauuaaaaagacaaaugugauaaaagaauugugauacagcacaaaaagccaaaaugaaaagcaagaaaugaaguaauccucaaguuggguuuugaaagauaagcagcagucuggccacauuagggguggaggugggauucaauauugcaaaggaggaaacagaauguuugaaagcacugaggccuaacacaucacagcacauuaaaggagcucuuacauaauacagaaaugacagagauuagagaggaugcaaggguggaguuuaaagguuucuaagcaagggaguaacaaucaaauuagccuuucagaaaucacucuggggcugggcgugguggaucacaccuguaaucccagcacuuugggaggccgagguggguggaucgcuugaggucaggaguucaacuccagccgccugggcgacauggugaaaucucaucucuacuaaaaauacaaaaauuagcugggugugguggugcccaccuguaaucccaccuacuugggaggccgaggcaggagaauugcuugaacccggaaggcagagguugcagugagccaagaaugaaccauugcacuccagucuggguaauagagccagacuccuucuuuaaaaaaaaaaaaaaaaaaaaguccaggcacaguggcucacgccuauaaucccaacacuuugggaggccaaggcgggcagaucacgaggucaggaguucgagaccauccuggcuaacagggugaaaccccgucucuacuaaaaauacacaaaauuagccaggcgugguggcgggcgccuguagucccagcuacucaggaggcugaggcaggagaauggcgugaacccaggaggcaguuugcagugagccgagauugcgccacugcacuccagccugggcgacagagcgagacuccaucaaacaaacaaacaaauaaaaagaaaaggccaggcgcaguggcucaccccuguaaucucagcacuuucagaggccaagguggguggaucaugagguaaagagauggagaccauccuggucaacauggugaaaaccccgucucuacuaaaaaaaaaaaaaaaaaaaauuaguugggcgugguggugcacggcuguagucccagcuacucaggaggcugaggcaggagaaucacuugaacccaggagguggaggcugcagugagcagagaucgcccacugcacuccagccuugcaacagagcgagacuccgucuaaauagaaaucacucugggcugugcacuguggcccauguguguaaucccagcaacuugggaggcugagugggaggacugcuugaagccaggaguucaagaccagccugggcaacauagcgauauccugucucuaaaaaaauuuuuuuaauuaaaaaaaauccccagauuucugaccacguggaaaauaaugcaacuaaagguaggaagguaggaacagaagaagcagcuaguuuuuuuguuuguuuuuuugagauggagucuugcugugucacccaggcuggagugcaguggcacgaucucugcucacugcaagcuccaccucccagguuuaugccauucuccugccucagccuccugaguagcugggacuacaggugcccgccaccaugccuggcuaauuuuuuuguauuuuuaguagagaugggguuucaccguguuagccaggauggucucgaucuccugaccuugugaucugcccacuugaccuuccaaaaugcugggauuacaggcaugagaaagagcuaguuuaagaacagaugauaggccggguggggugguucaugccuguaaucccaccauuuucggaggccgagacggguggaucacgaggucaggagauccagaucauccuggccaacauggugaaacccugucucuacuaaaaauacaaaaaaaaauuagcugggcgugguggugggugccuguagucccagcuacucgggaggcugaggcagaagaauggcaugaacccgggaggcagagcuugcagugagccgagaucacaccacugcacuccagccugggcgacagagcaagacuccgucucaaaaaaaaaaaaaaaaaaaaaaaaaaaaaaaaaaagaacaggugauaaacuccacuguagauaagugaauuuugaggguaugugagauacagaugcuagucagaaagucagaagaauaugaacuaaacacacauuugcaaguagacauagacagaugcaguauuagacucaguuaaaugaacugcuccagaagcuguuaugaaaagacaaucaaggacagaauccuagagaagcacauauauauggggcacaucaaaaaaaaaacaaucagcaaagaagaaugaaacaacagaaacacagaauaguaaggccaagauaaaacagaaccacaagugccaaaauaauuauuucuaugaaagagugggcuucuguaucaaaagcagcaaggaggucaaauaacauaugaauaauaagaccacuggguuugaaaagaaaggagcugcugaugugcucucacaaagagcaguuucgcuggaguaccauaugcagaaaacaaauggcagaggguuaaggaaugaaugggauaugaggaaguaacaagaaugagcauaucaaagacaggaaauacaauaaagccuguaaguuguguucaaacacugucauuuaaaggaaacuuuuacucccuuacauccaauuuggucucuacauuucuguugcuuaaggucugaagacagcacuuauuaaagacacuugacauaaugcauuaagaaagcagguuaaauaauuuccugagggucuauaaaaguagcugcuagaaugagguucuucaucuuuaaaugaaaugcaaaauaagcauccuaauggguaaucuccauaaacucuaaguaaauaauuucaaacaaauaauuaacucaaacaaaucugaaaguauguaacaaauaaaaauguauacuuacaacuaaaucaucuguuacuuuaacacacaaguucccaucagaaugccuauauuugagaaccacacgugccugaaacaaaaauacauauuuagaaacagugaagacaaaugacauuucuuauaaauaauuuagucuucagguaggcugaaaaggauccuuuuagaauaaauacccccaaacaucuaaaggcauuuuuacuauaaacuaaaccgaaaugaaguuaaaaaaaaaaucagcuauuuuaguucauuccuuugcuaccauuuauuuaagacuuaaaaaguuggauauuuuauuugcagccaguuugaagagauguacugaacauucucaaaacacauccacauucagggaaugucugugagacuuauaagguggcauuucuugccaauaagaauauacaccaacacaccuagccacagaggaaugacaggaaagggaggaaaacauuuagcagaaauggcuaguuaaaaaguccaaauccauucauuagcaaacagugcugcaggucagugcaacucacacuuuccauuuuuccacaaaucuuagcaagcagauucagacuaaaauauucagcaaaaucaggucuuuaucacgaagguagaacauaacgcauuauuacauaaaagcagaauucugccuugaagucuccaccaacaacuuuuccaaaaaccagaauaacuccuauacugaaguuccauguuacacaauacuuuauguucaauauucuacagauugccaaggcauuuagauauuagcauauuccuauaagacaucucccaagaacacuuccacgaacauuauuuuuuuucagugauggauucaagcacaguguaucgcaguuuuucccuaaccaguaucaguaacucuuguuuagcuagcuguuuuaaaaacugcuaaguaucggccaggcgcgguggcucacgccuguaaucucagcacuuugggaggccaaggcggguggaucauaaagucaggagauugagaccauccuggcuaacacggugaaaccccgucucuacuaaaaaauacaaaaaauuagccgggcguggugaugagugccugcagucccagcuaaucgggaggcugaggcaagagaauggugugaaccagggagguggagcuugcagugagccgagaucgcaccauugcacuccagccuggggacagagcgagacuccauuucaaaaaaaauaaauaaauaaaauaaaauaaaauaaaaacugcuacuuaucuacaagccagaacagaaacauaauuuuaaaaugguuacaaucuagcaccagaggccucaagacaauucuggaaacuaaauaaaaagggcuaauggaacugcaaccuacagcuuuccccauuacggucuuugcauuccugagacugaaaaaaaaaaguuacaucacuauaugcgauuugucugagugaaggaggaaagggaacucaucaagcauuuaagcagguauaaauaguaguaacuagguuaauuaucuuuagaauaccugauucuauuuauuuaucuaguaaauucaguuuuacacauuuuaaaaauucaguucucuagaaacgaaacacuuaaaaauauacuaagcaugacaacuaugugaaguuuuaacucucaguuaaaggaacacucacugguuucauuuaggagaaaugagaguuaaaaggccaaucauggcugggugcaguggcucaugccuauaaucccagcacuuugggagggcaggaguucacucacgaggucaggaguucgagaccagucuggccaacauggugaaaccccgucucuacuaaaaauacaaaaauuagcugggcaugguggugggugucuguaaucccagcuacucgggaggcugaggcaggagaaucgcuugaacucgggaggcggagguugcagugagcugagauugcaccacugcacuccagccuggacaacaaaagcaaaacucugucucaaaaaaaaaaaaaaaaaaaaagaaaaagaaaagaaaaaaggccaaucguguuuauaaaaggguccauuugguaauuuagagggugccaagucaccaugucagaugccauaaagaaagaaaaaucaagguucuuuaccaaaaauaaccaaaacacaaggacagaaugaauuaaguccuauaaagggauauacagauaaaaugcuaaagagagaaaacaaguaacuuagacugggaaaaaggaaagucuaaaaaaggagguggcuuugaaaugcuuuuuuuguuuuaaccuuauagaagaaggcagaagaaaggcuaaaaaucauucugaacaaggauacaauccgguagcuucaugagacuagagcugaagaucaugaaaauggugagacaaagccagaaagacuggagaugggucagacugugacugggaguugggacuauauccaguuaucaaagagccaguuuuuaagcaggagaugaagaauucaacuuuuguuuuuuagacaguuguggcaagaguguuaaggaacuaaaaaggcugacagaccaacaaagagguuauuacauaauccagugguaaugccaucuucaauuacagcaauacaagacagagugguaaaaagauacuggguauaaucaacagguuaaauguguugcggagagaagacagagaauuuuggaaaacagauuccagagaccugacaaaauuuguucuuuagcccuagcagaaagagaauggacuugggguucaaagaucuggguccaaauuucaucuuaaucucucaagaaacuagguauaucacuuaacagauauaaaaucauucauuuauauacuuugauggguugcuguaauuguucauauauuauguauaaaucuauguaaacacacauaaauauauauuaaaugccuguaacauauaaacauauguaaaaugccugucacguagaggcggagguugcagugagccaagauggcgccacugcccuccagccugggcaacaagaacaaaacuccaucuuggaaaacaaacaaacaaaaaaaacuguuaagcucuuccucuacacucauccucuccccucucaacauaucagucaagccaggcgccauggcuugugucuguaaucccagcuacuugggaagcugaggcaggagaaucaccugaggcaaggauuuaagaccaaccugggcaacaaagcaagagccccgucuuuaaaaaaaaaaaaaaaaaaaaaaaaaauuaggcaggcaugguggcaugucuguagucucagcuacucaggaggcugaggugggaggaucacucgagcccaguucaauggugcagcgaacugugauuugugccacugcacuccagccugugccaacugcaauuuucugacuggguaagaggugaaauauucucuuucuugucuauucuagacaugcuuugcucacagugaugcucuaauuauuuucauuuucccuaccacugccaucacauucuuacaguacaguuacucuugaugugaauuuauauauucuuuacuguugucucaaguauuuuuaguuuauacuguggguacuucuggauaaaaguccuguguggucucagaguagcauugucugaaugaagaaacaaaugacccugccaacaagggaagcuaaccaaaugaagcaaccagaagucaccaguguuauaaacaaauuacucaauuuaaaaaauacaauuuccaucauuuauuauuguaucauuuuauuguaaaaaauagaaguauguuuuacagcuuguuacuuagcuaggucuuucugugggucuaauacuauuuuuaaucauaauuaucaacauuucuugcugcacacuuuaaacuuauaugcacuauaaacuguauguggcauuggaguuacagguuaccagcucacugcauacacuuaaaacauaauucauauuacuuaaugaucaucaauaguuucacacaguaaauccugagcccugggcugggcgcaguggcucacaccuguaaucccaacacuuugggaggccaacgcggguggaucacgaggucaggaguuccagaccagccuggccaagauggugaaaccccgccucuauuaaaaauacaaaaaauuagccaggugugguggcaggcgccuguaaaccuagcuacucgggaagcugaggcaggagaaccguuugaacccaggaaguggagguugcagcgagcugagauugagccauugcacuccaguccgggcgacagugcgagauuucgucucaaaaaaaauaaaacuauugaaaaaaaaaaaaaaagauccugagccccgguuuuccgagauuuuaucugcuuuuaauuuucuuucuucuccgagggauacagucacaauacacuggaucuauaauacccuccaauaauaccagcuccuuaaggguugaacggaaucucauucaccuuugugucucccacagaaccuaauuuaacuuggggucaguaacacgagagugggaaaugaaugcagcauaaaagagauaacugaguuacaacaaacacaaaacaaaagaagcaucauacauaaccaggucugagguuuucaguauaaaaucccuucaauaugcugaguucuaaaaagaagcagaacuuuuaauuaacacgaagaugcuucaaauaauucuuagacaugacaauaaaauaaccaaaaccucaagagacgaaaaguaagacccgaaugcuaaacucccaucacuuggacuccuuugcuuuuuaauaaugagcuaaccucugacauccaccuccauuauaauuuuugugggggcuaagaauguauuucagagguccaugaaucccuuaaaauuguuugcaaacauuuacuuauacauuuacuuauaccauuuuucugaggaaaggugcaaauauuauucuuauggucccaaagccugugacucccaaaauacuaagaaccaauauucugggggguacagaugcuuccaaauuggaaucuuucaagaaugucugagcgguaguagaaaaaacaucaucaguuuuauauacaugagguacccuuaccgccuaggcgguacaggaaaagugaaccaagacaaaggacaggaagcugcagggggaggagcccuggcuucagggacucguaaaacaaccgaagccauaaaggaagcugagggacuggggcgggaagaucgauugcagaaauguuuagggcugagaugaaccuggcuguugccagcuucagggccucacugggccgcuagaucagggaagaaggggacgagagagcagaacauuaacuuggcaggguccauuuguguucauucccagcaccuccugggagcgcuggggaagcuccaggggccgaguggauggcgggaagacauccugggcuggggcccaaagcagcggccccgccagcgauuuaccuucauagggucagcgagguaaagcuucucggcagcgcggcugaacuccucccaggucugguacugcggcaucguggccuagaguggaaaaguaaagagaagcaaggccucagaacccggcccaacaaacuaccuacguccgggagucgccaaccgacgcgagucccagcagccccaagauggcggcgccuccucgcacc

SEQ ID NO: 191171 - RNA, 74426 nt, Homo sapiens
acucagacucugauggcucuguagcuaacuggcccauccucagagacuaacgcaaaggaacgaauuuccaggauguucgacuauguggagaaaacaaaaaaaaagcaaagaaaaaaauauuuuuaaagaaagaaagaaggccaggugcagugguucacgccuguaaucccaacacuuugggaggccgaggcagacagaucaccugaggucaggaguucaagaccagccuggccaacauggugagucaauacuaaaaauacaaaaauuagccaggugugguggugcacaccuguaaucccagcuacucaggagguagagacaggagaaucacuugaacccaggagguggagguugcagugagcugagaucgugucacugcacuccauucugggcaacagacuccgucucaaaaaaaaaaaaaaaaaaagagagggaaggaagggagggagggagggaagaaggaaggaaggaagggagggagggagggagggagggagggaggaaagaaggaaagaaggaaggaaggaaggaaggaaggaaggaaagaaggaggcugggcgccguggcucacgccuguaaucccagcacuuugggaggccgagguggguggaugauuugaggucaggaguucaagaccagccuggcuaacaugguaaaacccugucucuacuaaaaauacaaaaauuagcugggccguaauggugcacaccuguaaucccagcuacuagggaggcuaaggcaggagaauugcuugagccuggaagguagagguugcgguaagcugagaucgcaccacugcacuccagccugguugacagagugagacccugucuaaaaaaacaaaaaaaaagaaaaggaaaggaaaagaaagaaaaagaugggaagaaacaaaggaaggaaaauaaacuacauuauauggagaauuauuuggacaccaucaaacuuccacuagcugucccugaaaaccgaaauuaauaugcuaaaaaauuacuaucucuaaguccauagaaaagucuccucuguauauacaucaagaagagagcaaaacggggaggauaggacauaacccaccucccagagagagaagcagcccggccaguggaaguguccuggugauauucccccaagcacugcuacauuuccaaguggccccugugacuggaaauuagaagcauaggaguuauugaccuagguagauuuugaggcaaaaaaauccacaaagguacaagaagaggaaggagaggaaggagcuggugaaggagauugagaaagaacagccaggaagguggaagaaaaaccaggagaaggagggguccauggaagcagagggaagaaaguaagggaauggcaacaguggcaguggcagcugcuggacacagagaguaagaacugagaagguuucccuggauuucgaaucaaggaagucauuggggacugugaccacugcacuucgcagggugcugacaaguaaggcuuagaauguucauuuucucccccauuugcucugcaaaccacauugccccugucuaggacagagguucccaaaagcaguuuugcauucaaaugccaacuccacuacccacugacuguauaacccugggugacucauugaguaucuuggugucucaguuuucucaucuguaaacauggaaacaaugacaagaccuaucuuauagggcuauucugaggauuaaaugaguaaauaugugcaaagcauuugauuuuuuuuuuuuuuagaugggggucucucuauguugugcaggcuggucucaaaccccugggcucaaguaguccucucaccucugccucccauugugccgugccuggccauuugcaaagcaccugagaugaggauguguucucuccaggcugcuccagccaaugacaacacaguagagguacugggcuggccauuucugcccaaugcagacuucuauuggcccagcuuugccccagaauccccacuggguuggccaaggcuuucucagaguggcacugcagucuauggauccuccuaccacaccgccuuuccuuccccaucucuuuucauagguguaaggcuuauguuaugggcugaaggcuuuucuggacuacuccuguucucucuccccuccaguuacacaggacuuacccccaauaagucucuugcaugucuaacuucguuuuggcauuugcuucccagaggacucaaguugacacacuugguuaaacagaauucucugcuacaggacuugucagagccuuuaauauuaaaauauacacauuauaacucaucaagagggaaaaguauaaagcauuucccaaauucauuugaucacuaaaaaccacacacucacauccacacaugccacagacccucucaugaacaucucaugaaacauguuuugcugaguaaaguuuguuuaacauugaacuaggccagccgugguggcucacaccuguaauccgagcacuuugugaggccagggcaggcagaucacuugaggucaggaguuggagaccagcccggccaacauggugaaaccccgucucuacuaaaaauacaaaaauuagcagggcaugguggcgcaugccuguaaucccagcuacucaggaggcuaagacacaagaaucacuugaauccaguggguagaggucgcggugagucgagaucacgccacugcacuccagccugggcaacagagcaagacucuaucucaaaacaacaccaaaaaacauugaacugaagaccccuaaaguuccauccaacccugagauucuuucauaugaaucucaaagugugaaacgccucagucgccuagggccuuauucuacagaagggaaguccaaaggcucauuugaauugcauuagcaacucgagcuauauuuguaagucuccucccaucugagaauuucuuugucagcaacguuuucccuauucuacagauggagaaauugaggucuaggaagaccaagacacuugucucagacccacaguugaggucuuaguuugccacugagucacgguccgugugacacaaggauggaaaaccaaagggagccauagcugagggaagggaaaugagaaggguaucugaaaugucggcccugcaauaaggugggccacagcaauaaugagaugucacugggcucagcccugugccuggaaggagggagguggucaaggauaucaacaaaaaaauaguugcugaucccaggagaaauacaacacugaauugaggggaaaacacagaaacacaucuagacugucauuaaacaaauguaaccgaggcaggggaaauguggagccccaacgugaguaggugauggaguugggugacugucauaugucacagcaggauggguaguuggcugcccccagcccccuccugccgcucccuguuccagcacccuggcccaccagccccuuccuggcaacucccauacucccccaguucauccacuaaaggauuaauagcucacucaggggaggcuuccugccccucggccaacaccaacuucccuuucagcaagccagugucggcacuacagugguuuggaauacuuucaauaucacucccuguuaacaagccuauccuuggacuggcugagaaaagaaauggaacggggcaaaguaacaaaacaaagaggcaagacagagccaaaugucuccuaugguuaccuaaaucacaauuuagacaagcacuggugauucuugcacauagagaaccaccacugaacuguacaggggaaacugguuucugccccagagauguguuggggaaaugacauacugaccaccaugacuacauccucggaagacugaguggcagagugcuacuuuggcuuucuuaccaggugaacuugagcauauaucugggcaguucuagaauuucgaugugggagggacuuagggaugaaaaaaauaaaauguggaugguagauggcauuuggggcaggggauuggaggcuugucuuguagcuguuucugcuuaguaagcucccuguucuggcuuagagacauauuuauuggggagcuugcugaugggaauuauggacggggccaacuccucucccagcacccuguggugcugacaucugaggugaucacuucccauggaguggagaaaagcaugcugcucuauauuuguucccuacaacaggaagcgugaaaacaggauuugcugccacaugucaaguacucaugugccuguagaagaaaggggccauugcugcugaugauaacaaugauagcaucuaagguuuuauaguuccccaaauaauuucacauacacugugauuugaugcuuauaacaaccgugugaacuaugcaaaguagguauuauuuccccauuuuaagagaugggagaauggauaguuaguauuuugaaaauugccagaccccacacuuauaagacuacauguauuauuaguaaaauuacuacuaggggaccccagcuaugaaaaccucucugggagauagcacuggugggugaggggcagcagcuucggcucuugccuccuggcaagggugggauguaauacccuaagcuccaacagacuggggaaagagaaggggcuuagaaaacugucugggcugcuggauuucuuuccggaguuucccucucuccuucuacugucagcacgucccaucuuuugcaacaccagggagaagccuuuccaugccucuucagcucuuggaaucccuccagaagcccccucccuccugaguggcaucuaacaggccuguccaauacucaugcuacagcuaugaggaaagaauaaacccugcagcugcuucagaagagaaagaaaucucuuuucaaaugaaaccguuuuuugcagcccuguggaauucauauucucugugaucuccuuuggauucaaaucacggaccugaaagagggaggggaagaaaacagguucuuuuccucugccugggccugccguucccucugcccuccuacacuggguauggacagaccccaagggaccauggucuagguguuggcagccaggcuggcucuacaacacaacaugucagcugcucugcugggccucuguuuacucauccauuaaaugaggagauaagaucucccuugacuggcugugaagauuaagugcacaaauauguguaaagugcacaaauaugucaaauaaaaacugagacugacacguggaggugcaaaauuaaaaaggaagcuuugguuaguaucuccagaaccuggcuaggcacgguggcucacaucuguaaucucagcgcuuugggaggccgagauggguggaucaccugaggucaggaguucaagaccagccuggacaacauggcgaaaccccgucucuauuaaaaauacaaaaauuagcugggcauggcagugagccccuguaaucccagcuacucaagaggcugaggcaggagaauugcuugaacccgggaggcggagguugcagugagccgagaucacgccacugcacuccagccugggugacagagugagacuccaccucaaaaaaaaaaaaaaaaaaauccagaaccugcagauugugccucugaugcaucucaaacauccagggccagggagaaaauaaucuaaagaaaaauacuacugaaaaagauuccauugccauggcccucugagacacacacauucuuauucucuuauuuucucucucucucucucuucuucucucucucucucuuucuaucucucucucucacucccucucucauuuacucacaaggucaguggcccagacccaggcaguucuggauaaucccagcuguuucugacucaccaccauccucagggcuggcugacucacuccaggaagguuuuccaccaugaaguguuugucuauguccuuguguucccgugaaaaggauuguguggucagagaaagagaagacuuugcugggucagugagauagcauagugugagaggcuuugggaaguagaaaaagcaacauuaacucagguuuaaaaacuagacuuuguccaaaugguuggggaaaguagucauuguauguguuugcaauuaaauuuggguggcauaggacagccuaaagcccuuuguaagcagagcucuaugugcgcagcgaucccuagaaggcuggcaaggggaguggccagggcugcaccaaagaggguguugccuagcuggggaagaggaacuucaggugagccaggaggcucuucugcucccaggcugugcaaagcuucugaguugacuggaaugauaggucugaucugcccauuuguugcuaaaaugacuuaggagggaaaugaccuccaccugccugggaggagucacuuccuccagagaugagcuguccuugaggagaucagugggaggagaagccugcgcucugccccacugggcagaaggacaagcuuucucccaagagccucgagcccagaagaagucgggguggggccaauggaaaucagacaguggaacaaaugaacagcuuccaggacagggcugucgcuuuccucuguuuucaauugugauggcuucaugaaacccuugcaccagaaacccaugagcuagaaaugaaugccuguauccccaucucuggacucagaguccagagugccaaccauuacacaauggaaccuguguccccgccuuauucaagaguaaagaaagcaaagccuggugguggacggugguaccugcccaucaggcagcaugcccagacuugcaaaccagagauggaggaugucaaauaaaaacaaaaccaugggagacugaggcaggagaaucacuugaaccgggaggcggagguugcaaugagccaagaucgcgccauugcacuccagcccgggcaacaagagugaaacucuguuuaaaaaaaaaaaaaaauccagacuuuuauaaagggacacuucaauagaaagaaagacuauugcaggccaggcgcaguggcucacaccuguaauccuagcacuuugggaggccaaagcagguggaucaccugaggucaggaguucaagaccagccuggccaacaugaggaaaccccgucucuacuaaaaauacaaaaaaauuagcugcacauggcggcugguaccuguaaucccagcuacucaggaggcugaggcaggagaaucacuugcacccgggaggcgaagguugcagugaguggagauugcaccacugcacuccagccugggcaacaagagugaaacaagaaagaaagagcgaaagagagagagagagagaaagagagaaggagagaaggagaggaagggaagaagggagggagaaagaaagaaaaaauagagaaaaagagaaggaaggaaggaaaagaaagaaaagagaagagaaaagaaaaaaaaagagagaaagacaauuccaauucagagaaucugcaagcagcucaaaaucaaacagaaaaagauucuucuuuucuaggguaaaggaggagcaaguggagauaagcagacucuugggaggggaagcuggacaagugaggggaaaugaccagugggagcugacaggaaaagggucuugcuguguucagucaauucccaggagaagcugggcagggaagugacuuggcagggacacuccacuuuguuugugcuuguucaggcuugggggcaagcagcauucagggaucuguaggaaagagagaagucugaccaaaguuuugucaagcaaaggggguaagcaaugggugucagagacaagaauagaugggggcagaggaauaauagugacaaaaauacuugcuuuaagaaaagguaacaucauggcucucauauuaguauaaaauaaacacauuuuaaagauuccauuucggcagggugcaguggcucacaccuguaaucccagcacuuugggaggcagaggugggcagaucaccugaggucaggaguucgagaccagccuagccaacguggagaaacccugucccuacuaaaaauacaaaauuagccaggcaugguggcaggcaccuguaaucccaacuacucgggaggcugagauaggagaaucacuugaaccugggagguggagguuguggugagccgaaauugugccauugcacuccagccugggccaacaagagugaaacuccaucucaaaaaaaaaaaagaguccauuuaacuugauuaaacgaggcaaucugguggauguuauaacugguucaaaggagaaaccaaagcagcacaauuuacaugacgugaagaguacugaaauggaauaugcaacuagacaaaaaacuggucucucuacagggggacuguagugccucuacuggacagaaugcauuugcauaucuauaggaaaaauuauuuuccauugcuacaguuaucuacaacuuagauuacuuacuuagaguuacuuagguaacuauacauugcuacaguuauauacaacuuagaguuauaaaauaacucaaaaacaaugaaaggggcucgugugguggcucacaccuguaaucccaacacuuugggaagcugaggcaggcggaucaccugaggucaggaauucgagaccagccuggccaacacggugaaaccccaucucuacaaaaaauauagaaaauuagccagaugugguggugugcaccuguaaucccagcuacguuggaggcugaggcaggagaaucgcuggaacccgggaggcagaagaugcaguuagcugagaucgucaagauccugucacugcacuccagccugggugacagggugcuacaucucaagaaaaacaaaaacaacaacaacaacaacaaaaacaaugaaaggcuagacccagaucuucuggaaggagaugcucuaaaccaggguuucucagccucuacaugacugaugucuuggacuagaucauguuuuggguggagaauguaaaccaaaaauaaaauucuaagccucccccuccccuacccccgccaaccaucuaaauggaugguuccuccuuagccgaggcucuuaaaauuuuaaccugaaauuuucaggccaugaaggaaaggcaaggucggacaugcuucauuauaccucuccagcgugaacaucaaccagaguuuaggucugauaagaaacauuuuacugccuguucacucugaagccugcuagcuaaaagcuucaucuaugugauaaaacuuuugucuccacaaccucuuaucgcaacccaaacauuccuuucuauugauccugggccuuuagacaaacucaaccaauugucaaccagaaaauguuuaaauauuuaccuauauccuggaagccacccccacuacccacccaccaccccccgccacuuugaguugucccgccuuucugaaccaaaccaauguauuucuuaaauguacuugacugauggcucuugccucccuaacauguauaaaaccaagcugcaccccaaccaccucgggcacauguccucaggacuuccugugucacaggugugcaucuucaaccauggcaaaagaaacuuucuaaauuaaaugagaccuguuucagauuuucuggguucacaagagcuaucuuggacauuggaagauguucagcggcaucccuggcuucuacuuaguaaaggccaguagcaccucaucuccuagcugugaccauaaaaacuaucuccagacauucccaaaugucuccugggguggguaggggacaaaacugcccccaguugagaaccacugcuguagaccaugcacaguuuuccagugaaacccaaauucuucccuacuacuguagagaagaagaggagguaauuucugcccaucugcauuucuuggcacgcacccaugucucugugugugagaugagaaucacacccuagcuccacaacagaguggucacaguagccaacacaggcaguauucuaaaugcucucucccuauaguaacccaacuaauccugccaguuaaauaugaguuucagguaaacaaugaaucauauuuucuuuuagaauaaguauguaugcccaugcaauauuugggcccuacauauacuuuaaaaguaucuguuguuuaucugaaauucaaauuaaacauuugggaggguuguuguuuuauuggccaaaucauuuuauuuuauuuuauuuuugauauggaguuucgcuuugucacccaggcuggagcgcaguggcgcgaucucgucucacugcaacuucucccuccuggguucaagcguuucuccugucucagccucccgaguaacugagaucacaggugccugccacgacguauuuuuaguagagacggaauuucaccauguugaccaggcuggucucgaacuccugaccccaggugauccgccugccuccggccucccaaaguguugggauuacaggugugaacuaccgcacccagccuuauuggccaaaucugacaacccuaucuauaaucaaauaaacagcugagcaguaguaauugcagcauugugauugcaauaggccuccgguggcuuagagucccuguucugccugugacuguugugccacauuggggacgucauuuagcgucuccgaggcucaguuuucucaucuguaaaauggggacaauaucagcgccuucuucagagucgcugggaggauuaaaugagaugauguaugcagagccguuaagacgcuguuuggcacaaaguucagggcagcugguuuaguuuccucgacuucacuaccugacccucugcuaacuccccggguguuuuccggacggccacaacuauccuagccuucuucccuaugggcugcaaagguggccucggguuccggugggagccccaacucuggaccgcgauucgcgagccuccccggcgccgggccgcgccaucccgggagcuguccgcagauggcagcaccggccccgggucgcggcguucccggcgcucggcaggccgcaggauggccuggucccgggccgggagcccagcaggccgggagcggcugaggccacaccccgcgggccgggccgcuucccuccggugaaucaucgcucgcagcggcggcgcccgcaguggccgcagcagcgcgccgggcccuggccgcgccccagccgagcgcagcgcggagucgccccgaccuuucucugcgcaguacggccgccgggaccgcagcauggcgggcaucgcggccaagcuggcgaaggaccgggaggcggccgaggggcugggcucccacgacagggccaucaaguaccucaaccaggacuacgaggcgcugcggaacgagugccuggaggccgggacgcucuuccaggacccguccuucccggccauccccucggcccugggcuucaaggaguuggggcccuacuccagcaaaacccggggcaucgaguggaagcgccccacgguaggaagcgcgcggcaggacgcgggcagggcggggugccgggcagggcggggugcaggccggcccgcggcgcgcuggggcggggggcagcccgggugcugcaguggggaagccgcaagccaggaccucgcaguccugcgacaccuccgcgccgccagagcccgggacucuguucgagcguggggggacucccggggccuucccucucuuccacccaccacgcuuuccugggcgggucgaggcgaaucacugcccucagaucccacuagcaggccacuuuaggacuucacaaaaacucagggugaugcaggaggccggggugaaacuuugauuggacucuagcggggagcuggaagggaaggggaaucgggucugcagggaagggacggugagaggcagcaucuaccagacaaaguccgucuccaacugggguucugucuguucauggagggggacaggccauagccuggucauuuugugacuaaggauagucuccugcagcccugggguuagauuuauuuuuccaaaggggagccagcgauaccuccucauaacauugacacugguaauuaacccaggacacggaggugucucaugguuucccuggcgggaaucacccgggaaaccuccgggagcccuccagacccccuuaucccgucccccagggucucugaccucccggcccugggacaacuugugcuccccaaucuacuuguccauucuguuucuuggggaaccccugaggcuccuccuccuuugggacacuuccccaggcuuccccuaccacgccuaggaaagccugcccugaaguccaacuucuagauuccuguugugagaacaaggcuuccagcucugcuuccacacccagcagccucccaggucaccuucuguuacccuaaauccagcccauagguagcaagggcugcaggaagcgcccuagcccagacucagagcacuuggguucuucuucuugcuaaccugcuggugaccuugaacgagccauuuaaccucucugugccuccaugucuucaucuaaaagaaaacaugcugccuaaauauuuucucucuuuuguggcccacuaggcccugccgucauggccuccuuucagucucucaaagagccgguucuuuccugcaugaggccuucucaccagcaaggcacgcuguuaccuggaguguggcucacucucauucuucccaacuuagucacauguucccuuccuaaagaggucuuuucugacccuucuuagcagccaccuccccaccuuguuuuucucugucaccccacucauuuccuucauagcauugucacaguuuagaauauaaucacauguauuuguucuuccuacugaacugcaggaaucauguguauauuauuuaccaguauauccccagugccugacacauaaccaugccuuucacaguauucauucauucauucauucauucauuuacucacucauuugacaacacugauugagcaccuguuacaugccaggcacuguccugagagcucaggagauacaccagugaacacaaaagaagugacuguuuguagaauauggaugcaggauuguaaugugccucaaaugaaauuaugguugugaaagugauacgcugaccugacucagugccucacaccuguaaucccagcacuaugggaggccaaggugggaggaucgcuugagccaggaguucaagaccagccugggcaacacaguaagacuugucucuauaaaaaaguaaaaaaaaaaaaaaaaaaagugaaacacaaaccaagagaauguguucacuuuacauuugcauggcacuuuacaguuuacauagugaguucacauacucauucacuuauucuuucauucauucaguaagcauuucucgaauaccuacuauaugcugggcacaaugcauaugguuucugcuucugaagacuuacuucugaggcuagugaggggacagagacaggucccccaacaguuggaaaugccugugggacuuccagaugaggauguagaggucuagagaugaucuagcgccacugcuuagggcaggcgggcugugcacugcacaacuaaggaagagugugacuuuuacgauccccauuugccaguugaagaaauugaggcuugggaagguuaaauacuugcucagagucaaguggauauagggcauagauccaggacuguguguagucugugcauguugagccuaccccuuauggcugcgcucucugccuccuuccuaccuucucaaaugcugcugaggucaggcaaggggagcacaguuguuuccgcuggauuugaacacuagcaagucauuggugaguuuagcagagcaauuucaauggaaaggugagaguagaagccagauuguuguagacuccagaguaaaggaacuggaaauuaagaacaugaucaacuuauuuaagaaggacccccgggaagagaggagaacugauagguagaguaggaccuggacuuugagagccuguguuuuuuucauaugagaacaacuugaaugugucauauguugaaucaccaggaagaagggauuaaagauaaaggcagggagggggcagugaaacaggaucccugaggaagugagaauacggguugugggcaggggaggggagcagguuagccuugcagcaggaggagcugcucuuccucggagagaggauuucacaacacuggcaagaguggcuccagugccuggagcggggauuaaagcaguaaguccagugggguccaagggccaugcagggguacagugaggagaaagcaggugugauccggguggcacaucagauccuuccagcaaccagucuguuaggagcaagggcagauguugugagccccuauguuucccccaagaaaaucaaaccucugagagguuucucacuugcuuaucuucagcuggccgaacucagccucaaacccauauguccugucuccaaguucagugacuguuaucaucaacuucuucaacaguaauaauaauagaucacauuuauggagugcuugccagggcauguuuacaucauuaucucauuuaacacucagaacaauccucugugguggguguuuucaucguucccauuuugcaggugaaaaaacugagacuucaaaagguuaagugacuucccaggguccuacgaccuacauaauaaguggcagagccaggauucaaaccuagguuaucagaauaaugcagcaaagcccaaacccucagccccuuuucacugacugguaagacccauauuuaauucgaugcccuacaugccgugcacaaguuucaguuuucugaagcaucgcuuagaugcuuagguguuuagcaccacucugaacucugacuuuucuagagaggcugcuaaaggcauuagaaaguuucugaaguauaauggaaaaacccugcuggaguaagugccuggcacacucaggauuaucagugugauucuuuauaauaaacaggcucccagcaccaagcccaaucuauuccaucagcuggauaagagcucucuggcaggccuugggccaagcuggcuuccuuugccucagcagaagagcauucugauucucucugccauccccaaaacugacaggagcagagagaaacaaggcagaggcaugaagggaauguccucugcggcagauggugcuuccggaagagcucccacaaucugagcuagaaugaacaggggcuagauccaagucucauauaggcauacuucugcuugacagagugggcaugccgagggccguuggguggaggcaggcgugugcaacccaagcagacaugagacgcagcuccuucaaggcaagguugccugagcccagagaggcucaaauuugugccccaacuuccucuguggcuuuuggguggggcucuucagaaucgaaacacacucagagggcugcugaaagggcuaagaaguguucaagguuggcuuccaucaggcugcucaugacaauggccccugagguuuuaacacccuugaacgcuugguacuaaaucaauuagaggcagggcaggagcagaaagaguuggcgcauuugaucaguaaguuccaaugccagugcugucuauuaucugugaacuguguuaacuuuggacacgucacuucaccuuuuugagcuguuuccucgucuguaaaagggggauaauacccauuccaugagguaaagcuuugagcacagucucugauguaagcagguacagaauauauagaugcuguaaguuucauggucccauggaagaauucaaaaggguuagaucccgccugcccucaaaaggguauguguuaggaaaucagaguaauaccuaaguaguaaauugcagaguccagagacucugggacucagacuugaagggaugagugaggauuggacuaggacgacuucacggaggaggugacaaugagccucaagguaugaugcaauauggaaaaggagggaagagagugggaaaggaaggaauuucaugcaagcaaaacaacuugcaugcaguaacagaggagagaggaugcuaacccaguggauaggguggcucuagaguguggauggucuccacgucuggcagaaaaggcuggacuugcugcuguggcccccgggacacagcacaaugaaggaggcuccaggcaguccagagugugcaggguccaaugccugcccuucucagacaggaccacccauccacccaucagggcccagggagcaggggucagaaggaccucaugacacagaguucugacugugaugacacacuuuccccagaggggaggggaaggggagaagggguuagaagaccccacugagaauggaggcauccuagcugcagaagcaccuggcugguaggcuaacagcacuuugugggucucguucccaggagaucugcgcugacccccaguuuaucauuggaggagccacccgcacagacaucugccaaggagcccuggguaagugauagauucagagcaagcugggggaucuugucuguaaggcuguggguggaagagaugagggacaaccuguggcuucucucccuucccaagcagcuuggcaauuucuauuugcagagaagcuccauggaauuucuuggcccuagcgggcaaugauucuacccucagccccaugcuggggcacacaaaugaggccuccuguguccccugcacagggcuaguugcugagguuacagagaugcugccacuaggaggaccagggggcuucuggaugucagccaccccuugguaugcaccuccuggagccagcauuaccagugguucacgaaauacacucugggcagaggacuaggugggaggacucccccagaccaaugacagcacugagacaucaguucugugagguucaggaaccagggaaggugacucaguguaaagaaagaggaaacucuaaugcucgcugcugaaggaaguuauaguaccagggcauucucaguguuugcaagacaagcucaccaugguaucacaguuguaacgcucauuuaaguaaaaugaacuggaguagcugaauuguccaaaaccuugcuuucuggagccgaguucagauuuguuucuggagauaguccuuguugaagguuucaacccacaggguucuccaccuuuaguaugaaaauucccaaagcuucuaggaagucccagcaauggggccuggcgcuguuaucuaagauucucauagaaucugcccucaauguucuuuuacucauaauaaaugugggccuauaauuacuagagcagauuauuugcucugauaaaccaaaaaucuauuuucugccaucagccucagcuggcuggcuccccagacaaguucaucaguagcaaaaucagucaacuagaguuguaccuccuguccucacccaccuagcagagguucuguuacucauauacuccuaauaccagcugauaacagcuaauauguaucucuaaggcaccgugauuauucccauuuuauagaugaggaugcagaggucuuccuacagcuaaagugguggcugguaccccugaccccaggguauguuuaauuccugagcuagacucccuaagacgggaccuggaaaauuuucuagcccugaggaaugucagagcaucaugugaaucauuaggacagacagacugugaggaagaacaugagcugggcgggaaaguuugucugagcucaggcucugcagauuccugagaugccagagcacauucuuaccugcagaaaacacuccuuucauuucuuuucuucucgccccacaaaagacagaagauagagguccuugagcacccaaggcggauccuccaggaaaaucuauucauuagagaaaauggaauugauggaaacuuugaccaaccccgggggcuuuagagaauccagaaacagccggcgcaguggcucacaucuguaaucccagcacuuugggaggccgaggcaggcagaucaccugaggucaggaguuagagaccagccuggccaacauggucaaacccugucucuacuaaaaauacaaaaaaauuagcuggacgugguggugggugccuguaaucccagcuacucagaaggcugaggcaggagaauugcuugaacccaggaggcagagguugcagugaguagagauggcaccacugcacuucagccggggugacagagagagaccccaucucaaaaaaaaagagagagaauccagaaacaaacacagcaacugccuaacaucugcuucagaguuuaacaacaccuuaagugccaaaguguaagcaacaaauacaugauuuaaguccuguguaaauaccacugggccaauuggagaggagauagcaaagguuaacauuccugggagaaauuucccucccaggggaauuauaaaccaggugaaauguaaaccuuuuaaaaauuucuuaguagcuagucuguaauuucucaggggugugugcgugugugugugugugugugugugugugcgcgcgcgcgcguauaaugcaguauuggucauuuuguucuuucagccuuuuauuuuggaggacucuaguuagaucacaaucugugaaaugugguauacuguacucucacccugauucuggcaccuggccagcgggugcugauggggccuugaccuucaccaaaucccaacagccucacaagcaccaggaacagaggccauggcagugacacucugugacauggccagagauaugagccuagacucagcucuguugguaguccgaagacugggcaaguaauuaccuggaacuuccaucuggaaccuccgucucuuccaaaaacggagaaggaaggaggguaaauggagugaccucagacacccccuaugaguuuguauucagcuauucuaaagccauucccggguuucuaaccagcuacuccucauuccuugugcuagaggguuagagcacuacaagaucauccuuauuuucucucuuucucucuuuuuuuuuuuuuuuuuuugacagggucucacucuguuccccagggcuggagugcacuggcaggaucuuggcucacugcagccuuggccuccugggcucgagugauccucccaccucagccuucugaguaccugggacuacaggcacacgccaccacaccuggcuaauuuuuguauuuuuuuguauagaccgggucuugccauguugcgcaggcuggucuugaacuucugagcucaagugauccacccaccucggccucccaaagugcugggauuacaggcgugagccacugcgcccagccaagaucauucuuuuauuacacacagaaggaguaauaacaguacccaucaccugcauaacaguaugcaauucauagagcauuuuuucacuacaguauuucauguacucaucccaaaucuaaaguaaauauucucaccucacuguacagauaaaaaaaaacugagccacagagacgggagaguaaguguaaagccacacagcuaguaauugccaaaggauugaacccuggucugauuuugaauccuacacucuuccuaacccaugcucccuccaauuugccauagugcugugcugaggaaccauucucagcaaaauucaucuucucuaccugcgcuuucuacccugagccuuacucaguucccccagggaacuugggcaggugacauucuuagacuugugcacuuugcaacgcccugcccuguuuacugugcugcccagcaauguuuaauccacaaacacccacgcuccuucccagaaggcucagcuuccaagcuucaccaaagucauuuaaaccauguuuacagagcugcucucaccaagagccaucuccauugcagaauauaguuguguaagaauugauucagcagagaaaaaucugcccuucuggaggaagggcuggagacccagcuggagccuccacuggcugacccugcagcuaaauauggcucugaaaucgugggguaauaaccacauucuuacaggugcuugccacuugaaauggcucccaaggacccaggaaacuccaaggcugagcugcuccuaccucugaugcuuuacuuugcacugggucaccacugagcuuuccccacagccucacagcucacggaugaaggcagcuaccccagccaggaaggcauaggucaccuugcaggccucugauuuccugggguagagcccaaggcugccaaggcuguugaaacagcacacccccauuucauuguaacccagcaaauguucccugggccccucagaggugggucaaccugccuccuucucaagaugucacauggacccccagagcacccacugggagguguuuagcuacagggugccccaccccacagccuagcucagcagagaguggggaagggacaagaccaaugggaaaggcaagccagauggggaauuuuccaguccuguuccuucuaccacucauuagccacuuauuuggacccaaccccucugagccucaguuucuucuucugugaaaugggaauaaugauaaggaucccuucccagggcuguggagaaaagugagauuuauacaggcaaacacacuuggcacacuauagaaucccagacaaauucaagggaccaggauuaucauuacugauuccaguuaugugaaaaguccuuuugccaaauugccgaagaaaaagaggaugguggaggaagagaaaaggaggagaagaaaauaaguuggguuggaaaccagauccuuguccuugaaaauuucauaaucuaaggguggaaaugccaaaacgaggagagacaaacuuguggccuguguuuggguaacacacagauugaaacucagaaggagaaacauauggggagaaaaugaacacaaaggggucagaugugcauuccucaauuuuaaaaauugaauauuuaaguguuuuaaauaauuuuuauuucuuuuccuuucuuucuuuuucuuucuuucuuuuuuuuuuuuuuuuuuuuuuuugagacagggucuugcucuguugcccagacuaaagugcaguaacaaaaccauagcucacugcagccucgaccuccugggcucaagcaauccucccaccucagccuuccaaguagccaggacuacaggcacgcaccaccucaccuggcuaauuuuugugugugucuguguggagauggggucucacuguguugcccaggcuggucucaaguuccugggcucaagcaauccuucugccuuauccucccaagugcugggauuacaggugcgagucaccacaccuggcaaauaauuuuuaaauuauaaauuuaaaaaugcauuuuuauaauagguaccuuuaaaaauguuaauagacuuuuuuuuaagaacaguguuagguuuauagaaaagcugagaugauaauacaggaaguuccagauaccucauacccaguuuccccuauuauuaacauguuacaucagugugguacacguguuauaaugaaucagcauugaugcaguauuauuaaaguccaugcuuuaugcagauucucuuaguuuuccccuaagguucuuucucuauuccgggaucccauccaggaccccacguuucauuuaguugccaagucuccuucggcuccucugggcugugacagucucucaagucuuuccuuaauuuugaugaccuugacaguuuuggggaauauugaucagagauuuuguaagaugccugucuauuggaauuuguggugccuuuuuaauaaguaugcaguggcucacaccuguaaucccagcacuuugggaggcuggggcaagaggaucgcuugaacccgaguuugggaccagcuugggcaacauagcaaaacucugucucuacaaaaaaauuaccugggcuugguggcacaugccugucgucccagcuacucgggaggcugaagcaggaggaucacuugagcccaggagguagaagcugcugugagccgugcacuccagccugguucuggagccacugcacuccagccugggcaacagagggaaaacuuaucucaaaaaguaaauaaauaaguacccauguaguuaaaauguuuaaagacuagcaaauagauguuggcugguuugauggagaaaguaaauccauucuuuuucuuaaaaaugaucucuucaccaccagucccagcaccccccuuaccagccucccagggcacuguccauggcuacauuguccaugggccaucauguccccucggcuucucuucugguuguaaaugcucuugcacuuuucucccuuguggcugccguccacacucccagcugccuucccucugcacuuaagaucuaagaucuuagagacgagaugagacaucucuugccuucgugcaucuaagacagcucaucaacagguccaggugaacugcuaacacugcuguguugcuuggaggccccugucccacccuggcugccucagcuuuggccaugguacccacggucuccagcuacaucagaugccugaagaacaaaucucuccuuagcucucccugcccccucuccaggaauaggagcagugggacccccuucaagaaucccccauuucccauauacuuuccugcaaagccacagggcgugcaaagugggauuccagggcuccagccugcuccccaugggccucuggauccaggggugacucuuugccuguuugggugccucuuuagauuuuccaccagcuuccuguggccaggagccagaccacgccccuauacggccauaguugucuuaucuugucucugagauuagaagguuggaacagauuuuccugaugccccacuacuucugacauucugugacuuuagaauguuaccuuccucgacagcccccugcacccucacacaucuggcuuuagcuggacugguguuugugaggaauuauaucuccaccuuguucagcaccaguccccaagaagaccagccaagggacacucaucuggggauuugagaaaugaaggaccguggguuccaugaggucuguugggguccuggcuagcaacacugucuggaugauugagccccaggaggagguggccuggccagcaggugugcagugaggccacuucuagaccaccccugucccauagagcuucuagugaugauggaaaccguguauaucugcacugcuccaaacagcagcacuagcccuguguggcuguggagcacuugaaauaugacucaugcaacugagaaacugaauuuguaauuuuauuuaauuuaaauguaaauagccacauguuccuuguggcugcugcacugcacagcagcagacuguugcgcucuggaauccagccucucagccuuuacucuccaaagcgggauaguauucacaucagagccaaacaaugcacagacgucaauaaacaggcagggcaugguggcccaugccuguaaucccaacacuuugggaggcugaggugggagggucccuucagcccaggaguucaagaccagccaagcaacauaaugagaacccauuuccacaaaaaaaaauuuuuuuaauuagcugggcaugguggugugcaccuguaguuccagcuacuugggaggcugaggugggaggaucacuuugagcccaggaggucaaggcugcagugagucgugauugcaccaugacauucuagccugggugauggagugagaccuugucucaaaacaaacagcuaaaccuacaucaauaaacaucuguaaauaucaggguagcgaaugaggacuuggugucuggcaguuagggacuggccucuuauucugccacauacuggcucugucauuuugaguggaucacuauccucuucacaccucaguuuccucauccgugaaaugaagauaauaauagugccuacuaucaagaccauccuggcuaacacggugaaaacccaucucuacaaaacuacaauaugaaauacaaacaauuagccgggcgugguggcaugcacuuguagucccagcuacucaggaggcugaggcaggagaaucgcuugaaccugagagguggagguugcagugagccaugaucgcaccacugcacuccauccugggcaauagagcgagacuucaucucaaaaaaaaaaaaauugugucuaccucagaggacuguaaagaugaaaugaaauaauagacauauaaagcucagagcuccagaggcugguacauaguaaagguuuaauccaugcagauugcacguucucuuuggggacaguacagcuggaggggaguacugucaaaugaggucgcgucgcugagguggagacacauuguggcacaucuugaauacccgacugggucccagcuuuagcacuugacauuggcggccaccuaaguuuuggagagggguaugacagaggagguggugucccagggggaagguccggaaacucagaggaguuuccugcuguaauuuucuuuggucacacaauggucauggccuccugauguuucccacaaagggccagaggcccuucagugccaaggaacguggacucucuccuaucccagcacauacacgugcuuccaguaccuugugaucucuagccauaaguuuccacucacccaucugcgaaaugggaacaaugacgauguuugcguccuuucuuuuucuuuuccuacaaugcagggaacuuuaagacuaugugacagaaaggugccacuggaacccagggccucguggguuuccuccgucucucgggagaccaggauccgagugagaaaguuucccacguucauucuuguugggcccauucucaggaugauguuucuccuguauuuugcuaccccagcccaagcaagacuaguaguucagcuuugugaauccccucaggaagucaggaaaauagauacugucuuugggcuuccuccaggagcuaagaaaggagaguuccugaagagcaggaauuuaagacaggaauuggcagccgagggcaagguuccaccuccuccucccuucuucuguggggucugugaugagagcagggauggggaggaagaggguggguuugccugcgccuggggggagggcagccaucaggaaggagcagccaccucugcugggguacuggagauaaaaacucugauauugacuagugaccgugggggcgauggcccaggagggucagggcugcagggaacagggacacaaaaacgacaaaacaugcaacagguuauguccuucugguccagggcacggcugagacaggcaagggacuagagagaggaagagugaaugucaagccccagcacccucgccucccucccauccucccuuuuagggccucccuucuggcagauagggcagggagaagggaaaggaaaggccugggacacgugguuuggaucacuggcuguggcucacaguucugaugugugugcaguuuagggaaggaggcugaagacuucuuguuaauaaggguggggcaugaguaaaauggaggaucugcccccuccccucccagccccugauacaaaugaaggaugauuguacaugcauggggaauuccacuuuggggguauccuuuucugggcugcugccagacucugaaaugaguaacaaagggauggcccagggugacucaucagcuacccucucgcaggccuagcacgcuggcggggugugcauuuccucuagagaagccccucccugccaguuucagagggauggcccugaauuggcuuuucagagguuccuucuccucccuuccaaagcgaagacccacagcugccugaaaauguggcucuccgccuucuugggcugccuaggaccuugagagaugugucucucugggacagggugucaggucugcuggagauuguuaaaaugcuguugucucaggaagggugaaauuuagccaggagcagucuucaguagcuuggucuguuuaucguguaucuagcugucagcaugcaaaacaaaagaacaaaaggucuaaagaaauauaacgcaaaacagguacgauuugagauccaucaggguuucucaaccuuggcacaacugacuggauaauuguucauuguagggggcuguccugugaauuauaggauguuuagcugcauccuuggccucuacccacacacccccgugugccacucaaaaaugucugcagaccuugccaaauguccccugggggcuuggcggaguuggggggugcauggaaugcccccaguugagaaccacuggcagagcaggagugaagggggagguacugugggggucacugggcacacagaaugccauuuggggagccuggugcaagggaguggccggaugggagguaggaauagcagugguaaucaguaggugaguugcugaagacaaacuaaauauucuuuccagcauugcuucaaucuaauccagccgcaaguaugaguaaauacuguaggaaaggagaaaacauugcauguacggggucagggcagcauugcugggauauuugagccugugggaggggagcuucaagcuucccacuagcauugggaggaacacagcaaaggaggagaagggcccucccugcuucuuggagaaugguuccacuggcaggccauuccgucugcucagcuuccuagcucaggugccuuuccaaaccacacaucagcagggagacagugggaacaucucagguccaggguaccuugggaacugcagagcagcuggguggccugacacuggcauuucucaguguuggcuccauucucuugcuggcacccccaggugggagacucuguuagcagguguaucuuacuaucccuggcucccugguaugcguuacaguucagacucccaagcacaagcucccuguuuugucacaccuguaucuaguguguaacaauccaccccaaaacaaauggcuugaaacacaaggcauuuuguucucucucaugguucugaaggaugacggggcugagcugggcaacucucucccgcucucucaagugguugcaaucagauggggauggggacagagucaucuguaggcccccucaaccacaugucuggugcccgggcugaaggguggaucagcagggguccagggaucucugucucuuuuguggucuccccaucacagggacuugaagguagcugaacaucuuacagcagcucaugucccaagagaaagaccugggagcugucucaucuuuacgaccuaggcuuggaagucacauagcaucacuucugccauauccuauucauugagaucaaugaaggcucacccaggaucaaagagaagggacauggagcccacuucuagauggagaguggcaggguucuggaagaacaugugaaaccagaaacauuguugccaccauuuuuggaagacaccacgauuccuccccuuugaauaauggccuucuuguccuuuaccaguaauaacccaagcugcuuggacauuagcucuucaugguuugcgggguggggaggauguguuuucugggacuucccaagguacacaguagugaaggacuucacaagcugggcugaugugccagcuucaggacuccacucacccccaagcguucugagaugcccauggggcucaggagcccugacuugcacaagccagcaacugccuuucugcuuccauucagccagcuuuacugggcaucuguuauaggaagagcagugggcugagacuucagcaaaaaagacaaaagcaaaacacaaucccuucucuauacaagguucuucccuuucuguguccaaccagucccuccauucucgguccuuaacucaucaccaagccgccauuuucuucuauucccccauuacuccaaggcgggccucaguucucaccuggagucuggcucaggaugccuacagguggccccagaauuguaauggcuugacaugcaauuuuucagcuuuacaauggcaugaaagcaauacacauuuaguagaaacuguacuugaaguacccauacaaccauucuguuuuucacuuucaguacaguauucaauaaauuacauugaguuguucagcauuuuauuuuaaaacaggcuuugccuccuuagauaauuuugcccaacuguaggcuacuguaaguguucugagcacaauuaagguaggcuaggcuaagcuaugguguuaggcagugucaacaaaauagucaaauucugugaaauauuuaaagaguuuauucugagccaaauaugagugaccaaagccugugacaaagcccaaggagguccugagaaccugugcccaaggugguugguuuacagcuugguuuuauacauuuuaggaggacauaaguuacaggcagacaucaauccagaaaggcgggacaacuugaaguggauggggaaggcacaggggcuggagggggcuccgagucacagguggauucagagauuuuucugauuggcaguuaauugaaagcauuaaguuacuaucuaaagaccuggaaucaaggccgggugcgguggcucacaccuguaauuccagcacuuugggaggccaaggcggguggaucaccugaggucaggaguucgagccuggccuggccaacauggugaaaccucgccucuacuaaaaaugcaaaaauuaacugggcauggcgguguaugccuguagucccagcuacucagaggcugaggcaggagaaucgcuugaacccagaaagugaagguugcagugagccaggauugcaccacugcacuccagccuaggagacaagagcaagacucgcucccaaaaaaccaaaaaaaaaaaaaaaaaaaaaaaaacgaaaaccugaaaucaguugaaaagugugccuggguugagauaagaaguuguuagagaccaagguuuuuauuauguagaugaagucucacagagggccacucucaaaggcaauagauggcaaauguuuucuauucagaccuuuaaaaggugcuacuagaugcucagcuaaucucuucaggaucagaaaaagaccugaagggaaggugauucucuacaucaagcuuguccaacccucgugcugcccaggauggcuuugaauguggcccaacacaaauuugugaacuuucucaaaauauuaugagauuuuuuuuuuuuuuagcucaucaucuaucauuagugucaguguauuuuauguguggcccaagacaauucuucuucuuccaguguggcccagggaagccaaaagauuggacaccccugcuauagaauguagauuuucccacaagagacagcuuucagagacauuucaaaaucugucagaaaaauauauuuugggcuaaaauacuuugauuucuuucagggccugcuaucugucaugugaugcucuacuagagugugguuggaauuugguaucuuauugcuaggaagagucuguuuugugagucuuaagaucucuguuuucaguuaaggcuggucagcugugccugaauuccuaaaggaggaggauaaaaugaggcaugacggaccucccuucccaucguggccugaacuuguuuuucagguuuaccuuggaauccccuugacuaagggggcacccauucaguuaguuaaggggcuuagacuuugauuuuuaguuuacaguaggcugagguguauuaaaugcauuuucgacuugcaauauuuucaacuucugauggauuuguucagauguaaccccguuguaaguuaaggagcauguauacuuguaucuaauccacuuugggcauugcugccagaaaaccuguccucagggagcuauggaaguaguggaggcaaauuauuaaauggauggauuaauuccaaguucagaucauguugggagucagcugggagucagugugaggaucugggaggggaacaguaagggguuaagagagauaccccaaaggaugauuaaggagggagaguuggaaggaagguuucccacaaagaggaagcagggagugauucauucugaaaaaggcaaauauuuuauuaugcuuggagggucuggugcagaaggggaaaggaagagaaggaaguuuggcuuaaauucccuuaggagccaguucagauuccuaagcuggcccggacauccaacccaauccgccuagccccagcccucuccaguucccaaugcccagccccacaaugcccguccugcugccugccuguucuggacucugcacuugaccuucccucucccugaaagugccccugcucuuccucacccagcuccccgcucuaagccuuccucgcccaccccagcccuccuacagucccagucugcccuguucagacucaaagccucaugcucaccaccaucauccacaaccaguuuccacgucugucuccugccggcugugagcucacugccucagaaccagcgccagucuccucuagacugaguacaggccuggcacggagccaggaaugcaccaacaaggagccugagacuagauuggaggggaaagagacauguccuccagaguugacuuacgcgaggacagaggugugcagaggcacggcaagcugggccccaggcgagaagcauggagugagggauguggaggcagcggaaggcaucugggagucugggcugccccguagcagcucuguguucugccugcucuuccuccaagaugagcucccuuggccagugugugaaacgugugugugagugugucaccgguaagcugaguucuuucccuacuugguaucaguugcaaagaaagaacacucaguuggaaaaaaaggcaagaggguuuuauuccugaccaggagaaagagaaggagggggcucuugcucuaaagacaccuucaccccgagccauggaaacuggggaguuguaaggagauagguguggggcagggagguguguaagcagguguggggucacgguguggggguggagaccucuagacgcucaggcccaggucauaaacaugccucuccauacaaugcaagauguguuaccagaaagggguccugaucuagaacuaagaaaggguucuuggaucccgcucaagaaagaauucagggugaguccauacaguaaagugaaagcaaauuuauuaugaaaauaaaggaauaaaagaaaaucuacuucauagagcagcccugagggcugaugauugcccauuuuuaugguuauuucuugauuauaugcuaaacuucuugauuauaugcuaaacaagggguggauuauucaugccuccucuuuuuagaucacguaggguaacuuccugauguugccauggcaucuguaaacugucauggcucuggugggaguguagcagugaggacgagcagaggucacucuugucaccaucuugguuuugguagguuuuggccggcuucuuuacugcaacuguuuuaucagcaaggucuuuaugaccuguaucuugugccgacuuccuaucucauccugugacuuagaaugccuuaacugucugggaaugcagcccaguaggucucagccucauuuuacucagcucuuauucaagauggaguugcucuaguucacacgccucugacacauguucagaaauaauggugauuuucuucuacagguggggacguuagcauuauaaugacaugguaaaguucugaagguaacaagggguugccuguuccaguuucugccaguuuugggggucuuaucucccucugguaucugggcagaggucaagaagcucuggcaccaucaggggccagcuuguuucuuuaagcagcugugccuacaaauaaagggacuaaagaaaacaauaagaaaacccaguuauuuccuggggguugcucugguauccagcguguuuuacuucaccaagcgcaauucuucccagugcaggcacuggguguaacugugacagccagcaccaaccugcccacacaccuccuguccugcaggacugucagcagccucugcacuauagugugacagagccacagguagcucaggugugccucagcccagccucuccugcacucccccuccccuggcuccccaacucugccucacuucuguuugugaaggaaagacagcaguagcggaagggaaagaaggagaaaaugcagagcaaauauuaugcuuuccucuuggaaaaccuccaggagcugcaaauauuaguaauccagcugcaucccaccccccaggaugggcugggccugucacacagccaaccuucaggaugcagacacccaggcuggggagcacagcucuggaaauuuacugacauggcccugaaugaauuuaucuuuucaguagaaggcccuggaguuuaaaggagucauucauaaggucugucugggagugccuuguccucagaggagggucuggguggguuggaguggaaggaagggcuggcuaccuggugugcucuccguggguccccaagaaaggcagcccugcugggggcagugaagcccuuauccaggucacgugagucuuggaaggggaaggcugcugugcuuaacgauucaaaaacacaaaucaaaccuccuuucccaaacaaauuagaagguguggaggaagcuugaauucagagaggauuucccagagacccauaggcaaaaguggcuuaacugagcccagugggugucccagaaugggccagagagaaugacacuaaaaagucuuugaacaaaugagcaaaugaauacaggaaugcucaucugccauaggcacaaacgugguaaacguucccugagagaacugacagcccaggggugcagggagagaaacggucccaacugcagacugggucccaacugcagacucggucccaacugcagacucaggaggagggaggcuguuaaggggccgucuuuccuucuguuaugugaggagaaaagcagggaagggaccucaaggccagccucucccaggagcugcuguucucagccccgggauccagcgcuacagggaagugcaggggaggcuccacagucccggcuggagacccggucaggccuggguggccacucuucuuuguaguggccacccucgugucaccagcaaaugcuuuuguaucuacacccuucucagugcucccccucuuuuaaaaaauguacuuucuuuuuuuaaaaagaguugggucuugccuugucaccuaugcuggagugcaguguugcugucacagcucacugcaaacuccaccuccugggcucaacccauccucccaccucagccucccagguagcugggaccacaggcacacaccaggacaccucgcccagugcucacuauuuaccuuuauuucuuccuuauucggacaccccuugcuuccaaagaagaguuucggaaggcucaagacggugagacagacaccuuaugcacugcuucacucucccccgcagcuccccucccuccucacugacccccggccacaacccucucuccuugccccucaccagccggcacccuuggcaacccuggcacccuuucgaggacaagacugccaaauguggccaaggucuggcacaccauguaccaaucgaaacuccacuucccuugaguuucaguuuccacgccuauaaaauuagcaaaugaaaagagcaaacacuuggagacacuguucucaaugcuuugcauauuuuuuucauuuaauucucagugccaugagacagucuauuauuauuaaaccuauguuauauaugaggaaacugaggcacagagggaguaguuuccccaggucacagucaggauuugaacuccauggucuggcucuaguguuucccaaccauucggggugggagugggagagaaaccagacugcucucccuagaaaacagcauguguuugcaugugugccaaauuugcacaaaacauuugggguuccaggucucuaaagcccauccauggaaccccgguuucccuucucucacgugauccuaacaaccugccgaggauacaccucaucaugauccuccuuucacagcugagaacacaccagcuuagagaaauuaagaaguguauccaagcucacacaaucuuaaguggccagaucaggaccaaaauccagguccucuggcugggcgcaguggcucaugcauguaaucccagcucuuuggguggccaaggcggguggaucaccugaggucaggaguucaagaccagcuuggccaacauggugaaaccccaucucuacuaaaaauacaaaaauuagcugggcaugguggugggcgccuguaaucccagcuacucaggaggcugaggcaggagaauugcuugaacccaggaagcagagguugcagugagcuaagauggagccauugcacuccagccugggcaacagagugagacucuaucuaaaaaaaaaaaaaaaaaaauuuguggucuucuaaccacaaaucuagugccccuccccaaccaccucugguccagccucuuagaucuaucugggaugucuuuccaccauacuccuuucugguuugagaaccaccugaaggcucaacguggcuguggggugcuccguggagccauuuggccugugcccagcagcgagggggacagccagcaaagguacccccgccccugccagccugccaccuacuugggacguuucuuuucuuuuuuuuuuugagacggagucucgaucuguugcccaggcuggagugaagugacguaaucucagcucacuacaacccccaccuccuggauucaagugauucuccugccucagccucccuaguagcugggacuacaggcgcaugccaccaugcucagcuaauuuuuguaucuuuaguagugacgggguuucacuauguuggccaggcuggucuugaacuccugaucucgugaucugcccaccuuggucucccaaagugcugagauuacagggugagccaccgcacccagccuacucgggaccuuucaccacccaagugaccagcaccccugcccagagugccccgguucuguccacuaggccagcagggaccccgccucugggauuguuugcuggagggguccuggacaacguagaaagggcagcacacagcccugggcaggaagggaggcaggaagagagauccucaggggcugggcuggaggagcaaagccagccaaaggggagugagagggcagucaagcgccuagaagccaaggaaccccaggaggauggcaucgggcaggugccuccuggugcccagagacaaaaagaugugugggaaggugacagaaucaagcgguaaggucagugcuuugagggagcaggcaaccaccagccuccagugacacuugccuuucacagggauccuggagguccccauuugggaagguggaaaaucucaguuccaaccuaaccaaaagauacaggggcaaguuuggccuugaaacccuggaccaucugcccugggugauuuccuuucaacagugcuggguccagacucccagaacccuaccucucccaucuuccccaguaagccugcuuucaguccuuuucacacgagagcauuuaaauccaaggguucccuucccccuggguauuugcagcccaucugaucucuaaauguagagugagagccacuuguagaaauuaagucuaggcuggucacgguggcucacgccuguaaucccaauacuucgggaggcugagucaggaggaucacuugagaccaggaguuugagacuagccugggcaacauagcaagacaccucuacaaaaaaaguuuuuuaauuagcugggcauggugguaugugcuuguaaucccagcuacaaggugaggugggaggaucacuugagcccgggaggucaaggcugcagugagcugugauugcaccacugcacucuagccugggugacagagugagaaccugucucaaaaaaaaauaaaaauaagaauaaagaaauuaagaccagauguaggggagauuuguggaggaagggacaggaggccccuaaaaucccauccuguaggcagccccugcuugacuaagcauaaggcucguggggcacccaggugggcuuuuucuggagaggaagcaaggcagaaaaccccuccauuuuccauccccagccucucaggucugugccaguugagugucuuccaggacagaagcauggcuggguauggaggcagccuggauauagggauggccggucugucaagcccguggucaggaccuucacggggcagcuuaggaaccuccaggcagggccucaucugcugccguuaguaauaaacauggccagcaacagccagggcccugcuagcgggagaugucaucgguagccaccuuccuucucugcagagacaccgucugucccauggaugagcagaguccccuggggacccagcucugacacuuguccuugcucauguccagggugcuggacagacugaggcaggugucaggcuccugggaugagaaaggcagaugagagaugggagugggagcuuuacagugacuuaggcagaauugcuuaguauuuacauaugccuuaccucauuccacagagaauuuaaggccugaccaaaagagacggggcggggggugggggggagagaauacaauaacaccauguacuguaaagaaaaacagucaguucuaaaagaaaaacaacccagaaagaagggaaugugucaaaaccgggagaggggaaaaaaaaaggcaugcaugcuuucaaaagcaccuuaggggcuacagaugggcccuauacuuaguguugacacccaacagccauaaaagaaucucacugugcccccaggggagcacagggaaggucugauucuagauuuuuucugugccauuuauuuaucuauauccucaugcacaaguucuauacuguuuuaauugcuguagcuuuuuauguguuuaaacaucuaauagagguagacuuccuucucuuagauuuuuuucuagcuaugcuucauauuuaauuuuuaaauaaacuuaucagaaucagcuaaguucaaaaacaauuuuuaaucuuauuaccuuuuuuuuucuuuuuugugagacggggucuuguucugucacccaggcuggaguacagugguacaaucauagcucacugcagccuugaccucccagguucaaagugauucuccugccucagccucccaaguugcugggacgauagaagcaugacaccacaccuggcuaauuuuuuaaaaauaauuuuuauagagacagggucucacaguauagugagauuucaggguggucuugaaauccugagggcucaagaaauccuccagcccuggccucccaagagcuagaauuacaggcaugagccaccguaccuagcccuauugcuauuuuuauuagcauuacauuaaguuuauaggcuaacuuaagaggacauggcauuuuuaugauaaugaguuuuugcagucaagaacgcaggccaguuuuuuuuaaaugggguaaaugauuguccaagcgccuccaggcaggcucacgugcacacucuggagucagugaagaaggugaacagcugacaggagcagccucccagucagagaagcccugcacacuguugcaaacagacagcuugcaucuggagucuucugugauccgaggaggaagcguggcugaguccuucccagaagagggucuggagcugugaguuggggacaauugucagauucuagcagugaaagugguucaugugcaggugcaaccugccccgcagucacgggacacagccacauggagccgagccacgcucucagagaaggagccagggaagaaacacccuaacugcacuccucccuucuucuggcccccagcagccauaggcccugggcccccggugagauacccauagagaucagcucccaggcagcaggauggaggguguagacuggacaugaagaggcagcuggaauguaucgggcacucagcuccagcucaccacgauccaggcacucaaguucccaagacaauaguuucugcucucagauaaauggaauaauuaaggaucaaaagguuaucaacagguaaccaagcauaaacagauuuuuuuuuuuuuuuuuuuuagacagagucucacucugugccccaggcuggaaugcaguggugcaaucugggcucacugcaaccuccaccucccagguucaagugauucucaugccucagccucuccaguagcugggacuacaggcgcgugccaacaugccuggcuaauuuuuguauuuuuaguaaagauggaguuucaccauguuggccaggcuagucuugaacuccugaccucaugugaucugcccaccucggccucccaaagugaugggauuacaggugugagucaccaugccuggcccauaagcagauuuuguaccugagcaggaaggcuaagagcuuguaacaacugaacauuccccccggagaggaaggcaggaguuuugcuugugccaagugcacuguucagacaguccucugagguacaccaaggucugaguagccaucccacccuccccucugccaaaauuuuugugugacuggagagcagagcccuccuccaaaaauaaaaugagcacaaggaaaauacuauuugcagauacauaauauuaaaaccauaggucuuucuuuuucuagucccauccauauggcaacauuccaggagaggccuccgucacuggaaggcacccucaggggcuuuccuggagcuaaaaacaguuuaagccaaaaguuauuuguagcaucugaguuaaacucuucgucucacccuucucgagcuagcuggcuuauuuuauccggaccaggauauaacagcucuaaacaggcuuugccaggaagagacgucauggacuucaaccagggcaccugaccaggaagaaaucacugcaggaugaucugaaagaguuuucauaaauuauuuuacguaagguagauucugaccuugauggggacagccaagguucuggacccucagcugggaaagaugggacuaagucuacaacugcugagguuguagaacaggcuucuuguugggaggaacccucuuguggacaugggccgucgagguggagugagagaacaccgugccaccuggacgcugaaacaccauugagucaccucuguuugaaaugcuuguucccuggugccguaaagaaauagcacuugaacauaaauuuaauuuacucagcaaggacauuuuuauacuuucugugaaaggguacacucaccaggaguuuugccacgagaguacaccaaacaaaggagacagggucauuuauaaccugacgcguccacccuacugcuguguccaguuuccauuggcuggaacaggaccucccauucuguauuugucccgauuggcuaacaacuuagaacuuuuuaaaagaggcaaaggcagaggagaacaaaggaaggaggaaguaacuuguggaaugcugagaaagguaaaaacaccuuuagauaaggaagaggaacaggcuaugaccuaaugcuugcuuggaccaguauaagcaugccagggaaaauacuuaggcuaaauugugggagcuaagaacauaaaguacauugauuucuuuaucauggcuagcagauauuuaagaauguuagcacaggucuuugaauaaauuuugcuucuaagagaaguuacuauuuauuccuaauuaaauggggaggaaggucuuugaagagaaaccuuuacaccucuuaaggacaaaaguccccaagaccuguccaauuucgaauucaauuaggugaauucgaaauugacaccagccucuuugcagaggagacuguuuugguuauacaucaaaagccugugcuuugcagauagaccugacagccacuaauuagcuaggagcguugggugauccaguccaccuccuuaaaccucaguuuccucaacuaugaaauagaaugaaaauaguaccuaccuuggaacuguucugugacaaggaaaugagauaacaugauaaugugcauaaggcuuuuagcucggggccuggcacaccuaagccuuuguguaaucauuguguagaucuugucacugagaacgcuuacacgagcagauauuaaaauaaaggaaagaagucaguuggguaagggagcuucccagcuugguucaaaauauuuugcugauuggggugagggaaagagugaaggaaccagaagcaaaaaaaguaggauuucaaaugcuucccaccuuuuuagaaaucaagacauucuuuaguggccucuacaucuccuucaacuccagaauuuggaaaacugaugaaaaacuuuuugaaucuuuggcuguaaaauguauauauauauauaauguguauauauauauauauauauauauauauauuugagagggagucucauucuuguugcccaggcuggaaugcaauggcacaaucucggcucacugcaaccuccgcuuccuggauucaagcgauucuccugccucagccuaccgaauagcugggauuauaggcgcaugccacuaugcccagcuaauuuuuguauuuuuaauagagacgggauuucaccauguuggccaggcuggucucaaacuccugaccucaggcuaucugcccgccuuggccucccaaagugcugggauuaagaggcaugagccaccaugccuggccucuuuuaucuuuuucuuuucuuuucuuuucuuuuuggggggcacagagucucacucuguugcccaggcuggagugcaguggcgugaucuuggcucacugcagacuccaucuccuggguuuaagcaguucuccugccucagccucccaaguagcugggauugcaggcgugagcuacaaggcuaccaacugacugacucaggggaugugucuccgcuuaccauagaucugucauuagcguauauaggccucaaagagcuguaagcaaccaugucuaagugcuaacaggacaagcuaggucaggaacucucaggaugcuaagucaucgacuagaauucaaagaauucagugagcuucagcugguccugcuggcucacgccuguaauaccagcacuuugggagucugaggcaggcgaucaccugaggucaggaguuaaagaucagccuggccaacauggggaaacccugucucuacugaaaauacaaaaaauuagccaagcaugguggcaggugccuauaaucccaucuacuugggaggcugaggcaggagaaucacuugaacccaggaggcagagguugcagugagccaagaugacaccauugcacuccagccugggugacaagagcgagacugucucaaaaaacaaaacaaaaccaaagaauucagugaacuucaauaacauauauauauguuacugauauauauaacaauauuacauauauuacauauuuuauauauauguguguauauauauauauauauauauuuuuuuuuuuuuuuuugagacagggucuugcucuucugucacccaggcugagugcaguggcaugaucacaucucacugcagccuccaccuccugagcucaaauaguccucccaccucagccucccaaguagcugggacuacaggugucuaccaccacaccuggcaaauuuuuguauuuuuuugucgagacaaaguuuuaccauguugccgaggccagugucgagcuccugugcucaaacaacccacugaccuuggccucccaaaguguugggauuacaggcgugagccgcugcgccuagucuucaguaacauuuuuaauaaaccugucaauuggcgaaaauaaauccaacagugaauuaaacuccuuugaggcuacuucccauuauugucaugggaaauuguaggaaagugcacauuccuuaagaauggaguaaacuuccucauccucuucccaggcccccuccccuuuguuuguguuuuguggugaagaugaccccucccugcaaaccaucugggugcuguugcuggcaucagcuugcuucuaacugcaugaaaugauuguggugccugcugugcugagaaccuagcacuggcaccaaaugggugccgagugcuuacacaccugcucucauuaugccucacacuuauccaugucaugggggaggguucugaggcucagagagggaccaggcugccuggccagcugcccaccucguugugcccauccuugucuaccccuugaagugaccucugccccuccgcacagaaacccuucgggacaguccagccuucugccucugacucagggcuuuuccaucugcacugcuccguacuuacuuccugcgacuguacucccugccagagccucuuuuccuggcucugaccuuccuccuaggaggcgugcaacguuuguccccuucccaucuagcacuacguuuucuuucucucacucaaacuccccuuuauauauuuguuuguuuauuuauuuagagaugagggucucccucuguugcccaggcuggagugcaguggugcaaucauggcucacugcagccuugaaauccugggcucaagggauccuccugccgcagccucccaaguauucguauuauagcugggacuccagguguacgccaccacacccagcccaaacucccauucaaagccugugugcucagaagccucugcagcugcgcugguuucauucucucacuguggagcaucugcugcgaaucaggugcaaggcugggcucugagggcacaguucagccaccagaguucugggucuuucagggaaugaaauuucccaucucugcccaaccacaacacagcaaaaacauuucucccuuugcauuucccucaaaauacuagguuggugcaaaaaucacaauuacuuuuacaccaaccuaauagcccccaaacccucugacccaacccucauaugggggacugccugaaacuucacucugucuauucacagguugucuuaggcuuuaagccccuggagguggagacaagauuuuuaacauccuccugguucuaagacccucugauaagagcuccuugugcuguguucacaggugacugcuggcugcuggcagccauugccucccucaccuugaaugaagaaauccuggcucgagucgucccccuaaaccagagcuuccaggaaaacuaugcagggaucuuucacuuccagguaacuuaaugguuggcucaggugguuccucaacagguccagggggcuaggaacagucuucuggcuuggcuggguucaucagucccugguguuugcagacucccaagaccaauacuguucuacaaaggacauugggcgagagcaggaagcuuccuggcuuacccguggccaggaugugagacccggcugggauggcccugggugguuucuugggacauguaaaagggagguagagcaagguguucaggaacuaauucccaaguuuaaaaaaaaaaacuguauuauuugauguuugagacaaaaacguugaaguucuccuccuuuuaugccgguaaaugagaaauaauacuugaaaaagcuggcugggcacgguagcucaugcccguaaucucagcacuuugggaggccgaggugggcagaucauuugaggucaggaguucgagaccagccuggccaacaugaugaaaccccaucucuacuaaaaguacaaaaaucaguugggcguaguagugcaggccuguaaucccagcuacuugggaggcugaggcaggagaaucacuuuaaccugggaggcagagguugggaggccaagguggguggaucacuugagcccaggaguucgagaccagcuggggcaacaugcugaaacuccgucucuacuaaaaacacaaaaaaaauuagccgggugugguggcacgugcccuuaaucccagcuacucgggaggcugaggcaagagaaucacuugcauccaggaggcagagguugcagugagccgagaucgugccacugcacuccagccugggcagagcaagacuuggucucaaaaaaaaaaaaaaacagccuaagguacagggcagaaugcuaaagaggcggguguggauuugaaaggauggacaugcgccucugucuucgcuuuuuuagugaggacuuggccugcauaggagaguuaagggagcaccuccucccaggaugcgcucauggaaccuaucccaggggaucagggcaaggggagccagaggcagcugaggcucagagucccagugcugccaccagcuccuccugcagcccaccucucuuguucugcaguucuggcaauacggcgaguggguggagguggugguggaugacaggcugcccaccaaggacggggagcugcucuuugugcauucagccgaagggagcgaguucuggagcgcccugcuggagaaggcauacgccaaguaaguugccauccuccccuggccccauggccuucccccaaugcccuggauuccaaaaaauucacucaugccuguaaucucagcacuuugggaggccgagguggguggaucauuugaggucaggaguucgagaccagccuggccaacaugaugaaaccccgucucuacuaaaaauauaaaaaucaguagaacuacuccaggacuacuuugagugggaaguccuuuucuauagaaggacuucuuuggccaaaauuaggcucuaaaugcaaggagauagugcaugcagggugccuggcugcacuguacgcugauaaaugaugucuaucaccaucuuuaaccaaaugcacaggaacaaguuaugguacugauugugcuggacuugagaaggagcucuacuuccuugacaggacacauuuguaucaacuuaaaaaagcagaauuuuugccaaugggcagaacuauucauugcagagguaggaaacuugcccagaauagaugaugucacugauuagcaauggcuuccccaucuccgcacagcugcuucccacccagguugcccacaguugaguuuguccagugcucagggcugcccacucucaguaagaagccccacaccagccccucuccacaauggccccauguuggcugugccgcccggcuccuuccauuaaagugaccccacuuuagagcagcaaguggauuucuguuucuuacagucccaauccaggaaggaggagucagcugugagaaccuggagccugacggaugcuucuaagucccacugcucaauacuggggucagggaagccaccggacuccagcaucagcagucaggagcacuaagcccuugccaacaccgugccuguuucucagagaaacugcuuccauuauugaaugguuguccuuuuuuaagcuaucaaugccaaacgacccauuaguagaccuccccuuucuugucaggauguagaaggaaucaauacaggagguucauccagaaaaucacuaagguccuuccgacucuaagguucuacgagaaucuuuuuuuuuuuuuuuuuuuuuaauacggagccucauucugucacccaggcuggagugagcggcaugaucucagcucacugcaauuuccacguucugaguuucagcaauucuuuugccucagccucccaaguagcugggacuacaggcaugcaccaccaugcccagcuaauuuuuuuguauuuuuaguagagaugguguuuugccauguuggccaggcuggucuugaacuccugaccucaagugauccgcccaccucggccucccagagugcugggauuacaggcaugagcuaccgcgcccggccugagauuuucuuuaaaacacaaaauaccagggaaaugguaacuguggacauuauaccuugccuuccugagcaccccgagcugggaacaaggccaaggagaaugugagcagggggucccuggagcaucaaaucuagacgguacuaggggguggcuguuugagagauuauagcaucaguagugucaaggguagcggcagcgucuaauccccucuuguaggaucaacggaugcuaugaagcgcuaucagggggugccaccacugagggcuucgaagacuucaccggaggcauugcugagugguaugaguugaagaagcccccucccaaccuguucaagaucauccagaaagcucugcaaaaaggcucucuccuuggcugcuccaucgacguaaguccaggcugccuucccuagccucaccccaucugcucuugcugaagggaggcucccacagugcccaagggaacccacugcuccuguguacaacguaaugcagcccucguccacguaggggccaaaggaaaaccucccuccacccucugaagguccgcugaaaaucaacuggcaaaaggaagacuaauacaagaaauggcauacaaauguaugaauguggacaggggagaaucacaagagauuucccuaccacgcauugggauacagaggguuauauucccuuccucuuaggggaagggagauggggaggugcggaugauuuuagggaugucguaaaugauuuuuaggggaauucauugggcuuaaagaacauaaauggucugggauaaagucuguugggccugcagagcagacagugguuugugacaagucugucuagccauguugacagacuugucuuucuuccugcaauaugaguucaguucauaauaacucauggaaaggaccagacgucauuguuuucaucuuuggcagguccagacuuuaggcaggugagggaacuucagagaauagcuuccuccugugcuuugggggagaguggaucgagagacagaaggaaaggggaggucagagagaucuugaggcuucuucaguuuagcauuucaaagugccaucucuuagagguauugguuucugagcaccccagugucuaccauuauugcucaucaccuggaagccaaggguugcuaggcaaaagucaagcugucugggguguaauggauggggugauggugccuccagcccuucugucuucaguccacuucccacucuuagccugcucugaaucacccccaccccucugaccacagguucccugggagccccugccaccugcugccccugccaccuuccccuccaucugcagugcugugcagccuuccccugcacucuugcagagcuaauaggcccgugggagacuucggaaggaagaggaggaaagauuuccucauaauagccuugcuggcaacgcucaccaggggaugggaggugggcacugugcccaggagccuuggagcaaaggcugugcccaaccucugagcccugucccauccagguucuggucucugcgggggacagagauaagaagcccuggcuuuuggagccaaaaucuaggucagacucccuaggcaggaauucucaaaguuuaucagcagaacacguugaggcagaagacccuuucugcuccagcccuucuucccaggcucaaccuucaucagaauagauaggggaaaggagaggcugugaggcguucuuaaaacagaagcaaauucugacucagaccggaauaaacaaccguccuaguauaaacccuacagcugggcugggccagaccacggagcaugggcuggugguggggcgagggugugcucagugucccugggccacucaaggcugucuggguaucagcccugcgccaucgaggacccccuccggcccucucucggccgugcgcccuuucccugcgccaucgaggacccccuccagcccucucucggccgugcgcccuuucccgcccuucccagccugcagaaauccguggaugcgcuauucacacgggaaugccugugcucguuccgcgagaggguugcauuccgccuuuucucugguauucucggcguucaagcauuugaacgggguaggaaagguucuccaagugcaagaaagcgcagcccugagccucccaccccaggccucggccgcugcgcuagugcguccggcggucccgcccggcaguaggacagagggagcgagggaguccgggaggaagggagagcgggugcggccagucugacgguugcuguguuugcagaucaccagcgccgcggacucggaggccaucacguuucagaagcuggugaaggggcacgcguacucggucaccggagccgaggagguaacggccggcgcggaugugcagggguccugcuguccugacacgauggccacaggcacaguuuguggugaugcccaggggcccgcgcggccccacggugguccaguuuacacucgggccccgcacuccugaaguuccgcgcgggaggagaagggcgucccuuucgcagcucgggcgccgggugcgccgcgcugccaccugguggccgcaguggccggcgccaggggcccugguuuuacuuguuuuagauguuacccuguuuuacaguuacaaccuuacuauuuugauaagcuaaaaauaauaaaacaaugcaucuucauaguguuuuauacucuauaaggugcuuucucuuuugaucucguaaaaguauucgugcccauguucaaaucugacugccucuuaccagcuguguggccugggccaauuacuggaacucucugucccuuaguuuccucauuuaaaaaauggaaauaaugauaauauccauuggaaggucguggcgauucaaucaaguuaauauauguaaagugcucagaggugacucacacaucauauauaaggagguagcuguccuugcuguugugaucacuguuguuauugaaaauauuaugggcugacaugguggcucacaccugaaaucccaacacuuugggagaccgaggugggaggaucacucgagccuaggaguucaagaccagccugggcaacguagcaagaaccugucucuacaaaaaaaaguuagcugggcaugguggcaugccacugucgucccagcuacucgggaggcugaggugggaggaucacuugagcccaggaggucgaggcuguagugagccaugaucaugccauugcaccccagccucagcgacaaaguaagaccaugucucaaaaaaaaaauuaucaagcaacucaaguucacuguuaauuacagaacccagucuagaccgcagaucuucugcauguccaguguucuuuuuuuaaccuugauuuuuuuaacuacccccucacacacacacgucuuuuuauuugaaaauuuucacguauacagaaaaguugaaagacuaacauaauaacuauccaauugccacuccccuagauucaccgauugcuaacauuugccaugucugcuuuaucuaugugugcacuuuuuuugagccauaugaaaguaaguugcagacguuaugacacuucccuccucaauacuucagcauuuauucccuaugaauaaggacauucuguuacauaauuccucuacuguugccacaccuaagaaaauaacauuaauucaguagugucaucuauuauaaagucuauacuaacauuuucccaguugcccaaaauguccuuucuggcgacccaccccaaccccauccaggacucaauccagauucacucacugcaugugccuguuaucaccagugaucuuucaacaaaugguaaagcuucucugagcuccuuuaccaaaagcgcauccugucaguuaagcugaaguucagagaugaagcaccaacagccccauccucgagagccggauccugggagcuuuaaaucucauuuuccaaagcuaggcagcagugagaggucugggugccaagcccccucuagcucuugugauccucccucauacauggacucaacccccaaauccuccccaccguccucagccccauaccuccuggcucaugcggaaggggguuggaggcccaagccuucauagcccugacuugaacucaaccucuuacuccucccuuuuaucuaauccugcagguugaaaguaacggaagccuacagaaacugauccgcauccgaaaucccuggggagaaguggaguggacagggcgguggaaugacaagugaggagggcgcaggccucggggccccaggcgggggugcauugugcugggaggcucugggaagagggcgagagaagaagacaugugcauuauucugagaaauauagccaggagagcccaggccacguggacagggacccguggacaggggccccucaaagggucuuuuaaccaggacacuccuccagcagccugagugccuucuuccaggccccaagcugcucgugugaaguucauuccugccacugccuccagguucaccccuucccuagcucaaauccacccuucuauggggcuuucagggaaaaaaauacaccccaccuucccccaggcacuucuauuacagggaugugaacuuuguaccaaaggccagagaaacaucccucuguugauuuccagggcuuacugguaggcauguugaacccucaacuauuugggguaaacacuuguuuguacaucugcuguggcaaccucagccuacuugcucugccucagguuggagaggugggcaguacagaggccuguguguaauuccagccaaagcucaggcagugguuaguuuacccugugcacugccccuguguacagggccagguccuucugcuccguggacagagagacaccugcugaggcuucccaggccucagccggaggcuccucaucagaucuucaguugucucuaaaagagcugccaggcccaucucaauugggcaacugcucugagcuacuccaucucccucuaaugaacuauguucauuuucuggacucuuccuugccacugucuuccagcacaacucacccgcucacuuugcucccugguuugcaucuguauaguguucuauacucuuuaaagugcuguaagaguauuaaaaugcagcuguuagccagaugugggcuacuuucccccuuucuggagccugagcccucagaggugagagcagaugucccucuuccucaacucuggggccuuuggggagaaaucaucguacacuaacgccucucucuuuacuuuguuuuccagcugcccaagcuggaacacuauagacccagaggagagggaaaggcugaccagacggcaugaagauggagaauucugguaagauuaguggaggcuucagggaaagcucugucugccccaauguucuuuacuagaaaacugcuaauuagaaagagugucggccaaagugaguuuaccaugucgaggacacaagcgugugggauccugguuuuguuauuuuaaguucacuauaagagccugaauaaagaaauucuuaagccccuucaacgguccaucuugacaaugggguuuauaagcugagcagcuucagaaaaaggcuaagaggaauuccuuugguaauguucagaucccaggaaacaagggaaagauggggccuuucucccccagguuccggagacucaucccagccccuuaagaaacuggucccuuagugagcagcaauggacccacaugucugugugucugcgccacucuauaaccaccugcaccuggacacaacaugcucuuuaucaaauggggcccauauauugucacauuugaugggcacggcucccauuuuugcaggugagaguucugagcuucagagaaguuuaaguaaccugcucaaagucacccagcuagaaaguugcagcgccaggacuggaaucugggccuucugauucugaaccuggugcccauccacucaguucuaaugagcugcucugccuggcuuuggguggcuccuggucugguguugguggaaagucaaggcuuaccagugugucuucuuaucaccugugaugauugucucugcuuuugccaggaugucuuucagugacuuccugaggcacuauucccgccuggagaucuguaaccugaccccagacacucucaccagcgauaccuacaagaaguggaaacucaccaaaauggaugggaacuggaggcggggcuccaccgcgggagguugcaggaacuacccgaguaagggcuguugcauauaagggcuguugcaaugcggggccaccaaaggccaaagcuccccuuaccccacccuguguaccacaccccagccuagcagccccaggaggcagcuccugcucacuggaacccucucugucuucuuucucccugagccuuuucuuuucccugagccuuuucuccccgagcucucuuucucaaucccuuaccuccugcccuacccaggacaaacccaagagccacuguuucugugauguccucuccaggcccuagauuccccagcgcccaucaugaccuucagccugaccuuccgccaugcucacggaagcagugcucaaucccacuucacggccaugagcugcucuaugcaccccacacccaggcagccgagccuacaagggaaccuugucccggcacccagggagcccuccacauaucaggcccuguuuguugccccauacucacuucaaucagcaaauguugacugggcgcugcccagauggggugaagauuucuccucugguccagccuuuguugagccccuugauucuucugccuucauggcuuaguccgucagcaguugucugaacaugaugacaucugccaauuauggggcacaccuucagugcuuggaacuauccuaaguguuuuguacacagggugaggauccauaaucugaaaaugugaaaucugaaaugcuccaaaauccaaaacuuuuucagccccaacaugauaccacagguggaaaauucgacacuugaccucaggugacaggucgcagucaaaacacagucaaaacuuuguuucaugcacaaaauuauuuuaaauaugcuauagaauuaccuucagccuauguguauaaauuauauaugaaacagaaaugaguuuugucauuagacuugaguuccaucccuaagauauguuauguauauacaaauauuccaaaauccaaaaaaauccaaaauaggaaacacuucuggccccaggaauuucagauaagggauauucagccugcauaacauucuaucuaaccuucccaacaaacuucugaggcaggcacuuucuuaucaccuccaucucuaagaugaggaaacugaggcuuggagaggcuagugacuugcugaaggccacagagcgugcugggauuugaacccaggcccccugacugaggagucacuguguaaguacaguggcagcagaucauggucacauagugauucucugugacagaugaggaagcugagccucuaagucgcauaccagggccacagagcaaguagucagacugcggcuagcuggccuacaguucuggggcucggacuccuucaccucaaguaugcagccaccaaguggcagucccagaggcgcugggaaggcccucugccccccacaagggaccccuccuacccacuagaucaggagucggaaaacucccucuaaagggucagauaguaaauaauuuuggcuuugugggccacucagucucuauaacaacaacucuauugcuauaacccaaaggcagccauacuuaagcgaauggccguggcuacguuccaauaaaacguuauuuacaaaaacaggcagcggccuucggagccauagcugccaaccccuacacaagauggugccuguaauuucacaguuaggguuuuaucccauuagguauggaaaggcaauuagcauaauuccccuuaaacaugaaugaaucuuagauuuuuuaaauaaauagguuuuggaaguaaagagggcagagacaucaggagcagggcaagggaauaggccugagaggacaagggacgcagaacaagaaagagucuggaauuauacacaggauguucuuggccuccgggcucaccgagggggcggcgaccggcaagugcagggagcagaucccggagucccccaggccagccgagccccgccccaggcuccccaucagagcccagugaagagaagguaccaugaggggaagccacagcucuaaccacccugcguuccagagugacagaccaguccccaagacaagccagccuggagccagagagagaacugcaagagaaaguuucuaauuuagguuccuguuagauucagacaagugcaggucauccucucuccacagcuaccgucacccgucuccagccuaacaaagccugcaguccacacuccaacccuggugucucccaccuccuagccucucccaacaucgccugccgucucugaccaucuucugccauccucugccaucucccaccaucucccacugucucccacagccucccaccgccucuugccaacucccaccaucucccgccauuuucugacaucucccgcugucucccaccaucuucugccauacucugccaucucccaccaucccccaccaccucuuaccaucucccaccaccucccaccaucucccuuuaucuccaucccucucagaagccuccaagccugagaccagggccaccccccacccccaugcauuccugcucagggcugggcuccucugccccuuucuggcugcagacacauucuggaugaacccucaguaccugaucaagcuggaggaggaggaugaggacgaggaggauggggagagcggcugcaccuuccugguggggcucauucagaagcaccgacggcggcagaggaagaugggcgaggacaugcacaccaucggcuuuggcaucuaugaggugcagagcgcaggggcuccugcccucccuuccccauguguucaucucagccccugcauggaaagcugaccccagaggcagaacuggggaugggaucccagaccgggagcuuggccaaggaaaaacaaaacuaccagccuggccaggcucaggaguagcccccguagggaggccccugcaguggcucuggguuguggggccuucuaagcccuucacgggccccccacagccagccugcagggaguuccacucucaaauggccuccacaucccuucucacauccuccaggccuggcauucuggucagccuacccaucuucaaagaacagaauauacugggccacaucaggcaauacugugagggcaggacugaguccaugggugcagcugcucagagcucggcaaagucauuggccuggaugguggagagcuuggggacaggggaacauuggucaugaugcuccccccagggcucugauggcuggagcccagaucccuacacagacuccugcuguaugcguguuuuccuuucacucugagccacagccagagggcagccgcauugcagucuccucuccgcccucaggcuggggcuggggcacugagaacucacccaacacgcugggccccugggcucuccccacucccuucugcaaaacaagaaagagcuuucgugggcugcagguagccaugcgaggagagggaugaaaggaaggcuuuagggcacugacuggggaugcauuucgguuugaugggcuggagcuggcuccucccggcucccaaagcccaucucuuuucucugacccaugucugcugagguccuucagcagccugaaaaauggcccuggcagggaccuguuuacaccauggaaaguggcaaauaguacaaaucagagcuuccacccucucccaagagccaguuucccagcacaccccugggagaauccagacgaggugucaggagaggaggcucugugcucaccacuggcaacguugccacccauggaacacugacuucuaccugcucacccaccugagaaaggcagcugggcaaauaccaucaguuguaaaaaugcacauaggccuaaaccccuccgucucugaaacaggagcugaggacuucggaucugggacagaaucgauccaaggacaaugcaaauggaauugugauacacagcuucccucccaccggcuuaugggcuuggaaaugcagccacgggcuuucagaguugggacggaccuuggggaucacuggguccuauuuuugagacaagaaaacugaggccagagaggagaggggacuugcucaaggaaaugcagaccggaccacuggaccuggcugacagaggccggcacugcuggcuccuagccccagguguauuucaccucgccugcugccuccuccaacagggcccgccuggcccucuuucccugcgugggaggccgauaugggcuuugccaccuuagacaagucucuucacaucuccaugccugagauuuauacucuaaguuaggaagggaggugagggcuuaucaacauaagaggauuuucuucaguguuggagaggcuuugaguuccuuggaaaacaguuacucgguugaauuaguugauauugcuaaugcuacagagaaaacgggggcagcggaagagaagagcacagugaugcauuuucuuacacugcuuuuccggcaucugaauugcaucuccuuuauuuugcagguuccagaggagguacgucuggcccaugucccggggugcucaggucaccaaaaaagcgagaggcuuagacugcuggagcucagggagcgucgugaagcccgggcaggggcugguggucaugaaggaugaguccuggccaccccuggggcccugcugaaguugcccaggcucuagaucccacuggucuaagcucugggcaagguuucuggaaaguccuugugggacccgcugccucccugugaccuggcagagcccauacaggguuugguucugggcagaaaauccaugauccugagacugcaggaggcuuuucacaaaguucuuugucacucuuaggagaagacugagucagggaaaaggugaacccugcagacuguacuagaagacaacgcgggagcacagaggagaccaggacccaauucccaggcugugugaccuuggacacguuacagcuccucucugcauuucaggguuuuguuuuuuuuuuuuuugauuuuugguuuguuuguuuguuuuuugucucgcucuuucacccaggaugaagugcaguggcaugaucucgacucacugcaaccucuaccuccuggguucaagugauucuccugcuucagccuccccaguagcugggacuacaggcacgcaccaggaugccaggccaauuuuuguauuuuuaguagagacgggguuucaccaugguggccaggcuggucuugaacuccugaccucaggugauccacccccuucagccucccaaagugcuaggauuacagguguagccaccgugccuggcugcauuucaguuuauuuuucaguaaaacuggucaaccauccaccucacugcacuaccguggaaugacuuaaauuuugcgagagcauuugggcccacagucaccgcuugcugaagcagaugggaugccugguccaaggucacgauuauuaaaguagacacacggggcacuuugacccaccuguaguacauuucuuucacagcaaggcagugcaaccgguagcacaucgggcucuuuuagaugcugcuccagccuugguccgguggaucaugcuugguuuagaagcuggguugucuuucuccugcccccaguccugucuuugcuuuuauagugcaucauacaccacguagaaccgagccagguuccugccauguggacgcuguuccugccugagagucucuuagaggaaggcugggaacacuguggaaagacugggcaucucugcaggcggagcugaauggaugugaaaccccugugggcaugugcuuccgaguuccucagcaggcauuuguguuuuuugguagaaaguuugcuuuuuguuuuuuuuuuuuuuaagacaaggucucauucugucacccaggcuagaguacaguggugugaucauagcucacugccguccuugaacucucagacucacgugagccuccuaccucagccuccugaguagcugagacuacaggcgcuugccgccaccccuggcuaauauuuuuauuuuuugcagagacaggggucucacuacauugcccaggcuggucucaaacuccuggccucgagcaauccucucacagccucccaaagugcugguauuacaggcgugagccaccacaccuaacaaaaguuugcuuuuuaucuaaaaugacccaggcauugucacuguacugcuauuuuuuuaaaaaaauuuuguuguuuuguuguuguugucgucguuauauagaugagggcuuccuguguugcccaggcugguuucugacgccuggccucgccuccuuauacaccaggacagcaggacugagccaccacacuacccaacugcuuuuaucucagugaaugaaaaugauacuugccuggaggcuuccccucaucuacccccauguuucucuauuuauuccucaguuaagugggcagaccaacauccaccucagcaaaaacuucuuccugacgaaucgcgccagggagcgcucagacaccuucaucaaccuccgggaggugcucaaccgcuucaagcugccgccaggagaguacauucucgugccuuccaccuucgaacccaacaaggauggggauuucugcauccgggucuuuucugaaaagaaagcugacuaccaguaggcgguuuggucccuuccucuccccacccuucccugucccuccccacuggucuguuccucggccccuagagggcucuuucauccucugaaugucaguuacuuuuucuguaacaccugcccaccucgaaggacuaguguggggauuugauggauugaggaaguucuaguguuauaguaagguaaacaauggaaaaagccacuguggauauuuuugguuggaaagggguggcuguacagugaauugcagggucuaauuucauaagcgugucucugaauucucaaguugguacuuuaauguuaaacuacgaauccagucucgucauuugaagaaagcugagcagugcugguguaauccuugauuuuccaggccaccuggccuagcagagccaccaaggguguaaggugggaaccaucucaacgguucccaccuccagaaccucucccuauuauaguugucaugucaccagcucucucuccccuuccucaugggaucccacguuugggaacccuuuguggcugacaucaccauuuccugccacuguccagguggccucaauucacaauggcuucugccacuuugacuucugccucaaccauguauguucagcugggcacuugauuggcaaaggcagaaucuacccugggugauuuaagcuaaagggaauucaucgaaaggccauuggagacuccagaacugaugggagguagggggucaggcuaggaagaacaggagccaaggauguguuggaggaccagggugugagaugaccccuuggacucugggucaugugcugaggucuaaagaucuuguggagugugucugaggugcugggcuugggucagccaccuggccugcugguuccuguagaggaagagccaaugggagguagaggcagggaacugcccuugccccaagauaaugcaugaugcagaaauaauuucccauggcgaagggagacaaagcaaugccaggcagcugcauaccaaugaaugccaccauagcacggcuguagccccccugccacugacaggcugucuucauuugcuaaagccuaccaugggggaagggaccuuuccucucagcucugaggaugcuuagaggaagacugguguguucaguuuaguccucacugacaagaaaauaggagcaugaccugguggcauuagaauaacaguguccuuugucaaacucauuacucucccugccagccacaagucacucucccagggaagccucaaccccucaacucucucuagggugagcucccuaccccaagaggacaccccaccucucaaagguuucugacuuccuugucccaaaauauuaauccuucugcuccagauuccaaugaucagcaccaagagguccccuuuuccuucugccaggcauuggcccugcugauaggacucuuggucacuuaguuaaaaucacaguggcccaaggaagaaccuccugagcuugauuacccucacuauggagcagaaggaccuggcccuggacacaggggcggugcacaguauaaacuaaccacugccugaccugagcuuuggcugaaaugacacacaggccucugcacugcccaccucuccaaccugaggcagaacaaguaggcgaugauuugcacugcaugauucucagugugaaagucuauguuggcaaaggauauuucaaguggaacuuagaagcuauuccuuaaggcuaggacgaacaccacgcuacacgcgaaggcuauccuauuugauaaagaucaaaaacuagcaaacaaaaaucuccagcugcccacguugcuuuggucaugacccuuccuucagaucacuucugccuuuauuuuugcuguuuaggggauguguuaucacagaaacuuggaaugcagagaaauguuaucacagaaacuuggaaugcagaaaaauuuuugcuuuuuaggggagguguuaucacagaaacuuggaauacaaagaccuccccccaccgcagcccugccccaccccaccuacccccugcuggauuuagcacugcacuuccauuuuagcagugauuuccuuccuuuuugcccucgccugccuuccaguaacacauaauuuccuucuauuuccagagcugucgaugaugaaaucgaggccaaucuugaagagguauuuguaacucuuugaauuucacccacucuguccuggacaauccagagagcagaggagcaaaaaaacuccaagaguuuuuggacuucacgaacaaagccugaaacuaaggauaaagccggguacugggaauccaagagucgacuaccugcaucagcucuggccucugugcugggggcaugggccagucccuugccuauugggcugugcuagccacugucaaaauccauccacaacauuccagcuagucuuuauucuucugaguccccacuagaauagauccuaaaaggccauuuuaauuggaugcuagagaagauaccucugugagaaauuagaauauuacuccuucccacauaauuuacauuccuucuuguguuuuaauuagaaaaaaaaaaccuuauauuaauucuucacacuauaccugaucuuaacccaaaucaccguagaauuugggccccagggagggguagagaaggggagugggagguggcugccauggaagggcgggcagacacuuggugucaugccucgcucugaugcauucucaugucucugccucaccuuccaguucgacaucagcgaggaugacauugaugauggauucaggagacuguuugcccaguuggcaggagagguaaauguucccaaaaacgauguuaugcacucugguugaugcaaaggaagagacaguguguguccccaaggggacuuuaguuuaaaggggagaggaaacaaacugaacaaaagcaaagagaaauugcaaauggcacuuggguuccagcucagcccucuugcguguguccucccuaagaccuccgcaugcugccgggggcuuccauuugcauggucagcccugacucuguguuccuccuuccuuaggauuccugggcucaccuugugacuguuuuauuuucucuguucuacaccaauugaggcaugaaacuuggccccuuauccuugauuuccacaaaggauuuggagagauggaaggguuucaagucucaagaaugcaggccaccugcaacagaguguuugaauuaggcuuuucuguucucuuuucuuuuuucuuuuuuucuuuuuagagacagggucucucucugucacccaggcuggagugcaguggcaugaucauagcucacugcagccuccacuuccugggcucaagagaucuugccaccuuagucucccaaguagcugggacuauaggugcacaccaccaugucuagcuaauuuuuauuuuauuuuuauuuuuguagagauggaguuuugccauguugcccaggcugcucuggaacuccugggcucaacaauccuccaaccuuggucugccaaaguguugggauuacagaugcauaccaccaugcccagcuaauuuuuaaauuuuuuuuagagacagggucucacuuuguuguccaggcuggucuuaaaccccugagcucaagcaguccucccaccucagccucccaaagugcuggaauuacgggugugagccaccauaccuggccacuucccuguucuuaaaaaaaucccucagccauuuagucccaucacaaaguuauuuagcccucuuucuucccaacaacuccaaaaaaaaaaaaaaaguccucuuucuucacuauguggaggaacuuuccaaucauugagcucaucugguacucccuucgcugaccuaaagacccaucaaaguacuaagccaggcaucgucugcucugcgccuccaccggccucucacccucugcucccucccagauucccaaggaaaggggccaugagagucuucuuuccccucugauugaaucccacacauacacaccccaaaaggcaaacaugacugcaaucaaucuugguuuuaaacaaaggaguuuauccaugaguuacacaaauauguguaaguggauagagacaucugagcccaugaggggcccuggcaugaugggcauagaggagggccggcuaggucuuggagacagcugguuuucaccaguuuuacaggaagucugagcuuugaguuuuaaagaaugaagaaaacaugccagauaagaggaaugguauaagagaauuaagaaagaccacaaacauggguagaggggaguauuuauuauuuauauucucuacagcaaagaaauggugagugaacucucccuacugcauccguacauuaaaacaccguaucuaggcugggcacaguggcucacaccuguaaucccagcacuuugggaggcugaggcuggaggaucguuugagccuaggaguuugagguuucagugagcuaggaucauuccacugcaguccagcccagccuggguguucuaaaaagaaccaaaccaaaaacacuguaucuaaaauccagaauggggcaguacuacucaaaguguggucuggggacagcagccccaacauggcucgggggcuuguuagaaaugcacauucauaggccccaccgcaggccuaccuaaugcacugguguccugcccugugcucauccagcucccacggggggccaauaacuaugcucugguuauguguccacaggaugcggagaucucugccuuugagcugcagaccauccugagaaggguucuagcaaagcgugaguauccccucauugcaaaaccucauccugcucuuuccccuguggaugggagggaacauggaaaucuuucccccuccaugucuggcugcugugacuaaaccaccacccuccauccccuccaagaaguggaugaaggauuuguaugaugugaugaaaaagaacaaguguuuguagcauccacagaucaaagaucaaauccagguuuccacuacauacuagcuuugugugaucuauuuuuuuaauuuauuuuauuuuauuuuugagacagagucucacucugucgcccaggcuggaguaaaguggcacaaucucagcucacugcaaucucuaccucccaaauucaagcgauucuccugccucagccucccaaguagcuggaaucacaggcaagugccaccacagccagcugacuuuuguauuuuuaguaaagacaggguuucaccauauuggccaggcuggucuugaacuccugaccucaagugauccaccugccuuggccucccaaaaugcugggauuacaggcaugcacuaccacauccagcuaauuuuuguauuuuccuagagaugggguuucuccauguuggccaggcuggucuugaaccccuggccucaagugaucugcccaccucggccucccaaagugcugggauuacaggugugagccaccgugcccggccacaucuuguaacuaacuauuucuuaagcaaaaaaaugucagaggauugauuguucaaccccuuacuguggaucaccagcagggaggagcgggaaacacaacacagagacauuuuuuccccucaaauuaucaaaagaaucacgcugcauuuguuaagagagcaacuggcaauccaggaagcagaguuuugaacauaucagaaguuaggaaucugcaucagagacaaaugcagucaugguuguuugcugcauaccagcccuagggaucaucucgagaagccucauggacuucaagggacaucauucccucugacaagauggccucuagccuaacuccaugagauaaaauaaaucugccuuucagagccaaagaagaguccagggccagcugggucuucccucccagugugaaccaagagggcugggccagucagguuacggucaguccagugcagggccuccccagaggagacccagucugcacccgcccuccucuaauuuucagggaaggcaagaagauuguguuuacccuggaggccaccaggcacaagugaggucacagagcucuucagauaugcaguccucaugagcugaggagacuaaagccucauuguuucugcacagauggaggguggggcugggagguggggaagaagcgggccuugccuggauucagcccgcuccuugcugggggagcagcauucgcuccgcgcgugccucugagcuuacuacccuaccccuagcugccugcugacuccagccuucuggagggcuccacaccagagucugcaugcacagcugcugggccagagccuuaugaccaucuaagggguuggugcccagaguggcagcuuugaggcaggucaggcucuaaccucuuucggggacauaacaaaaaggcugggcuuuucgugaagucuguggggagccagguucacauuggugacuagggagggucucaugccaccugccaaacaccaaguggacaggacucacuuagugcagcacaaauagcucguggaucgaucccaguuccucagguuucucagucagcuggggacacaguccauaaaugucugcagauggacaguucaaguaaaccucuuucucucacgggucauagccuagaauuaacacaccugcucucuguuuucuuuuucccugcccaacaacuacaggugacuuuauauccugugggcaccuaaggcccaaccauugaucauucuguuauuuauuuguucaaaaagcacuuuuuaaagcccuguuugcccacggcaaauauacagagacaucaggacaauguggacaucaucugcacugucccagucugguagucacuagccacauguggcuauuuaauauaauggaaguggcuucuguaugugaagggcacagauaaagaauaucuccaugauuguggaaaguucaguuggacaucaccgcucagagauuuuuccugucacacugauuuugucuuuuaggccaagauaucaagucagauggcuucagcaucgagacaugcaaaauuaugguugacaugcuagauguauccuuuaaugugcuccagggaauagagacugggggaguuuaaaaucucacuccagaaagauucaaacacauggccuucucccuuuucaaaauagccaguuguucccaacuugcugaguugcugucggacagucagcagcgcugaccucccuuacuagggaaaugcgagaacccucugaugagggaaagcaaaugcuacacccccccucccaccuacccugaaaggcuuagaaugcaggcccauggcgggcgguggcucaugccuguaaucccagcacuuuggaaggccaaggugggccuccugacucacgaggucaggaguucgagaccagccugaccaacauggugaaaccuugucucuacuaaaaauacaaaaauuagcugggugugguggcgggcaccuguaaucccagcuacucaggaggcugaggcaggagaaucacuugaaccugggaggcggagguugcagugagcugagaucgcgccacugcacuccagccugggugacagagcgugacucaucgccaaaaaaaaaaaaagaaaaagaauguaggcccaccaguccauuccuggggcuggugcgggaaauuccugacaauaugcccaucacuucuuugcacaaagcagcucgaauuuguuuccucagugauguguuuccauuacuuccucuaggaaaauauucccuaaccacaguauuucugaugugaaucuguuuugucugaucaagaucgucgucuucuuuauuuauuuauuuauuuauuuuuuauuauuauacuuuaaguuuuaggguacaugugcacaaugugcagguuaguuacauauguauacaugugccaugcuggugcuuugcacccacuaacucgucaucuagcauuagguauaucucccaaugccaucccuccccccuccccccaccccacaacaguccccagagugugauguuccccuuccuguguccauguguucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugagccacauuuucuuaauccagucuaucguuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugauauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauuaugguuuugauuugcauuucucugauggccagugauggugagcauuuuuucauguguuuuuuggcugcauaaaugucuucuuuugagaagugucuguucauguccuuugcccacuuuuugaugggguuguuuguuuuuuucuuguaaauuuguuggaguucauuguagauucuggauauuagcccuuugucagauaagcagguugcgaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuugaugguuuuaggucuaacguuuaagucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuuaucaaagaucagauaguuguagauacggcguuauuucugagggcucuguucuguuccauugaucuauaucuguuuugguaccaguaccaugcuguuuugguuacuguagccuuguaguauaguuugaagucagguagugugaugccuccagcuuuguucuuuuggcucaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacaauauugauucuuccuacccaugagcauggaauguucuuccauuuguuuguauccucuuuuauuuccuugagcagugguuuguaguucuccuugaagagguccuucacaucccuuguaaguuggauaagaucgucuucuugauuuagauaagggcuacuuucaugaggauccuacuucccuuuugcucuagcuccuucccaggccacccaccuuuccccaaggcaaacuagucauccauuucccccuuguuuccaaugcuuagugagaaguggugguaaggggcagccuaagcuucugugaaguuuuuucuguuuguuuguuuaguugguugguugguuuuuugagacggggucucacugugucacccaggcuggagggcaguggcaugaucucagcucacucgaaccuccgccucccagguucaggugauucuccccccuccagccucccuaguagcuaggacuacaggugcgcgccaccaugcccagcugauuuuucuauuuuuaguagagacaggguuucaccguguuggccaggcuggugucgaauuccugaccacaggugaucugcccaccuuggccucccaaagugcugggauuagaggugugagccaccaugccuggccacuucugugaaguuuuaucuaguggauucaugguguacaccugcuagcucccuucaccaaaggccucuuagauauacuccacauacuuuaaaaaaaacagcaagggccuagccacuagaagccauccaaagcccucugcaugucauccaauaccucauuuuuaguaguaucuggggccuccacagcaccccuagaucaaaacagcaaccagauucggcagggagccagcaggucuuucucgcccuuccuccaauccuuuaaauggagguuuagccagugggaaaagcaggaaaaggauccuucugcaaacccuccuuguguauaugcuaugauauucaaaagauccaguugagaagacaaacuaggugacacuaugugcaaauggacccacacucaagggcuuuccuugacugaaggcagucggacgggaguggcaagcuggggcugaaggaguucuacauucucuggacgaagauucaaaaauaccaaguaagaucccagagaugcggguggaucuguguugggaaacauucuguucauaugcuuuaagaugcagcaacuccugcacagaguggagaaacauuuccaaggggauugggauuuuacccauaaugaagcucagagugaguaaagauggggcugaggaaaugcaaacaaaaaaccaaccaggacuucgcaggugaaauggccuauucccuuccuccugauuauugggaucaucuaaaggccaccaucaaggguuuccugaaaaggguuuuugacagcuaaaguacaaaaauuauauaagacaagaacauggaccuaugggcguuggcuggcugauuugaugggcauauuuacaaaccagcucacagacagaagcaaaauacuauuaguuauuuaaggcagaaacauaagugauucuuccacggccaaacuagaggcacagagcuggaaaaacuucauccccacucagcacauacuagggagguaacuugccagcuuugcuuugggucauaguucuuacagcuaacuuauguguuccagaaaauuuaccgagaaaucgacguugacaggucugguaccaugaauuccuaugaaaugcggaaggcauuagaagaagcagguaacccuuuauaacugcauuuucguuccuaguuuaaucugucuguagaauaugugaacacucaucuuauaccauauaacacaagauuugguaaagcuauaaaauaaaguaggugcugguuuaauacagacaccuccuuuucauuccccuuucaaagacuaauugguaaaauuaaaugcaguaggaugcucugcccucugugccuucuugaauccaaguuuccuuuggagccgccuggcacaguaagcaggcaaagccaggucucaacagccuccuccaggugcuuccuuucuggugcaggguugguuaggcagaaaucaaaugucucagcucagcccuuaggguaagacccuagcagaauuggauaucaauaaaaggacacaagcgagugguagaccagcaaagcaggagacugcugggcuuugggaacaaaugugucagcaugaggcuguucauucuauuugcuggaauauaaugcugcugcagagaccccacacaacauugguuuauacgagguaugucuuucugucguauagcaaucccagcuccagcaguccacggcuaggacggugccuccuacuauccuaccaugucacuaucugaucacgcuucccccagccuccccccauccaugaugcccaccggaccuucaagggucacccucauccaagggaccugggacagccugccaccacaaacacaugccaccaacagguugacagaagaagggccccuugccuuuaagggcacacaggccauuuccggucacacaucccaccagccagacucugaucacaaggccucuguugacugcaaggaagcugggacaugcagucuugaugcuagguggccauaggcucaauaaaaauuauuuuacucuggaaggagagagaacuacuaugaguuuaccaggaaagcuucugcucacauauauccaggaagaaucugaucuucaagacgauugagagcuaaacaaaaaaucaaacagcagcagcaugguuaacaacaugaagcaacugugaccaugagaacagaaacaggcaagaaaacacuuaugugucagcaaaggacacaggcagggugaagguggacaguucaaaaacaaaagaaacagcagaagguacuggcuuugcaaaaucaaaccagucucacagaagagcagccaagggacaaaagcaauuauaccucauuuaaaucaccacauuaguuucauagccugugagcgcagcuaaauggaacaaucuaaugcuuagcaaugaguuuguuuguucauguaacuucagguuucaagaugcccugucaacuccaccaagucaucguugcucgguuugcagaugaccagcucaucaucgauuuugauaauuuuguucgguguuugguucggcuggaaacgcuauucaguaaguggauauuuggggaaugacucauuucaguucucuugguauuaaaguggccugccuuucaccucggugaaaucaucuaaacuagagacaugucuuccaggaguugagaaugaaauucccucuuuacuaauuugagggugaggaagaaagcauguaugguggucagugaagucaguugcugaacugaaaagaggauaaugugaucuguuucagcucacucacuugugacacccucuuuuucucccuccacagagauauuuaagcagcuggaucccgagaauacuggaacaauagagcucgaccuuaucucugugagucagcaggccccgccuugcuucuaaggggaugggggaggcauggggcggaaagggcuguuacuugagugaucugcuuuuucaaguuuugcuuuaaagagcucuuggucugucggggccaggccuguaaccgguuguaagaucccacaaugcacuuuuacuugcaguuguuuuccaaccaccuauucucaaguccaaaaugcacgccuggcucccucuucucaugagcuuugacuugaguguagcucaagguuaaacuaaggaguggcugcaggaucaugcuuagaaaaaugaacuccugauuagcaugcaagggagaacauguuuauauaaagaaauccuucagcugaaauucaaguuggguuuugggaagauccaucauucuuagaguggaucuacuuaaaauacuuuaagcaaauuaguuuucucuacucccuccccguuuaagauaaaaccaauacuaguaaauacguuugccauuuauuauuguuauugcacucaugugucuggaacccuagcaauacacaucucugaaaugaucaucaaucugaauuaaguggguaugcuaauuucacaaaaagcaaagcguaaaauguucucgugucaucccaaugacaggaaguucucucacugaaagaaagaagccaggugggguauacuuccauuaucaccuggcuccagucagcauuuccucuauacucagggaaggccacagagggccgggcgaaguggcugacacugggugagaauggcaguugucaguccuguccguguaacagaggagugaaguggugaggagggcaggucuaaggcacuggcagcucuuuuccauggauuuugaacucuggaggaaggcagcaacuaaauaacugucucauucugcuauuaugcauuguauuagcaaagugaaaauauagucuaucugguuacaaauaacacuaacuugcuuaaaacuuuacauauccuaggaaauaucucuaccccuagauugcaauguagagucaaccccaucucuaaaaaaauaaaaaauuaggcuggccgcagugguucaugccuguaaucccaucacuuugggaggccaaggcagguggaucaccugaggucaggagcucaagaccagccuggccaacauggugaaaccgcgucucuacugaaaauacaaaaauuagggcugggcgcgguggcucacaucuauaauccuagcacuuugggaggccaaggcgggcgaaucaccugagguugggaguucgagaccagccugaguaacauggagaaaccccaucucuacuaaaaauacaaaauuagccaggcguggugacacaugccuguuaaucccagcuacucgggaggcugaagcgaaaggauugcuugaacccgggaggcggagguugcggcgagcugagauugcaccauuguacuccauccagccugggcaacaagagcaaaacugcaucuaaaaaaaaaauuagcugggcgugguggcaggugccuguaaauacguuacucuggaggcugaggcaggagaaucacaugaaccuaggagguagagguugcagugaacugagauggugccacugcacuccagccuaggcaacaagagcaaaacccugucucagaaaaaaauaaauaaaaaauaaaaaaaugagccaggcaugguggugcgugccuguagacccagcuacccaggaggcuaaggugggaggaacaccugagcccagaagucaaggccgcagugagccaugaucuccccacuacauuccaucuugggugacagagcaaggcccugucucaaaaaauuuaaaaugaaauaaauaguagagucaacacaacugugacacgaaacaugccacauguuaaguucuggaaauccuagccugucauucuugcuggauauccuauucuaccccagccacccacccccacuccaggguccaccuggccugccugcucaguccacucccuccgcaucuccuccgagaagcaucuucuuacccacuggcuuuuccugccacuccuaagccuuaccuuuugcagguuccuggagauccucgcuucucguagucuuugcaaggaugagccauguucagaagcucuccguucagucugcagggauuucaaccuuggcugcagauuccaucacauggggagcuuugccaaagugcugguguccugucuguaucccagaccaguugaaucaaucugauuuaaaguuuccguaucacuacaacuuagaaccaaugcugaacaccauugguugcagggauauccacaucccaaacuaacuucugaugugauacucugaggcagagaugugaaaaugcuaauuucuguugugugaauuucacuuuucaugugugcaaucaacccuguaauaugauucauggccacuuaaugcaaaucacacagacuacugaccuguuaaaagcuagacucuagaaaucagguaagaaaaauaugaguuagugcacugauauuguagcccucaaucagcuuuuccaguacaaguuuuuuggaacaaucuacagguacuuaaauagccuuuaauuuuaaaaguggucacugagcugacuuuuuuuuuuccuuccucacaguggcucuguuucucaguacuuugaaguuauaacuaaucugccugaagacuucucaugauggaaaaucagccaaggacuaagcuuccauagaaauacacuuuguaucuggaccucaaaauuaugggaacauuuacuuaaacggaugaucauagcugaaaauaaugauacugucaauuugagauagcagaaguuucacacaucaaaguaaaagauuugcauaucauuauacuaaaugcaaaugagucgcuuaacccuugacaaggucaaagaaagcuuuaaaucuguaaauaguauacacuuuuuacuuuuacacacuuuccuguucauagcaauauuaaaucaggaaaaaaaaaugcagggagguauuuaacagcugagcaaaaacauugagucgcucucaaaggacacgaggcccuuggcagggaauauuuaaagcaacuucaaguuuaaaaugcagcuguugauucuaccaaacaacaguccaagauuaccauuucccaugagccaacugggaaacaugguauaucaugaaguaaucuugucaaggcaucuggagaguccaggagagaagacucaccucugucgcuuggguuaaacaagagacagguuuuguagaauauugauugguaauaguaaaucguucuccuuacaaucaaguucuugacccuauucggccuuauacaucuggucuuacaaagaccaaagggauccugcgcuugaucaacugaaccaguaugccaaaaccaggcauccaauuuguaaaccaauuaugauaaaggacaaaauaagcuguuugccaccucaaaacuuuaugaacuucaccaccacuagugucuguccauggaguuagaggggacaucacuuagaaguucuuauagaaaggacacaaguuuguuuccuggcuuuaccuugggaaaaugcuagcaacauuauagaaauuuugccuuguugccuuaucuucuuccaaauguacuguuaaauaaaaauaaaggguuaccccaugcaaucacaccaugccauguuuuccuuccuggagggcagccccacaggacgguuuaugagcacacaauuauagcuuguuucuacuuuaacaagguaugcugccucuguaaauucauguauucaaaggaaaagacaccuugccuauaauuaaaauguggaacuauaaaauuuuuuaaaauccaa

SEQ ID NO: 191172 - RNA, 53929 nt, Homo sapiens
ggagcgcgugcgcccucuuacucggcuccccuugguuuccugggguccugccccuucaagcuggggcgggagcggaggaccccgcucucagggguugccggaccaugcguugggggcugcgcccucgcgggccgggcgcggccgcccuggccacugcccgaaguuugugggggacgccccgccuucccugcagcccgggauggcaaggggcgacgaagaggcuucuggugcggucggucuccggggccaguaaccaccagccgaacucgaauaguggcagauaccgggacacggugcugcugccgcagacgagcuuccccaugaagcugcugggccgccagcagccggacacggagcuggagauccagcagguacgggccccgccucggcgcggggccuccagagaggcccgauccggccgcgggcaccgggcgcucgcaggcgccacaccucuaggcuccacgccggugcgggugggcgggggugugaccagauugguggaauucgucugcuucgcacagauuuugugggcugaaaaccuaagugaagaaaucucuagaugagccccuccuuuguaccagguucuggagcgggacauuaaggggucacuagcgaugcccaguuaccagcauguaucgcacguaugucccaugucuaccguaggcaaaacagauagacuuugggcacuuuuccaaugccuuguaaaaaguaaauucacauguccacauguaaauaaaaacccaggcugggcgcaguggcucacgccuguaaucccagaacuuugaaaggccaaggcgggagaaucgcuugagccaagaguucgagaccauauuggcuagucacccccacccccccguccuuaaaaaaaaccuuaaaaaccucaauuaugaugaaugaaggggaaguugaagcccacuucuuggaucuuuuagaucccuaguuggaauuaugacucguuugaagucgcccaggcuggagugcaauggcgcgaucucagcucacuacaacuuccgccucccaggcucaggcaauucuccugccuuagccuccccaguugcugggauuacaggugcgcaccaccacgcccggcuaauuuuuauauuuuuaguagagauggaguuucaccauguuggccaggguggucucuaacuccugaccucaagugaucuucccgccucggccucccaaagugcugggauuacaggccugagccacuacgcccagccuagucugaacuuucuaagagcagagauuccucuuuagcuucuguaauucuagucuuuaaaaaucccugauauucuuggaauauugguuaaguaaauauacuuagccuaaauauucugacaguuauaagaguucaucuaauuuuuuaaagguuuuuuagucaauaccuucuguaugccagaaagagugacaguuucaaauguuuccucguuuaaucuucacaccagcccuguaagauggauauuaacacuuuuuuuuuucagauaagaaagcaggcccguaagugcacaguaaccuggacaaaaucauacagcaagugagggaagggaagugacuuagacugccaugcauguuguucccagauuuggggaauggcaagcauugccgccaaagaauagcaagaauaugugugucgggaaucugcagguccuucaacaugucgggggugaggagugaagcauggggagugaugaaagaaugcccgagaacuuaguggcacuaaaccuuuguagggugcugcauaucauauaaagaguuuagacuucaaucugagguguauggggacauuacugaaagauuuuaagagaugcguacuuugacacgcauuucagaaaccucaccuuguauuucagaguugaguagauuggaauggaauagauuggaauguaauuggaauggaaauaagcaaguguuggcuguuauuuaugguuagacucaggaguauguauuuauaugauguuuagauaucuuuuuuuuuuuuaaaacagaaauguggauuuucagaacuuuauucauggcaaagagaaagaaaaguaaagacagaauuuugccuucaugauggaccuccuuaugcaaacggugacccucauguuggacaugcuuuaaauaagguaacuauaauuuagguuaugacacuugaaagaaaguguuuauguaaauacucuuuauaaauguguauucuaauuauaugauaauuauguaaauuuagauuugcacauaaaacuaaaacauuuucauagaaagcaauauacaauuuuaguacugcauaaaaaaaauugcugcuauuugcuuugagcuuaacguuauauuaguaaacaucaucuuauucagugcauaauuaucgggcgaggcauuguucuagaaucugggaauagcaguggacaaaaaaaagguaugucuuggccgggcaguauggcucaugccuguaaucagugcuuggcccacagauaucaauaauucauuauuuuuaaaaugcuuaguagaauuucauugagagaauauguuaauacuacaaucuguucacucauuuuucaguucuuuauuuuuuguagauuucaguggaaauuuuggggaggaagugggcuuaggcaucuguaguuucaaaaccaggaauuuggucacugaaugggucaauagugcuauuaaagagaccaggcgcaguggcucacgccuguaaucccagcccuuugggaggccgaggcaagcggaucacgaggucaggagaucgagaccauccuggcuaacacggugaaaccccgucucuacuaaaaauacaaaaaauuagccacgcaugguggcgggagccuauagucccagcuacucgggaggcugaggcaggagaaugccgugaacccgggaggcggagcuugcagugagccgagaucgcgccacugcacuccagccugggcaacagagcaagauuccgucucaaaaaaaaaaaaaaaucauguuuugugauauaaauacagaauaaaacucuauuauuucaaacccuuuugcaaggaauggaagagccaacauuaacuggauuaagcaaagagagagaauuuacuggcuuuuuuacuguagaguccagauaguuuuagccaccugcauagcuggaucaggaauucacauaaaauuaagaauugguuucugucucucacucuuugcuacuuuagugacugccccaccccagacccccagcacauuucccaguaguuucaggcuuacauaauuccaccuucucuuucccaacaguucuuuuuucuuuuuuuuuuuuuuuugagacagagucuuguacugucgcccggacuggagugcaguggugcaaucuuggcucacugcaaucuccgcuucccggguucaagcgauucuccugccucagccucccaaguagaugggacuacaggcgccugccaccacgcccggcuaauuuuuuguauuuuuaguagagaggggguuucacuguguuagccaggauggucucgaucuccugaccucgugaucugcccgccucugccucccaaagugcugggauuacaggcgugagccaccacgucuggcccccaauaauucuuauaaaaguccuggaauugaaucucauuggccugauuugggucgcacaucuauuucugaaucagucauugcagacuuggggauagaauauguuaauggcuacaguggaucacguguucacucuuggagcugcagcagagggagccagcuccauguggauugaggacaaaggaauaauuccauaaaaaacaguggcaucuuuuguuguuguuguucuuugagacagagucucacgcugucacccaggcuggagugcaguggcgcagucucggcucacugcaagcuccgucucccggguucacgccauucuccugccucagucucccgaguagcugggaccacaggugccugccaccaugcccagcuaauuuuuuguauuauuaguauuauuuuuuaguagagacgugguuucaccauguuagccaggauggucuccaucuccugaccucaugauccacccgccucggccucccaaagugcugggauuacaggcgugagccacugcacccggccaaaacaguggcaucuuacaaaacuaucucucacaugaagagaaaccuucuugaagcccuuagcaaagagcaugggcacuuuggaacuagggaaggaccaauucuugcucuuccucacacaugcuaauuauagucuugcuugcuuucuccucuuccuagaaugcaucaccagaauauucacauggaucaccuccucauuucuuucagauucuguucaaaugucaucuuaccaggcucucuugacuucccucuaaaaugguaccacccccagccccuaaaugucauuuucuaacccuauaauuugcuuuuuucuccauagugugugauauguugguauauauucuguguuccuccaugagaaaaaagaccuugucguuuuuguuuacuacuauauucuagguuccuagaaaaauucuugacauacaguaggcauucagauauuuaucccucaaacaaagcaaugcaugaauauuagaaaaaugaaaggaacagagauaaaugacucuuaaaaguauggaggaacuuuuuuuggggagaaggagggugguguuugauacugaggaguuaguaaaauauuccuaugauauugcuacuauucuuuucacuagaggcuucauauauuauauuuuauuauuacauuuaagaauccuuauuagguacacuguuaauuauuaguuccagugauugauuucauccuguucauaugacugaaagcaacacuauucaguagaaauacaaugcaagcggcugggcguggugggucuggccuguaaucccagcacuuugggaggcugaggcgggcagaucaucaggucaggaguucgagaccagccugaccaacaugguaaaacccccucucuacugaaaauacaaaaaaauuagcugggcaugguggcaugugccuguaauccagcuacuuaggaggcugaggcaggagaaucacuugaaccugggaggcagagguugcagugagccgagauuguaccacuguucuccagcuugggcgacagagcgagacuccgucucaaaaaaaaaaaaaaaaaaaagaaauaaauauaaugcaagcuauaaauuugugccacauagguaaguuaaaauuuuucuaguggccccagaaaauaaugaaaagaaacaagugaaauuaauuuuaauauuacauuuaacucaacauaucuaaaguaucauuucaacauacagucgauguaaaacauuuuugagauauaucacauuuucguaaaacauguuugaaaucagguauauauuuuauaauuuacauuacaucugaauucggacuagcaccaaaaaucacauguggccaguggcuacuauauaagauaccauuguuuagagcauauaugcauccauguauucauguauuugauaaauauuuauagacuagugccagaaaccauucgaaaggcuggaauucauaggugaagaggacagaugggcucucugauuucauggaguuuauguuuuacagggaagagacaaaaaaauaaguaaacaauuuccaaagaguuaaguagaaaggagguuauuuauaugaugauugauuuaaauaauauacccagaguaaagugaaccaaucuuaaguauguauagcuagaugaauuuuuuuuaaugugacaaccacucagaucacaaggcuccuuccuguucauuaguaaacaguuugaaauuagaguuuuuaaaggggggaagggaugggaggagaauauaauaauaucuuuucuacuuuugauaggcauggaaaggaggaaauuguuuucuggacuacugggcuaguggucagagcacuguuuccucuugggaagaaggaaauugagcuuggagccaaaucuauccuuugccuuugauuccuccauucaacuauaguaauauauuuuuuaaaaggcucugcugcccucugguaucuaaaaugaauuuaaaaagguaaauugguucuagaacuauaccuaaugaagaggucuacuguuuuaguaaggguuugucaaugacagaguuaaccacaauauuccauucucugaguacacuguaaguucugcaaugguuugaugauauuucuuagcucaauauaaauaauauuagacuauuugugucaauaguuuuuuuaugaguuaauuuauacguuuccuuucaaauugcaguuuuaaaaaugguauuaaguuuaaaaaaaagaacauaaauuguaggccaaauauuuuauguaugaaugcuaauuaucauuuuaucuuugcagauuuugaaauacauggccaaauauuuuauguaugaaugauaauuaucauuuuaucuuugcagauuuugaaagacauagccaaucgauuccauaugaugaauggcuccaaaauacauuuugugcccggcugggauugucauggguugcccauugaaauaaaaguauuaucagaacuugguagagaagcucagaaucuuucagcuauggaaauuagaaagaaagguaaauaaucuguauuucuguuuuaaaaugauauuuguaaacacucagguccuugaaauagucagaacuuuaccaaaggaaccuuuuguuuggguuucguuugcuuauaauaagaucuauuggaaacgccuuucugucacagaaaauucagauuuuauuucauugauuuuuguaagaacuuauguuuggauauugaaggaaagacuuugugagcauuucugauugcauucucaguuucuuaauguucauauuuuaaaaaacuauuuuuugguaaauucuuuuuucugcuuuccucaagggggcuuguugacugauuuuagguguuaagccaaaauucaauucuaaaauacauauauuuuacauuaaucuuuuauuugauccuuuuucuucagucgacugggccaagggaggauucucuuuuucuuauauguuauacuauuguacauuuggauguaacugugaagauuuuuuuacuuccuugugaaaccuauuaucauuggcuuagauuugauauucugauuaauuuuuuguguauaaugaaaugaaaauuguuaucugaccuuuucuuaaauuaagaaacaauaaggaauaauuuuuccaguuuauuuguccuaaauaugaggucauuguauaaagucuggaaaauacagaagacaguaauaaaauuuuaacuuuugcaauuccaguuaauuuuagaauuuguuguagguaucuucugaacacuguugaccuucaaauuauuuuucuauuaaaaaauuuuuauaggcugggcacaguggcucaugccuguaauccuagcacuuugggaggcugagggagguggaucgaucaccuaaggucaggaguuugagaccagccuggccaacauggcaaaaccccguaucuacuaaaaauaccaaauaauuagccagguaugguggcucacgccuguagucccagauacuugggaggcugaggcacgagaauugcuugaaccuguguggcagagguuacagugagcugagauccgccacugcaugccaaccugggcaacagagcaagacuccaucucaaaaaaaaaaaauuuugugcucgggcgccguggcucacgccuguaaucccagcacuuugggaggcugaggcggguagaucacgaggucaggagauccagaccauccuggcugacacagugaaaccccgucucuacuaaaacuacaaaaaaauuagccgggcgugguggcgggcgccuguagucccagcuacucaggaggcugaggcaggagaauggcgugaacccgggaggcagaggcuugcagugagccgagaucaugccacucgcgccacugcacucuagccugggugacagcgagacugugucucaaaaaaaauuugcauucuaaacugucuguagcauuugcauuuagagagauacaugcuaaaccauguuuaagaauucgaauucauugguuuuuuaaaaucuuuuuuucgucuuuuuuuuagcuagaucauuugcuaaagcagccauugagaaacagaaaucagcauuuauucguuggggaauaauggcagauuggaauaauugcuacuauacauuugaugggaaguaugaagccaaacaguugagaacuuuuuaccaaauguaugauaagguaaagaaguauuuuuucucuuugaguagguuuuaguaugcguuacaagauucuacuuuuaacaucauauuuuugucuuuuauagggcuugguuuaucgaucuuacaaaccuguguuuuggucuccgucaucuagguauauaugcauuuuucgguaauuaaaagggagaaauuugugaggcuuccaaguauuuauguuuaauauuuuuaacccuuaggacugcauuggcugaagcagaacuugaauauaauccugagcaugucagucguucaauauauguaaaauuuccucucuuaaagccuucuccaaaauuggcaucucuuauagguaagauuuauucauagcuugaguguaccaaaguuauagaauuaucccauuugcuaacauauuuacaauuguauuuucacagaugguucaucuccuguuaguauuuuggucuggaccacacaaccuuggacgauuccagccaaugaagcuguuugcuauaugccugaaucaaaguggguauauuauugcauuuuuuguuuuauacacaaauagaauguauuccauuauuaacauuauuuugaauuuauuuuauccuguuuauuauuguaaaauuuaaugaauuauaacuuaguuauuauguucauauagauuuuauuaaccuuuaggugauccuuuuuaugaccuuauccagcuuuucgggaaaaugaaauagaaguauaaguuacaaaguguuuugaaaauaguacaguuugaucuugaagucaguuuuuucuuuuuucuuuuuuuuuuuggagaccgaguuuugccuuuuguugcccaggcuggaguacaguggcaugaucuuggcucaccacaaccuccaccucccggguucaagcaauuuuccugccucagccucccgaguagcugggauuaugggauuacaggcaugcgccaccacgccaggcuaauuuuguauuuuuaguagagaugggguuucucuauguuggugaggcugguugcaaacucccaaccucaggugauccaccugccuuggccucccaaagugcugggauuauagacaugagccaccgcgcuggccugaagucaguuuuuucuaaaaugauuauuuaaaaauuaaaaugauaucuguggcuuuucuuguuucauuauuaguaauuucuccuaaaauuuuauguuagguaugcuguugugaaauguucuaagucuggagaccucuacguacuggcggcagauaaaguagcaucuguugcuucuacuuuggaaacaacauuugagacuauuucaacacuuucaggugaagauuuuuagauaucugacaacauagucaucaaaguauugggcugacuugaauuuacuacuuugcugaacugcauauuuugaauugaaacagauauggccucuaccuuucuagaauacauuuuacauugauuacacuaaaggagaauauacauuaagcaugauaggaguauagaaaaauaugaauauugauaaauguacaacagguaaaacuaauuucuggcaauauccaguaguuacuugguaaaauuuuaugcaaaauuaauuuuuaaaauuguuuuuaucuguuuuaauaaaaguagcaagaaaggaaaugcauauacuuauuuuucgauacauaauuuuaauaaaggauugaauaaguucugaaaauuauucagaaagcaguucuucuaucaaaggaauuuuauuuuauuuuauuuuuuaaagagacagggucucaugcuguugcccacugcuggaaugcagugguccagucagcucauugcagccucaaacucccgggcucaagcaauccuccugcccuggccacccaaguagcugggacuauaggcacaugccacugcacccggcuaauuuugaaaaaauauuuuacagagaugaauucuuguuguguagcccagacuggucuggaauuccugggcucaagugaucugccugccuuggccugccaaagugcugggauuaaaggcguaagccacugugccuagcccaaaauaauucuuugugagcuauaauuugggacuuuugagguagugacugcuuugaaauauaauuauggaagucuagggaaguuuaaaauuagcuuuuuguuguuguuguucuucauuuuguuuugagacguggucuugcucuguugcccaggcuggagugcaguggugccaucuuggcucacugcagccucuggauccuaggcucaagugaucuuccugccucagccucuugaguagcugggacuacaagugugugccaccaugcuggacuaauuuuuaauuuuuuugguagagaugaggucuugcuacauugcccaggcuggucuugaacuccuggccucaagugauccuccugcuuuggucuuccaaagugcugggauuaugggcaugagccacugugccuggacuaaaauucuauuuuauuuuauuuuauuuuuaaagagaugaggucucacuauguugcccaggcagaucuugaacuccugagcucaaguguuccuccugccucugccucccaaagugguaggauuauagacgugagccaccaugccugggcuaaaauuaucuuugauccuuagguaugauauaucuuuuaauuucuugcuaaaaaaucuaucacaugaauaaagauacaaaaacugccuagaaagacugccuagcuaaauaggaaagcccucuaaauuaaucaguucagauacaagccaaugagaaguuuaaacaaccuuaacaaaaauaaaaagauuuuuaugucagaggcaggaaaggagcuuaagaauuuugaagaccauuugguccucuuuggugcaauaggguaauaaaaauaaaaaccaagauaauaauuuacuucacacccucucucacuguguugcccaggcuuguuucaaacuccugggcucaagcaaucuuccugccacagccucccaaagugcugcaauuacagacaugagcuacugcacccagcccccugcucuuuuauaaaugcagaggauauuaaagacuucauugucaaguuauacauuaucauagaagcuaaaaaucacaagauuuuugaaaguguuaagguugaauuuaaagaucuuuugucuagauagcauaauuguuucaaauucuuacuaucagauaauuauugaguugcuauuugagucaccauauuguggaggaguauauauauuaucccugucaaaauaagcuggugucacguagcuacuacuuauuaaaguaguaggaauguugaagagcuaaaaaugaaguaauuuguaugggguagguuuucuuuccggaaaaaaaugaauuauuucuuaucaauuacuuagagaucauuuugggaggguggugagggagaauauuaagugguagaugcaguaaguaucaaaacacuuaaacuacauuaacucuguuuauucucacagaaacccucugaggugggaaccauaauuaucugcauuuuauagauuauagaaggucacagaacaaguuaaaggggaagcuggaauuuaagccuagccaguauuguucuagauucugcacauuuaaccugauacucuauugcuaagcuuaaggagauagauuugccauauaaaaugauucuuaauagugguuuucuuuccccacagguguagauuuggaaaaugguacuugcagucauccauuaauuccugauaaagccucuccucuuuuaccugcaaaucaugugaccauggcaaaaggaacgggauugguucacacagccccagcucaugguauggaagacuacgguguagcgucucagcacaaccugcccaugguacuguuccucuuuuaucauuuuuaauuauucaucuuaauaaaaggaaaugauaaauucuaaccaacaucuucauuuuuuaaaaaugaugacuuuugucaucauaauugugaaaugcucagguuuguguaguacucuaaaguuucauuaauucguacuaauugaaaaagauuucccagaauuaauagaaaauuagcacuuuagaauugaagaauauauaucauggggcacuuuuaaaauacuuuuuuucuaguaucaagucacauagacaaauuacuuuuauucccugaaaaagccuguuuguuuuagcuaaacaguccuuucuacauuuacuuuacauacuucaguuacuuagcaaguauuuccguuuaguuaaaaggugagucagaaagggaacaacuguguauauaggcauagauuuggaaacaauagagaccacucaaagauguuuuaauauauuuuguuacuuuuguuauuaaaguuuauggauaugcuucaauaacacauuuuggcuuuggugauuuaaauguauaaaauucacaaauuccuauuuccuuuucuuuucuuuucuuuuuuuuuuuuuuugagagggagucuugcucugucgcccaggcuggagugcaguggugugguaugaucucggcucacugcaaccucuaccuccaggguucaagcgauucuccugccucagccucccgaguagcugggacuacaggugcacaccaccaugccuggcuaauuuuuguauuuuuaguggaaguggguuucaccauguuggccaggcuagucucaaauuccugaccucaagugaucugcccaccucgaccucccaaagugcugggauuauaggccugagugccgcgcccggccaaguaccuagaauuucaauguagaaaaagaccaggcuauacugagauguuuuuauauauauuguuuugccagauauugucauaagagaaaaugucuugauauuuuaauuguucaaaaugauacuuuauaggauugucuaguggacgaagauggaguuuucacagauguugcagguccugaacuucaaaacaaggcuguccuugaagagggaacugaugugggugagcaucauaucuguugauaucauacauguuuucugaaaaguagguagcaguaaccuuugcuaccuauuuucccuccuuauacuuuaacagaaacaaaaaaauaaauuaugucuuguuuugccauauguuuuaaaauggaguuugggacuuuuucaucuuuugcuuugaagcugcuuuauuuaagcaagucagggcagucaacagggagugaaguuauuuuagggcuauggagauaauaaucagcaguauuacuuuuguggaaggauacaaucaagaucagggcuggauguugacuguaaauuacacauucccuacucacuuuuuaacccuuguaaauaacugaccuauauggcaugauuuauguauuagaaucuugggaauccuccagccuugaauugucuuucugucuuccuuuacagauucagagaccaagugcuaugaaaaccuuucuuugcccacacuaagacuaaggcuauuuagaccugauauauuacuuuucuagggcuacuguaaaaaaucaccguaaacuugguaguuugaaacaacagaaauuuauucucucaagugcuggaagcuagaagucuaaauucaucguacuggcaggaccauguuuuccugaagguuuuaugggagaauccuuacuugccucuuucuagcuuuugguggcuccuggaaauccuuggcauuccuugguuuauaacugcguuacuccacucucugccugucuugucacauggccuucuuuagaucuuacuuguuuuuucgagacaaucucacuuucucacucagguugaugugcaguggcaugcuuucagcucacugccaccucuguguccuggguucaagugauucuugugccuuagccuccugagcagaugggauuacaggcauacaccaccacacccagcuaauuuuuuuuuuuuugagacacagucucacucuguugcccaggcuggagugcaguggugugaucucagcucacugcaaccucugccuccuggguucaagcaauucucuugccucagccucccaaguagcugggauuacaggauacacaccacuacuccuggcuaauuuuuguauuuuuaguagagaugggguuucaccauguuggccaggcuggucuugaacuccugaccucaggugaucugcccaccuuagccucccaaagugcuggaauuacaggcgugagcccucacugugucaggccauaauuuuuuuauuuuuuauuuuauuuuuauuuuuuuuuuaagacggagucucgcucuguugcccaggcuggaguacaguggcacgaucuuggcucacugcaagcucugccuccuggguucauggguucuccugccucagucucucgaguagcugggacuacaggcgccugccaccaugcccagcuaauuuuuuguauuuuuaguagagaugggguuucaccauauuagccaggacggucucgaucuccugaccucgugauccaccugccuuggccucccaaaaugcuggguuuacaggcaugagccaccgcacccggccuauuuuuuauuuuuaauagagacaggguuucaccauguuggccaggcuggucucaaacucccagccccaagugauccaccugccuaggccucccaaaguguugggauuauaggugugagccaccguacccagccaccuucuuuaggucuuaaaugucucucugugaauccucuuuuuuuuuuuuuuuuuuuuuuuuuuauuggagggacugguucuuuauuucaaaaagacacuugucaauauucaguaucaaagcagguggacuauugauuucuguuucucccaaucggccccaaagagacuauaucaaaggacaguacguuuuaagccaguaugcugcaggauguacaccugacagacuuuacagaaaccuuaucggaaaguggggauuggguagggaaagaaacuuuaaaagaucagcaaacugccagcccggccaggcacgguggcucaccccuguaaucccagcgcuuugggaggcugaagcggacauaucacgaggucaggaguucgagaccugccuggccaacauggugaaacccugugucuacuaaaaauacaaaaaauuagccagguguggugguaggugccuguaaucccagcuacucuggagggugaggcaggagaaucacuugaaccugggaggcagagguugcagugagcugagacugcaccacugcacuccauccugggcaacagagcgagaguccaucucaaaaaaaaaaaaaaaaucugccagcucacagacuguagagggcugucacagucaaacuggguggccagggugccacccaaagaagcaaaguuucaaaauaauacaaaaauuuaaaaaaguuuuguacauaagcuauuuaagauuucucuagcauuaacugauauuaagcacaaugagauggcacuuuuagagacagcagcuucaaacccagaaaaggguaaugagaugaguuucacauggcugaaucaguggcaaaaacauaaucuucuuucuauccuccucuaagaacaccagugcucccuaaugcagugugaccucaucuaaacuugauuacaucugcagaggccugauucccaaguaaggucacauucacuagugcuggggguuagaucuucuuggggacacaguucaacccacuacaccugguuuccuccagauuaccuggagaccauuuuaagauucauggcaugaaagauuauggaucuaaacuucaaauguagaauucuagauauaaucuguucaucuuuucuuugacgugaaaagagguagaaguggcauaauuuggagucugauuaagauuuuacaguccgugcuuuuuuuugccaggagaaucccagagcacgccuuugauaccuggaaggugacuacucuuuuuuauuuuauuuuuuuuugugagacagagucucgcuuuguugcccaggcuggagugcaguggcacaaucucgguucacuacagccuccgcuuuagcuuagguucaaaugauucucccaccucagccucccaaguagcugggauuacaggcucacaccacugugcccugcuaauuuuuuuguauuuuuaauagagaugggguuucaccaugcaggccaggcuggucuugaauuccugaccucaagugauccucucgucucugccucccaaacuguugggauuacaggcgugagcaaccacgcccagccaaguugacuacucuuuuauuuuuugagacggagucucgcucugucacccaggcuggagugcaguggcacgaucucggcucacugcaaccucugccucccagguucaagcgauucuccugccucagccuccugaguagcugggauuaugggcacacaccaccaugcccggcugauuuuugcauuuuuaguagagacgagguuucaccauguuggucaggcuggucucgaacuccugaccucgugauuugccugccucagccucgcaaagugcugggauuacaggugugagccacuguggcuggcaaggugacuacucuuauugccaccuguugcugcagauuuaguauuuucuggaaguuuagagcauuuuuaggauuuucacaguacuuuuuaauuaugucuaauuugguguuuuuuuuuuuaaaguuauaaagaugcuucagacugcaaagaauuuguugaaagaggagaaauuggugcauagcuauccguaugacuggaggaccaagaaaccugugguuauucgugccagcaagcagugguuuauaaacaucacggauauuaagacugcagccaagguauaaaaagcauccuguuuuaacaggucgggcauaucauucccucaguauaaaggggcugcaugugagguugaggugggguuucaggaguaauagggauugcugcuauuaugauuuaguuucauaacauuguagaauuuuagaucuggaaggaccuuggacuuccauuuuuucauuauacaugugugagaaaugaggcauaaagagguugagugauuuguccacaucacacuguuaguagauagacuuucuugcccaguguagucaaaguugcauagaauuuggacagaacuguguuaccuaguuuaaccucccacugccucuguuuccucaucuauauaaagugguaauaaugcguaucucauggaguaaggaaauucgaguuuccagaauauggucugauacauaauaagcagucaguaaaacuuuuuuaaacccuuugcuuccuuaagauugaaauuacaaucaauuaaaaaaguuacuguucugcuuacaaaggaagcauauuaaaaagaaaaacuaacaauaugaaaaauauacaaaguuguugcuuuggagcuaacaaauacuuauaauugguauuuaaauacuuaauauauauuugagcccuuucauuuaauauguaucuuucuauauggguauauauauauauauauauauauguguguguguguguguguguguguguaaacaucucucacaacuugauucuauuuaaugaaagagcuuaaauauauauguguuaaccagguugaauauauagauauuuugcuuuacaguuugaaagauacuacuguauuuagcugguucauuuauuggccuggcaauuugggguccuugccaaagcuuuuuauagcaguuuauacuuucuauacuuguguaauguggacaacuauaauauauagugcauuuugguuuuuucuucauuuaaagccucucuuccuuauuugucaauguuaaaauuuguaaauugcagcucugcaccgauuuuugguuguagaacaucuaagucugacgcaauauauuuaagccaaguuuuuuuuuuaacuuuuuuguaaaguuaaaaauuguucuuuguagaaguagugagaauaggauaauguauugucguauucccaucacucaguuucaacaauaaucaacuuuugguuaauuuuguuuuuaucuacaccccuccgaccaccuacuuuuuuuuuuuuuuuuuuuuugagacggagucucgcucugucgcccaggucggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggcccgaccaccuacuuuuuaccccuuaacaauuggauuauuuuaaagcaaauuccaggcacuauuucuuccauauuauauauugucccggcgauauuuuagcacauauauuugaaagauaagcucuuuuuuuuuuuuuuuuuuuuugaaacagggucuugcucugucacccaggcuggagugcaguggugugaucucagcucacugcaaccuccaccuccuggacucaaccuauccucccacgucagccuccugaguaacugggacuacaggccugugccaccacaucuggcuaauuuuuguauuuuuucuagagauaggguuuugucaaguugccccgguuggugucgaacuccugagcucaagcagucugccugcuucggccucucagagugcuguaauuacaggugucagccaaagauaaacucuguauuuauuuauuuauuuucuugagauggaguuucacucuuguugcccaggcuggagugcagugaugugaucuuggcucacagcagccuccaccuccuggguucaagcaauucccugccuaagccuucugauuagcuggaauuauaggcaugcaccaccaugcccggcuaauuuuuuuguauuuuugguagagacggaguuucuccauguuggccaggcuggucuugaacuccugagcucgggugauccgcccuccucagccucccaaagugcugggauuacagacgugagccaccaugcucggccaaacucuuuaaagcauaauucccaugccauuaucaccaccuuuaaaaaguaauaguuauuccuuagcaaaaucaaauaucuauucaauauucacauuucuuagacuuuuaaaccaaguaugguauuaaucaaauugauuuguagagauuuugccauucugccaauagguggugcuacagagagcuuugugggaggggacuucugguaguuacggugagugaggaaaccauuuaaaccuucuuugaaaauguaaaaaugcuuuuauuaauggauagaaagauuuuuuaaaaugaaguuaacauuuugaccuuuuuggagacuauuaguaaacauuuuugcuauacaguuaaucuuuugcuaguugacaaauuaaaucaaaugguagcaguuuucaaccuuauuuugggaauggaggaagggagcuuucuugagaggaaguaacuguuagccauuugucgauagauauauauauauagagagagagagagauuuauuuuagagacaggcucuugcucugucgcccagguuggagugcacugccaugcucauagcucacugcaaccuugaacucuugggcucaagugauccucccaccucagccuaccaaaaugcugggauuacagguuugaaccacauacuugggcuuauuuugagaaaguguuuucuguguuguaaacuauauuauguaaaauuagguauaucgcaaucuuuuuuuggcagucuacgauaguaauuuauuuuuuaagcauuuuaaaaaaugguggaaaucaaguuugaauugauuuuaacuauaguuuagugaaguauaauaguucuaugaaagcuuuuauuaccaguuuugaucuaggguugguguaaauuagaaauugguaugaaaucuuuuguaacauuguuaaaaaaugcaacaaugcuccugauauuaucacugcucccgauauuauuuauuaaguucuucgcggcuccauuuuuacuuugccuuauuugcucugaaaucuuuuaguucuuuaguuguuuuuuugaggggaggguaagggagguaugugaauggcuacaaacauccaaaagaaacaaaugcauuuggaaaauugacuguucuagaauacuuguucugcuuucucucacaagacuugauuuaugaauuaauugcaggaauuguuaaaaaaggugaaauuuauuccuggaucagcacugaauggcaugguugaaaugauggacaggcggccauauugguguauaucaaggcaaagaguuugggguguuccaauuccuguguuucaucauaagaccaaggaugaauacuugaucaacagguagaaugcuuucuaaaauuuuuuaguguuuuaaagugaaauauuuuuucuucaaaaauugaaaaauaauguggaugauuaagaaccguuuauauauguuaaauaaaauaugcuaaaauagucuuuugggggacuaaaauauaaguucaaaacaauucuaucauacaguuaaaauauuaacuagauuuucuuaaauauugauacuuagaaguaaagucucugacuuuuuuucuaugagaauuuauugggcuguauuaagguaucauggauccaaagauggacaguguuuagcaggggagccugaaauguauuuuuucuaaaggaaugaagagaaucacucucacauucugagucugcuuuccuuuucaguggaaaugggauuauguaauuguguagauacuuaaaauuuaagaaauuguaguuaaaugcacaugauuacacugaugauuauauucccaguuuuucccuuuuuuuuuuuuugaguuggaaagguaauagauggacauagugaacaauucauaguagaaaagcuuguacacugaaaaguaggcuuuuuccuacuccagguauccagaaccuuuuuuugaggcagucauuguuuacagcuguuucugaaucuuuccagaaaaaaugaauucuucugucagcacauacauauguuuauacaaaagagaguaucucuaucuucugcucugugccuagauuuuuuucacuuuauguguuaugauuuauuccaaaucacuacacauagaucagccucauucuuaagcuuuauuaaagcauacuuuacauacuauaaaauucauggccaggugcgguggcucacgccuguaaucccagcccuuugggaggccgaggcugguguaucaugaggucaggaguucaagaccagccuggccaagauggugaaacuccaucucuaccgaaaauacaaaaauuagccaggcaugguggcgcgggccuguaaucucagcuacuccgaaggcucaggcagagaacugcuugaaccugggaggcagagguugcagugagccaagaucgugccacuggacuccagccugggugacagagugagacucuaucucaaaaaaauuaaaaaagaaaaauucauuuauuauaagugauuuauaguaaauuuguuaaguuuuacagccacuaucauaauugugucuuagaauaauucuuuuaucccgaacagcucccuuuugugcuuuucgaaagagaaguugcuuggaaaucugugagcuuuggagaauggcaacugaauuugaacccaggcuuugccauucacugugugugagacugaggaauuuacuuagccucuggcuccucuauaaaauaggaaaagcaaugguugcagguagacuguuaugaauacuaaauaauaaaugcaaacuacuugguguaaagcacaguauuccauagaugaugagcuauucauguauucacuuaagaaacauuguuaugugggcacaguggcucaugccuguaaucccagcacuuugggaggccaaggcggcaggauugcuugaagccagcuguucaagauuacagugagaccccaucucuacagaaaaauuuaaaaauuagcuggugugguagugugggccuguagucccagcgacuugggaggcuaaggcgagaggaucgcucaaguccaggaguuugagguuauagugagcuaugaucaugccaaugcacuccagccuggaugacagagcaagacacugucucuucagaacgaaacaaaacagaacacauugucaagcacuuaguacgugucagugcuaggaacugcuaguugcuacagugaacaagacugacauggccccuguuuuuaaugagauaauagucuagcuaguuuaucuucuaguaauauuagggaggcuuugaguguuguugcuguuuuucacagauguggagaggggaauguuaauucuuccuuuuaggaacacauuccagauuuucauuuucuuugagcaauuuuuuuuaauuuggugaauggaauuuuuucuaaauuaugcuauuaagaaguuuaaacuuuuaaguagacuugaggaguaagaguauguuuuaggaaaagaaaguagaggcuagagacuggaaagucauuggaaagcuauuucaauauuauuauaaguuggaucugagguaagacuuuaggaauaaucuaaauauuguugcugugguguucuuacagagcuuggucagauguaaacuacuaauaucuuaauacuuacauuaagaauuaauguaaauucuguccaguucagauuauuuuauuuuauuuuugauacagucucacucugucacccaggcuggagugcagugaugugaucuuggcucacuacaaccuccaccucccagguucaagugauucucccuccucagccuccugaguagcugggacuacaggcacgcgccacugacuuggcuaauucuuguauuuuuaguagagaugggcucuugccacguugacgaggcuggucucgaacuccuggccacaaaggauccauccaccucugccucccagagugcugagauuacaggcaugagcuaccaugcccagccucagacuuaguuuaaaagaaaaagaauuaaagugauuauaccugagacgaguuuccacaaacauuuguuuaaaauuucacacuggaaaguuuuuuuuuuuuuuggaaaguuuuauaagccaugucauugucuccucuucuuuuuuuuuuuuuuuuuuuuuuuugagauggaguuucacucuuguuuccuaggcuggaguguaguggcacgaucucagcucacugcaaucuccgccucccagguucaagugauucuccugccucagccuccugaguaguugggauuagaggcaugugccaccacgcccggcuaauuuuauauauauauauuuuuuaguagagacgggguuucuccauguuggucaggcuggucucaaacucccgaccucaagugauccgcccgccucagccucccaaagugcugggauuacaggcgugagccacugugcccggcuacucuucuuuucacuauuuagagagcaagaugucuagggaauuucacugaagugauugagguggguggggauuccuugguggaauagcccucuggacucugagguggaucauauguauguauuaguaaauauagcaaacugguuuaauugauacauccugauaauuaaaugguacauagguugacuggucaguaaguuagguuaaauaaauaugagcuuugucagaaaaacacaaguuuucauuagguauauuuauguuuuauuuacucaauacauuuacaugguaguguuacagauuaucuucuguguaccugccauugcguugguugcgugguguuagucgauuucugauauugaaguagcacagucauacagaauauuggccuaaagaaaugacagacaaacucagcuauauugucugucaauucauaggucauuuuccuguauaccauuucugaaugaugacuuuaauccucuuccauuauuggaucuuuuugguguuacaaaacuugaauuuaagaaaauugauauuaauucuuaaucauuuguuaauuuuauaaaacaggcugaaaaucuuuuuuucugcuggaaucaaaugagaguccaagugaccacaauuuucugucuuucuuuauuauaccuuuauauuguagcaaguugguaaccaucaaaaguaacagcaucuccacuggaaauugguacacaguccacauggaguugcuguuacacuugauaacaccauuaaacauauaaggagauuccuuuugcucaucaugggagcuguacgauaucucuaaguauacuuguuucacagaagaaagucucgauuuauucauguucuaaauaaguuuagggacugguagauuugaaacgcugauguuuuauuuugauuugaauuaauagugucauuugcauuuuagaucauauuuguauuuuaucaagaaauaauuccauuucugacuuuacugucauuggucauuuuuugaaucugugagauaaugccauuagaauuuggguugaaaucuguuacuagucaauaaaaacagaagaaauaauuuuuagcauaaaaaagauaaaauguagaaacacuggcuaccugggaaggaaaagaaguugguuaaauuucuuucaucauuucaaacaguuauaaucacuuucaugcuauuaaugcuauaguuaacauagugaaacuuagccccuaacuucuggaaauuaugagaaauuuaguaaaaauagccaaggaauuuccaauauaauuugaguguuaacuuuagcuaccucaaauuuuuucucaguuaacaauaauaaaccuuuuguucaaaaaauuuauguucauuaaauaaagaaaaauuucuucaaaaugguuuucugucagcuuuaaaacauaaaucuaggauuaaacuaaaaauagaauuuccccuuccaaauuucacauuguucuagaauuaaauuuaguaaacaaaugugaaacauuuagccucuuaccucauucuucuuccaguaaguuacagaagaaaaguugucuuaauaaucuucaauauuuuugcuuauaaaggcaaaacacagaagacagugggaugacagcagucguuucuuuguugcuuuaguaaucuuaaugcugcuuaauguccauaacacgcuaaauaagccucauuccgguugauaucgaaguucagaaugauuggcugaugucauaguugcucaugcuaccuaguggauuuucacugauugaaaccuaagaagggacacguaaugcauguguugagauaaggccuuugaguaaaguacaagguuuuaugauggauuuauugcuuuaugaaguaaagcauuaagauggaagcauauagauuacauacugguaagugguuucacccacuuuuaucagcagucguuuauacugaucuuuggguuauagguuaacuaugaguuuguguuaaguauacaauguuaaagaaaugaagguagaauucuuaaauuucagacaaauuaggaauuuuccugcauuuuuuucugaagaauauuaaauaucacaaggaaauaguuagaaaauuguuuaaaaauuuuuuuaggaaacagaaaauuauuuaagaaaucuuuuaaguauuaucuugguuucauuauaaaaaaauuccacuucuaaguauuuacccaaaggaaauaggacuaauaccucuugugugaggauauguauauaagauguccaauacaguuguuuauaaaggaacauaaugauauacaaaagaagauguaauuuaauuaguuauagaagaaugaauauguaccuguuaaaaaugucagcuuagcucuuaaugguugccuaguuccuuguguaugaaaaucaaaugaacauaacuuauccaguguuuggauuuuguuagauguuugucacaucucuauaaugagugucuuuugagcacuuguucacaguuaacuuuauauacuuuuuucaaauuaucuuuuuagauuuuguuugaacauuaaguuuaucuuuguuuuuaucaucauuauaccuagcucaaguuuguggguuauaugucuguuuauuuuuauugcaauuuuuguuuucaaagcucucugucacacuuuuuuuuuuuuuuuugaguuggagucuugcucuuguuccccaggcuggagugcaauggugggaucuuggcuaacugcaaccucugccucccagcuucaagcgauucuccuucuucagccucccaaguagcugggauuacaggcuugcgccacuaugccuggcugauuuuuguauauuuaguagagaugggguuucuucauguaggucaggcuggucucgaacuccccaccucaggugauccgcccgccucggccucccagagugcugggauuauaggcgugaaccaccgcgcccggccuuuuuuuuuuuugagauggagucucacucuguugccaggcuggagugcaguggugcaaucucggcucacugcaucuucugccuccuggguucaagugauccuccugccucagcaccccccaaguagcugagacuauagucacgcaccaccauaccuggguaauuuuuguauuuuuguagagaccggguuuugccauguugcccaggcuggucuugaaguccuuagcucaaaugauccaccuaucucagccuuccaaagugcuaggauuacaggugugagccaccgugcccgcccaaaauuaauuuauucaauugacaaaaauugcuuauauuauguacaacauguuuugaaauauguaugcauuguggaauggcuaaaucuagcuaauuaacauguauuuguuggguuuuucuuuacucucuuauuuuaaaauuaacuuuauuguuuuaaaaauacaaauaauuuaucuagaaucucauaauagaaccgaauuauagaacauaaugcuuacuaaagugcauuuaguagacuuuauuuagaacaugauguuuucauaauucacaauauaaaguaaggaaggaagucuugcucucuaaauauuagugagacuugcucucuuaaugagauaaagcuucuucccuuaaaaauguuucauguuucuuuuggauacauugaacaaauuuuucuuuuguucugauucauauacuuauguaacaaggaaaaaaaucugaaguauguuguuuuauuuacaguagccuuuuugaaauuggauuuuuaaaaauaauugcaggauugcuuuucauugauguagcuaauguguaguuacguuguuucucguaaguguaauuagguaagcuaaaagaaaaacaaaaaaccuuuccuccucacuaagagacuuuugucaguuuuuuuaaaaaguuuuuuaaauuugcaaauaaaguauguauaaaacacaaaauuacauuucuuauauuaaaauaugcgcuauaucuaaauuacuaauauuguuauaaaaauguagcaauuaaaaugaauuuuagacuagaggugucugacuaaacuuggugggauuuuacgguugcuuuaauaacaugccaacagcaaaacuggaaucuuucuuucuuaaugcuuuuaguuauaugcucaguagguuacuugaauguaguuaaauaacauuuaaaaugucauugaauuuucugauauuuaggaauaugaaaaagaacuuauuuuuauuuuuuuuaaaauagauguggggucuuuacuauguugcccaggcuggucuugaacucuugggcucaagugauccuccugccuuggccucccaaagugcuaggauuauagucaugagccaccgugccaggccaagaauaugaaaaagagcuuaguuuuauuaaaguugaauuuaggauucuaaaauauggauguggagcugagugugguggcucacaacccauaaucucagcauuuugggaggcuaaggcuggaggauugcaugaggccaggcauuugagaccagccugagcaacaaagcgagauucccaucucuagagggggggaaagaaagcagggcauguuggcaugggccuguagucccagcuacucaggaggcugaggcgggaggauuacuugacgcaggaguucaaggcuucaagugagcuaugaucaugccacugcaauccagcuugggccacagaguaacaccuugucucaaaaaaauuaauuaauuaaaauaaaauaaaauggauauguuucaucuauagucauaacguuacucacuuucuuuaguuauuaggacuuuuucuuuuaagaauaaaaauuuucgccuagucuucgucacuuuuuccgauguuuauagaaacugaaacucaaaaaauaguaugauuuauuccugucauuuuccaguuaaguccaguuagagucuggucuuuggacuuagugcuugcugugucaacacacuaaucuccugagacugccuaguuccucacuucaucucugauacguagucuucacucuaugccuggguaaaagagccuuucugccauugcuuagcaaacuccagagaguaagagugugaauucaguuacaguguugucuuuauagaugaguuagagaggcagaauaaagaaguaaaaacagcacaccaaacuauguaugauuuaggaaacacaaauucaagcccugguuuuaacuguuacuugcuuagcuucauaauuuaaggaacccuaaggugcagaacaaaucauuucucaagacccacuguguauuucugugaauccaauuagcaagugcuuguaaagugcuucgaaaaagauaugugguguacguauauacauaguuuuguauacauacaaauacucuuuaucuuuuauacauacaaauacauaaaauacucuuuauccuaacauuucuaccguauuugcuaaauuaauaugaaauuugagacauuuacuuuuacuucgauauuauuuuuaugucuuuuuccaauacauuuaaagcuguuuuacuguuuuauuuuacucuuuaccuaaacuugccagucuaaugauaacauuguaaaaaaaaaaaggcaaaaugacacccauuuuuagaauuauucuuuuuuaaugagaauuucauuaguaugaacaguguuaucaauuguaauugugcguauguguccauguaaauguacuuuacuaguaucucucuuuuaugguuguaaucuuuuuguuuuuuuuuucuuuuggucuuuagauuuauucagauuuuucuauuauaccauauucauauuuucuuaacugaaaauguucuggacaaacuauauaaaauaguaauauguaacuaaauacuauugucauauaacuagguaguuauuacauaagguuuuuauggucugauaacauaaaaguuuaucuuuacuguuaaaguccaucuaaaaugauucacugucuuagaaacaugcauuuaugcccauuuuccuuucucauuauaaguucuucaaaguacaugaugguaacauuauacuuuuaaaaucuauccuucauagaauaccaacuuacugauauccagcuuuuauaagguauuucaaauuuaaauuuguagagcauauuuauuuauuuauuauuuuuuuugagacggagucucccucugucacccaggcuggagugcaguggcgcgaucucagcucacugcaagcucugccucccggguucacgccauucuccugccucagccucccagguagcugggacuacaggcgcccgccaccaugcccggcuaauuuuuuuguauuuuuuuuaguagagaugggguuucaccguguuagccaggauggucucgaucuccugagcucgugauccgcccgccucagccucccaaagugcugggauuacaggcgugagccacugcuccuggccuguagagcauauuuaauuuauacucauuugauuuugcuuuccacaacaauuuuugguaaacacuucauuuaucugugaauuaucaggcccagaccugacgucaaauaaucaguuugaauaaugcuuacauaguauuuauucaaaugugccagguauuguucuauguguuuuauauuuauuaacucaguuaauauucauaggaagucucuucaugaugcuguuacuauuuguguuuuacaaaugaggaaacaggcacagaaauguuaagugccuugccuggguucaagugguggagccagaaauuaagcuaaagcccccugcuggcaggauccaugcucuuggccauuauauguacugugacuaaaugaaaagcaacuagaggaagcuguaauagcaacaaagcuacaauaauaaauucaauauucuaauaaaucaaaaauauuuuauuuuugugagaaacuauaguaugaauuuuuuucccugaguuuaauuuuuaaauaauuuauuacuguauaucuuccuaaagauacgaccaguucuguuauuuauuugauagggguugauuggcuuucugucauguguuaggugcuguacuaaguuuuacauguauagucucauuuaguuuguaguuguucugagggaagugucuaggauuacuacaauguuaaguuucaccaggggagggaucuuguguauuuugccaacugcuguaucucuagugccugugcccaggacacaggagguguucaauaguuucugaacaaugaauuagauuguucuuaacagaagggaaagcuaggucuuaaagaaguuuuaguacuugugcauggucauauaaauacaaagugacagucagaauauaagccuggauaucugucaucacagucucugcucuaauauggcauugcaucuugugcagaugccuguaagcagggagggaguccuggaaaguuuucaagcagagaauucgugugauaaaagcaguuuaggaaugcaucuauuucaaggucuguuuuguaaaguaaagggaugaggguaggaggaaguacucucagaccauugauugcaucaguuuaguuuugagggaaugagguuggacugauacagugucagugggaaccacuguaaucuuucaaagguagaacugagagaauguguugguuuaauuuaggcagaaaucagaagagggaagauaauuagaaggcuuugaguauaaguaccuggauagaaaauagaugaguaagaaauagguaaaucaguaacggaaacagauguuuuuucuuuuuaaggauauguauaaucaauuuuuuauuuauauugaauuuaaaaugauagcagcuuuuucuucaaacuaagguuugaggaaaaaggaaaauaaaucacuauuucuuaauuuuaaaauguuuguuauucaucacaauaguuaauugaauaauucugccauguccccccugaaauagccaaaccacugagcauauuguuaaacuaguggaacaacacggcagugauaucugguggacucuucccccugaacaacuucuuccaaaagaagucuuaucugagguaaauuucuguuuguauuuaacagccuuuguauguauuacaggacuuaaugacaacaugagaaauucuugagaguuaaaaaauuaucuuauguaaaguuaacaaauuuauuuacuguaaauuagaagcuaaugcagugugaaaguagacauuuuguuuaacuauagaaguguaguauuuaaggcugggcgugauggcucacaccuguaauccuagcacuuugaaaggcugaggcagacagauagcuugaguccaugaguuugagaccagccugggcaauauggcaaaacccugucucuacaaaaaaauauaaaaauuagcugagcauuguggcaugcgccuguagucccagcuacuugggagguugaggggggaggauggcuugagccuggaagacagguugcagcgagccaagauugcaccacuacacugcagccugggugacagagugagagcccaucccugcaaaacaaaguguauuauuaggucgggcgcaguggugcacaccuguaaucccagcacuuugggaggccgaggcgggcagaucacaaggucaggagaucgagaccauccuggcuaauacagugaaacccugccucuacuaaaaauacaaaaaaauuagcugggugcgauggugggcgccuguagucccagcuacucgggagacugaggcaggagaauggccugaacccgggaggcggagcuugcagugagccgagaucgcaccacugcacucuagccugggcaacagagugaaacucugucucaaaaaaaaaaaaaaaaagaaaaagaaaaagccacgcaacauaccuuuagucccagcuacucaggaggccgaggcaggagaaucacuugaacccaggagacggagguugcagugagccgagaucgcgccauugcacuccaggcugggcaacagaguaagacucugucucaaaaacaaaacaaaucaaaaaguguaguauuuaauaaaguaguggaaugugagggucaauuguuaucucauugagggccaggauugauugauguugacugauuugguugacuaagcucauguaauuuacuguuagagaacagugccuaaugguacaucaggccuuuguaggaucuguaguagaguuagcugauuguaucacacauuaaaauauccaaauuuaaaguuaauuucaaggaaauaaaaaccaauucauauuacauugguaaauauguaauucaguggccacagauacuuuuaaaugugaauggagggaguugaaguuaacugugaaaugcuuaaaaauacuguaaauuucaucuaaaaaugugaacuucaugguugcauuucauuuucugaagacuuuugggguacaguauuuguugucuauauugugaucuuuguguaccugacaugcuuuugcauuaucuuacuagguugguggcccugaugccuuggaauaugugccaggucaggauauuuuggacaucugguuugauagcggaacuucauggucuuauguucuuccagguaauucuuaaaaauagauauaugccgaucaagaaguuuugaaaauauggaauugguauuuagaagggaucuauaaucaaacucuuuuucugugugugcuuuauuuagagaucugcuauauuuuagaccucgaaagacccuuagaguuuacuuaauccaaugauuucuaaaccuuuuucuguuuuucuagaugaaauuucauuuagaauuuauaauacagaaaauaguuaaacaugggaauauuuuuccuccuuucaaccaguucauucuccuuggccacuuggcaaccccaaggcacccaguuuuguaaaacaaaguuuggaagucacugaaauagucugaccccauaauuuuucagaagagaaaaugaaauugacuuagagccaaauuaggugauggucacauagcuuaguagugucaaacuagaacgcaaguacccugauuuucaguucucaucuucuauacuacauugcuuuuuguggcuuuuucuccucucuguacaaacagcugacuaacuuuauacuuacagauaauuagcgaauguuuuugacugauuggauaaagagaaaggagagacguugggcaggaauuagaaaggaguaguaggagaaggcacauauuagaggauguguuuagaugcuugagaagaaauauuuuuaaggcaacuaagugaaaagauagaguucaaaugaagaacaaggcuuguuaucacugugaaguuggagacagggaugagaugucacggaggcagugauggaucacacaguuccucacacuccuacuaagggccagcuuuggccugagagacccuguuugcuuucuggaguaaggguaugugggaaaaguagcuugucuaugaaucacacaauaggauuccuaguagguggaucuauuuccuucauuuaagccuuucuuucagcuuaggaaguuugaaaaacaaaaugcauauaaauucauguuuacucucuauuacaaguaaaaugugcguaauaauaauggccaaauauaaguuacauauuuuuauaauuuuuuuguagugauuuucagaauuauuauuucauaauuuuucucccagcauauucgagagaaaauacugcaaguuuagguacuugguuucccuaaauuacagucauguguuauauaaugacacuccagucaguagcagacugcauauaugaugauggccccacaagaugauaauacaucugacuccugaacaacaggguucugacugcacaggucuacuuauaugcaauuuuuuucaaugaaaugcagauggaaaauauaguauucucaggauuugaaacccacauauagaaagggagggccgacuuuucauauaugcaguuucagcagggccaacugugggacuugaguauucacagauuuugguacauauggggguggggggcugggggguugguggguccuagaaccaauccucugcauauaucaagggaugacuacuguauuuuuacuguaccuuuucuguguuuagauauguucagauacacaaauacauaccaugugcugacauugccugcaguauucaguauaguaacaugcugugcagguuuguagccuagaagcaaaaacacuaugccauguuggcuagguguagaguaggcucucccauugagguuuguguaaguacacucuaugauguucacacagugaugaaaucaccuaaggacacauuucucagagcauaucucuauuaagcaaugcaugacuauguauugaaaaugcaggucaauaccacuacuuaagguaguaggaagaagaguuuccugcuggcacauuuugggcagcauucugaauuucagaaaagaguaugccaauugugaaacagugagguauaguguauuucaaaguguauucacugcuuuaggcuuugugagaauuaaugcugcuaccauuguugcuuuucaguuucugaaaugguuuuacagugcaguuaagugcacguuauauuuggcgcugucaaguggguuaaaauccaugaaaacuggcauuaaaaucuaucugauagaguuuagucauaauauuucuagagugugauuuuuuuuuuuuuucgagacagugucucacucuguugcccaggauggagugcaguggugcgaucucagcuugaguucaagugacucuccugccucugccuccugaguagcugggauuacaggcaugugccaccaugcccagcuaauuuuuguguuuuuaguagagaagggguuucaccguguuggccaggcuggucucaaacuccuggccucaagugauccaucugccucagcucccaaagugcugggauuacagacgugagccaccgcacccguccagagugugauauucuuaaccaaaugauuuucacugcaacagaaaaauuuuaaauuaauucauaauaauuguacauauuauugaguacguguaguguuuugauaggugcauuuaauauguaaugaucaaaugaggguauuuaagauaucuaucaucucaaacauuuaccauuucuuuguggugggaacauuuuauaucuucucuucuaguuauuuugaaauaugcaauaaaugguuacuauauuuacccuacuguauuaaacacuagaauuuaucccguauauguaacuccuuuucuauccucauugaccaaacucucuucaucccucccucucacccuucccagccucugguaacugucauucuacuuucuaccuccauaagaucaacuuuuuuagcucccacauaugagugaaaauauggaguauuugucuuucuaugcuuggcuuauuucauuuaccaucaugaccuccaguuccauccauguugcugcugaugacagaauuucauucuuuuuuauggcugaauaguauuccauuguguauauuuaucacauuuucuuuauccauucaucuuugauggauaguuagacugguuccauaucuuggcuauugugaguaguguuguaauaaacauggagaugcagguauccuguggauaugcugauuuuauuuccuuugcauaaauaccuaguagugggauugcuggcuuauaugguaguucuguuuuuaguuuuuugaaaagaaaccuccauaauguuuuuuauaaugacuguacuaauuuacauucccaccaacaguguauaauaguuccauucucuccacauccuugccaucauuuguuacuuucuuuuugauaauagccauucugggcuaacugggguaagaugauauaucacugugguuuugauuugcacuucccugaugauuagugauguugaacauuuuuucauauaccuguuguccauucauaugacauccuuugagaaaugucuguucagacccuuugcccacuuuguaaugagguuuuuuuuguuguuucuuguuuuugcuguuucuuuauuugaauuccuuuauaaucugaauaucaguuucuugucagacaaauaguuugcaaagauuuucuuccauuccacagguugucucuucacuguguuguuuccuuugugugcugcagcuuuuucuuaauauaguuccauuugucuauuuucgcuccuuuacuugugcuuuugaagucuuagccauaacauuuuugccuagaccgauguccuggaggauuucuccuguguuuuccucuaguaguuucauaguugggggccuuagauuuaagucucucuuuugaguugauuuuuguauauggugagagguaggggucuauuuucuuucuuucuuuuuuugagacagagucucgcucugucgcccaggcuggagugcaguggcacgaucuuggcucacugcaagcuccgccuccuggguucacgccauucuccugccccagccucccgaguagcugggacuacaggcaccugccaccacgccuggcuaauuuuuuguauuuuuaguagggacgggguuucaccauguuagccaggaugggguagggguuuauuuucauucuucugcacauggauagccaguuuuuccagcaccauuucuuaaagaggguguccuuuucccacuguauguuccuggugccuuuguuggaaaucaguuggcaauaaacugguagauuuauuucuggguucucuauucugucccauuggucuaagugucuguuuuuauaccaacaccaugcguuuuuacuguaacuuugcaguauauuuugaaguugggcagugugaugccuccagcuuugugcuuuuugcucaguauugcuuugacuauuugggaggcuuuuguguuuccuuaugaauuuuaggaugaauuuuccauaugaauuuuucuguuucugugaagaauaucauugguauuuugcauggaauugcauugaaucuuuauuuauuuauuuauuuauuugagacagagucucgcugugucgcccaggcuggagugcaguggcacagucucggcucacugcaaccuccgccucccgaguucuagugauucuccugccugagccuccagaguagcugggauuauagucaugugccaccacacucgguuaauuuuaauuaauuaauuaauuuuuuugagauggaguuucacucuuauugcccaggcuggagugcaauggcgugaccugggcucacugcaaccuccaccucucggguucaagcgauucuccugccucagcuucccaaguagcugugacuacaggcaugagccaucacgcccagcaaauuuuguauuuuuaguagagacgggguuucuccauguuggucaggcuggacucagaacuccccaccucaggcgaucuguccgccuaagccucccaaagugcugggauuacaggcgugagccacucugcccagcaauuuuuauauuuuuaauagagaugggguuucaccauguuggccaggcuggucucgaacuccugaccucaagggaucagcgcugcucagccucccaaagugcugggauuacaggcaugagccacgaugccuggccacguugaauuuuuuuuuuuuuuuuuuuuuugagauggagucucacucuguugccuaggcuggagugcaauggcacgaucucagcucacugcaacccccgccuccuagguucaagcaauucuccugccucagccucccgaguagcugcgacuacaggcauccaccaccaugccuggcuaauuuuuuguauuuuuaguagagacggguuucaccauguuagccaggauggucucgaucuccugaccucaugauccaccugccuuggccucccaaaguguugguauuacaggcaugagcuaccgcaaguggccuguugaggauuuuugugucuuuguucaacagagauacuggccuguaguuuucuuuuuuguugugucuuugccugguuuugguaucaggguaaugcuggcuuuguacagugauuuaagaagaguuuccuccucuucgaugcucuggaguaguuugagcagaauuguuguucuuuauauauuugguagaauucagcaguaaagccaucugguccuagacuuuucuuuguugggagauuuuuuguuacuuauucaguccgguuacuccuuacuguucuauuucuucccgguuuaaucuugguagguuguauguguccagggguuuauccauuuccuccagguuuuccuauguguuaguguacauuuguuuauaguagucugugaugauccuuuguauuucucuguugucuguuguaugucaccuuucucucucuuuuuuuuuuuuuuuuuugagauggagucuugcucuguugcccagacuggagugcaguggccugaucucaucucacugcaaacuccaccucccagguucaagcaguucucugccucauuccucccaaguagcugggguuacaggugcccgccaccaugccuggcuaauguuugcguuuuuaguagagaugggguuucaccaucuuggccaggcuggucuugaacuccugaccucgugauccacccgccuuugccucccaaaguucugggauuuuacaggcgugagccaccgcacccagccccaugucuccuuuuucauuucugauuuuguuuauuuggaucuucuuuucuauuuucuuagucuagcuaaagauuuguuuucacugcauaugcauuuaccuucuuacauuaucucagacuuuccuggcugcacagacuagauuaaacucuuuauuuuccccuugguaacacccaucacaguuauuucuuuucuuuuuuuuuuuugagacagauucuuacucugucgcccaggcuagagugcaguggcacaaucucugcccacuguaaccuccaccucccagguucaagugauucuccugcuucagccucccaaguagcugggauuacaggcgcccaccaccgugcccagauaauuuucguguuuuuagagaugggguuucgccauguuggucaaccuggucucgaacuccugaccucaggauuugccagccuccaccucucaaagggcugggguuacaggcacgagacacugcacccggccccaucacaguuauuucuugcuuaacauaaaaucuacccuacuaggugucagcuccaagaaggcagaguccagauuuccccagggucuaacacaaugccugcuauauaacaagugcucaguaauauuggugcaauugaauugguuugauucaguuauuuaaauuuuguuuccccaccuccacucaguuaaucuuucuuacaugaagauuacaacacuaaauuuucagucuuaggacauaaggacaaaucauaauuuuacaaauaaaagggauuaugggggcuuugagaguugugaguuuagauuuaaaauauagauguaaucuuuaucaacgaccucauguuacuuuuuuuugaaaacccuuuuauuuugaaaagucauaaaguaucaugaagaauuacagcaugcucuucaucuagauuucccaacguuaacauuaacauuuugcuacaguugcuuuauauauccuauguauauauauguagaggaaaagaugcaucuuuuaucucaauauuuuaguauauauuuccccaaaacauggauagucucuuaacauaaccaacacagauaucaaaauuagggaauuaacauugauuccauacuguuaacugucuauagaacuuauuccuagguggaaagaggaaaaaaaaaaaaggacccaagaucuaaucugagaucacaugucacauuuaacugucaugucucucuaguucuuguucugugucuuucaugacauuucaugacauugcuugacauucaugcaguacagguuuauuuuguagauggucucucuggguuugugggaugcauugucaugauuagauccacguuaugcauuuuagguaggaauaucacagaaaggauacuguguuuauuucaguacaucauuucagaagucacgugauacaucucugucccauuacuacuggugauguguaacuuuggucacuuucuugguuaagguggcaucugucaguuuucucuauuguaaaguuacuucccuuccuccccacuaauuguuauuaauaaguaucuucuuuuucuauuuuaauuaacuuaaauuucuggguuuuuuuuucuuuuaauacuuaauuuugagguccugaccaaagagcagauuuguacuuggaaggaaaagaccagcucggggguugguuucagucauccuuauuaacaaguguggcagcaaggaagagagcaccuuauaaguaaguauuuaugccugaaccaaccugcugaguaccugccagugugugaagcacuaugcugaguacuacagagaugauaaggcaccacucuugauugcuuacaguguccuguaagaauuugaaguaaaaaaagagaaaggaaaaaggagacaacaccaaggugucuugugagugugaugcagaucauaacucuuugaagaaaaagucagcauugacuggaguaguugggggaacuuauguaguucuuuguuguuguuguuuuuuuuuuuuuuuuugaaaaaggaucgcauucagucacccaggcuggagugcaaugguguggucagagcucgcugcagccuccgucuccuuggcucaagcaauccuccugcuucagccuccugaguagcugggauuacagacaugcaccaccacaccuggcuaauuuuuaauuuuuuuuuagaggugcguucuccucccauugcccaugcuggucccaaacuccuggccugaagcaguccuccugccuuggccucccaaagugguaggauuauaggcgugagccaccaugccuggccuagaacuagaucuugaucuaugguaaaacuugacuaggaggaauguagggaaggauauucaagguugagagaagacagccugagugcagauguccuuuauauuuguaauauccacaguggcuagugaacugaaacauugcuuucaugaauuuuauuaaauuagguauucucauuuaguacacauaauuacuuuuucaaacgugugggugaaaguacuaaucagaaagauuccuaaauagcuuagcuuaagauuguggcucucuuaggauaaaaacccaucccagaacauuucacauguuucuuuuuuuuuugagauggagucuuguucuauugccuaggcuggagugcaguggugcgaucuuggcucacugcagccucugucucccggguucaagcgauucuccugccucagccucucgaguagcuggaauuacggagcaugccaccaugcccggcuaauuuuuguacuuuuaauagagacgggauuucaccauguuggugaggcuggucucaaacuccugcucucaagggauucacccuccugagccucccaaagugcugggauuacaggcgugagcccccacgccuggcccuuuuacauguuuuuguuucuuaacaugcguuuuaaagaccaguaaaagggcagauccuauuuuuuucaaauugucuuuugaaaauaauuuugagaugauaaucugcucuuuuuaagacauacuuuuuccugguuuuauuuuuucauuuaaaauuuuuuuuuuuuuuuuuuuuuagugaguuauauaguuuuuccgcuaucaccacaagagguuuuauaacauuuccaacacacuaaaaaguuuucucaugcccauuugugacuaaucuccacucccaccccagggccccuggcaaccacugaucuccuugcugucucuguaguuugcucuuucuaaccugguuaguuuuaaugauaaaaucaguacauagcagaagcucagaaaauaaucuguuuagugaugaaaauaucuaaaguuuuccuuuguguaagucgagaguuaacuguuugacuauugugauacaugagcuaagaaugacuuuuuuuguuugagauggagucuuacucugucucccaggcuggagugcaguggaacgaucucagcucacugcaaucuccgccucuuggguucaagugauucucaugccucagccucccaaguaucugggacuacuggcacacaccacuauacccagcuaauuuuuguauuuuuaguggagacaggguuucaccauguuggccaggcuggccucgagcuccuggccucaagugaucugccugccuuggccucccagaguguugggauuacaggcgugagccacugcacccagccgaauuugacuuuuaaggaaagguuucggccgggcaggguggcucauaccuguaauuccagcacuuugggaggccgaguuagguggauccccugaggucaggcguagguaggagaaucccuugaaccuggaaggcagagguugcagugagccgacaucaugccacugcacugcagccugggcaacaagagugagacuccaucucaaaaaaaaaaaaaaaaaaaagagaagaaaagaaaagaaaagguuuuauucauaaucagucaagaaaaaucauauuuuugugucaaacuuagauacucuuuuuaagcuguaccuaaucuucaaaaagauaauuauaauuguguuuaucauuaaaauagcugauuugucccuuuaggacagugauuguucauggauuuacccuuggagaaaagggagaaaagauguccaagucucuugggaaugucauucauccugauguugucguuaauggaggacaaguaggugauucucuaaaauguauuuuauuuucguuuuaaggaucuuaaauuggcagccaaagcccuuaauauaguuacuucaauguaaaaauaaaaacuaucuuuuauacucucaaauaacacaugauuguaaugaagaaggcagaggcugggauugugguccuuuuaacuuauuucaggccugacucuccaguuaggucccaaaccacgcuguuucuuuuuuaauugucugagagccuuuaaaauguguagauccuuuugugauucguaagcgugaugauuggguuuucgcacuauugugugaggugugccucccucaaaccuuguuacaguguuggcacauugcugucugaagugaaaaaagaauauguaaagugugauuguguaguuaaauggaaaugaugaaaaaugagauugcaacuucaaaaugcgcauuucauuauuauauuguugaaaauuauacacuuuaaagcagguccuaaauguacaucaaaucugagguugcugauaauuuggggggguuuuuggagcugcuuuugugaauuaaaucauuugucuguuuuuuucuauuuuuuaacuccuguagcuuuuuacugcccgccuaacauccuguaaccguucauuguuuuguguacagaguugcuaggaaauagugaaaggaaaagcaguccuuccucuuccccucccuuauuauagagaccucccuggcacugcugugugucuaaccaccagcuguaauagaggaaacagacaugaccagggaagagauuagguaugagcauuugugcauugaacaagauugcagagcacgcucuuucuuuuuccaguuuuguuuuuagauacagucuaauuugagauuguuagcccgcauuucauuacagugcuaguauaguuuguacuuacauugugcucaaaaauaucugaauaggagcuuuaccuaaaacauuuguucggcuaauuggaauugaaagccauuguguuuauauauuuuuuucucaaugaaaaggaucaaagcaaagagccuccguauggugcugauguccuucgcugguggguagcugauuccaaugucuucaccgaaguugcaauuggcccauccgugcucaaugcugccagagaugauauuagcaagguuagaacuauuauucuuccuauuucuaaaggacaaguuugucaaaucauuguuuuaaaaaaugagacacauuuuguuuggaacugaaaaaaacugaaugaaaacgaguucuucauuuauugugagauuuuaagaaucuccuguguuggccaggcaugguggcucaugccuguaaucccagcacuuuuggaggcagaggcagguggaucacgaggucaggaguucgagacuagccuggccaacauagugaaacccugucucuacuaaaaauacaaaaauuagcugggcaugguggcaugcaccuguagucccagcuguucgggaggcugaggcaggagaaucacuugaacgcaggaggcggagguugcagugagccgagaucgcgccacuggacuccagccuggcgacagagcaagaccuugucucaaaaaaaacaaaaaacuccuguguaaauuuauuuguuucaaaacauugguaguaauaccaguaauuuuauauaauuuguauauaauauccuuuauauuuuauuaauauauaaaauguaauauagcauaguauagauuauauuaauuuuguauacuuuuauguacucaauaaccuuucacauuuuuccauguaucuuuauuucauugugaagcaagugaaauaacauuauucugacccacacacaugaauaaacugggcuacugaaaggugauuugccccaacguaauaaagaaauauaaugaaaauucagucguuaggcguaaaauccagugguuguuccuauaacugggcuauuggaauaagaguuuguuguguacuuuuuguuuuuuauuuuuuuacauuuguagucuuauuuggaaugauaauaaaaauaccccacuaagaaaaugacaagaguuaguaauaaaauaacuuuucagugaaaauugaaggcaccauuagauuuuuuuaacugcauauuuuuucuuccuaugaauagcuuaggaauacacuucgcuuucuuuugggaaauguggcugauuucaacccagaaacagauuccaucccuguaaacgauauguaugucauagaccaguacaugcuacacuuacugcaggauuuggcaaacaagguaaauguaaauuaauaaacuuuuggaaacuagaaauaucagcacuauuguagguuaaaauuuuaguuuuaucugaguggaacagaccuugcuggaaauaguaacuauagcacucuugaagagaaauauguccagacuuccccucggaccagauuuuucucucaugauuagcucuauuuuuccaacaagaaggaauaaaguggaguuauacuuuaucugcacaugugcuccucauaauaaaguacagaaauaaccaaaauggacuauccuauuugucucauaagauacuuacucauuuucauauagacuuaaauaauuucuguuuucuggcuggguguggaaacucacaccuauaaauccuacuacuuugggaggccgaggugggaggauugcuugaggccagguguucaagaccagccugggcaacagagcaggaaccuaucucuagaaaaauuuuaaaaauuagccaggcguguuagccagugcauguagucccagcuccuugggaggcugaggcaggagaaucgcuugagcccaugguuuugaggcugcagugagcugugauugugccacugcacuccagccugguugacagagugagacccugucuuaaaaaaaaaaaauuguguuuucucauaauuggaaauguguuugcauuaguguacccuuaagucagagguguacauaccaauuuugcccaaaucaaaaauaaaugaggcauaaaugaaggaacacuaaugaauuguuggugacguccacuguuugcuguuguuaaaauggugugauuuuguuauuuacaaucucauucuuuccuuaauuaauguccuuucguaguucucagaguaaaauaguauuuucugaguguagucaaauguguuauccagaaaugacauuuggaagauucccaggaguucuugcauauugccuguuuuguauuugucucauugaaacauauuuuugaaaggagcauauuuugcuugugaugacuuacauuuucauuugccugucucagcuuccaaauuuauuuuggcuuuguucccuagauuaccgaauuauacaaacaauaugauuuuggaaaaguuguucggcuguuacggacguuuuauaccagagagcucucuaacuuuuauuucaguauaaucaaagauagguauguaugacuaaauauuaaaaugcuuaacaauggccagguguggugacucacgccuguaaucccagcacuuugggaggccgaggcggguggaugacaugaggccaggaguucgagaccaguauggcaaaauacaaaaauuagccgggcaugguggcacaugccuguaauccgagucacucaggagacugaggcacgagaaucgcuugaacuugggaggcggagguugcaaugagcagagauugugcugcugcacuccagccugggugacagagcaagaucucgucucaaaaaauaacaacaacaaaaccucaacaaguauuuuuugagugucuacuuguguuuggcaaccgucagggauacagugaugagcaagaugggcaguguugugcaguuauuaagauuggguuccgggccaggcguggugccucacgccuguaaucccagcacuuugggaggccgaggcgggcggaucacgaggucaggagaucgagaccauccuggcuaacacagugaaaccccgucucuacuaaaaauacaaaaaauuagcugggcgugguggcgggugccuguaguuccagcuacuugggaggcugaggcaggagaauggcgugaacccgggaggcagagcuugcagugagccgagaucgugacacugcacuucagccugggcgacagagcaagacuccgucucaaaaaaaaaaaaaaaaaaagauuggguuccggagucaagucugaguauaaagguuugaccucccgcuuacuagcuuucugauuuggggcaacuuauucuguaaucuguuucuucaucuguaaaauggguauaauaauacuuaccucgugauugagaaggaaaagcaauaaugugcuuaaagcugugcuugauaaaguguucaaaaaaucaucacuacuaauaucagacgaugaacauaaugcuuguucucaggaguucucaaauccugaggggaagagagagauauauaugugcaauuauaugguaacaguguauaauauuagcaguauccuuguagaagaggccuugaugccaagucuucaucuguugcuccagugugcaggugacgguccuaccuucaugguaaugaguccagucugaggcguuauccucagccugucagcaccccaaggaccuugcacauagggauuauaacuccuacuccuucccuuaaaacacuaauaacauuggagugggugggagccacauguuaaauaccaucaacuaacuuauucauaguccuuuaauacaguagucuagacucuaguugucauccaccugagaaacagaaugagauagcguagccaugagugcuuucaaggagguggguacaccuggacggaguaaaauuguaggagaguguauuguauucuuuaaguagaagaugauuagagccauaggauuagccacuaggaauaaacucaaccugaggcaggucccaucuaggugaccauaauguauaaaguauugucaacugcugaauaaguuguucuuguucaggcucuauugugaaaaggaaaaugaccccaaacgacgcucuugucagacugcauuaguugaaauuuuggauguaauaguucguucuuuugcucccauucuuccucaccuggcugaagagguguuccagcacauaccuuauauuaaagguaaggaauacuucauuuauucucuuaaugagaaauaucccugaucaaggugcaacuucuacuucuaucugcuucauaaaaggggcacuuauccauuuacagugacugcugugugacacagugugucuuggucauguauuuguuucugcaccuauuuguagaggaguaggguaaauuucagaauucugugcuuucugaaauguauuagcagcuugacagugucgagaaaucaccuuuuuucuuaaauaccuuuauaacuguucugaaauggcuggcaugguggcucacaccuguaaucccagcacuuugggaggccgaggugggcagaucacuugaggucaggaguucaaaauuagccaggccaacauggcgaaaccccaucucuacuaaaaauauaaaaauuaguggggcauggugguggcgggugccuguagucccagcuacuugggaggcuaaggcaggagaauugcuugaacucgggagguggaaguugcagugagccaagaucaugccacuguacuucagccugggugacagagcaagacugucaaaaaaaauguucugaaauauauuuuagguuguauuaaaacaaaauauagugcuuuuagugaguuuuauguuaguuguuuucuucugauuguauuaaguuuauaaaaauuagaaacuauagaaguguaggaagagggggaagucacuuauaauguuacuccugauagcuguuaauauugggauauuucuauuuauuuuuuucuaagcauccuuuuuuucuuugagaucuuauuauauauuuucucuuuuguuuaaauauaacaaagauuuuccaaugcugauauaaauguuuuguaaauaauuaggauggauccauaauauuucaucacuugauuaccauaaauaacaauucuuauuucccauuaaugguaacuauuuaaugguuagagcuucauauacaguuuaggauguuuguaaagcaguuuacuauuuuuguucuucugaagagcccaagaguguuuuccguacuggguggauuaguacuaguucuaucuggaaaaagcccggguuggaagaagcuguggagagugcgugugcaaugcgagacucauuucuuggaagcaucccuggcaaaaaugcagcugaguacaagguuaucacugugauagaaccuggacugcuuuuugagauaauagagguaugcagcaauauguaccuuuugaaaugguguuaguaucauagagcuuugccugaaauuugcuuuuaaaaugugucuaaauuaaucaaauaacauuggguuauguguaacuuuacuaugcaauuauucuauuauguuccuuuucacauacuuuuucacuuuuaaauaucuuuuaauaaauuaagcaaagucaugcacauuuaaaaaaaagugucuaaauuaaaaaaaaauuaauuuagaaauuaggguuuccgucuucuaauccugauaucaucacugauucuuuuguuuccuauuucaccauauucuuuuccaugucuuguaaaacguguucugugcauguaacacauacauauuacuguguagggauagggaaggaauagauaaaguucuguuucaaacaaaaggccucaggacuauuuagaagacaggggacauauaaauugaucgcgaucgucuuugaauguauaaaaaaugggaguuuuguauuaagggucagguuuccugagaauuucauccaucuggaccagauucaaaacaaacccaaaaagaguuuccauuuuuauuuugugaaaucuggagaaaauucauuuucuccagcaaguuaccacauauauuucaaagcauuuauccuauuuuuauuucuagaagggccaucagaauuuuauucuugggauuuuuagggguugauuggccagauuggcuuauagcuuaacauaaugaugugauuuuucuccagucuaaaugcuuaagaagagaauuggcaaugaauauaauuuuuuuuccacggggcauuuuauuuguaaauauauguauuacaucccuagaaaaagaaucccaggauuuucccuccuguguguuuucaucuugcuucuucaugguccaugaugccagcugagguugucaguacaaugaaaccaaacuggcgggauggaagcagauuauuuugccauuuuucuagaucuuugcuuugcacaucaaaucuggggcugaugucuccacacuuguuuagccugccugugagguucacaacaauuuucccagcucugugaccaucagugauuucaaauuugccaauguaaccaugcuucaucaucacggugagaaacaggaugaugacuuuggagcacggccuaauaagcaccuggcuuuugccucucuuuuuggcauuguugaugcucuugagagcaucagccaggacauucaugcgcaccauugugguggugcagaaagacgguggaagagcuauuuuuuaaaaguuuuauuagugucaguuuucuaaaaaacauccaucuuauuuuguaugguaagcucaauuuaaauuuuuaaugauguaauuagcaagauuaagauuugagcuugaaauagcuaguagguauaauagaugagauuuucccauuuuaaaauuuaaaacuugggaagcuguucauuuuacaagugaggaagugaggacugcugaagcugugaccuagacaggguaacacagccuaguccuggccuuuuuuccuacauacuguguuuccuuugucuucagucuuucuaaguaaugaacugaaaagaagaacagcuuguuuggaucaauuuuauuggaaaaaauacuuugggauuuucaaaaacaugaauguauuuuccuuaggaaucauaccaaguagcuguaagauggaguccugguucuauccauuacuaauugcauaaacuuguuaaaaccaaauuaaucucuuugagucucuuauuucucaugggcuuuaauuuuuaaaggaaugucuauguugguuagcuuacaaacucacuuugaagaucaaaauuacagagaaaaauguguucaucagacaaauucagucuacuucauaaguguucugcguauuguucagauugccacuaucaguauacauuacuaaaagcugguaccuguugagauaguauuuuagccccucacccaaugauacaugaaaaaaaaaaaaaaaggcuuugaggcugacagaccugggcuugaccugcaguuccaccacguauggguugagaaucuugggcaaguuaaccucucuuugcuuguuucuucauuuguaaagugaggauaauaaacaccauauagguuuuuuuuguguguauguaugugacaauuagaaguaagagacaucuuaggaucuagcaaagugaagugccuggcauucucaauaaauacuguugauggaaauauuuaguuaaaaccuuuuaugcuaauuaggauugauacauuuagugauguuugcucaggaugcaaugguauaccagaagguuccucucuaaacgugagauuuuauaguguuucuuuuuauaaccucaguuuaugguacaaauuuaacauaaacuguaacuuucacaugcuuccuuccagaugcugcagucugaagagacuuccagcaccucucaguugaaugaauuaaugauggcuucugagucaacuuuacuggcucaggaaccacgagagaugacugcagauguaaucgagcuuaaagggaaauuccucaucaacuuagaagguaagaaggagaugaaaguaacaaguaacaucuggagaauugaauaauuauaggucaucuccaacuuuccaguggacuggguuuauucuaaagguagauauauacuuggaauacaucuuucuauggaaauaauaaaaacaauugccaaguuucuaagcccgcucuuaaaacuaucuuaccugaugaucuugggaacugagggcuagggacagaagagggagagagauuuucuuucuguccuuugaauaaauaauggucacuguauaugaaguuuauguuaggcugacuugcucccauuccucuuuugugucccccugcuuugauacuuaguaccccaguacuggcccaguccugcccacuguuccccaguauugauucuaaaauuuccuauuauguauaccccggauuaaaauauuuagccauucuugugagggguuaaggaggaaguuuuauugagcucauucuaacaaugguaucucauaagcaagcauuuugucgauauuuguuuuauagaagauuuuaaaagucagucugguucaucuucauugguagcgguagaguugcauuaauaaagaaaaauaggcugggcacgguggcucaugccuguaaucccagcauuuugggaggccgaggcgggcggaucgugaggucaggagauugagaccauccuggcuaacacagugaaaccccgaaucuacuaaaaauacaaaaaaaauuagccaggcguggcggcgugugccuguagucccaucugcuggggaggcuggggugggagaauggcgugaaccccggaggcggagcuugcagugagcugagaucacaccacugcacuccagccugggcgacagagcgagacuccgucucaaaaaaaaaaaaaaaaaaaaaagcagguaucuuaugcugcuuguguuuuucauagcuuuuggguaccaggagaugggaagcuaacuuacaggcaucaguucaaauuugggcuuggcagcauagaccguguaguaaaaguucuggcuuaauuuacuuuguguaauuuuuucuuucggacggaauuucgcuugucacccaggcuggagugcaauggcgcaaucuugguuuaccgcaaccuccgccucccagauucaagcaauucucuugccucagccucccaaguggcugggauuacaggcgccugccaccacacccggccaauuuuuguauuuuuaguagagaugggguuucaccauguuggccaggcuggucuugaacuccugaccucaggugauccacccgccucggcaucccaaaaugcugggauuacaggcuugagccaccaugcccggccauguaauguucacauacucuuuguacaaugacuagaaaauaacuuaguuuuauauuuuuaucaaucugaggucuaagaguauuaauuguggagauauuuuugguuccuuuugucccacgagauauuuugagugaggacacuguaguugucacuauaauuugacuuuuaaaaauucuuagucaaguauguagcuggagaggcagugucauucaucagaacuauacccaaauuuaacagcuagaaagucugcucugccugaguagauguagaacucggugacuugggagaugucaguuaaucucagagucacggggucucuaauuccucagcucccuucagguguugaguuguaugaucccauuaucuuggcuauauauguaaugggacaaauggggaagugucugacaagcuuuaccaaggcaggacaaaagacugaaaaagaagccucugcuaaaccaauuaagaaacaguguuacaaguugaaugccuaucagaaauacucuucauguauuuuuuuauagguggugauauucgugaagagucuuccuauaaaguaauugucaugccgacuacgaaagaaaaaugcccccguuguuggaaguauacagcggagucuucagauacacuguguccucgaugugcagaaguugucaguggaaaauaguauuaacagcucacucgagcaagaacccuccugacaguacuggcuagaaguuuggauggauuauuuacaauauaggaaagaaagccaagauuuagguaaugaguggaugaguaaaugguggaggaugggagucaaaaucagaauuauagaagaaguauuuccuguaacuauagaaagaauuauguauauauacaugcagaaauauauauguguguguguaucuguggauggauauauguauaucucuuccuauauauauccauaguggacuuauucagaacauagauauguauucagcuugucuucaaauacggccaagcagaaaauguuuuauauuuuauaaaucaucuuuugacucuguauuuaaauucuaugauacugaaaauaaaggcauucuggaaaaaua

SEQ ID NO: 191173 - RNA, 32368 nt, Homo sapiens
gcgcgcaguuucccgcaugcucaguagcugagguagggaugccauccuucucaaaagacuuauugacagugccaaagcucgguacuggacacaacgagggaccugggucuacgauaacgcgcuuuugcuccuccugaagugucuuugguccaacguuguuccagguuugucaccguuucucuccggccggucagggcaagagccagguagauaggauuuauguuaaaaaaauaaaacgaaaaagguuuaugugaaucagauugcuucuccagauauucuaacuuccgacuuggacucuugagugucgauauuuuaauuguuuaucugugcuuuuauuuucgugauccggaagguuuuuauagccauauacuguagaaacaagacaaaccuagacauugaguuuguugaugcacccaaauuuagaaacugcuugguaccuaaaauuaaauuucuuuaaacagcaaauauucuuccaacugccauuucuacauauuuauagguuugcgugauuuauuuggauuucucuguaaauauaauuguugguucaaaagauacguacuuuauacuuuuauuaagguucucaaaacucuccuaagaggguucaccgcuuugccaacaaugcucaggaacauguucccucacacccuugcaaacuggacaaaggacaaacucuucuucuuucuucuuuuuucuucuucuucuuccuccuccuuccuccuccuucuuuuuuuuuuuuuuuuuuuuuuuucgagacggagucucgcucugucgcccaggcuugagugcaguggugcaaucucggcucacugcaagcuccaccucccagguucacgccauucuccugccucagccucccgaguagcugggacuacaggcgcccaccaccaagccuggcuaauuuuuuuuguauuuuuaguagagacgggguuucaccguguuagucaggaugguuucgaucuccugaccucgugaucugcccgucucggccucccaaagugcugggauuacaggcgugagccaccgcgcccagccuuucuuucuuucuuuuuuuuuuuuuuuuaagacagguucuagcucugucccccaggcuggaguacaguggugccauuaugucucacugcaaccuugaccucccagggucuggugauucucccaccucagccucccgagcagcugggacuacaggcaugugccaccacaccaucuaauuuuugcauuuuuuuguagagacgagguuuugccauguugcccaggcuggucucgaacuccugagcucaagcaauacaccagccuuggccucccaaaaaguucuaggauuacgggugugagccacugcauucagcgacaauuuuuuuuuuuuuuuuuuuuuuugagucggagucucugucgcccaggcuggacugcaguggcgcgaucucggcucaccacaaccucugccuccuauguucaagcaauuuuccugccucagccuccugaguaauuuuuguauuacuaugccugguuaauuuuuguauuuuuaguagagaugggguuucaccauguuggccaggcuagucuugaacuccuaacuucaggugauucaccugccuuggccucccaaagugcugggauuacaggugugagccaccgugcccugccaaauuuucuuuucuaugccaaucuuaaaaauaaacaaucauggcccggcgcgguggcucacgccuguaauccuagcacuuugggaggcuuaggcaggccaugaggucggaaguucgagaccagccugaccaacauggagaaacccugucucuacuaaaaauacaaaauuagccagguguggagaugcuugccuguaaucccagcuacucgggaggcugaggcaggagaaucgcuuaaacccgggaggcagagguugcggugagccaagaucucgccauugcacuccagccugggcaacaagagcaaaaacucugucucaaaaaauaaauaaauuaauuaauuaauuaaaaauaaaauaaucauuucucauuguuuuaguuugcauuucuuucauaauuagugaagcugaguauuuauguauuuaauggccagugcuuuucucuuuguagguguugcccguucuuguuuauuugcucauuuuucuauuggauuauucagcuuuuauauacugaucuuuuacaaauuaagucauuugucugguaugugauacaauauuuuuuucucauuuugucaaguaccuguuuauuuaguuuaugguauuuuggccauguagaaguuuuaauuuuauuuuuauuuauugauugauugauuuugagacggaaucucgcucugucacccaggcuggagugcaauggugcaaaugaucucagcucacugcaacuucuaccucccagguucaagcaauucuccugccucagccuccugaguagcugggauuacaggcgcgugccaccaagcccggcuaauuuuuguauuuuuaguagagacaggguuucaccaaguuggucaggcuggucuugaacuccugaccucgucauccgcccgacuuggccucccgaagugcugggauuacaggccaccgcgcccagcaacucuuaguuuuauagagucaaauuuaucaauagaauauuuuauggauucuugguuuuaugcuuaaagggcauuuaccaagcuuaugaaguuuauaauuuuuauuuccaugcuuuuaugguuucuuuuuuuacuuuuauaaaccaugcauugaaauguauuuauaucaaaauguauuuauaucaaaauaucaaaagaaugcaaaaaggacucaacuuuuuuuuuuuuuuuuuuugagacggagucuugcucugucgcccaggcuggagugcaguggcaccaucucggcucacugcaaccuccgccucccaaguucgagcaauucuccugccucagccucccaagaaguugggguuacaggcgcccgccaauaugcccggcucauuuuuuuuuuuuuuuaaguuuagcaacucaggccgggcggaguggcucacaccuguaaucucagcacuuugggaggcaggcggaucacaaggucaggaguucaagacuagccuggccaacauggugaaaccccaucucuauuaacaguacaaaaauuagccuggcaugguggcuugugccuguagucccagcuacucaagaggcugaggcaggagaaucggcugaacccgggaggcggagguugcagugagccgugaucucgccacugcacuccagccuggacaacagagugagacucugucucagaaaaacuuuagcaacucagaccaggcaugguggcucaugccuguaaucccagcaccuugggaggccgaggaggguggaucacuugaggucagguguucgagaccagccuggccaauguggugaaaccccaucucuacuaaaaauauaaaaaaauuagccaggcguggugaugcgugccuguaguuccagcuacucagccauaugaggcaggagaaucgcuugaacucuagggggcggaaguugcagugagccgauaucaggccaccgcacuuuagccugggcgacagagcgagacuacauaucaaaaaaaagaaaaaguauuuaaaaguuuagcgacugcccugccauuuaugcaaaauugaauuucccccaugauuugaaacacuaccuuuaguguguucgguucuauuucugcaauuuauuuccuuaguuugucucacuagccaaacuuuuauaucauauguugauuaaaucauauuuuaucauauuuugauaauugauaaggggaguaccucuguucauaguucuuuuuccagaauuugcuccauuaugcuuacauuuuaauuuuuucagaugaccuugaacauuaucaucaggccaaguuccaaaauauaaauaauuuuaguauuuugacuuggaacucaucauuuuuagauccuaauccucauauggucacaaucguuauaugagaagaaacuaauguuugauuccuguuguuuuuuuccauccuucugaacuagcccuuuggcaguuguaaagacuucucaaggauagguauuagguugauggccuuaaguguuauacagcuuuuuuucuugucuacucuccaagccuaaagcucagaauguuaugaagaaaagccugaacuauacucugauugagggucauguugauuaucauuuuguauucucaaggucagaauacuguuggagaaacuacaggaacuuuuugcccuuaacacugcccuaaugucccugcaaaauaaccgaaauaaggacaaucauaauaaugguuagccaguauuauuugguguuuaccuugugccagguaaagcgcuuucuuuacacguguuacucauuuaauaauuacagcagcccuauacuaugaguacuauugucuccauuuuacagauuggggcacagagaauuuaagugguuuucucaagguccacagcugagccaggauuugaacacagguagugggcugcagagccugugcccuuaagcacugugcuguuuuagauuaggcuuucagaaagacaccuucacaagaguguuuuaaggcccagaagauguaaaacugguagagaaagaaguacaaugguguuauuugaacugcuuuaagaaaguuaacuugccuguagcuaguuugggccuugcucuuaaucuaccuguaucaucaaaagguaaaucucacuguaguauaggagggagcauaaugaaaaaggcuaaaagggaccucuuguauagauuuuuuguuuugauaauaugacuauguauuuuuucuuuuuuuuuuuuuaaccaagaaccaacauuguauucaucuguuuaaaaaauaguuaagaaaacgauuaaggcuagggcauaguacuauuucauuacuaauucaguuuggaccagagaaguacuucaaagaagaaugguaaaaauauuucccuaucugccaauuaaaagugauuuguggaaucucuuuauaaaucauugugugcuuuacaucaacacuauuuuucccauuuuuauugucuucuauuucuuauuuuucccauucuuauguuuuauaagcugauguuagcuuuaacuggugguuaauaaauauaauaucauuuugugaggaaauuaguagacagacaaugccugaaaguuuuuccauggaagaaaacaccauggacuuggcaaauacaaggggaaguaguugagucauuuaugaagccugacaagggucaaaugguugcuuaacugguucaaagguaaaugauaucuaugaaaaguuauaacaacaccauacagugagggaaggugaucuuccuauuacaaaagaauucuuauauaacaugggaauugaaggagcauacgaacacauaauuaaaauauggucaagacagcuggguagaacaaaucaguugcccaaagaccacauuuccagugcauaauaaaucagauauaugucuggauauggauauaaaggaauagaaauaagaccaacaaaguguuuacuaaauuauuucuguuuccuuuucuuuuucuuuuucuuuuuuuuuuugagacagagccucgcuauguugcccaggguggaguguaguggccgcaaucucagcucacugcaaccuccaccucccggguucaugccauucuccugccucagccucccgaguagcugggacuacaggugcccaccaccacgcccgacuaauuuuuuguauuuuuaguagagacuggguuucacuguguuagccaggauggucucgaucuccugaccucgugauccacccaccucggccucccauagugcugggauuacaugcgugagccacugcgccccgcccuauuucucuguuuucuaucugaagugcuccugaauuaguaguaauuguaacugguuuauuccacauguaacuccuaguaugccaagaaaauuaaucuagcuugauuaugauaucauaaaacaaacacauuauauauaguuaucccuccguauaugagggagguugauuccaggaaccccugagaauacuuaaaucugcacauacucaagucccacaguuggcccugcaaaacacucauagaugaaaacucaguuuuaacagaucacaaacucucuugaaacuaaaauaaaaauauauuuuaaaaagucaggcuuuccugucuacagauuuuacauaccuuuucuauccgcauuugguuggaaaaaauccacaaaguggaccggugcaguucgaggccguguuguucaagugucagcugcacuuagaaacccguuuuauuggccgggcgcgguggcucacaccuguaaucccagcacuuugcgaggccgaggcgaguggaucaugagguuagaucgagaccauccuggcuaacauggugaaaccccaucuguacuaaaacuacaaaaaauuagccgggcgcaguggcgggugccuguagucccagcuacucgggaggcugaagcaggauaauggugugaacccgggagacggaguuuguagugagccgagaucgcgccagccugggcgauagagcgagacuccaucucaaaaaaaaaaaagagaaacccguuuaauuuucaucuuaauuuccagacagcuauuggucacaguacgguauucauuaccuuacauaaauuucuuuuuuuuuuuuuugagauggagucuugcucugucgcccaggcuggagugcacuggcacgaucucggcccacugcaaucuacaccuccuggguucaugugauucuccugccucagccuccugaguagcugggauuacaggugcaugccaccacgcccggcuaauuuuuguauuuuuaguagacacgggguuucaccauguuagucuggcuggucucgaacuccugaccuagugaucugcccaccucggccucccaaagugcugggauuacaggcgugagccacugugcccggccauaaauuucaauuccaucuuccuuuugaagaguuucaaacacuucacuuauuguuccaguuagguucauaauuccugucaauagaguguggaugauagaaacaagauguaaaggaggcugggcagguggaucuucugaggucaggaguacaagaccagccuggccaacauggugaauccccgucucuacuaacaauacaaaaauuagcugggcguggugucaguugccugugaucucagcuacucgggaggcugaagcacaagaaucacuugagccugggagacagagguugcagcgagccaagauugugccacugcacuccagccugggugacagagugagacuacgucucagaaaaaaaaaagaaaaaagauguuaaagggguuaaaacaucaaaucaaauauucagucagaaagucaugguagaacaaugacuauugcugaauggagguuuauaauguucucuauagucccagggcugagcgugguggcucaggcauguaaucccagcacuuugggaggccaagguggguggaucacuugaggucaggaauucgaaaccagccuggccaacauggugaaaccccgucucuacuaaaaauacaaaaauuagccgagugugguagcaggcaccuauaaucccagcuacucacgaggcugaggcaggagaauugcuugaacccaggaggcagaguuugcagugagcugagauugcgccacugcacuccagccugggcgacagagcaagacucugucucaaaauauauauauauauaaaaaauauaaaauauauauaaaauacauauauaucauauauauuuuauauauauauacacucucucucucucucucucucucucucucucucucuauauauauauauauauauauauuguccuuggaacaaucauguguucccuuauugcgaugaaauaauguugauuugauuuagaggugggaaguuuuugucacagguuaauuccccauaaaacucuaagacagagauaaaguggaagagguuuauuagggagugcuuucggaaucauuuguggaagggaaggggaggaagggaagaaaguuggagaagguaucuugggcugugaugcagucucagcuaaggccucaguugaccccauaggguauucuggaagcuagauggcccuucagugcuggggugguagcccacuugggguaggaaauggccuuuaaaucucccuauugugacguuucaggugaagugauccuucucagcagauauacucccaaagaaagauggcagcugaaagccaucuuuugacagcugucucagcaaguggggaaauaagcucuucaguucugaagggaaugugggugguacauccaggacagucacgaaaauuucgggauuugaauucauauuuucuuuuuuuuuuuugagacggacucucgcucuaucgcccaggcuagagugcaguggugcgaucucugcucacugcagccucugcgucccagguucaagcgauucuccugccuuagccucccgaguagcugggauuacaggugugcaacaccaugcccagcuaauuuuuguauuuuuaguagagacgagguuucaccauguuggucaggcuggucucaaacuccugaccucaggugagcugcccaucucggccucccaaaauccugggauuacaggcguuagucaccgugcccggccugaauucauauguucaaaggaauguacaggccagauacaguggcucacgccuguaaucccagcacuugggaggccaaggggggggaucacgaggucaggaguucaaaaccagccuggccaagaugaugcaaccccguguccacuaaaaauaaaaauuagccgagcaugguggugggcgccuguaaucccagcuacuugggaggcugaggcagagguugcagugagccaagauggcgccacugcaauccauccugggcgacagagcgagacuccgucucaaaaaaaggaaaaggcaacguacuugauucuaaaggcuguuuuuuccguuuauuucauuggcgcuagagacuucugacacuccuuacuuuuccaagugacuggucuucauuauaauuuguuagguugcuuguucucuuuaucuggcuacugacgaagauggagguaaauaauagcagagaauauucauugauuuucagaaaauaauuguaguuauaugcaaucccucugauguggugaggcuuuguuuccccacccaaaucucaucuuaaauuguaauccucauaauccccaugugucaagggagagaccagguggagguaacugaaucaugggggcagugauagugaguaaguucucaugagaucuaaugguuuuuaagggacucucccgcuucgcuuggcucuucuuccugccaccuugugaagaaggugucuugcuucccccuuugucuucugccaugauuguuaaguuuccuuaggccuccccacccaugcugaacugugagucaauucaaccucuuuccuuuauauuagguuggugcagaaguaauugcgguucuugccacuggaaauaauaaauuacccagucuugggucauucuuuauagcuguaugaaaauggacuaauacacccucccuuuuuaauuacacccuacacaccuacaucccuuauacuauucauaccucuuuuggcgcugccuaguuuuauguuauagacguuagguuaccuuauuuuaucuacaacucaccaaaauauuagcuccucaaacacaaaucuuacaucucauauuuuuagccuacaaagcaccuuccacauacuuuacacaucacccacgaccucauacacaaacuuuuucacaugcucagcauccugggccaguuucuccuaugcuuugacaugucucaucugcagagagacauaaaaaauacagaauuuauugagagaguuaaugcccaaaucgaguuuuuucgaagucucuuuuaguaaauauauauuaaagaauuuacucaguuaaugggagcaaucccaaguuagcacucaauuaauauguguugaguuggauuuaaauaaauaaaaccaguaguuggcuuugaaacuaacaagacauuuuucuugaucucuuuuuagaguguaccauggcuuccaguaacacuguguugaugcgguugguagccuccgcauauucuauugcucaaaaggcaggaaugauagucagacguguuauugcugaaggagaccuggguauuguggagaagguacucaaacucucauaucauuucauaccaacuugauuuuuguucuugagguuuagcuaaaugauauaaaaauguggacagacuuuaucaguuaaaauaauugauggcucccuuagggagacugcaagacgcuugguucuaaaggguuccaucucugcuuugaaaaugauuccaaggccgggcgugguggcucaugccuguaaucccaguacuuugggagaccgaggcaggcggaugaugaggucaggaguuugagaccagccuggccaacauggugaaaucccaucucuacuaaagauacaaaaaauuagccaggcgugguggcgagcgccuguaaucccagcuacuugggaggcugaggcaggagaaucgcuugaacccgggaggcagagguugcagugagccgagauugcgccauugcacuccagccugggcaacagggcgagacuccaucucaaaaaaagaaaaaaaaaaaagacuccagacuuucuacguccaagaucuuuauuuauaugucugagucuucugaaccauaucuauccccaaggcauuguaaccgagcuucaaauccuagaguaaucuauuacaugcagugccaugcaauccuuagugaacucaacauguucgguaaaaucuggcauuuacauaaauauuuguuauaaucaaagugauacauucuuuucuuccucauggaaaagaaacucaaagcaagcguguuuuucccaguauaguaauuacaaacuuaaauagauuaucagaaaguuuauagugauagucaauucuuaaaagaaauaccaccauguuuguguuccaguuuaaagcacaaucuucugaccgggugcgguggcucacgccuuaauccuagcacuuugggaggccaaggcgggcagaucacgaggucaggaguucaagaccagucugaccaacaugaugaaaccccaucuccacuaaaaauacaaaaauuagcugggcaugguggugcacaccuauacucacagcuacucaggaggcugaggcaggagaauuacuugaaucugggagagcgagguugcagugagcugagaucacaccauugcacuccagccugggcaacaaaagcaagacuacaucucaaaaaaauauauauauauauguguguuauuauauacauauauaauauauauuauauuuauauauaauuauaauauauauaauguaauauaauuauauauaauuauauuauauaaaauuuauuauaaauuauuauuuauuauaaauuauuuauuauuuauauauaaguauaauuauuauauauaauuauuauuuauuauuauaaauuauuauuuauauauaauuauaauaauucuauauaauuaauaguuauauuuguuauuauaaauuauuauuaauuauauauuauauguuauauauauuauauauauauaaaucuuccuugggauuugguaauuacuucacauuacaaauuuuacacguaaguuuucauauauugacuuuuaauccuuaaauucuuuauuauaaucuuuuuuuuuuuuuuuuuuuaaagagacaaggucucacucacauuguugcccaaugcuggagugcaguggcacaguccuacugauagcuuguugcagccucaagcucugggcucaaaggacccucuuggcuuagccuccugaguaguuaggacuacaggcaagcgccacgacaccuagcuaauguuuuuauuuuguggagaugggguuucaguauauugcccaggcuggucucaaacuccuggcuucaagugauccacccaccuuagacucccaaggugcugagauuaugggugugaguacagguaugagccauuacacuucgccuaaaucuuucuuuauuauagccuuuaaggaaaaguguauuguaauuucuuccaagugagaacauuaauaggauaugauuuaucauuagcacuuuaacgauuuaaaauagagugaguuaagucacucacuuaugagugauauaucuaucuaggguuguuaccauaagaaaaaaugagauauaugaguaaaaaacaacuuagaaaaaaguugacgugaguucacuuuuugaacucacguucaaaaguugaauguaaaacauucaauguaauugcuuuuaaaaaguuaauguaaaaaucagccugggcaacauagcaagaccccaucugacauggugggacaugcuuguaguccuagcuugggaagcugaagugggauaauugcuugagcccaggaguuugaggcugcagugaccugugaucccaccacuguacuccagccugggcaacagaguaaaacccugucucuaaaauaaauaaauaauauuaaaaaaaaaaauucauaagaacaaaugaaauaaaucucauuuccuuuuuugauagauuuaugggccugcucauagaggaaauagaggguaucuugauuuaagcaaaacauuuuuuauagucugucauuuucuauuuaagaaaauauucaaguuauuuuuaguuauauagacaacaucucccauccugagccaugauuaggugcauucauaacuggaugaauaacauuauccacaaauuuaaauucaugagucauuuucauccuggaaaaggaucacuguuggcugaucacaggacucugcuccugacauuguacuguucucuuuaaucauuaaauaacauacaguuuuaaaaaauauggaauguguuagcugaaguggaagaugauauagaaaacaugcuuaucaaauuugucaauaagagaaagcugagcgggcuaguucaugcauuugaucacagaauaaguauucaaaauaguugcaaccucugagaaaaguggaccaaauccaacaggauauaacaggaauaauauaaagcgcuguauucauguucaaguuauguaagauaaaucugauucaaauuuguuugaaaaagagauuuuaguugacuacagacaugcuugguaauaaccaacgaaauaauacugcugcuuucagagggcuacuacuauuauuauuauuauuauuauuauuauuauuaauuuauuuuuuuuuuuaagaaggaguuucacucuuguugcccaggcuggagugcaauggcguuaucucagcucaccgcagccucugccucccagguucaagcgauucuccugccucagccuccuggguagcugggauuacaggcaugugccaccacauccagcuaauuuuguauuuuuuugccuuuuuuuuuuuuuuuuuugagauggagucuugcucugucacccaggcuggaguacaguggcaugaucuuggcucacuacaagcucugccucccagguucaugccguuuuccugccucagccucccgaguagcugggacuacaggcgcccgccaccacacccagcuaauuuuuuuguauuuuuaguagagauaggguuccaccauguuagccagauggucucaaacuccugaccucggcauccgcccaccucagccucccaaaaugcugggauuacaggcaugagccaccacgccugggcuaauuuuguauuuuuaguagaggcaggguuucuccauguuggucaggcuggucucgaacuccugaccuugugaucuaccugccucggccucccaaagugcucggauuacaggcaugagccacugcgcccagccccuaaucucauuuuuuauaaaguuuuuuuuauuaugaaaaguaggaaauggagaaaaaugccaaaauaaacaaaaaucauccaucaugccaccauugccaauauuuugaauuauuuccuuucagauccuuuuccuuaacaucacuuauuuuaaguugaucuuauguugagguuauauuagacauacaauuuugaaacccagguagcuaaaaaggaacagagauguaaugcuaagucgggaaaaaagguaacauucucauugucuucuguagugcucaggcauuucuaguacuuuauauccuuccguugauaccuuauuuuuaaaaaaacagcaaaaucaguuuaucacacaagguuccaaugaugaugucuggaacuauguugauagaauaggaaauauuuaucuuagcgaggaaaagaaaauugauuuccucacauaguggaauggcuuucaaugugucuuuuuuuucucuaccgcaguggucuacaaacuugauugguauuuaacuaaucuucaaacucaacaauucuuuugaguagguucauucaaaagauacuuauagagcaccuacugugugcuaggcacaguucuuuagggaauaaaauccuuuuguggagcuuacauucuagcagaauaguacuuugcauugagauauacagcaaaucucagugaggcauaaaacaguugcuuuucauaaugacuucuuaucucauugcaaaguauuguuaaaauucuacuaagaugaggcugggugcacuggcucacaccuguaaucccagcacuuugggagcccgaggugggcggaucaugaggucaggaguuugagaccagccuggccaauauggugaaaccccaucucuacuaaaaauacaaaaauuagccaggcauggugggggacaccugcagucccagcuacucaggaggcugaggcaggagaauugcuugaagcagagaggcaaagguugcagugagcugagaucgcgccacugcacuccagccuaggcgacagagugagacuccgucucaaaacaaacaaacaaacaaacaaauucuacuaagaugauauaaucuguaaaucuacuuaaccaggcauauauaaauugcaacauaucauaaggcucugaaagcaaacuaacaaaggagguugugguugucacuugcaaaacuuuucucuuucacuagcaugaguaucugacauauugauugagugagggugccauaggugagcuauauguuaaauauuacagcaguucauauucguguuuuuuagauuuuuagaaacaggauuucuuaggccgggcaugguggcucaugccuguaaucucagcauuuugggaggucaaggcggguggaucacaagaucaggagaucaagaccauccuggccaacauggugaaucccugucucuacuaagauacaaaaaauuagccgggcaugguggcacgugccuguagucccagcuacuugggaggcugaggcaggggaauugcuugaacccaggaggcagaguuugcagugagcuaagaucgugccaccguacuccagcccagugacagagcaagacucugucucaaaaaaaaaaacaaauaggauuucuuacucuguaccugugaaucaacuugaggaccuguugaauuauuaugauuaggauuaguguggaaguuauagaaagauccacggaacacuuuucuaauaacuauuaacuuugccuugaaaaguuauacauuuccuaucucuuaaccuauuuaagcaaaagguugaugucuagagauaaggaauuucuaaacuagggaagaaaauguucuggauuauuuaaaagcuccuuuccaaacuuuacccacuauuaauccuuugagaaaaaccaaggcaagaaaccaguuaacucauuugguguuaaguucuaugacucuaaaaacugacaguguaaucuaaauuauguaggcacucaugcacaaggaaucagaggacaacuuauuuuucauuagcucugcuaaaauuugcauucuuuauuacagaccugugcaacagaccugcagaccaaagcugaccgauuggcacagaugagcauauguucuucauuggcccggaaauuccccaaacucacaauuauaggggaagagguaagcgucaucagagacauuuuuuuaaaaucucuguuuaccaaauggauuuauaacugacacuuuaaugauuuauauaccacuauuaugauuuuaagcauuauauuuauuguuuuaaacacaaaaguaauuauuguauuccuuggacuuggggaaaauaucugauuuuaagacauuuuggucuauuucuaagccaguugucuuaauuauugaccauagaagauaugguuacuguuauacccagcauacaaacuguaagaugggcagagaucuagaacuuuggaauaaaauggguuucguuguuguuuguuuuuaaaauuaggcuuauuugcauacuuauccaaagacuauaacacuuugaaaaugagggaauuaggccaggcgcaguggcucacgccuguaauaccagcacuuugggaggcugaggcgggcgaaucacgaggucaggaguucaagaccagccugaccaacauggugaaacugaacccugucucuacuaaaaauacaaaaauuagccaggcuugguggugaaugccuguaaucccagcuacucaggaggcugaggaaggagaacugcuugaccccaggauggggagguugcagugagcugagauggugucccugcacuccagccugggcaacagagcaagacuccgucucaaaaaaaaaaaauaaaaaaagaaagugagggaacugacaucucauguaauacaagggaacuaucugcugucagagacacuuguuuaaaugaguguauaauacuuaaaaauucuuuucuuuuuaaacucucuucaguauaaugacacuggaaccauuuagucaauuuugaugagccacauaugguuguuuuugcaaauuuuuaagguuugcuuuaaaagcucuaaauauaaaugguaaaccagaagaacuagugaaaacugugaugcugcauuucuucuguuaaugagacaaagcauacucuguaaacacuaaacagcuucaguaaccauuaggguuaucucugcuuuaggaucugccuucugaggaaguggaucaagagcugauugaagacagucagugggaagaaauacugaagcaaccaugcccaucgcaguacagugcuauuaaagaagaagauguaugacccauauuuauacucaacucucuauuaaccugggcuuuuugccauaguaaaggaaauaauauuugcauguaagaugaaaaauugguaguuauaaaauaggggcaaccagaaacuugauaucuuucagagccaacauggaaguaucaggcaaccauauggauuuagaguucaguuucucauccuauggguuuccuuugcacucuaaaaccguuauuuaaaauacuuuuagggacaggcaugguggcucacaccuguaaucccagcacucugggaggccgaggugguuggauugcuugagucuaggaguucgagaccagacucggcaacauggugaaacucugucucaacaaaaaauacaaaaauuagccagguaugguggugcacacuuauagucucagcuacuugggagguugagaugggaggaucaccugagcccauggagguugaggcugcaaccagcaccaucucuuuuuuuuuuuucugagacggagucucgcucugucaccaggcuggaguacagggccgcgaucuuggcucaccacaaccuccaccuccuggguucaggcgauucuccugccucagccucccaaguagcuaggacuacaggcgcgcaccaccaugcccagcuaauuuuuuuguauuuuuaguagagaugggguuucaccauguuggccagaauggucuugaucucuugaccucgugauccgccuaccucagccucccaaagugcugggauuacaggcuugagccaccuuaccuggccccagcaccaucucuuaaagagauuauuuuuuccccaguugaauggcccuggcacacuugugaaaaaucagcaggccauagauguauagguuucacgcuggccaugguggcucacgccuauaaucccagcacuuugggaggcugaggcgggcagaucaccugaggucgagaguucaagaccagccugaccaacauggagaauccccgucucuucuaaaaauacaaaauuagcugggcgugguggcacaugccuguaaucccaguuacucaggaggcugaggcaggagaauugcuugaaccugggaggcggagguuacagugagccgagauugcgccauugcacuccagucugggugacaagagcaaaacuuagucucaaaaagaagaaaaaagaaaagaaauagauguauggguuucauuauggacucucaguuauauucuauuggucuauaugucuauccuuaugccaguaccacacuuucuugcuuugcauuaaguuuugcaauugggaaguguaaguuguccuacuuuguuccuaccuugugcaguuuuacauguaccuuacagccuggacagcagagugagacccugucucauuaaauaaauaaauaaauacuuuuaggaagaaaaucuaauuuguuauuuaguagauauguaguagauuugcuaguaaaacauucauugguaauuggggauagaaggcuaugaaacagguugcuaccuuauauuuuuagaagaacauaaaugucauccugcuugcuuuuuauaguugcuuaaguuaaaccugugacuucagauagccaccauaaugucuuuaguuuuccaauuuuuaauuauuuaaggcauauucauuggagacuuacuaugaauaagacacuuugcucugugguauggaggaaacaaagaaaaugagacaugguggggcugggcaugguggcucacgccuguaaucucagcacuuuaggaggccgaggcaggcggaucacgaggucaggagaucgagaccaaccuccgccucccagguucaagcaauucuccugccucagccuccugaguaacugggauuacaggcaugugccaccacgcccagcuaauuuuguauuuuuagaagagacggggauucuccauguuggucaggcuggucuugaacucucgaccucaggugaucugcccgccucagccucccaaagugcugggauuauaggcgugagccaccaugaccagcgugaaaccuauacaucuauggccugcugauuuuucacaagugugccagggccauucaacuggggaaaaaauaaucucuuuaagagauggugcuggggccagguaagguggcucaagccuguaaucccagcacuuugggaggcugagguaggcggaucacgaggucaagagaucaagaccauucuggccaacauggugaaaccccaucucuacuaaaaauacaaaaaaauuagcugggcaugguggugcgcgccuguaguccuagcuacuugggaggcugaggcaggagaaucgccugaauccgcuaacacggugaaacccuaucucuacuaaaaauacaaaaaauuagcugggugugguggcaggcgccuguagucccagcuacuugggaggcugaggcaggagaauggcaugaacccgggaggcagagguugcagugagccgagaucgcgccacugcacuccagccugggugacagagugagacucugucucaaaaaaagcaaaaaagaaaagaaagugagacaugguguucuccaucagaaacaugcccucacucagaaauucacauaauguuaucauuguagugguuaaaggcagcauauccugaaucauauuaaauguccuaaacagaaggaauuuuccuuuuaaaucugcugccaguuuuauuauucauuuuucuuuggauuguauggacuguguccuuaagauaaucagacuuguuuuuuuaaaaucagcacuuauauauaaaaaugaguagcaacugugcuuguucaaaacauuuuuuugccacuuuacaaguuuuuccuguaccaugaucuagagaucaguauauucauugugcuuaguguucaaaugacaacaaacuuuuaucaguuaagcauuucauguugaaaaucauuuuuuuguauuuuuuuuuuuugagauggaguuuugcucuugucauccaggcuggagugcaauggcacgaucucugcucacugcuaccuccgccuccugaguucaagugauucuccugccucagccuacugaguagcugggauuacagccacccaccaccacgcccggcuaauuuuuguauuuuuaguagagaugggguuucaccacuuuggccgggcuggucucgaacuccugacuucaggugauccacccgccucggccucucaaagugcgggauuacaggugugagccaccgugcuuggccugaaaauucuuaaaucagacuuuuuucuuauucaaauggacuuuuuccaugauuacaaaagaauaagcuuuuuguacuaucucaaaacagaugacauuaauuuaagccauccauaauacaauuucaaacaggaaaaaaagaguaauuuuaaucuauuuaaaucuauuuuuagaauuuugugugcuugauuuagauauuuuccuucucucuuuuuaauuuuagcucguggucuggguugauccucuggauggaaccaaggaauauaccgaagguugauaucucuuuuguauucauauuugacaguagugggacaaggauaugauguuaguuguaaauauuugauauuuuguauguuguauggaaagcuacuaucauguguuauguuuaccccuaaagcuauauuugugcucaugguuaucauacaucguugauuguuaagacaggagaauaaaauucaucuccuucaaauaccaccccccacauacuccaccagccccacacuucuaaugucucccagaugagaauaacauauuaaaccaguguuaccaaaaugacuauacugaacccagcuuuauugggguagaaaaacgauaacgaguacaacuguguagcucuugcucugccaccaccaccaucccaugcccuccccauucacucuccccuaaucugugaacugcuuucacauuucauagccucaccuucuaaagguggguuuugaaacacaguacaauauuucuccuuaucuaagaugagaacaauuagagagcaacaaauuaaaauaaaauuggccauauaaauguaggaaugaacaagcucagagccagaguuuuagguuuuguuuuuucuauuagacagucuugcucauugcccaggcuagagugcaguggcaccaucucggcucacugcaaccucugccucccagguucaagcuguucuccugccucaccucccaaguagcggggauuacaggcaccugccaccacgcccagcuaauuuuuguauuuuuaggagagaugggguuucaccauguuggucaggcuggucuugaacuccugaccucaggugauccacucaccugggccucccaaagugcugggauuacaggugugagccaccgcaccugguagguuuuagguuuuaagcuuagaguuuuauuuuuaaacuuaagaucuaggccaggcgugguggcuuaugccuguaaucccagcacuuugggaggccgaggugggcagauaauuaggucggaaguucaagaccagccuggccaacauggugaaacaccuucucuccuaaaaauacaaaaauuagcugggccugguggcacacgucuguaaucccagcuacuuguggggcugaggcaggagaauugcuugaauccagaagacagagguugcagugagcugagaucaugccacugcacuccagccugggugacagagcaagacucuguuucaaaaaaagaaaauaagaauaauaaugaugaugaugaugauaaaauuaaauuaaggucuacauaaauuuucuuguauuggcucucaggacauggcuuaaaaaauuuaucauaauuacuagaaaaaaacuauuuuacuguucuugaaugagacaucgcuauaaugggugaaucacaguguguguauacauguguauguaugugugugugcugaaaacaucuguagaacccauugugaaauaaggaagcucuagacaacuuuaauguguauaaaagcaccuagaaagcuuauuuaggucuugucccccacucucagauuuugauucacuaguucugggaaggagccugagaagaucuguauuauaaaaaguacaucaguuaauucuaaugcugcuugauaguccuugggccucccuuugagaaacucuguuuuaaaggcuugaaauacaagucuagaguguaauccaggaauauaaagugauucggcagguaaggaugaguuggaugaugguggaagaggcacagaggaaucugaugaugauggcugcaaaauuauggcugcuuuauuuaguugguuuacacauuguacuaaugagaccaugauagccaauucaauuaaguggccauagauccuauggcuguuucuggccagcuuaucauuuaugccuuucacuauaaauaggauugaucacggaugaaucauugcaaauuccauaccuuaacugcaaaacuaacuuggagcaauugauguaguaaugaugagucauaauaugagcaaguuauauaacugauauuuauuucuucuuugcaggucuucuugacaauguaacaguucuuauuggaauugcuuaugaaggaaaagccauagcaggaguuauuaaccagccauauuacaacuaugagguauuacuauaaaugauacaaaguaauuucauuagauaaauaauuauaguguuaucugauucuuuauguuaccuaagcaagugguuuuuagcuugguugcauaugcaaucaucuggggaacuuuucauuuuuuaaauuuuauuuauuuauuuauuuauuuuuaacuuuuuuuuuagcuaugcuauuaacugaugagaaaccuuuaaaaauacggauucccaggccauaccccagaccuacugaaucaaaaucgcugggggcauugguacuggguauguauauauaugcauguguauguacacagacccacuaaaugcauuauauauuuuuuaauuuauuccuuaugauucaaauauaaauguugagagaauuacugauaggguucuugauuagcuugggcaucaagacaccugauuuaugauugguuccugaagcacauucaagaaaugaaccauuucaacuaagaaaagaugcuaggccuguuguuuuccagguaacgcuguguagcgccuaaguuacagucaguguugguaacagaacguacuaugcucuugcauucuuuuuucuugucucuucuaaucugcuuugauuuucuauuauacaucagauaaauugccuuccauagaagcaagggacuaguguaauuucaaagcaagaauuuaccauuaaauugcauuaaauuguauaggaaauuguugagauaaaguaguuaagguauuuauauuaaugugaccuugauagaacuuuagagaaacaaaguaaucagagugggcaauacuacuucugaauuuccacucugaguuaaaagcaagguuaagcuuuauuucuaauauaaauuuguuuuuuccugcuguuuguaugauuauaaauuauauuaagaaucguguuucuuaggauuuaccaaaagaguuauauguuauugagaaagucucugggguuaaauugcuugugucuauuaauucuuuaaauaugauuuuaauguugauacuguuauauacagacauaaguuugugguuuuuauguaaacuuuaaguuaauacuauuacuuucaaaaggggcauuuaauucauauaaagcauuguaaugcacgguaccuuucaucaagaaaaaaucuaagugcuuaggaguuaauaauuuucaccacuucuuucugagauuagaaaaauuguauucauuuuccacagaacaaugaaaaacagcaguuaagggaacacaggaaugaagcaaaggugagaaaaauagcuaggguuuuggcuccacuaguagguagaaaagaagcaggcaacuugugguaccccagguggucauuguacaucccacauaccaguucauuuucuccaguucugcuucucuucauuaccucucucuguaccacuucccuucuggacacucuguuuauccuuucucuugcuucucuugcuuaugccuuaaaauucauuaccacaaauggaaguagaaaaguugcucagcuguguuggugguauucaggcuaaagauucaauuuuaaauaauaaucaucaucaccauaauagcuaaaauuuauuaagaguuuacuguaugcugccagguucaaggguuucaaauguauccuuucauugaauacuaaccacagcccuuuaaauaaacuauuauccccauuuuaaagaggaaacugaggcaauuaacuuuccuguggucacccagcugguaaauggcagaacugagauucaaacucaaauccaaaccuugcuacuguauuacuuuauauugcccuccugagccagagaaaagacuuagcaauucaaacuuuauuauugcuuccaacauauacugaaacuaguagacacuuaaaggaaauagcaugaagaaacucagucuaucuucauacugaagccaguuucuuaaccauugaagcuuaauugucagaaaauuuucgccuuuauuacccucccaaaauugguguggagccuuugaaagagagagacaaugccagagccugagagucaggagcacagaagaaggcaagccagcugcaucaugggauugcauuuaccacaccaagacaccagaguccuugaucccauccuuuuugccuagauguucauuuacagaggcaauaugaccuuguagggcccaaaauauucguguccacuguuuucuuuccuuuauuuuuuuccagaauaacuggagaacugcauuaauaaauagguuucuugguugggcgugguggcucacgccuguaaucccagcacuuugggaggccaaggcagguggaucacaaggucaggaguucgaggccagccugaccaacauggugaaaccccugucucuacuaaaaaaauacaaaauuagccggacaugguggcaugcaccuauaaucccagcuacucaggaggcugaggcaagagaauugcuugaacccaggaggcagaguuugcagugagccgagaucgcaccacugcacuccagccugggcgacacaguaagacucugucucaaaaaaauaaaaauaaaaaaauaaauagcuuccuuagauuccaagccucuccuguaguguaaacucagaugggaacagaggaagcacauuaacauauacugaguacccagugcuuguucuuuggcuccuuuguugccccauaugccaucagacucuucugggauugcccuaccaauggagagcugucucaccuaggaccaccccucuucccaaugcaguccauuuccagugacugauuauugcaggaguuuaaagaccugacaucucaucccaauuugggacuacccugaaaggcuauuguagcuccagacuccccgcauaggaacagcuccccguagggucagcucuugcuguaccugcaucacagcuuauuucuucccucugcccacacccuccuccuccuuccacagguguugauaccaagcgcacuuccuaacaaacauaccaccugccucagagucugcuucccagggaacccaaccugcgaccuaaguauauuucacaauaacaacacccaggguacugcucuaggacaaauaagaugaugugugugaaaacauuugacagguaaacauaggcagucuaauuuaguguuuaagaauaucaucuuugaagacagaugagccaaucuuugguugugaacuucuuagaaccuuuagucagguuacuuaaugguuccacauuucauuuuucuaaucuuuaaauuaaggaugagaauaccuacuucaugggggugcuuugaggauugaaagagagauaauacauguaaagcacuuagaauggugccugguacauguuugguguucaguacaauauguauaucucuauaauauaugucuacuauauuaauauaauuguauuuugaugacuuugcaucaaucauuuuauguaucaguuuuacuuuccaugaaauacagauuuuuuuucuauaucaaguguauaguuauaacaauguaguugaaauugaguucugcaaaggaaaauauagauucuaagauugcauuaucauugucauuuugcuguuaaaauugucagcaaaaucuuaacucugaucccauuauccauggcuacucuucaauauuguauuggccuauucaguugcccuaucuccauagcagccaaauacauugucaucauuaccuauuccuguagcaacaugauuuuuaauauuucuuggauaaugaaaaguaguuaucaauacaugguauuucauuuccuggggaucuuaguaccuucugaaaauggccauuuucaaauacaacaaagagaucauuagauaauucagagaaacaguaaucaguuuaugauguuucagcacauuauaaacagaaaucaguuuauaaggauuccagggaauaaccaaaaguucuuugaaacuguuaaccagaacaguaaugauaauaaucagcagauucucucaggagaaguucuuugccagugauauuguucuuguacuuuauaacauuaucauguuuuuugagacggagucuugcccugucgcccagacuggaguguaguggcgugaucuuggcucacugcaaccuccaccucccagguucacgccauucuccugccucagccucccaaguagcugggacuacaggcacccaccaccaugcccggcuaauuuuuuguauuuuuauuagagacgggguuucaccguguuagccaggaugguuuagauauccugaccucgugauccgcccgccucggccucccaaagugcugggauuacaggcaugagccaccgcgcccggcuaucauguuuuuauuuuuuaaaucaugaugcuaauauaacugaauauuccauuuaugggcuaacguucuucuccaaauaaccacaagucuuguuguuucacucguuuacacaggcaggaccagaugcuguguuggggaggacaaucuggggaguuuuagguuuaggcgccuuuggguuucagcugaaagaagucccugcugggaaacacauuaucacaacuacucgaucccauagcaacaaguugguuacugacuguguugcugcuaugaaccccgaugcugugcugcgaguaggaggagcaggaaauaagguaugaaaaaugucugucaucugcucugaagugcaagugaaucauugaaauacucaacuucuaaaaacaugaaauaagaguuuagccaucccauuacuggguauauacccaaaggacuauaaaucaugcugcuauaaagacacaugcacacguauguuuauuguggcacuauucacaauagcaaagacuuggaaccaacccaaauguccaacaaugauagacuggauuaagaaaauguggcacauauacaccauggaauacuaugcagccauaaaaaaugaugaguucauguccuuuguaaggacguggaugaaauuggaaaucaucauucucaguaaacuaucgcaaggacaaaaaaccaaacaccgcauguucucacucauaaaugggaauugaacaaugagaacacauggacacaggaaggggaaugucacacucuggggacuguugugggguggggggaggggggagggauagcauugggagauauaccuaaugcuagaugacgaguuaaugggugcagcacaccagcauggcacauguauacauauguaacuaaccugcacauugugcacauguacccuaaaacuuaaaguauaauaauaaaaaaaaaagaaauaagcguuuaaagagaugggaguaaagacuauaauuuguacauuucagcagcauuuaaauuuuaaaaauaaauuuaagaaucaaguuuuuuuuuuuuuuaucugagagaguucaauguuaaugaaagucaucaggaugacuccaugcuucuugccaaagaccuuauuuucccaaggacccucuuagauuauuuccuagcccuucuacagacucuaagaucuggccugccugcccacuuccuaucuauuucccccauucuuucauccagguuuccaaccugcugagagaauuaugaaaugggacacaauuugaucuacaucccuagcccugaucucuucucaucugauuguccccuagauaucauuaugaugacaucccucagguaucucaaauuuagcguguccaauuugaguucauccucuuucuacccaccucuggauguguuucucucccuguuuuacuaucccacuaauggcaccaccauuuuucuaacugauccagccaaacaccugaaagucauccuagacuccuuccuuccucacagccuaucacucugguccuacuuauguaucuucugaauaguuuuuuguuuuuuuuuuuuuuuugagacggagucuuacucuguugcccaggcuggagugcaauggcacaaucucggcucacugcaaccuccaccucccggguucaagcgauucuccugccucagcuuccugaguagcugggauuacaggcgccugccaccacaccuggcuaauuuuuguauuucuagaagagucugaguuuuauaauaauaauuauuuuacacuauaaccaaaaaaagucaauugacuaaugaaaguuugauagcagguuaccauuuagagucaugcaaguucuagcagugaucucaguugugugucaguauuagaggaauuguuaggaugacucuauaaaaguuuguauuuuguggcgcugcaaagcuguucuuuguggggaaaaaucugcaucuguaaagcaucucuauuaacauagcuagcucuuuuucuuucagacccuccaaauccuaaacagauuaacuaaaaucugauuaggaaacauuugucaccuauuguaucuaaggacagccacuauaagacuucaaaggaauuuuggucucaacaaucuuuaucuuaaucugaacauucucuuucuauagaucccaggucuuuagacaaacccaaucaauugucaaucagaaaauacuuaaauucaccuauauccuggaagccuccccgcccccaccgcuuugaguuguuccaccuuucuggaccaaaucaauguauuucuuaaauguauuugauugaugucucaugccucucuaaaauacauacaaccaagcugcuccccacugccuugggcacauguucucaggacuuccugagggcugugucaugggccauggucacucauauugggcuuagaauaaaucucuucaaauauuuuuaaaaaaaaaaguuuguauuuugguagugaaauggcaauacgugugaucccaagacuuaugaaaguauuuguuagacuagucacauugcacaucuguuaggaucuauuacaauuuauacauuaugguacugcuugauacuucucuguccuuuauuuaauaauggucaggguuuuuuuuugaggggagugcuuuuguuuguuugagacagagucucgcucugucgcccaggcuggagugaaguggugcagucuuggcucacuacaaccuccaccucccagguucaaacgauucucgugccucagccucccaaguagcuaggauuacagacaugcaacacaacacccagcuaauuuuuuguauuuuuaguagagauggguuuugcuauguuggccacgcuggucucaaacuccuggcugcaagugauccaccugucucagccucccaaagugcuggcauuacaggagugagccaccaugcgcagcccucuaauaaauggucaauuuuuuagauguugaaaaaacuugaauuaauucugcuguaaauguauauugcuuuuacacuaaaaaagaaaaacaacgugaauaaaaggaacauguuacuuuauguaacuuggaauauggagacaguucagauauccucuuuguagcuuuuuugaccauuauuuuuccuucauaucacuauauuauuaugcauuuauucuauguauuucuucauaauacugguauaauuuaaaccugcuaaaagcuuuaacuaaauuuaacagaggaacugauuaaauguccuugauagaaacaagcaguuuuucuuaucuguaccucaaucuuuucaugacuuucaauuauucuuucuauuaucaaaggauaauucuuauuuuuacccuuacagauuauucagcugauugaaggcaaagccucugcuuauguauuugcaaguccugguuguaagaagugggauacuugugcuccagaaguuauuuuacaugcugugggagguuagucuguuuuauuugaggaaauucauaguuuuucuacaauuauaucaugcuaagacauaauaucucaguaauauuauuuuacuuagacuguuacgauauaaaagcuagaaggcagcuuagagauuauccaguccaaaccccucauaugauagauggaugagagagcagauuuucagcaaguuuuacuuuaguuaucgucucuuuuuuugaacuuugaucugcauacaguuaauuuaauuuagcccuuauuuauagccuuuuuuuuuuuuugacacagggucgcuauugucuaggcuggaaugcaguggugcaaucauggcucacugcacccuugaacuccugggcuuguagugaaccgagguuguaguaacugagauugugccauugcacuccagccugggcaagacuccaucucaaaaaaaaaaaaaaaaaaaaaaaagaaaagaaaaugcuaaauaaaauuaauauuaaucagagaaaaaauaauuuuauauccuuuaguuaguuaaaauuguucuguagucuuaaauuucaagugaauuaaaacuuaaccuuuauggacacucauuauuucauccagaauuuauuggcuacuauuggauaaggaagcaaaaggcacuuaaaaauaacuagaaaaaccacaauccaauuagccacuaacuugauugauugauugauguuuuucuauaggcaaguuaaccgauauccaugggaauguucuucaguaccacaaggaugugaagcauaugaacucugcaggaguccuggccacacugaggaauuaugacuacuaugcaagccgaguuccagaaucuauuaaaaaugcacuuguuccuuaaaggaaaguuucauuuggccgggcgcgguggcucaugccuguaaucccagcacuuugggaggccgaggcagguggaucacuugagcucaggaguuugagaccagccugggcaauaucgugagaccccaucucuacaaaaauacaaauuaacugggcauccugucaugcgccugucaucccagcuacuugagaggcugaagcagaagaaucucuugagcccggaaggcagagguugcagugagcugagaucgugccacugcacuccagccugagugacaggaguuaagcccugucucagaaaaaaaaaaaacaaaaacccaaaaaguacuuaaaguuucauuuacuuagcuaggagaaagacuugguucucaaaauaauacauuuuaagauuaauuggguagaauuagaguuccaccuuuauucauuguugagcagugauuuauauuuaguuauuauauuuaggaauagaaaauagaauuaaauaauuuaacuugauuaaucaaccagaccaauuuugacgucuggagaacuuauaaacucaauauguuauauuuguuuuccuguauuuagguggagaaaugagaaaaagcuuuaguuccaauugacaguucaggucaauguucaaugaacauuccuaucuucuaaaccagauuucucuuuuuuuuuccugagacggagucucgcucuguagccuaggcuagaauguaguggcgugaucucggcucacugcaagcuccgccucccggguucaugccauucuccugccucagccucccgaguagcugggacugcaggcaccgccaccacgccuggcuaauuuuuuguauuuuuaguagagaagguguuucaccguguuagccaggauggucuugaucuccugacaucgugaucugucugccucggacucccaaagugcugggauuacaggugugagccaccgcaccuggccuaaaccagauuucuuuagggcacaauuuuuucuggaaucucacucuuguuuuucacaguaauuuuaaaaacguuucuacuccaauuaagaauauauaugauguuauuauauaugcuuaugaaacagauuuaugagaaaaguuuuuuuuaaauaaauuauuuaauccuagcucuuuguuauucaccagcuuuuuaaaaaaguguuugaaaauuauacauucucgacuuuggggauuaguuuauucuuguggcaucauuauaaggcuuaauuguggaaagcuaaguacuugcuucuauuccuuccaaugagagauuauaacauaaacuauuaaaauuauucugcuaauauaccuagauuuuuauuuuuaggucucuguccauugcuuuuaauuaaaauuaucuguuuucaaaucaa

SEQ ID NO: 191174 - RNA, 78059 nt, Homo sapiens
agcacgaaaggccacgcaggccguucuaacccuggcggccaagaggagggguagcaggcucuggaaccugcgggcggggacgaagacggcgcgcgacgaugucgcaccgcggcgugcgcggugucggcaguagcugcggcgcaggggcggagcgaaggcugcggcggcgucggguacgcgcacacguugcaucuucuuccuuucgcgggguccuccguaguucuggcacgagccaggcguacugacagguggaccagcggacugguggagauggcgacgcucucucugaccgugaauucaggagacccuccgcuagguaaggggccgagaccaaugaccuguguggguugcaucagccagggagggugcagggcguggaaggucgcugcgccccggcuuugcgcagugguggucaccaucugggauguuggaccugccccucgccccagaauuguacguggaggaggcuccgcaccccucgccccguguccccggcaggugcaucugcuccugaagaugguuuucccgggcauggagggaggcgcagugugagcccgggcuagacaacacgagacuccgcuucggaucuuuuucucagagggaugaacucccagucaacucaccucucccuuuuucccccggagagcgagaguugcucguggaaauaagauuuuaaaacuuaaaauccaauagucgucgcuucucuuuuagcauuuuucccccaacuccuuuucuuaccuccuuuccuguccugucccuccucucaggagaaauccucaguucacuugagucaaauuuuccuuacguuuuaucgaguucagaagaaauaacccagacgagcauauuagcauuuaggauuucaacugaggcugcauuuauuuuuaauuaaaugugguaggguaauuggggaaaacacccagguacacuguagacugaugcgguugcuuuuacugcacccuguggauguguaguaaauuucagaguaaacauuggaucugucaccuuacugacacaucuuaaguucuguuuggaauuauuuuuucgacaugaccaagauuauuguugguagauugcuuagaauuucugcuuuuucauuacuuugggaaauuacacagaagaauuuaaguaguuugccgauuuuuuuuuuucuuuugagagucagggucuugcucuaucguccaggcuggagugcaguggcgcuuucaaggcucacugcagcaucgaacuuccgggcucagaugauccucccaccucagccuccuuaguagcugggacuacaggcgcgugccaccaugccuggcuaauuuuguguuugugucuuuuuuggaaagauggcguuucacuguguugcccaggcaggucucaaacuccugggcucaagccauccugacuuggccucccaaaguacuaggauuacaggcgugagccacaguacccagccugaccuaauauuuguuaaugcauauguaugauaauacacacacaguacuuucuaauguugaagaagcccauaccuuuauauacaguugaccacguggggcugaugaaauuauucauuauauucucaacuuuggugauguuuuaagguuguugaacaaaaacacaacuuaauagccauuuuaaacauuuaaaagaugguaauguuuuggcauauugguugcaguaauggacuaaccgcacaacaaaucaaugaacucuaaaaggaauggguuugauuccugagcuggaaaggcauuagagugccuucaugauugagagcaaagacauuugguuucugcagaccugaguccaauccuggcugccacuuacuaguugugaaaccuugacaaguuccuuauuuagcuucucccauaguuuccuuguuuuaagaaagggagaauaaugucuuccagauaggauugguugccagaguuaagugagacuauaguuaaagcuccugauacuguuuuuuuuuuuuuuuuuuuuuuuuuuuuuuuuggagaccgagcucauugcaaccucugccucccaggaucaagcaauucuuguucucagccacacgaguaguugcgcuuagaggugcgcaccaccaugcccgccuaauuuuuguauuuuuuaguagacacagcauuuugccauguuggccaggcuggucucaaacuccugaccucaagcaguccgcccgccuuggccucccaaagugccaggaccacaggugugagccaccaugcccagccuccugauacauuuuuuguuacuuagaaaaucacccugaagguggccuguuucuguaguguauuacagaacucagaauucugccaguauucugugaaacucuugucauuuugaacuguaugccaguuaucaaauauaucauuuuucuaauugcuccucucccuuuuuaauuuuugauuuaauuauucccaguuuaauucaauuacauuuuaucuuuaaguaauauaauuagaugaaacauuuuaaaauaauaguugcauugcuagaauuuuccuauuuuguaugcauucaucauguuauauauuuaauguuaauuucaaacuuaaaauaaagaccuuuuucccccauaccacccaagagcauacuguagauaugaggcuucaguaucucagcauaacuccaguguacauccccaacaaacuuggaaacuccaggugaucucacacaagcacccaaaucaggaaauacacuuggauacaaugcuuccaucuaaugcacagaccccauccuuguucuaucauuauuuguuacaaccagacccuccauaguguugagaucaaaaucccguauuaugcuuuguuugcaucugauugucaccucucuccaguuucuuucagucuggaaugguuuccuagucuucccuuggcuuucauagcuuugaccuuucugaagauaacaggccacuuaacuugaagaauauccucuguuuaaguugucugauauuuccuggugucuagauucaggcucuuuguuuuuggcaggaauagcguaguuauuccuuguucuucauugcagcccaucaguuggugcaugaauuuaauuuucccauuacugauuauucuaaccuuaauuuuaaugggcagaugcauuggaaucauguaaauguuccacuuugcaucagaucuucacccacuaguuucaguauccauugauacuuccugccuaacuugauuuuuaugauuuuaugauguuugcgagauagugacuuucccauucuaccauuccuucuguauguauuaguuggcauuuuucugugaggagagcuuucucuuuuucccauuuaaaaaaaucauagcaaaaauacucaagaaguuacaauuuguauuauuuucauuuucuauuuaaaauuauuuuguuuuuaaaaauuaguuuuauugaauuauaacuuguauacaauuguucaccaauuuuaagugauugacaaauguguacaaugugacaaaugugacaaguguguaaucuacaccacagucaucauguagaguauuuccauuacuucagaaaguccucucacgccccuuugcagucauuccuuucccuacuccuagcaccuaauagcgacucaucuucuuuuugucacuuuuuugcuuuuucuauaauuucauauacauugaaucauauuauauauauucuuauauucucauaugugccuaggauaauacuucugaaauucauauaucuuuuugucuaugacaguaguuuacuuuuguuguuguugauguuguuuuuuguuuguuuguuuuuugagauggagucucacccugucaccaggcuggagugcaguggugcgaucuuggcucacugaaaccucugccucccaguuucaugugauccuccugccucagccucccgaguagcugggacuauaggcgcaugccaccacgcccagcuaauuuuuuguauuuuuaguagagacggaguuucaccauguuguccaggauggucucgaucucuugaccucaugauccgccccccucagccucccaaagugcugggauuacaggcaugagccaccacgcccggccaguaguucauuuuuuuauuugcuggauaaaauuucauuguaugggugugcuaaaauugaucucauuuauuucgaugucauuacccugauuugccaguggaagccccuccaaccuggacucuguccuuucuuucuuuuuucuuuuuuuuuuuuugggagaugggguuucauucuuguugcucaggcuggacugcagugguacgaucuuggcucacugcaaaccuccaccucccagguucgagcaauucuccugccucagccucccaaguagcugggacuacaggcacaugccaccacgccuggcuaauuuuuuguauuuuagcagagaugggguuucaccauguuguccaggcuggucucgaacuccugagcucaggcaauccgccugccucagucucccaaaguacuaggauuacagguaugagccauugcauguggccuuuuuuuuuuuuuuuuuuuggggacggagucuugcucugccaccuaggcuggagugcaguggcgugaucucggcucacugcaaccuccgccuccuagguucaagugguccuccugccucagccucccaaguagcugggacuacaggccugugcugccacgcccagcuaauuuuuaguauuuuuaguagagacucuauguccuuucgacauauauguucucuaucuuugaguacuccuuugcuuucuaacacaauaagauuuuucagguuuauuuugcaccuuccuugccacagcccuguuuccaguggaacaugguguuuauaaaccaguaucugggugcuaguuguccaucuuuuuuuucagacagaauuucacucuuguugcccaggcuggagugcaauagugcaaucuuggcuugccacaaucuccgccucccagguucaagugauucuccugccucagccuccugaguagcugggauuacaggcaugugccaccacaccuggcuaauuuuguauuuuuaguggagaugggguuucuccauguuggucaggcuggucucgaacucccgaccucaggugauccacccaccucagccucccaaagugcugggauuauaggcgugaaccacugcgccuggccugucuaucuuaaucaaauuaagggacagaggauuaaugaaucaauuaagugucaagaggccauuuuacacuguuuuagaguuugagcuguggacuacaugaggcuugcauucagauccugacugcuauauauuuugucaaggacauuaggcugguuauuuaacuccuuuaagcguuacuuuccuauucuguaaaauggggaugaaaguaucucucauuuuuuuuuuuuugagacaguuucgcugugucauucaggcaggaacgcaguggugcaaucagggcucacugcggccaugacuucccaggcucaagcaguccugccaccucagcccccuggguagcugggaccacagguguguaccacuaugccuagcuaauuuuuguauuuuuuuguagagacggggucucacuauguugcccaggcuggucuugaacuuguggguucaagcaguccucccaccucagccucccaaagugcugggauuauaggcuugagauaucauguccuuugaaucuaacucuacagguuaccccaaagaugaaaaauucuaacuguaaagcauuuggcauagugacuaagauauaauagucacucaaauacuauuaacgauagcuuuuuucuuuuuuuuuuuuuaguuuuuuaaaaauccaaggucaacauauuaacaaaagcuuuuauauaaggcacuauacuauuuuuuuuuuuuuuaagacgcaguuuugcucuugucaccuaggcuggagugcaauggcucaaucucggcucaccacaaccuccaccucccagguucaagcgauucuccugccucagccucccgaguagcugggguuacaggcaugcgccaccaugaccggcuaauuuuguauuuuuaguagagacgggguuucuccaugucggucaggcuggucuugaacuccuguccucaggugauccgccugccuuggccucccaaagugcugggauuauaggcaugagccaccaugccuggcuggcacuauacuaauuucuuuuugucuccgaagggagaagcagauuaauuucagugucucuaacugaaagcugaacaaauucaaaaccaguuggauaugcuagugaauggauucuggauucugauuuguugcugcucugagacaaaagacuacauuuucugucuacagacuacugagaaaaaaguucacuccuuguaggacuuaauauugguuuguugacucauccugauugcuuuaugauucaaguuauaaauacugcauugcuuuuaaagauaaaaaaucuuuucauauuauuuauaggagcuuugcuggcaguagaacacgugaaagacgaugucagcauuuccguugaagaagggaaagagaauauucuucauguuucugaguaaguguuuucaucuuuuuauuuucaguacugauuggcuuuuucuuuuuuuuagaguuuuuuuagagacagagucucccucuuuugcccaggcuggcaugaucauagcucacuguaccuagaacucguggacucaggauccugccaucccagccucccgaguagcuaggacugcaggcacaugccuccacaccuggcuaauuaaaaaauguuuuuuguagagaugggguaucacuguguugcccagcccaguuucgaaccccuggccucaagccauccuccggccucagcaucccaaagcacuaggguuaaagacgugagccaccacguuuggccucugaauggcauuuaaagaaauauucggcaucgccgggcgcgguggcucacaccuguaaucccggcacuuugggaggcugaggcaggcggaucaugaggucaggagaucgagaccauccuggguaacacagugaaacccugucucuacuaaaaauacaaaaaauuauccagguguuguggcacaugcuuguaaucccagcuaccugggaggcugaggcaggagaauugcuugaaccugggaggcggagguugcaguaaaccgagaacgcgccacugcacuccagccugggugacagaguuagacucugucucaaaaaaaaaaaaaaaaucagcauuaaauguuguaugcuuguuuuacuuacuaauuaaguagauugucccuagaaagaaguauacuuuucuuuauucuaaaagaauugaaucuagagacuuaaauuuuucagcaaacugauuccccauguagucuguuuaaaaggaacuagaggucuagcuuugagagcccaucugcaacaccagcuccugaaaugaggcaggguuauuuaauuggacuggccuacucccagaaaugagugacugguuuaaugggaucccuuggcacccagcuguugauuuuuuccuguacaaccaccaacucagcuuuuaacugaaacuucuagggaaguuucagacaggggaauguugcuucagaaagcaauaccccaaagacuggcgcuuugacaugcugagaggccuuagaagcuaccucagaaucaggguaccuguaaccuuguuuccuuucacaacccaacaugcccacuucccccaucauauagagagggacuuucuagaauuuccucaucuggccaagaaagcaucuuuccaaaagaaaugcaguugacuuaaguccccuccuuguggaucucaucaaauaaucuggaaaggucagucaaucccagcucagacagacuucaccugcucuucugagggcagcuucaagauauuaccuaggugacuuuacacguguaauaagacagucuuuguuccugugccgcucuguuucuuaucuuccuuuaauguugcucccucaccucccugcgcccacuuccugguccauuuauucugaugauuuacuuugcucaaaagaauuaucugcauucccuaucuuucugcuccccuaugaaacaggguauguggccaggcgcaguggcucaagccuguaauccuagcacuuugggaggccgggcgaguggauugcuugagcucagcaguuugagaccagccugggcaacauaguaaaauccugucucuacaaaaaaaagaggaaaaauuagcuggguguacucccagcuacuugggaggcugaggcaggaugaucaccugagcccacgagacggagguugcaguagagccaggaucgcaccacugcacuccagcauggaugacagagggagacccugucucaaaaaaaaaaaaaaaaaagauaaacugagcugggugugguggcuuaggccuuuaaucccagcacuuugggaggccaaggcagacagaucaccugaggucaggaguucgagaccagccugaccaacauggagaaaccccaucucuacuaaaaauacaaaacuugccgggcaugguugugcaugccuguaaucccagcuacucaggaggcugaggcaggagaaucgcuugaacccgggagguggagguugcagugagcugagauugugccauugcacucuagccugggcaacaauagugaaacuccaucucaaaaaaaaaaaaaaaaagauaaagcugaaacacuuuccccuguugccacuacauacacacagucaccccauacucauaaacuucugcucucuaucucccccuuucucccaguguaguuguaccauaauugucauuugauuaccauucuguauuuacauuauaaugaccguguaaguuuuauuuacuacugagccacauaguauaauugcuuuucauguaaaacuguuaguuuuccauggaguaauugguguuuguuugcuuuguaauuuucuucugaaacuuucugauuucugaacuuuucuaugugacuucaggaaguuuggaggaaucuucccuuaggagucaguauucucaaauuuuacaauaauaugcuuuaguuugggucuauuuuucaucuguucugcugggcauuugguugccucuuucauuguggaaacuuggaaauccugcuuuuggaaauugaaaacauuuuuucuuugaaaaauguuuuucucucuauuuuugguucuuuauguggauguugggauuaguccuuuauuuuucuaaguugucaccuccauuuuccaucuuucuauuuuuuuuuuuuuuuuuuuuggagauggagucuugcuguguugcccaggcuggaguacaguggcacaauccaggcucacugcaaccuccgccucccagguuuaagcgauucuccugccucagccuccuaaguagcugggauuacaggcaugugccaccaugccuggcuaauuuuuguauuuuuaguagagaugggauuucacuauguuguccaggcuggucuggaacuccugaccucaggugauccgcccaccucggccucccaaagugcugggaucacaggcgugagccaccacgccuggccucuuuauuuuuauuuuuagagauggaggucucaguaugcuguccaggcuggagugcaauggauagucacaggugcaauuauagcacacuacagcauccaacuccugggcuuagcgauacaccugcuucagcccccugaguagcugggacuacagguguguaccaacaugccuggcccauuuuuuuuuuuuccuuuacuuucuggaaaguuccucaacuucucaacuuuauuaucccauuuuucuauugagguuuuuaauuuuggcuauuauguuuuuaguaucugaguguucuguuuuuuuuacauucuggauacucuuuuuuuaguaucuuguuuuaugauugcaguauuuuuguuucauugcuaaaaaugaauuuauucuuuuaugaacuuuuauuuuagguucagugguacaugugcagguuuguuauguagauaaacuugugucaugggguuugcuguacauauuauuuugucacccagguacuaagccauccaauaguuauuucuucugcucuucucccuccucccaacauccacccucaagccccagugucuguuguucccuuuuuuguguucauguguucucgucguuaagcucccacuuauaagugagagaaugcaguauuugguuuucuguuccugugucaguuugcuaaauauaauggccuccagugccguccauguugcugcaaaagacaugaucuuuuuuuuuuuuuauggcugcauaguauucugugguauauauguaccacauuuucuuuauccagugugucacugaugggcauuuagguggauuccaugucuuuguuauugugaauagcgcugcagugaacauuuccaugcaugugucuuuaugguagaaugaacuauauuccucugaguguauagccaguaaugggauugcuggguugaaucguaguucuguuuuuagcucuuugagaaaaugccauacugcuuuuuacagugguuugacuaauuuacacucccaccaacagugugugguuuuuuguuuuuuguugugagguggagucuugcuccgcugcccaggcuggagugcaguggcacgaucuuggcucacugcaaccuccacuucccggguucaagcaguucuccugccucagccuccugaguagcugggauuauaagugcccaccaccacacccggcuaauuuuuauauuuguagaagagacgggguuucaccauguuggccaggcuggucucaagcuccugaccucaagugaucuguccaccucggccucccgaagugccgggauuacaggcaugagccaccacaccuggcuugugauggguuuggaugagguuugaucugccuucguagccucuuuauuagcaauagauucuuggcuccuuugccuugauuuauuuuauuuauuuauuuuuuuugagacagggucucucucugucacccaagcugaaguacaguggugugaucucagcucacugugaguucaagcgauucuugugccucagccuucugaguagcugggagcacaggugcaugccacuaugccuagcuaauuuuuguguuuuuaguagagacgggguuuuaccauauuagccaggcuggucucaaacuccugaccucaagugaucugcccgucuuggccucccaaaguacugggauuacaggugugagucaccacacuuggccagccuugauuuauauuaaaucacuguuauucucaacaucccaguuauauuuucauauuugcaccucugaauagacauguaaagaacaaauuagcagacugggcgugguggcucaugccucuaaucccagcacuuugggaggcugaggcagguggaucaccugaggucaggaacucgagaccagccuggccaacauugugaaaccccgucucuacuaaaaauacaaaaaauuagccugucgugguggcagccaccuauaaucacagcuacuugggaggcugaggcaggagaauugcuugaacccuggaggcagagguugcagugaaccaagaucacaccauugcacuccagcuugggcaacaagagugaaacugcaucugaaacaaacaaacaauuaacagaucuauuuuuuacuauaguagaaaauacaugguaaauauaauaaaguuuccauuuuuacauuucuucauaagucucaugacuuacugauuugcuagagcagcaguaauauuuuaucucgugcuuauauucuagaaaugugauauucacagaugugaauucuauacuucgcuacuuggcuagaguugcaacuacagcuggguuauauggcucuaaucugauggaacauacugagguaagcaaugaacauuuuguuguguguguuuugucuuaugcuucuguuuuuuuaugggaaccucaucauuuauuguuggcuuaugaacuauucuacuuaaggauauuaacagaguguuaauuauauagaccaagguacagaaugcucaucuuguuuuuuugucacaaaaaaauucuuuuuuuguaauuccuaaguuugaaccuuuaguccccuaccagcuguacuuuugggagcauuuagugccaucuuggccuucacagauuccuagcauuucauagccagauggggcuguauagaucaucucauccaacuuucuuacuuuacggauaaggcagcaggccuagaaaaguuaaguuugaacaggguaacacgcauaguuuggaucccauuuucuuuucuuucuaaguguaugccuuguuuaauuaauuauuucaguaguaaauuagcuuuauauacaaucaugugccucuuaacaaugggaugcguucugagaaauguguuauuaggcaguuucaucauucugucaacaucauagaguguaccuacaaaaaccuaaaggggauagccuacuacccaccuaggcuauacaguguagccuauuccuucuagacuacaaaccuauacuggcaaguuacaauacucaauacaguagguaauuguaacacaauacguauuuguguaucuaaacauagacaacauagauaaaacuauaaucuuaugggaccauugucauauaugcagucugucauugaccgaaaugucauuaugcaguagaugacaguacugcuuuuuagaugcugcuuuuuuuccuguuuguauucugcucuaaccuuccuaaaucucauaaaauucaaaguacacagaaugguuucuaaguacuaacuuuuaaauuuuucaaguaaaugaaucuguuuggcuagguaccaucccuucgguucauucagguuggcuuauuucugccaccaauucucaaauucuuauuuuccuguucuuuccugaagugccccgccacacuccuguaaaaaaaaaaaaaagcagaaagcauagcaaaauaaauguggcauuuauuuaaguucuauuuuagauuuuaggcaaucagaauuuaguccacauaaugauaaauuguauaauuugagaaaggaaaagcauaguaagaguguacuguugcucuaguuaacuagaauuuuuuuauggucuuucuuuuuauaaguugaaauguuggaaugcauuucuuuucugucuuuuauguugacagauugaucacugguuggaguucagugcuacaaaauuaucuucaugugauuccuuuacuucuacaauuaaugaacucaaucauugccugucucugagaacauacuuaguuggaaacuccuugaguuuagcagauuuauguguuugggccacccuaaaagguaucaauaauucuuaauaauccucuguuuuaaucguuuaauauuuugcuggauaaaaauuauauauauuucuguguguaugcauguauguauauguguguguauauauauguuuagacaguaacuuaggacuuuauuacaggggaaugaccucccuggcuguuuuauuccuauccagcuacgggaauucccuguguuuuucugccgucccgucgucugucucacaaccccaacuuccuucuugccuuuggagcugaucuuauuccugauaaagaaguccccaucccauuuauguuagcaccucuccuacuucagcuauuauuuuacuccagacacuugucucugacuugaaaaaagccauuauugcucagugagugugugacugggagguuagggaguagugggaugauguggaguugugguuuuucuuggaggucacuuccuucuucuacaacuaguuuggaacaaguaagaauaugcuuuuuccaacuuggaaagacaguuuuuucaaaaacaacuuucuugagguauaauugacauacagaaaaucacacuuauuuaaaaauguauauuuugauaaauuuugacauauauauguguguguauauauacauacacacacacacacagcuguggaacuaugguuacaaucaagauaauaaauauauccaccacccccaaaaguuccucaugcugcuuuguaaucauccacccucaccaggucccaagaaaccagcaugcccagcuuugcauauuuuucgucuucaguugguuguaucuacgguuauggaacccauggacacagagagcuaacuguuuuagaaaacaguucaguguauauccagauauuuaacauuucauuuucuuuagaagcacaacuuuaagccaucucaauuacuucaauuagucacaacuggaacuuugcuuuugaagcugcagauuuauugaauaguuuaaaauuaucuuugcucauaggaaaugcugccuggcaagaacaguugaaacagaagaaagcuccaguucauguaaaacguugguuuggcuuucuugaagcccagcaggccuuccagucaguagguaccaagugggauguuucaacaaccaaagcucgagugguaagccuuuuuuucuuuuuuuuuaaaaaaaaaaacacuuugggaggcugaggcgggcggaucacaaggucaggagauugagaccauccugaauaacacggugaaaccgcaucucugcuaaaaauauacaaaaaaaaaaaaaaaauuagccgggcgugauggugggcgccuguagucccagcuacucgggaggcugaggcaggagaauggugugaaccugggaggcggagcuugcagugagccgagaucgcgccacugcacuccugccugggcaacagagcgagacucuaucucaaaaaaaaaaagaugacauuucagucugucugaggcccuaggucugaaaagacaauuauuccuacucauaaaguuuauuuucuuuuaauaaauuuaaaaggaucuucuugcaagaaucugacauuuuuaagucuugguuucacauuuaauuguucaucuauauaaagcccuaaucuuuauaauuauauagcuaaauauuuugaucauccaguguaugucccuuaggcaauccaaacuccauauaaauaaaaccucauuaauuuuacaccuuugcaauuuuuucuuucuucugaaucuccugguuuuugaaccauugagcaucaaguccugggauucugcagcacuuuuucauugguucuguaggaaaaugugacauaguguacaguacaaaagcuccuuuucucuaccagaguugcuccacuuugaucuguuuuacacuuuaggaauguguuguaaaguuuugauuuaauuaagguuuucuaauguaaaauuugaaaacuacugucuacuuggauaaagauagcccaguccacucaguuguuuuggcuacaaaucuuuacucauccuucacuguuuuucacauuuacucaacgaguccuguuaugacuucucauguguguagauuuguuuucuguccaucuucagugcuacugcacuuuguugaggccuaauuuuuccuugcuugguuuaauaccauaaucucauaacuaaacuuccuuuugucucaucuuucucuaguucaggguaucacuuuagaaaacacaaauccacgguccuauuaucccugaggacugacuccucauugccuaaaacuuaaaagccaaacuuaaaagguccucuguguuuuugacuuaaucuauuucggcuuccuucccuacccacccaauaugcauuccuaacuuuucauggacauugcacuacuuuuuccugccuuugugccuuaccuacucuguuauuuauuuacuuagaaugaauaccccauauacuuuuuuuuuuuuuuuugagacagaguuuugcucgucacccaggcuggagugcaguggcaugaucucggcucacugcagccuccgucucccagguucaagcgauucuccugccucagcuuccugaguagcugggacuacaggugcacgccgccaggcccagcuaauuuuugcauuuuuaguagagaugggguuucaccauguuagccagucuggucucaaacuucugaccucaagugaucugccauccucggccucccaaagugcugggauuacaggcaugaaccaccgugccuagcaucccauauacuccaucugauacauuucuacuuaucuucgagguccagcuugguucuuaacugcuuuuaagcuuuuccugauaaaccuagguauugcugauuaauuucaacugagugcccuaacagcacccugaacauaucuguauuacugguauuugguuuuauuuauauucuuaaccagauuuuguacccucaaguguagggaugauguucuagucaucauauuuuucauaaccaguguguguagugccuggcacauuuguugaaugaguguguucuuagacauuuaaccauaagacuuuuuguugugauggugguuguguuuuucaggcaccugagaaaaagcaagauguugggaaauuuguugagcuuccaggugcggagaugggaaagguuaccgucagauuuccuccagaggccaguggguaagaaaauguaacucacauuuauaauugaauauauuuagugggaaagcuuuaaaacagugauuaaauacuuaaaguauuaauagguuaauaauauagaagaacauaagauuuuaauugugagaguuaaaauucuaaacguuuuaacaguuuuuauguuauuaauaguuaauguugauuuaauuuguaguuuuaguuugucaacuuaguaaaagagacauuuuaguuuuauccugacagaacuuuaauuauguaauuaacaaaauauccaaaaauaagaaaccuuaaauuucauuuuuauuuuuagauuuuugggcuuucauuuaauuggauuuguauuuguacccugagcaauccuuuuaauuagcaguugaaguuauaauaguauuggucuuuaaguuauuuuuuuuccccaagugaaggggaguccugaaaagccuguuccuauuccuuucuuuccauuagguuucccaaccccuucaucucuuggcacccauggaaaguaguauuugaauagcucauuagagaaaaagacuguucuguauggugaucaccaggcuggggcugcuucagcccuugcccaccauuccccaaggcugagaaggaagucuuugucuuugcacaccugucauccuauuugaaguauacuggacaagcuuuauaauagcguccuuccaaugauguuaauauaauaaaauaccucuuauuaaagcaguuagccucacuuagaaaauuaaccauuaggaaaauguucugccauguuuuguaauugaggugauuauuuuuuccaaauuuaagauuuccaaauuuaauuuuuucagauuuuguauucuaucaccauaaugaaguucucaccuuucuauaguacacaguagaaacuggaagauacagaaacaauuuucuuuuagcgauguauuuaauacuucuucacaaacuauuucauaagcaucauuaacaguaaaauugcuuuuagaauuucacauuuugucucugcuuuucuauguuugcugauucaggaggugaaauaaaggguagauagaaggagaugaaacagaagugaugacuguggaaaauucacagacuugaucguuaaaugguugauugguaauugacuaaguggauucaggcauaaauaauacuuaccuuacaugguuuaauaucuauagacaucuuggguuccuaccaucuaguauucugcuacugugcacuugguaugagaggucaugauuguccuguuggauagugaccuugaucgucuaaaagccaccuuuuuuuggcaguggccauuuuuagcugcgccacuugaacauuugucuuuuuuaaaucuuuucauauuuugcgucacugucacuucugggaauagugaguuccccauguuuguauauuuacaguauaauauauauuuaccuguuguaaauuaugucagagacuacgcucaugagacaguuuuggggucaggaauauaaaucaguauuuaguuuuuuuuacuaugcauaguuuucaucaucucuucuuguacuguuaaagaguuuuucuuuaauuacuauuuuuucauuuuuucuuuucugugucuuaaaugaaaggccagaaggcuuggcuuagucuuuuauucuuauucuuagcuaacauauacauagcaccuauuauguacaggugcuaccacaugcuuuacuuauaguaacuuauuaaucccaacagccuucugaggaggcacuguuguuaucucuguuuuacaaaugguuucggaaacagauucauauguuguaguaacuugccaagcucaaaccucuaccaucuggcucuagaauccauauaauuaaaaauuguacuacauguaucuguuaacauauggcagaagcccaauucagcaucaguucuaacucaugcagcaugauucuuuugugugugugugugugugcgcguguguguguguuuuagcgauucugauauagagucacucuuuaacugaugauuuuaguugucuugugacuuauaguccucuuagcuuucuugagguuuggaauuguuagaccugcagauuuagaaauaacauuuuugaaauaauguuuugaucucaucaccuuucuuaaauuaauuucuguauuuuaaagccaagcacauuaacuguaaaauaauagguacuaauuguuaaucuuuucuugacaaugguuauaacauguuauugggugcaacgcccucaaguuaaaaguacaccacaauauuuuucuuccugggaacuuauggcccuucauuuaguuuuauuuuuaauaaauuuuuaauuuuagaauaguuuuagauuuacacaaaguugcaaaaauaguacagaaaguuuccauguacccugcacccaguuuuuccuaacauuaacauuuuacauuauuaugguacauuugucacaacuaaugaacuaauauuaauauguuauuaaacuccauccuuuuuugggauuuuguuaguuuuucccuaguaucucuuuucugaucuaagauuucaucugggauaucacauacagcccuuuuuuuaaaaaauuuuuaauuaauuaauuaauuaauuuuuuguauuuuuaguagagacagaguuccgccauguuggucagccuggucuugaacucgcgaccucaggugauccgccugccuuggccucccauagugucgggauuacaggcaugagccacugcacccggcguacagcccuuuauuauauguauaaaguuuugaauagcccuaaauauguugcauuguaguuguuugcauuagucuuuguauauaaacccuccuuuuuuuuuuuuuuuuuuuugacauagccucgcacuguuguccaggcuggcgugcaguggcgcgaucuuggcucacugcaaccuccaucucccagguucaagcaauucuccugccucauccucccgaguaguugggauuacaggcgcccaccaccacgcccagauaauuuuuuuuuuuuuuugagauggagucuugcucugucgcccgggcuggagugcaguggcacgaucuuggcucacugcaagcuccaccucccggguucacgccauucuccugccucagccucccagguagcugggacuacaggugccugccaccacucucggcuaauuuuuuuguauuuuuuuuaguagagacgggguuucacuguguuagccaggauggucuugaucuccugaccucgugauccaccugccucgaccucccaaagugaugggauuacagacgugagccaccgugccuggccaauuuuuguauuuuuaguagagacgggguuucaccauguuggccaggcugguguugaacuccugaccucgugaucugcccgccuccgccucccaaagugcugggauuacaggcaugagccacugugcccggcccaagcccuucuuaaaguugaaucauugaucugggaugcuaaugacuuuuaaaaacuugauugauuugaaaauaauguaaauucauaaacuuuuaugaauuuuuauauuauuuuauuuuauaaaauaauauaauuucauaaacuuuucccccucccauauggauaucaacugagaucaaaccugugugggaaaccagguaacuaucuuaaaacuguacaacugcuggccgaggcaggcgggucacaaggucaggagaucgagaccauccuggcuaacacagugaaaccccgucucuacuaaaaauacaaaaaauuagccgggcaugguggcaggcaccuguaguaucagcuacuugggaggcugagguaggagaauggugugaaccugagaggcagaacuugcagugagcugagaucacgccacugcacuccagccugggcgacagagcgagaguccgucucaaaaaaaaaacaaacaaaacaacaacaacaaaaaaaacuguaccacugcugccaucauuauaauuugaaacuaauacaaguuggugaaagcugauuaaacuuccuugcuucaugccuugucagcccaaucaacuguauuucaacauagugguguaacauauuuucuuuuacucauguacuugauagaaggaggguguugaugugugauauuaucaacagugucucugaucuguauucuuccuuacaauugucagcugcucacaggaacagcagaacaguguuuuuguagauucugauucauugaguguuggugcugaugagaccuuugggauuauuuaguuaaaauucuuuuauuuuuaaucuccgugacaugaguuuaccuauauaacaaaacuucacauguaccccugaaccuaaaauagaaguuaaaaaauuaaaguuaaaaaauaaucuuuuggcugggugcgguggcucacgccuguaaucccagcacuuugggaggccaaggcaggcggaucacgaggucaagagaucgagaccauccuggccaacauggugaaaccucguuucuacuaaaaauacaaaaauuagcugggcaugguggcgcgugccuguagucccagcuauuuggggggcugaggcaggagaaucgcuugaacccaggagguggagguugcagugagcugagaacgugccacugcacuccagccugggcgacagagcgagauuccgucucaaaaaaaaaaaaaaaaacuuuuauuuuggcaucugagaaaaccaaagccuagagaaguaaagcggcuuuuacuaauugucaugugcucuuuucauuuagucaucacagugacagucucagaagagcuucucuccaguggcauaggugggcacccaguucucaguaguaguaggucuuauuaaagacaaacaguggaagguagcguuggaaacaauuuugaagcagcuuuacuuuaauuaaaugaucauucuuuuugauaaaaagaaaaaggagaaucuccuuaagguugcaauguuuguaaauaccuuguccccucugugagauuuuacauuugaaguuguuucuuauaauuguuuuauauaugguauagucuuuuuuuuuuuuccugucagggucagauuuucuaucacaguacuuuuuguuagaaaauaaaauaugacuuggguaccaauuagaaggacuuuuguuuaguucucaucuccucaaaaagguuaaguuuaaguauuuaguuaaaacauguuaaugaguuucuuugugaaauguuuuuguuuuaguuacuuacacauugggcaugcaaaagcugcucuucugaaccagcacuaccagguuaacuuuaaagggaaacugaucaugagauuugaugacacaaauccugaaaaagaaaaggaagauuuugagaagguaauuaaaaguguagugaugacccuuugccagaaaagugaauuaaaguuacaggauuaccuaauaccuucaugguaugaaaauaaauuuuguucucauagcugcuuuuuucccuaucuauauauuccauaucugagaccuaagccaagaaaugucgagcucccauaccaaaaaacuuaagaguuauuuuuccuuuccccaguuauagaguuuaccugaaugauauguuuuccuauaauaccaauuuauuaaauggucacuggaggcagguuuuuuggucauauaaucuuaaguuuaugaaugaaauaaacacuaaguagguauuggaaaaugugaagguuuccuagccucuuaucuuuauucagaaguauggcaguguauucaaagagagggcaaaugauugucaguucucccaguaaugaccagcuuuuccaaaguaaauggaaaacuccaucgugagaucagcuuucucagcuggaaauuuggaggcuaauauaaugaguaucuaucuguuuuuucuuuuuugaucuaauaucauguaacuuccacaaccauuuucaggcuaaauaagacugauggucuauguuacauuugcuuaaaugcaguaucaaggguugaaaaugcacgaaaaaaugcaaaagauauacugaugguuauuuugguuucuuacuacagguuaucuuggaagauguugcaauguugcauaucaaaccagaucaauuuacuuauacuucggaucauuuugaaacuauaaugaaguaugcagagaagcuaauucaagaagggaaggcuuauguggaugauacuccugcugaacagaugaaagcagaacgugagcagaggauagacucuaaacauagaaaaaaccguaagccacauuguuuuauauuuuaauugauauucuuauauugugcuucuuuaguagaacgugauuucuuuuuugugaaagcugcuaguuuuuuuguuuguuuguuuguuuugagaaggagucucgcucuguugccugggcuggaguacaauggcgcgaucucggcucacugcaaccuccgccucccagguucaagugauucuucugccucagccucccaaguagcugggaugacaggcgugcaccaccacaccuugcuaauuuuuguauuuuuaguagagacgggguuucaccauauuggccaagcuggucucgaauuccugaccuugugaucugccugccuuggccucccaaagugccgggauuacaggcaugagccaccguaucuggcaaaagcugcuaguuuaaauacauuuggguauaugacucauuugucuuagaaaucuuuuuucuuccucuaucuuuauguucuuguuauuuuauuaacaucacaacugcaugugaauaugcccuuaguaucucacuuauuauguguagucuuuugcauuguauucauucaauuugaaggauuccuucugcaacauuuuacaguuuucuuacuuuaaauacuuagccuuucuauaauacaauguuugaugauaauguugucacccaagucuuccuuuuggcauguggguaaauaugaauauaauauauaguacaagcucaguacuaaccuguaucucugaaauaucacuugacugaagagcauaucuuucuuauucauggcuucucuccugaacuucuaaauugggugauuuucauucuguaauuauguugucagaacuucacuauaauuaaaccuggagugccacauuugggaaguauuaguaaauuaaaauaguuauaaugagucuuuuuuauuuugaaaagguuuucuacauuuucagagguggcuaaccaauggacuuuuagaccuaucuugauuauuugagggcaagugucuuacauuucuaguagcuuccacagaaaauuauuguuuaacaguuuguaugcauacagggcagguuuuugcuagauauugugauauagagggagccauagccacuuggaauguagaguccuuuuuucugguauuaaacucuuuucuuuccugugucacuguuuucuaucaccucuuauuuucuuggauccaagaguauccugcuucucauugggaugaugaaggggcuuucagggagcccaugagcucagacucucaaccugagcuguguucuuuagauaggcacggucuguagugccaaugccugugggaccuuagggccggaccaaaccauucugucccuuaggcaugagguggcaaaauaagaaugcuucugcuuuaaaggcagaauguuaaauuucagggagaugagaagagaaggggcuggcccguugugccaugaugggaagggaaacacuaggugagcggagccuucaggccuuguacuuuuucuuaugcuuaauugauaccacaugaguggaauguauugauguuaccuuuucuaaaacguauuuguauuugcuaaauguauugugaaacuucuuuaauuaaaaaaugacgcauuugcucuugguacuggauacuggaaauauuacaguguuuuuaaacuaacacagggugguuauaaaacaagaacaugaaaauuuauaucaaauuauagcacuaugagaauaauuugaauuuaaccagauuagugaaccguaauguaauuaucauuuuauagcuauugagaagaaucuacaaaugugggaagaaaugaaaaaagggagccaguuuggucaguccuguuguuugcgagcaaaaauugacaugaguaguaacaauggaugcaugagagauccaacccuuuaucgcugcaaaauucaaccacauccaagaacuggaaauaaauacaaguaaguauaucuccuucaauaugcuagguagccaucugugcuuuuguuuugaucuucuuuaaacauggaguacaagcaaaauagucaagaaaccuggccuuuuguucauccauggguucacuggcugguggccuucuguaaaggcauguagccuuucacgggccguuuacucaccugucaauuaagguucuaccacauuauuucuaagaucacuuccaucuaugaaaguccugagucugccuagaguugcuuuuuuuguauugauuagguauacugugauguacaucuuuaggugaagauacuuugcuuccuguaauaaacuuugagucuacuuugcacaaauugauuccuaaaaguaauaguauugaaaacuuccagaaauaugaacaauacaggagaguaacauguguuuagauuaguuuucaauguggauuuguagguuaacgaaucuuuguuuuaaauggaccuuuuccaaaaaaaaaaacccuacuuuauaaaauaaaucauaaaaaauauuuuuuaauacuuugaagaagcguacuacacauaaaugcugaauuaaaauuucugaagagaaugguaaauguaaaugauuacuugguuagcugaugugacuuacuuuaaacucaugggugcugacaugucuguccauauauagacaaauacacaugugauuauaugugcauacauaucauuuuucucaggauuacuccuuguuuuacuaagcaaauccuuucaauacauuuggaaaagugacuuuggauacacauuuucagugucaaauaauugcaaagcauaaugcaguagcaucuuaaucaaguuguaucuuaaaaguuagaauguauaauggcugggcacaguggcucaugccuguaaugccaacacuuugggagucugaggcaggaagcucucuugaggcuaggaguuugaaaccagcgugggaaacauagcaagaaccugucucuaccaaaaaauaaauuaaaaaaaaaaacuagccagguaugguggcacgcuucaguaguucuagcugcuuggaagacugaggcaagaagauugcuucaguccaggaguucaagguuacagugaguugugaucaugccacuucacuccagccugagcaacagagugaaacccugucucuagacaaacaaaaaggaaagcauugguuggguguaguggcucaugccuguaauaccagcacuuugggaggccuugguggguggaucacuugaggccaggaguuugagaccagccuggccaacauagugaaaccccaucucuacuuuaaaacaaauacaaaaauuagcggggcaugguggcgcaugccuguaaucccaucuauaccugggaggcugagaaucacuugaacccaggaggcggagguugcacugagcugagaucgcaccggugcacucuagccuggguaaaagagcgagacugucuccaaaaaaaaagaaagaaagcauaaugcacuaauauauauauauauauauauauauauauauauauauauauauauauaaauucaaauugauacugcauguaaauuguauacauuaucuuagucagaaacuguuuuuuagacuauuucaucuuaaauguaauuuugaccuaaugauuuucuggucuucugucgguuuuuuuuuuuuacacagugaauggagcacuguuuuugaguguguuugaguacuuuuaagacuuuuagggauuuacuugaguaagggauuacucagaacagagugagacuccgucucaaaaaaaaagauguucaaaagcuaaauuuccuuaaaauuauuacauguauuauuuauugcuuccuacuauguuauacauuggccauuacagaaauauuaugauuauacaauuugccaagccaauaccuaauuuuguauuagauugcaaauuugcuuuuuuguuugacugcuaaguugacaacugacucauuguucucaaaggcugauaauguuuugauacacuuugaguauuaagucauaaaaccuuuugguuuuuaagaaucucuuaacuuguaaagaauuacauuuuaaauuaguauuguuguuuauaaugcuuaaucuaagagggaaaggguaaaauguuuuguuuauuuuauuuucuuuuuuucuaguguuuauccaacauaugauuuugccugccccauaguugacagcaucgaagguguuacacaugcccugagaacaacagaauaccaugacagagaugagcaguuuuacuggauuauugaagcuuuaggcauaagaaaaccauauauuugggaauauagucggcuaaaucucaacaacacagugcuauccaaaagaaaacucacaugguuugucaaugaaggacuaguagauggaugguauguuuaauguuacuuagaauugacaagaaguaaggacauaguagaucagugauuuuuaaacugcuugagagauagggaaggugauugggaggagggggaauggguaggccuauagaauuccugauucuuaucuucuucucagccagugcauuagggcuuccccuucuuguuuuaaugccacaaauaauggagugcccacuggggaucauggaaugaaaaacacacaugagggcacauccucugcaggucuuagcauuuaauagaagaacaguuuugacuuucugguucuugguauauuugguuacugaucucuacucucugcugaggcugagguuuuucuuuuuggcuaggucccaagaagguuaaaauacccuugaaucgaagugaagauguaaaaguuuaucuugagcuccaugaaaaggguauuacugcauacuuacugagguuugcagaucccugcagaauauuaauuuccuacauauauuuuuguuuuauuccaaagggcuuuauaaaguauauucauaugugaaugacaggauaccaucuuuuuucugauucucaugguccuauguggaauagggaccuugaaaauguuugauaaauaaaaauguaugaaugcaugggauuuccauauuugaaaaugucaccauugugucuuuuuuuucaaaugugcuucuacuguuuccaguagugcauuuauuuuacugcaguauuugacaggucagcaguuauccuguuccuugaauuugggcucacuaguauugcauacuaccuaauuaguauaacuagcucuuagacaaauguuuaacaagcugaauaugauuuauuauugauuaaguaucuucuacucuccacaucuacacauuacaaaauuuccuugguacuuaaaauuuacauauuuccagggaugacccaagauuuccuacgguucgugguguacugagaagagggaugacaguugaaggacugaaacaguuuauugcugcucaggugcguuacaguuucuuuuccagcuugucuguuugaaauuucagguacuucuauuacugucccuuuacucuuuauuaucucuguuguucuuucuauuccuuguuugugccuuaugauccaagggcagauuuuuuuuuuuuuuuuaaaacaaacuuuuuuuuuuuuaaaguuuaucacugcuuauaauagugaaaaauugaaaauguccuaaacuccuaagcuagauuuggagaaaggcagcugaaguauuuuuagcagugaauuauaugacuugacugugagcagucuguagacugaaccuuuacagugaacuguuaaggguaaccaaauuaguuuguauacacugaguuuuauauuucacuagaaguaaacuugaaaguauuuaucgaguuuuuuuuuuuuuucuaaacaugcuuagcaugaaauaaaggcaaaguucuaauuaauacugcuugcccuuaaaaucauguuguuauuguuuuuuagggcuccucacguucagucgugaacauggagugggacaaaaucugggcguuuaacaaaaagguauguauguuaacucucugccuucuuuucucaugcuuaagucccaaauaauguacaaguagaagucauuacugugcucaugguagagaaaaguuugugaagaauauuaacauuuugcagacuuucaggaaaauggaauguuuuccuuuuuuaaauacacgaagagcauuaauuaagccuauuaacuauuccaaauaaguaacaaugauugaaacaaacaaacuuggaauuauggggaacaguaauauuuuuuuccuuaaauuuuuuaugaacacucugcauuucauuuuucugcuuucaagcugcgagcucucuguaagaagguauuacuuaaugcuuuuauuugccuuaaacauagcuuuuagcauauuacauguuaaaaccugagauguuauauggcuuugaagcacaaucacauuuauauaaaagacuugcuuauacaaacgcauugaaaaugcauuauuccuaguguuaaaaaccauguccucugguuuucuuagugccaaggggaauauugggauaacucuauucuaccccauucccuugugugcugagaggacauagaauucuaaaaguauguauuucauugaguuguauuaaaguuucauuaauuacaguuccuuugucuuacugaauccagcuuuuuuuuuuuuaacuguuucuuaacugaaagucaaaugaggaacauugccuauugacauuguuaauuacuaauuggaaagcagaugcuuggacacuauaauaaggcaaaucauucaaaugccauguuuuaaauuaugguuucugugauuguguucuguaaauucuuauuugggauugcugcuugauggugcugaugucuugccucaagauauaguugcuuguuucgcaugugucuugaauuuguuuuauuuuggucuuucguguuuaguuuuugauacauaaaggaauuguuaauugguucuugcuguugcugcaguuacuaauaauaaauaugaguagaauuugcuggcaaaguuaacacugguguacuuuucauuaacaauacaauuuuuacugauuuuaaguuuuaauaaaguuaaacauggacacuucagauaucugaaauauauuuuacuauagucaaauaguucuguagggucuguuaagaugaacaacacauuccucucucuaucuacuuucauagucucccuggagaaagcacuuucaucucuucuagauaguucuuuugguauuuauuacuuauauuucuuuuuuuugagauagagucuugcugucgcccacgguggagugcaauggcacagucuaggcucacugcaaccucugccucccggguucaagcgauucuccugccucagccucuugaguagcugggacuacaggcaugugccaccaugccuggcuaauuuuuguauuuuuaguagagaugggguuuuacuguguucgccaggcuggucucaaaccccugaacuugugauccgcccaccucugccucccaaagugcugugauuacaggcgugagccacuguguccggccuguugcuuauauugcugaaugaaauauauguguuacuacuuuuuuagcuauguuuagacauauuaguugacuucccgugauggaagauaaauaauuugaccuuuuacuuuuucuccuaacuuuuugguuugcuuguaguugauugucuugcuuugucucucccucucauuugcuuauuuuuuguuuuuguuuuuguuuuucuguuaaaaaaaaaaaaaaaagccagguucucaugccucuacucccagcaguucagaaggccaagguaggaggaucgccugagccugggauuuugagaccagccuagacaacauagugauaccccaucucuccaaaaaaaaaaaaaaaaaaaaaauuagcuaggccuggucgugcaugcuuguaguucuagcuacuugggaggcugaggugggaggaucacuugagcccaggaggucaaggccgcagugaguccugaucacaccacugcaauccagccugggugacagggugagacucugucucaaaagaaaaaaaaaagaaaauuaauuuuuuuuuuuuccucuccccaccccugcguacucuuuuuuucuuuuuucuuuuucuuuuuguagcggaaucucacccuguuacuuaggcuggagugcaauggcacaaucugggcucacugcaaccuccaccucccggguucaaaugauucuccugccuuagccucccgaguagcugggauuacaggcacccaccaccacacccagcuaauuuuuguauuuuuaguggagacgggguuuugccauguuggccaggcuggucucgaacucccgaccucgugauccgcccaccucagccucccggaguucugggauuacaggugugagccaccaagccccccugcauacuuuucugucuccacaagaugugcaaauuucccaccaagauauucagaugccuuagguauacuuucaguuucauuuuggagacauuugccagagccuucugugcugcucuguaaccugauuuggauucauggcccauugguuucugaagcauagcuaucuuccuaggucucuucagcaucuuccuagggauucccuuugcuuuuauucuguaauggacauuacagaacauugccccauucuuggaucuucuuuuuuuuuuuuuuauauuaccuucuugcuuuccugaagguaauacgucauucuuuggagacucaguccagcucccugacaaggggaggaugggaugaagaaaauuuugaaaccuuguaucugaccuguguuuuuagucugaaauuucaugaugauaggccauggugagggucuguuuucauccgcaucauuggaagaacaugugacuuccagucuagaaacucauuccuucaguucugggaaauuuucuugaauucucucccuuucccuuucccuuucccuuuccaucuuuuauuuucuuucucuugucuugucuuuucucuuuuguuuuguuuuauuuuuuucugagacggagucucacucugucgcccaggcuggaaugcaguggcacgaucucggcucacugcaaccucugcugccuggguucaagcaauucuauugccucagccuccugaguagcugggauuacaggcuucugccacugcaccuggcuaaguuuuguagcuuuaguagaggcaggguuucaucaucuuggccaagcuggucuugaacuccugaccucuugauccacccgccucagccucccaaagugcugggauuacaggugugugccacugugcccggcuuugaauucuuuuucuuucuucucuauuguguauuucuucuccuggaacucuucuugggaagauguugggccucuuggacugguacucuuguuucguguucugucuuauuuuccuucuugucuuuuaguuuaucacagaucuacuuaauuuuuaucuucccaccuuucuguugaauuuuauuuaugcuacuauaguuccaguguuucucuuguucucugaauuuucaaaauaacucucuauucuuguuucaugguauuaauaguaggguuuucugcagaguagugucucuucuccccaauuuguuuauuuugguuucuuucacguuaaagauauuucucagaugucugguuagagccuugguuaucugcuuauguuuaauguggggaaauaaagagugauuggaagccugaagaaugagaguugggcuuucaacugagcuucacuguacaaugaucuggcugggcuaguuuguuggagaaauuccaugucaguaauuuuauaucuuuucucaaggauuaggcaguuuucccagaggggcuucauugaaucgccuuccugaagugugaagaccuggcugccaggcuuuggagccaaaugggggaagacugcugaggguuuuauaaaucuacuaucauacauucacuuauucccauugucucucgugcaguacccuuuccuuuggcucuuucugguaucugccagaaucuagauacccucuuauucacagaguaaacuuccagucuuuugucaagguaggggagaggcaguugccugguuauauggaguggggaggggaugcuucuauguuuuucagcuuccagaauuuuguugcuguuaucuuuuuuguuuuuuuuugagauggagucucgcucugucacccaggcuaccgugcaguggcgugaucucggcucacugcaaccucugccuccuggguucaagcaauucuccugcuucagccucccgaguagcugggauuacaugugccugccaccacgcccagcuaauuuuuguauuuuuaguauagacaggguuucaccauguuggccaggcuggucccgaacuccugaccucaggugauccgcccacuucggccuaccaaagugcugggauuacaggcgugagccacugugcccagccuucucuucuuuuauuauauuaauccuucuggauuuguuccuuuaaacaaaacaaaaccuuucauuucuuuuaaguuggggguugggaaagagugaaaguugaugaguauuuucagucugccuuuuuucuccuaaauccugugagaucuuuaaucauuaaacaccgucuuuaaaacauagcauuguuuuuagucaacugguaguaaaaaggaaaucauugugaucauuacuuuuuguuucuauugcuggccuucaugaugucuucauacacugaaacccauucccuucaacucuugagguacauaccccucuuauuuagaguucauggcacucucaaucucuaauuacugcuuuguuguuuucuagcuugcucugucuuucuucucaagcucugcagguaagauuuaagugaagcaucagugaacuaaauuuagcgccguggaguugugaaguaaguguuacuggcagagcugaaucaucauucuuuggacauucuccuacucuucacuaacuuagcauuuuuuuuuucaaagcagguucuguuuuaaaaaaaauaagcuagauuuauuugcaugauucuuuggagaaagagccuuauuuuaggagugaauuguacgugguaaagaaaagaagggagaaauggaugaaggggaaagagauguggggugauuaguuaucucaauaucccuucgacaauaccgugauccuuguuuucucagccugaguuuucaucuugauaggaaacuaguacuuuauuuuucuguaucauaguuaaauggaauauaucuauaaauaguuuuuuccuugauagugguaggagacauuucaagagcuuacuuugcauuaaccucacuaguuuucuucuagcuuuuauuuaaguguuaagauuuuaacuuuucagucaaggcagaagagucacagguuuaagauguucauuuuagagcuguugucaaucucuaugaacccuuauugacugcuuuaguuuuaaaauguauguauuucaguaguauaauauaauuuuucccaacucucaucucaaccccuugcaucuguucucagcuaauaaaguauguagagacuucucuccccacuccacaaaucaggagacuuccuuccagugaaaguuuucuugaaaauuaaaccccaauaaauaaaacaaaaacauagcuguucugguugaaguaugugaaggggaucuggaggcccucugguccuucccccuucacuuagugcuaccagaauuaaaccccaauaaauaaaacaaaaacuuagcuguucugguugaaguauaugaaggggaucuggaggcccucugguccuuccaccuccacuuagugcuaccagggcaccucuuugaaauauuuaggacucuuuggaguaauuugaaaaccacugauccagagacuuuuagaauugcauauuuuuagagcuaaaaauaccuuuuaagucuuugaauccaaguuucccaaauaugccugauccuaaccauccuauggaaugcuuguuaaaaauuagauuucugaaauuuacuucagaccaaguugucucagaaucugugcuaacaacugccccaaguggugauuaaaauuagucaaguauaggaaacauccugcuccuuuuggcagcggaggaaacagcugcaaugaacuaaguuucuuaggcgggguugucuaguuuuaguuuuuuuaaagaaauuaugucuuacugacuuaaauacugaacugaguagucagucacgaauuaaaucuuugauuauuccagcccaguagaagcugaaaggagaaauccuuagcuaguaagaaugaacuuuaagccucaaggaaggaaugaaacaguaaacuugaaaaaggcugguacugauuuaguauuagcaugaaauauaagcagaugaggauuagcagaugaggagaaguuaaauagcuuuucaaacuuugcgugaaugaccucucugaggauggcuuccucucugaguucauucagaauuuccacgauaucauucuuuuuagaagcugaaaacuaccuucaacacugacaaaaaaaaccaacccaauaauggcaacaauggaaaaauaaaaacaaauuuaauuauaccacuguuuucugcauucuucuaaugagaaaaaauaacuuccauuacuuagcuguuugacucugcuuucaucuacauuuuucucacaugugcuuuauauauagugucuaaacauugcucuugugauuggucaucaugacuaauuuuacacugaacagugaagugagaaaaauacaucagcuccagaaggggaugcuacugaugauuuggaaguagaauagguuagagcauaauguguaugaccauuuauugaggcaaucugcaaauauuuauugauuaccuauaugagacagacccuagcuagguacugggaauauacugagaauauacuggucuauauauacuggccucuacauauagcauguaaaccaguagaaaugucauuuauacuuuuaaucuauagaauugccuuauuauagugaccgaaugcuauucugcuuuugauggugauguguuacccuaacacugauuaaagaaaacaauacugaaacaaaaauauccauauucucuuaaaaugggcuuguccaaacuauaaaauugaauaucacauuuaccuuuaggauuaagauauaaccccacuggaaaacuuuuccuugccuucuaauaccagauuuuaaaauuauuuucaaaauaacucuaauauuaugcuuuaauugguuucuuuucaccugccaguagcuauucuugugaaagaagucuaaauccuucauguagucuugguuuacaguuguucucuuuuuucugcuuaaugguaaauaucagaaaagaguuaacaguugaaaaaaaauuaguaaaugcaguaacaagaaagccaguuaguauuccugugcuauuauuuauuuugcuuauggcgcucuauaagauaucgcaguguuuuaacaugaggauguauuuguugcagguuauugacccaguggcuccacgauauguugcauuacugaagaaagaagugaucccagugaauguaccugaagcucaggaggagaugaaagaaguagccaaacacccaaaggucacucuuacaguuucaccaauguguuucucucuguuaaaagaaggagcaggaaauaaaaaggaaaaugugcuuucauggcaguggcaugauuuugagaugauuuucuuucuuucuuucuuuuuuuuuuuuuuuuugagacguagucuugcuaugucuccaggcuggagugcaguggggcgaucucggcucacugcaaccccugccucccggguucacgccauucuccugccucagccuccugaguagcuggaauuacaggugccccccacuacgccuagcuaauuuucguauuuuuaguggagaugggguuucaccauguuggccagguuggucucaaucuccugaccucgugaucugccugcgucggccucccaaagugcuggaauuacaggcgugagccacugcgccaggcugagaugauuuucuauucaacauugucaggauuugauacuaaucgaaguaaaucuuuuuuggauuuuuugccuuaaaaaaguuuauuuuaguaacaauccauaguacaucacacagaacuguuaugcucaguuggugcuuauuuuuuauuguguagaguuagcauauuaguguguaauaagaauuuaucucuuccuagaguaauccugaaagaugaguuauaauucaagcuccuaucuuuauauggaaucugaagugcauucucuauuaacuaggguauucccugucaccuuugucuuuaagccaaaacauuagaccuacuacuguugaaucacagcuugacuucagagucucuuacacugucauuuccucuguuuggaaaguauaagugaaggguccaucuaaauucugaauagaauuuuuuuuuuuuuuuuuuuugagacaguugcgcuuuguggcccagguuggagugcaguggcaugauucuggcucacugcaacuucugccucccggcuucaagugauucucaugccuuagccuccugaguagcuuggauuacagaugugcgccacuacacccagcaauguuuguauuuuuaguagagaugggguuuugccauguuggcggccaggcuggucuugaacuccuggccucaaaugaucugcuugccucauccucccaaaauacugggauuauaggcaugagccacugugcccagcccugaauagaaaucuuaaauacaaguaccauagaguacuuuuuuguuaagcuguggucaucccagauccuuaugacugcuuaguugacaauuuugaagcaaaacaagauuuuuuuuuuuucuuaauuuugaaaugggccuugcucuggugcucaggcuggagugcaguggccugaucucagcucacugcauccucuaucuuggucucaagugauccuuccaccucagcauccugaauaccugggacuacagguucaugccaccauaucuggcucauuuuuguacuuuuuuguagagacagguuuagaccauguugccaaggcugguauuuauagaggcaggguuucaccauguugcccaggcugguaaaagaguuguuuuauuucagcuuuacaaguugucuauaaauaacuuuauuauauacugaaaauuacguucacagacuaacgcauauacuaguagccaagcuuauaacuguguucguagacuaacucacauauaagaugaugugcauugcaaagagcuauacauauucuaaauuguagcuuuauaugauugucuucccauguaugucauuaucuacuuuuuaauuuuaaagauuugaauccuaauaagauuuggggugcgcguuuaguugauugguuuggcuuugucuuucuuuauaucugauuguuuugaccagguaaguaguaguaucugaccugccauaucaccuaccauacaguuaguauaaaucugaagcauauugaauauuuuaaaauuugaaucuugagaauaaaaguuuugaagggugcuuauuuuuuaaaaugacaguuguggucugauaguuuagauuaaauugcuagguugguggcuuaugccuguaauccuagcacuuugagagguggaggugggaagaucauuugaggccaggaguucaagaccagccuggucaacauagcaagacucugucucuacgaaaaauaaaaaaauuaaccaggcauuaugguucaugcuuauaaucucagagguagguggaucacuugagcucaggaguucaaggcugcagcgagcugugacuauaccacugcacuccagccugggugacugaucaaagcccuaccucaaauaaaauuuaaaaaauuaaauuacuaaguacugcucauuguuaaaaauaagaacuaauuguuaaggaagcacacucuuaaauugugacuggauuacucaguuugcucuguggaauuuucauuauaacauuuccgucgcaaaguauuuuuuauuuagccugucaguauucuauucugagcuuaguauguuaucuguuguuaaaacauacugauuuuucugaaaugcauuggugaguucauugaacaguuguuaaacacaugcugguuaauguuuauuucaaaagaucuucuuacuuuuuuuuuuuaauucugccaaauaaaaacugaaauuauggcguucuuuuuauucuccgcaucucuuuuucuuuccauaucauacacacuagaaaggcagaaaauuuacuuaucuauaucuauauagauaauacuuucuuuaaaguuugucuucuaaaaucugaaagguccauaauuuccugcuaagguggcaucuguuguccuauaaugucccauagccacugcucaagaaugacuuauuuucuccuuugcugcagaagcagugagauucuuuuaucuuuuuuuuuuuuuuuuuuuuuuuuuuuuggugacggagucucgcucuguugcccaggcuggagugccgugaugcaaucucggcucacugcagccucugccucccagguucaagugauucuccugccucagccucccaaguagcugggacuacaggugcaugccaccacgcccaguuaacuuucuguauuuuuaguagagacgggguuucaccguguuagccaggaugaucucgaucuccugaccucgugaucugcucaccucagcugggauuacaggcguaagccaccaugcccagcgaagcaguggccacccaaagugcugggauuacaggugugagccaccaugcccggcgaagcagugggauucuaaggauaggaaacagauucuaguugaagagauacuaaaugauaaaguauacugucuuagcugugaaaucaaugagucuuguaggcuggaaguaaucuuaggggcaagcuaccucaucuaauuccauuaacauuaguggucagguugcugaucugaugucacagagcuggaauucaaacuauugauuucuauugaggccgaguauguauuguuuaaaugcuaagaacagaauugggaauauguuuauguuaaaauacauagauggagaaagaguaaagcauuuucuuccuaauacagcaaugaacugcuaacaguuuaguaacacagaagacuuuuguaugguuaaagaauagaaugaauguauaaauuugcauacuggguucaauaaguuguuguuucaacagacacucugcuuuucuuuaucaaucagaauccugagguuggcuugaagccugugugguauagucccaaaguuuucauugaaggugcugaugcagagacuuuuucggagggugagaugguuacauuuauaaauuggggcaaccucaacauuacaaaaauacacaaguaagaacuuuuuguuuguuuucaaauaaacauaggagaaaaguauuuuauuuguguuuacuuauuaaacauuaccaaauucagacccauacauguugcugacuaguaaaucugcccagacauagcuacugcaaauucuggacacaaguuaaauuuuuuuccauauaucuuucaguuuacuaacaggcuaucaagaugucuuuuauuugugguguugaaaauuacuacaucuggauauaaaaaauaguuguaaugcuuuaaugagaaauuacaugauaaaaagggacucuauacaguugcaugacauggggaucuuuuagacagaauuuauauguauaacauaaucuuuuuacuaaaauuuacuuuaaaacugauugguuaauaauuaauuugacuuucuaguuacuauagugugcuacacuuaggaauaugaucuucagauucuauaaaugaaacauaguaugcuuaagacugauuuaugcaaacucugaaaucuuaauugcguaguuauuacauaugauugcaaguaacugccaaauguuuuuaaacauaguaauucaaauuuuauaaugcuugaugcaggugacuuuaaguuaauaaauauauacauguuccucaucaauuguaugugaaucuguucucuaguugauuauuaguaucucgaugucagugauuauguuguauuuauuaaccaauauaugucuggcauguuagaagcucaaauaaauguuugauuuggaauuuuuccaaagaaaauuucuuauccauuuauuacaaaauaaaacaauaaauuauuuuauaauaauauaaaauuauuauagaacaaaauaaugaauuuauggcagcugugguuaauauuucuuugaauacuuuuaaucuuauaucuagaaaugcagauggaaaaaucauaucucuugaugcaaaguugaauuuggaaaacaaagacuacaagaaaaccacuaaggucacuuggcuugcagagacuacacaugcucuuccuauuccaguaaucugugucacuuaugagcacuugaucacaaagccagugcuaggaaaagacgaggacuuuaagcaguaugucaacaagaacaguaagguaaccuuccaaagaaaccauauuucaccuuuuaaauuuuccuuuagaauuaaaaaaauuaauuuuauauauuucggauccucagauaaaauggauaagauguguagaauuuuauuuaaaucaaaugauguaaguuggccgagcaugguggcucaugccuguaauccuagcucuuugggaagccaagauggguggaucgcuugagcucaggaguucaagaccagccugggcaacauggugaaaccccgucucuacaaaaaaaaacaaaaaaaaaaacaaaaaaaaaaacgauguaaguaauguuuccauuuuauagaugauaggaagugaaacacagugaaguugaguaacuuaccugaggacaaacaguaaauaguagaguugggauucaaaucugacccucguauuuaagccuuacgccagcaugccuuucaccuaagucuauuacaugcuucuugcaucauauuucauauuuauagcagggaaauuauuucuucuggaaugcuaaucaaguuauuuaaaagguuuuuugaggccaguuuaugaauguuaacuuuuaaaaaugugauaaauugaauugucauuuaacacuucaccguuucauuguguguccucaaguagugaacuuuuuaacauaucuguuuaaaaugggaguauuuuaguuaguggaaacugcuugcauuuuagaguuauuuuacuacuaugauuuugagaaaguguacuuugguuuauaucaucuuuacagcaugaagagcuaaugcuaggggaucccugccuuaaggauuugaaaaaaggagauauuauacaacuccagagaagaggauucuucauaugugaucaaccuuaugaaccuguuagguaaguaaauguaacugaacgucuaaaugaaaaugcuuaaaguuguuauagugaguaauauuuuagaaauugaacuuucacuaaaauaacguaccuaacaguuuucuuucucagucucucaguuuuauuuuauauuuaacauuuuagacaaguaauuuauuuuaacaagugaucuuugaaacaacacgcacauugaacauuaauaaauuauucauuucugaaauuaaaccucuuauaauuaacuuuccuguagcccaaguauaaagaacaaaauuucagucuguauauuaccuaucuuugggugaaaauuauuaccauuaucuuuuucuuuguaguguauuuucacuagauaaaugguacaaacagcauacauuuagagggaagaaauaaccaguauuuguauuuuuuuuuuuaaccaugaaguaauaggauuauuagaaggagaacucuauguaaauuuuugucccuuuuuuuucuuuucuguuugucucugcuauuuuuuuaagugauaucucuguaacuguguagucaaaacgccucuccugagauuuagucuugugaaucuaacugcuuuagauaucugugaauagauucuuucaagcauuucaaacucaacguguucaaaauuccaggaucuaggugucaucuuugacuuaugcuuccccuucaucccuuuuuucacucagcaaacucugucguuuguguugcccaucugguccaucucuguggauccacugcucugccuuauuucaggcuauaacauugcuuccuugauugccaaaacaggcucucagguaucuccuugccuccaauuucauccuuuuucuguucaguuuucacaugcccaccagucugaaaauuuaagaguaacaguuuuaucacauuucucuacuguuaaaaaaucucuauuaguagggcagccacuaugacuuaugccuauaaucccagcacuuugcaaggcugaggcaagaggauuacuugaggccaggaguucaagaccagccugggcaacauagugagaccccaucucuacaaaaaauuauaaauaaagaauuaaccaggcauggugguacacaccuguaauccucacugcucaagcaggugaggcggcaggauugcuugagcccacaaguucaagguuacagugaccuauaauugcaccaccacacuccagccuuggugacagagcaagacucucucaaaaacaaacaaacauuguuguuaguuucagaguaaaggcuaaacuuuugaguuugauaugcaagauuuuucauguuacggcgucucuugagccauagguguuggaguuuucucgcccugaucccuucuuuuuaacauauguaccaaauugccuggggcuuuucaaaagcacuugaugccuuuuccuggaauggccuuguggcuuuuucgucauaugaguaaccuuauucauuuuaauaucacauuuccuuuagucacauaagcucacgcaugcauacaguguagcauagugccuaauaguugcuaagcccuccuuaaguauuuaguaaugguggugguaccaccaacuaaaauaacagaguagguucucauuuuauucuuagaaaguuuuugaacuuuucaacaaauagugcuagaagaacugaauagcuacacaugaaagagugaaguugggcacuuucucauaucauauacaaaaauuaacucaacauuuaucaaagaccuaaauguaagagcuaaaaacuauaaaacucuuagaagaaaacgugaauguaaaucuuuguaaccuuggcaaugcuguuuuggauauaacaccuaaaucacaaucaaccaaagaaaaaaaauaaauuggacuucaucaagauuaacauauauuguguuucaaagaaagugaaaagauaagucacagaaugggagaaaauauuugcacauaugucucuuaaaggacuuguauccagaagagaacccaauuaacaauggauuuaaguagacauuucuucaagcagauguacaaauguaagcacaugaaaagaugcucagcaucauuaguuguuagggaaauucagaugaaaaugacaaugaaauaucauugcauaccacuaggauggcugaaauaaaaaaagacaauaacaaggguuagaaauguggagaaauuggaacccauauguauugcugguaggguuguagaaugguucagccacuuuggaaaaacaguuggaugauuccuccaaaaauuaaacacggaguuaccauuugauccaucaauuccauuccugcguauuugccaaagaaaaauaacauguucacacaaaaauguguacaugaauguuuacagcugcauuauucauaauugccaaaaaguggcaauagauuauugcuaauuacuauacccuuugaaauugagaaauucuuauaaauuauuauuuuuuuaagagacagggucucacucucacccagacuugagugcagcggcuugaccuccccaggcucaggugauccucccaccucagucuccugaguagcuggggcuacagauaugugccaccacaccuaucuaguuuguguauuuuuuguagagacaggguuucaccauguuucccaggcuagucuugaacuccucggcucaagagauccaccugccauggccccccgaagugcugggauuacagaugugagccaccauacccacccuuaaauauuuuaaaauaaauaaauguuuuacagaaauuuuucugcuuauaagcagauuaggugugguauguagacaaauuuucuugaagucaagaguaucauuaacauucacuaacgcccuuucuaguggcaggcauagcagauauaauuuugcccuggacauaguuuguucauauggacgaaaguucauagauuggaaguuuguaauaaggacugucaauuuuuuuucuuuuuuuuuuuccauugaggcagaguuucucuccuguugcccaggcuggagugcaaugaugcagucucagcucauugcaaucuccaucuccuggguucaagcgauucuccugccccagccuccaaaguagcugggauuacaggcgcccgccaccauaccuggcuaaauuuuuguauuuuuuaaguagagacagguuucaccauguuggccaggcuagucucgaacucuugaccucagguaauccaccugccuuggccucccaaagugcugggauuagagucaugagccaccacggcugaccaauuuuuuuuuuuucuuuggagacagaaucucacucugucacgcaggcuggagugcaguggugugaucuuggcucacugcaacuucugucucccagguucaagugauucuccugccucagccucuggaguagcugggacuacaggcacccgccgccacgccuggcuaauuuuuuguauuuuaguagcgaugggguuucaccguguugcccaggcugguuuugaacuccugaacucaggcaauccacccgccuuggccucucaaagugccaguauuauaggggugagccacugcgcccggccaagacugucaauuuuuauuuaugcauuuguuguuuguaaaacuauucugaagagccucugauuugaauaguaagacaauggacuauuuuauacuucaaaaagcauuaacuggacaggugcaguggcucacaccuguuaucccagcacuuugggaggcugagguggccggaucacuugagguuaggaguucaagaccaggcucuacuaaaaauacaaaaauuagugugguggcauguggcugguaaucccagcuacuuacaggcugaggcaggagaaucacuugaacgcaggagguggaagcugcagugagcuuagaucacaucacuacauuccagccugggcgacagagugagacugucucaaaaaggaaagaaaaaaagaaagaaaagcauuaacuuagugccauugaauuuaucuaggaauucaguguuuauugcuguucagauaauuuuguucaaauaaacuauuuugucccuuuauuuucuuuuuagcccauauaguugcaaggaagccccguguguuuugauauacauuccugaugggcacacaaaggaaaugccaacaucagggucaaaggaaaagaccaaaguagaagccacaaaaaaugagguaaugacuuuuacggauauguguauaaaaauaaauggucuuucuaucccaggguuuagaauauauuucuuuacagaugauuaucuuucuuacuguggagacugaagaagacaguuaagucuugcucuuugcauuuuguuguuauccuuucauguaagauuuuaaaaucucacucucacccaaggcuggagugcuguggcgcgaucugggcucacugcaaccuccgccucccggguucaagcaauucucaugccucagccuccugagcaguugggauuacaagcgugcaccaugacgcccggcuaauuuuuguauuuuuaguagagacaggcuuuugccauguuggccuggcuggucuugaacuccugaccucaggugaaacucccaccucggccucccagagugcugggauuauaggcaugagucaccgugccuggccagaccccuuauacucuuaagaaugauuugcuuauguggguuauauuuaucagcauuuaucauacuaaaaauugagaaguuuuaaaaggauuuaauucauguaaaaauaauaaauccaguuacauguuaacauacgaaaaguuuuuauuaaaaaaaauuuuccaaaauaaaaauuuuaguuaaaagagcgguaugguuuuaaauuuuuacagaucucuuuaauaucugacuuaauagcuucuaaaaaccuguacaaacagucaugagagaaugagagcgaaaaagacaaaauacaucguaauauagugaaaauagcugugacuuugcagauccccuuuaaaaggguuuuauauaccccuuggggucuguggaccacaccuugaaaauugcuacuauauauuauucaauaacucauggaguaagcaugagaugggaaauuugguugcuuuucccucauugguuccaguucccaucugugccuaucauuuuuuacauauccuagaaagauaacugguguuaugcuauaaguuaguauguguucuugaaaaacuucauguucugcaaaaucacauaccgaaaauaacagccgauuuuucaagaaaaacagaguugaggcaaaccacuaaaaaccuauguaucccaugugguuucagucagaugguggcuggguagcagucaucaaagacucaacugggcuguauucuauuuuuauuuuauuuuauuugagacagaguauugcucuguugcccaggcuggagugcagugguaugaucuuggcucaguguaaccuccaccuccuggcuucaagcgauuuucuugccucagccucccaaguagcugggacuaaagucacgcaccaccaugcccagcuaauuuuuuuauauuuuuaguagagaugggguuucgccauguuggccagacuggucuugaacuccuuaccucaggugaucugcccaccucggccucccaaaguacugggauuauaggcaugauccacugcaccuggccugggcuggauucuaaaauuguuuccucaccuggaugccaaguugauauugguguuggcugggagcucagguggaauaguugacugcaauagcugcaaguggccucucuagcaugacaguggcaggguaauaagacuucuuaacuaucauuuaaggccuccaaaagugaguguccaguagaugaggugggaguagcauugcauuuuaggauuuagacuuguaagucucacauaacaucauuucugcuguacucuguuggucaaaucaguaacaagcuuucucagauucaggaaagggcacagagaucccccuucuuggugggaggaaagucaaaaaauuuguggacaugcuuugaaaccugcacacuuuugaauagaaauucaauauucagguacaguugacugccacuuauacccaacuuugcagucagagauccuuugcagcuuuaaaccugaaggauaauaaugcuuuucccugugauguguagaucuuugaggauauuuuucuccaauagaggcugauacuaucaaaauuaaauucucauccagggcuuaauguuaugguaaaaaauguuuuuuaagcaucauccucauuaaaggaaggcacuuauaugaaagguuuuuggguuuuucuucagauugucaauguauuucuaaaguuuucucuuuaauuaugaaaagcuuguuccugcaugcuucuuuauuugacauaaaacuggaauacacagggaaaaaaucacacacaaggcagugugauuuuuuuuuuuuuuuuuuugguguuacacucauauguuccccuguuuacuaaccaugaaugagaugauuuauguugcaaauuaaauguagcagaacaggccaggcgcaguggcuuaagcuuguaaucccagcacuuugggaggccgagguggacagaucacgaggccaggagauugagaccauccuggccaacauggugaaacccugucuguacuaaaaauguaaaaauuagcugggugugguggugcaggccuguaaucccagcuacuugggagguugaggaacaguaaucacuugaacccgggaggcggagguuucagugagcugagaucacaccacuggacuccagccuggcggcagagcaagacacugucucaaaaaaaaaaaaaauguagcugaacaaauauauauuuuugauauaggguggcuacaugaauuguauuauuuauuuaauguauaugcauuuauauaugcauauuaguguuugaguguacauauagaaucucacuaaaaauaaauaugagugauuuaaggaauuauggggaaggaauuuugagcgauggguuuuuuuuacugacaugcccacuuugagagccuaacgccuguguaaaaugcaacucugauacagcuugagaugccuguuaagugucuagguaaagaugucuugaagacauugaaaaugcugggucugggaucaggacagaauucuggaauagagaugaaaauuuuuggaauuuguacauaagacugugaauauggauaagauuauucugaaaaauuaaguggcagaucauuuaaaagaaaaaagcugaaagaaagguauaaugugagcuggguuuuaauguuagaaggguuucaguagggaagaaugcagucuaggcagcagaaagcaugaauaaaaauaguaucuuuauucacucuucaggguugauuuuagugaacauagcucuagauuuuauacacaaauagauaccuguaaauuuauaauuuuacacaaaugaaacuguuccacaacaaugaguuacaauuauaucacagaguuugauggagcucuugccuuaucaacaaucuagauguauuucaucucuaaaaaaauuaauagugauaccuaaugcuuauugauauucacuuuuucucagccuuugugacuaagggcuuuacacagauuacuuuuuauuuucccaucaacuugauggguuaaguaugguuaucccccuuuuauaguaaggaaacagcuuaaaauaacucaaaguugcacagugaguaugugguagagcagugauuuauucucaaacuugauggauauguuauaauuucuuuaguccccuaaugacaaagauuuaggguauuuucagguuuuuacuauaguaaaaaugcuucagugaguauguagguaccucuaucuuuguuuacgccugucauuuuucauuaggauaaauacuuaggagauuauucauuuaagcuuuuuaagggauugaaguuuaaaguuucuguuuuuaauuggaaacauuauaaaacaaucaguuugaaauaauuuugugggaaaacauuuaauaugaauuaauuauuuuacuuuugguuuucucucuugguagaccucugcuccuuuuaaggaaagaccaacaccuucucugaauaauaauuguacuacaucugaggauuccuugguccuuuacaauagaguggcuguucaaggagaugugguucgugaauuaaaagccaagaaagcaccaaaggaagauguagaugcagcuguaaaacagcuuuugucuuugaaagcugaauauaaggagaaaacuggccaggaauauaaaccuggaaacccuccugcugaaauaggacagaauauuucuucuaauuccucagcaaguauucuggaaaguaaaucucuguaugaugaaguugcugcacaaggggaggugguucguaagcuaaaagcugaaaaauccccuaaggucaguauguuagagaaagucaagaccacauuuucagugugugaauucaaacugcuuagaguagucucaucuucuuauaaaacaucgacugcucauauuuugauguaauaaucaacauugauugauaccugcuaugugccaagcucugaaaauauauauaagaagcucauaaucuaguggaggggugacuuacuggggaaggaaacauacagacucaguguacucuuaugugaugugacuguaauccuuugugauauguauaaguugcuauguaaaggguuuguguucuuaaguggcaacaaagguggaaaccauuuauaaaggauauuuaaaaucauccugaaguagaagcagccauuaugggggaacaaagaucacaacaaggcacucuuuaaguguggaaccaugguucucaagcuuuacugugcaccagaauuacuggcuugguaaaacauggauugcuaggcccugcccuuugacuuucuucugcaguagauucagagcacguggagaauacgcauuucuaaaauguuucucaggugaugcagaugcuacugucccagggaccaugcuuugagaacuccugguguagaggacaguaccagcagagguagaggucagcagguacaagguguauucaaggaauaacaaauggauugucaagagguuuuugaccugugauuaucuccagcuuuucauagcagagccuucaaauuauaugacauuuugacugaaguauaaauuauauucuuguuucaguauguccuuaggcaaaacauuuagccaaguagguguggcaccuagugugaaaugggcuuacuugauguagguaagagacaaagggaauggcaucuguauagacugugaaagaucguauuuaauaaugaagguauguaguucuccucaaacagcagcauaguuuaagacaugaucagauaaauaguacugcaacgaaaaacaauucagccccugaugagcugccagaaauuguagaauuuaggcuguggcacauacacagagagguaugguacaccacuaggcuugacuuguguggcgggaaggggauuuguucuaaaaugucagaucuguuguccugucaggguccuaggcucaggcuggagaauucaguaaguucuucaccuuaucaacaaguugcuggcaucugacaugaaacacugccaccuaagauacuuugauucaugaauauuugaccucauauuuugaggucuugccccaggaguuaauauuuuucugucucuccauugugaacuguugagaaauccuuuauuaggucagugcaaaaguaauugcgguucuuaccauuacuuuuaauggcaaaaaccacaguuacuuuugcagcagccuaaauagccuguugagaucccgcagaaccaugauuaucuaaaacagcuuugcuucaaggaauaaaugcugcuggauguaugaguuuaggauauaaauuccagauguuucuuaccucauggggagguugggagcauuuugcacuguaucuguuggacacuaaauauguacuccuuuuuagguguaauuuggagggaagggcuuuggucuucaaauuuauucauuguauaaguagaauauauugagauucugugccaauuuuuggucagcuuaauuauggguggaauaguaacagaagcaaccguuguacuuggagugacagucaacuaugaauccaucacccauccuuuuggguuaauggguuacaucaugcuuucauaaaauaucacuguugagguuaugaaaagucagcuuaagguaaaaagaucuaaauuucuuugguaauugggcagguacuuuuauuagguauuuuaauacuaaugugauacugaaauaaaucugacuucaguuuagucugacuuacauuuauugaaugccuacuguauaccaugucuguguuucaaaauauaguaagucuuaauauuguucauagguucuuggaaacugagacuuuaagcaaaauggugcauaacaacaauaggcuaauugagauaaacaagaaauuaaguaggccaggugcgguggcucaugccuguaaucccagcacuuugggaggccgaggugggcagaucauaaggucaggagaucgagaccauccuugcuaacacagugaaacccugucucuacuaaaaaugcaaaaaauuagcugggugugguggcgggugccuguagucccagcuacuugggaggcugaggcaggagaauggcaugaacccaggagggaaagcuuggagugagcugagauauugugccacuguacuccagccugggcaacagcaagacucuaucucaaaaaaaaaaaaaaaaaaaaaaaaaaaaaagaagaaguuaccacggcauauuucugaucucaaaaacaucgcauuacacaaacuucuuguguuuuuuuauuguuguuguugucuucauuuuuucuuuuucuuuuuuaauauuuugucuuuucuuuuuaaaauuauuauuuuugcauuacacagaccucuaauaaagacccaaacacuucuaauugaaacaaaugugagcuguauauacauuuaagaaagaugaauaaagacaagauaauuauuuacccauuuauucuaguucaggguuuuggguggccagagcccauccuuguagcucagggcucaaggcaggaaccagcccuggauaagacaucauuccauugcagggcacacucacacacacugacacucagaccgggagcauuuagacucaccaguucaccuaaugugugcagcuuugggauguggaaugaaacuggaguucccagagaaaacucacacagacauggggagaaugcacaugcuccacacagacaguggcuucggcuggggaucauguuuuuuuucucuaaaacguuaugaugaaaugacaucaaacaaaacaauguuauucaaggaccugcuguacuccguauauuuuuucuccgaaugcuaauaguaguaaauguuucuucucuucuaaagaacgaacccaguuacuaggaauggaacgcauuuagccugcaucuggcacuguguacuauacacuuuuuaguccucccaagagccauguacaaaaauauucaaagaaugcuacuuuuucuauuugcuuguuauagcaacagaggagaaacugaauaugaaaguaacuuccugaaauuugcaaagccuagauuaaaauauugaccgauucccauguuauuuaccuugagagguggugacagugggguacuccauugaaagcgcuagagaguuauaguuuuacuagcuuaucauuauuuagcaagucugugcuuguuuuacauuaauaauuugccuaagcuucuuaacuauucaguuuucuacaaaggugguuauuuuacuaugucauguuaaaugguaaggaaggugaccagcugaaguuuuagguuaccagcuucaacuagacuuuucuugcucuguuuuuuguuuuguuuuuaaucuucucuuuccugcuucaggaucagauagaugcuucuaugaaagaacuuuuaaguguaaaggcaaaguauaagcaaaaagacgggcaaguaauaaaaacuugaaguccaucaagucuaccaucuuuugcuccucuuauucuuuuucuccugcucaguagguugcugcauaaaauaauggaucaaguugguguagugugaggugcauaacagagaauacaccaaagauauaauaacacugaauacuaaguuacuuuaaaaacuaaagcacuuuaaaacaauuuuuuuuuuuuugagacagggucuugcucuguugcccaggcuggagugcaguggcuugaucaugguucacugcagccucgaccucccaagcaauccucucaucucagucuccuaaguagcuggaaguacaggcacaugccaguaugccuggcuaauuuuuguauugcucauagagacgggguuucacuguguuaacaaggcuggucuugaacuucuauacucaagcuguccgcccuccuugaccucucaaaguguugggauuacugaugugagcugcugggccuggccguacgccuguucuuuguaaaugaauuuuuuuuuugagacggagucuugcucugucacccaggcuggagugcaauggugagaucuuggcgccuccgccuccuggguucaagcaauucuccugccucagccucccaaguagcugggauuacaggcgcgugccacgacaccuggcuaauuuuguauuuuguuuuuaguagagacaggguuuuaccauguuaggcuggucucgaacuccugaccucaggugauccacccgccucggccucccaaagugcugggauuacaggcgugagccacuacacccggccuguaaaugaaguuuuauuggaauacagccacacucaugguguacauaucgucuauggcugcuuucaugcuacaguuagaguugaauaguugcaaccaagacucacauagucuaaaauauuuauuauauagcccuuuauagaaaaaguuugcugaucccuccauggaagaaagaguuuugagaaccauuguaguuaacaguuguuuaaaaaucaaguaacaacaaaauaaaaugauuauuaaauaaaaauaauucacaauuguuuugucacuaauguucucucucuaugccauacccagucuauguggaggggaguugaaucaccauuugcuucuguaguugcagcauuuuaauucacggcaccuuguauuuuauguccccaauaauucaucuugccaaucuuugcucuuuuauuuuuuacaccaauguuauuguuuuuuaaaacccaaaccacaguuuaucaggaaaggacauacaucccuguacccuuuuguccauuaagcagguuguucuaggaagccgccacccugcacucucaccccagauagcuuuaagaugucucaggccaaaagauaaauguugcagggaaggaaacaagaaaaaagccuaucuuuuucuugauguuguuuguaauucuuauuugggauguguguagugaauuccagcuauaucuauuuaguacuuaaugcaaaauugauuuugaucuaaacaaauauaaauacaucuuacaucagauuaugguucaggauacuucacaagacuuacaucagcuuggggaucuucuggaaaaucuucagaauuuguguuaauugauuuguaucagagaaaaauagcagguaaauugugauuuagguaaacgaaucagcccaguugauaagcaggagaacagguguuguguucuaauuuagguuugaugucaggaucucggcucuacccugugcuguauuggcuccuagaaucagguuucaguaaucgguuauuccuuacagguguagguauuuaagcuaugcacaacugguuaauuauuuucuuaaaaugccucucuuugcaaccugugaacuucuaguuuacuuagucuccuagcagacuuuaaaaaauauaauacaagcaucaucacucucuucccucacucaguuggaaggauuuucuguucugauuaccuuucauucaucccccucccaaccaagugagaaucucugcuuucaggagucaucauuaccaacguguguagauauaguucucuuagauaugcuaguaaggagcaaaggugagugguaauaaaauuggaaaaaacaaguuugaaaaaaguauuuuuugaaaaaaguuuuuucauuuagaaucgagauauccaggcuauuuugaaagguucuaguauuucaaauggauaauguuccagguuuuuuuuuuuuuuuuuuuuuaaggucacuccuuuccccauggagaaauguuuccaucuaguggcugcugaaaaaauagcuguuugaguacucauucugaauguaaucagaauguaauaaaaaaaaauuguccauuuucuccauuuuauuuaacuuuccaguuuuuagucauaacauuagcaucacuuuuacuuauuuccaauucccaucuuaaaccuuuaccaaagucuuuuguauagguuguuucuuuucucauuaauccacaucagcaauuauuugcugaaaaccuuuucuguuuguauugguauauguuagguaaguuuaaaacagucuuuguccacuaacaacuuaaaaucuacuagcaaugcucucucagcuucugcuguuguaugauauuguacuaaaucauaguauaccacccaauuccucuuuguaaaugccuuuugauccagaaaacuaguauauuaagagauaauuuguucuccauccauuuguucuucauuguguauucuaagagauaaauucaaaguaauagucaaacaucucuuucgaaaagcaguuuuccuagcauguuacuaggauuaaaaugcacauuuagaucuuuguuuucuguaauccuuagcaaaccguaguggucaagaucacagccucuggaauaaacucgggauucaaauacuagcucuacuacuuauuguguaacucuggggaaggaacuuaaucuuucuaaacuugacaacuucucuaaggguuguuuugagaguuaaauaagauaccacguaaagcacuuaguguagugucuggcacagacuaaauauaccauaaaaugauaaugauacuuuucauauuauaauucaaauucucucaagaaucuuuagguaccuucuaaaucaucagggaagauugcauaguggugauuaguauaauuuuacucuuuuuggaagaauaaccugaguaauuuacuuaguuaucuagaauauuccauuuccuaaugggaggggaaauauaugaauacauagcuuuauuaagaguaucucauugaauaacagagugguuugcucaccuuaauuuucuccuuuauaacguuucaaauuauaaucuuggcgaacgggguuuuuuuuuuuuuuuuccgugugaaaagugugccaucugacuuuaagcucuaaugaauaccugcuuauaguguaaaauggagcuucuuucaaauagucaucaaauagucauuuuucuagaaauaguugcagggaaguuccuucuuuuccauuuuuauuuuagcugguggaaauuucccuuuuuuccccccuugauucucauaugucugauuaacuuggccguuuuucuugagauaaaguaguuucugcugugaaaacucuuuccuaaaaacagaauaaacaagagacacaacaggaguacaaaucagacaaucuacucucaucuucucuuuguacauuuucucuuaauuuuacuaccuuugugugguaccugguaugacacucuaauaggcagaaaacguuauaaaguagcuggacaaggaaaugugcuuugcugccucauagaugcaaauuuugugaagguauaccauugguauccugcauuccucugaugcccauuugaguauucuucauggcuucugccugguuucauuuagcuaucuggagcauuauucgaauguagcaguaaaaauuggauagggugauuuggagacacuuuuccuaucuauuuugauugauaccuccaaguucccagugguacacugguuuguggugagauaguagcaccauuucagguaagguguccagcuugggcccuuugccuguguugcuaucauucucugcuagagagucacaagugucucgguggggcugaguauaucauucuuuuuuauuauuauguugaaguaucagauuaaaauauauagguaagugucuaaaaacuucaacaugcuuucucaucucauugucaguuuuuaaaauugauauaacuauucauuaguuggacccaaacuuccuuuuuuuccccaaaguuguauuuaauuucuguuuaauaagcuguggaaaguaagguuuguauaggcaaagccauugaucugaucuuuguucugauuuuguaaauucugacuucacuauuuauagaccuaggucuugacacugacaguuuacuuagauguucuauuauuugucuguuuacuuaaguaaaauagaaaguuacacuguuguauguugaauuguauuuuuguuuauucagcuuauauauaauuuauguuuuuaauuuagcuuuaucacuuauuguaggcugaugauuuaacauagguuuccccaugauuaacuuaugggaaugauuugcugauaauuaaagauuuuuaaauggcauugaaauuuccagaaauuuccaaaguuuuauaaauaucucuuucucucuuuuauuuuaggcuaaaauaaaugaagcuguagaaugcuuacugucccugaaggcucaguauaaagaaaaaacugggaaggaguacauaccuggucagcccccauuaucucaaaguucggauucaagcccaaccagaaauucugaaccugcugguuuagaaacaccagaagcgaaaguacuuuuugacaaaguagcuucucaaggggaaguaguucggaaacuuaaaacugaaaaagccccuaagguuaguguguuauuuuguuuauaugcuuuuguuuuuuauguuucaggguauugucuuugccucaaguguuuugugccccaucaaaucuggcuaacuucuacucauauuucaguucuuaauucucuuaccuugccuuuuagagaaacuuuguugauuguuucuuacgccaacuagauuugauuggauguuuucauaugacaccgcccaucacugacauaguacuuaaacagacuguauuuuaauuguuaaauuguuuguuucccuccaaccuguaagauccagaauagugaccuagacccuagcacagugcucaccccauugaaggcccuuaauauuuaccuuguuuuucauucuuucuccuaaagcucugucaaacugaaauaguagguuuuauuuugagcucuuaguaguuugugcuaguucuuuaagugugaauucuguuaucuuuuuaggaguagguuuuucuguacagauucacaugaguggaagacaguuguaguuuugaaauuuaacuuuauuagaacuugauaaccauuaucucaucuuuauaauugugaaauguucaacuuauguaauuuaauggcucuuaacuuagauuccuauggaauacauguuagauaccagugcuuucuaguagaacuuucugcagugauggaaauaugcuauaacaauauugucuaauacaguagucauuagccacauguggcuauugagcauuugaaaugugauuguggugacugaggaagugaauuuuuaauuuuauuuacuuuaaauuaaauucagccacaugacuacuauuuggauaaugcaguuauagacugugcuguuuuccagucacaguuuugcacaauucuaucccuguuuaucauaaucuuuauaauuucaauaguugguguaacaccuaccccaaaccccucuguccccaaaccccugucuuuaauuguguuugcagaucuacuuuuaaacuuuggacagauccuuuuguaguuccuaagugugaugguuggguuuucacacucauaugugagauaugccucccucaaaccuuaucaccaccugggcacauuccccgugugauauuggcggaaaaaagaaagcuuugagcauuguauuuguuuaagugugcuuagacaaugacuugaguuaaauacugucuucucuuuuuccucuuuuguuaaacuaaaggaucaaguagauauagcuguucaagaacuccuucagcuaaaggcacaguacaagucuuugauaggaguagaguauaagccugugucggccacuggagcugaggacaaagauaagaagaagaaagaaaaagaaaauaaaucugaaaagcagaauaagccucagaaacaaaaugauggccaaaggaaagacccuucuaaaaaccaaggaggugggcucucaucaaguggagcaggagaagggcaggggccuaagaaacagaccagguaaugaaucgcagaaacuucauuugaagcaaagcagugaauuaauucaauucuuaauaguuuuuaaaacaaauuuugacugguuuaaccaucacauuaaguuagagaacgcuaaagcuacaaugucagcagauagcauuuauugauuuuccauuuaguuuuaaaaauagguaacacguuuguuugguucaagaaucucagaauguaagaaguuccugugcauguuucccaucuuuccgguuuuccccaccaccguaaucagucaguagccacuguuaacaguuucuucuguaucuguugagcgauuuucauuuauuauucaaguaaauacagauacacacacacacacacacacacauacauauuuucucuccuccuuuuuaaacaugauugguagccuaauuauacacauuguuuugcaccuuaagcagauuuuuuucagaugaagaucuuuuguggggacuaagugagagcuucauucucaauuuaaaaauugauaguuuaaauauaagacaaaacugacuaaagacaaaaugguuggauagagggcucuuuaaggaucuuccaaucuguauaaauaauguacggucauacaccacauaaugaugugucagucaacaguggacuacauauaugacauugguccauaagauuauaauggagcauguauggaaaccugauauauggcacuugauauuggcaucgcagaucaagugggggaaauuauugauauucaguaauguugcugggauauuugguuuuccauauaaaaauauauguauaucaucuagguuuguguaaguacaagcuaugauguuugcacaaugaugaaaucaccuaacagcguauuucugaaaauguauucaugucauuaagugacgcauaauuguaauuuuuuaucuguuuccacaauuacagugaacuuugugauggguuucccuuaauggcuuacuuaauaagaagaaaaagcuguuacugagauacuuugguuuuacauuuguuuagcugaguaucaaauuuugcugccucuuagcucucaugucauauacacaaugucucuuuaaacaagagaaugcaacaguuauuuuuccuuuugacuauuaaacugaauaaccagaguuauagcaggguagaagagaauguagaacuucucaccuuuuacuuucuuagugccugugaaagugcuagguuucacagaguuauuuuguugagguaugucauagugaaacaauggagaaugcaaaugcaaauacauuaaaauuuuuagccaguaaaaccuuguuuuuaaacuccaaaaagagaccaucucuauccugaauaauuguugauauuucaagaaaaugauuauugucugaaauaguuuuuuuauuggagaccuaguuuauuuuacaagcaucuaucucugcaacuuuuauucuaguuaaaagaaaaacuugaggccaggcguggugguucacaccuguaaugccagcacuuugggaggcugggauggguggaucgcuugaggucaggaguuugagaccagccuggccaacaugucaaagcuccgccucuacuaaaaauacaaaaaaauuaaccaggaaugguggcacacaccuguaaucccagcuacuugggugggggaggggggcugaggcacgagaaucgcuuaaaccugggagguggagguugcagugagucuagauugcaccagugcacuccagccugggcgauggggugagacuguuucaaaaaaagaaaaagaaaaacuuacauaaauuuggcuaauaugcacacaucaguacacacacauauguguguguauuuauagccauuguuuuuauuacuuuuuagguguuacuuucagugaaacagugaucuuacuauaauuuuaacuggcauaagauucuucuuuuuuagugggagaauaggugugaacaggcugugucucuauuacaaauacauugccuuaaaaagaaccuuguaaaagagaugucugcauagaaucauagcuuuuguuacauuuggcuuuccuagauuuuguggacaauaucucucaacuuuuuaagagaugucucugcuguuuuuguuucuuucuuuuuuuuuuuuuuuucuuuugagacggaguuucacuuuuguugcccaggcuggagugcaauggcgcaaucucggcucacugcagccuuuaccucccagguucaagcgauucauucuccugccucagccucccgaguagcugggauuacaagcaugcgccaccacgccuggcucauuuuguuuuuaguagagacaggguuucuccauguuggucaggcuggucucaaacuccugaccucaggugaucugccugccuuggccuccuaaaguggugggauuacaggcgugagccacugugcccagcauuucuacuguuuuuuuagguuaaaaacauuaucuuaggggcuaggcaugguggcucaugccuguaaucccagcacucugggaggccagaacaggaggauugcaugaggccaggaguucaagacuggccugggcaacauagcgagacccugccucuaccaaaaaauaaaaauaaaaaaauaagccagauguuguaugcaccuguaguccuagcuacuggggaggcugaggugagagaaucucuugagcugaggaguccgagguugcagugagacaggaucacaccauugcgcuccagccugggugacagaguaagacccugucucaaaaacaaaacaagaaaacaacaacguuaucuugggaaugaauauagaagaguuacaaauacagaaauaacucauacugaagaaagacuaaucuauuuugaacuuuagagguuuauuuuuauucaaccuaaagcaguugcugaaugaagauauuuaucuuuuacuuuucacaucugcagguugggucuugaggcaaaaaaagaagaaaaucuugcugauugguauucucaggugaguaugcauucaguugauuuuuauguuuuaagucugucaauggcugcuuuuuauguucagauucuaaaauaugggcacaaaggcaauaguaauaauguuguauaaugccuuuaauaauacacaguguagucauuuaacaugacauuauuuuucaacauguuaacauaaagucuugaauugaaaagcaguaccaugagauagugauugauuuuuuuuuuuuaggugagauaaagggauuaauucaaagccacaaagauauagucaauagcagaggcaggauuggaauucaaguuuuuuuuuuuuuuuuuugagacgggaguaucagucuguugccuaggcuggugugcaguggugcgaucuuggcucacugcaaccuccgccuccuggguucaagcaauucuccugccucagccucccgaguaccugggacuacaggcacacgcuaccacgcccggcuaauuuuuguaguuuuaguagagacuggguuucaccauauuggucaggcuggucucgaacuccugaccucaagcaauccacccaccucggcgucccaaaguccugggauugcaggccuaagccacaaugcccgguggaauucaaguuuuauggagaguuuggaacccuguuauauguuguuuuucaguauagucaggucuguuuuacuuccauuaugaccucccacauuaaggggauguuaucaacaguagaagccuccagauuugaauuuugguuaucauacucuugccacuuauacuagaauuuugguucaauguaagcuuuaaagacuauuuuucuuuuaaaaaggucaucacaaagucagaaaugauugaauaccaugacauaaguggcuguuauauucuucgucccugggccuaugccauuugggaagccaucaaggacuuuuuugaugcugagaucaagaaacuugguguugaaaacugcuacuuccccauguuugugucucaaagugcauuagagaaagagaagacucauguugcugacuuugccccagagguaagugagcuugcuuuuuuauuuuuugcaauguucucugacaaacuggaaaauauauuuucaacuuuuaacaaccaauuuugaaaaauauaaagccauuuuuauuaaaaaguucuguuucuaccuuuauagcaaguaaugauuuuguuacauuaauuaacugacuuuuaauauuuagaaggucaguaagugcguaccuuuccucacagugaacagcagcgacuauuuuaacuugccuaaauugauauagcaaaaauuaaaacagaggaaauuugccugcauuuguacuguugcuccaaaaugcuauugaaaaaaaaguaugaaaaaugauuuuuucuuacuagguugcuuggguuacaagaucuggcaaaaccgagcuggcagaaccaauugccauucguccuacuagugaaacaggugagaauaggcauuggagugcaagagaaugcucacugaacguuagagacagccucuaaaguugagucucagcuuuugcuuugugauagcuauaaucucuguugacgauauaacauuucaugaauguugaugaagauugaaugcaaacuuaaguugucuagaguuuuauucucuaauauucauuguagagcuccuuaucauuaaauuauaggauuuuuaauuuaaauacucauuuuuaugcuguaaauuuuuaggacuuuucaaggaguuuuauucuuagaauaauuuuuauuguuggaauugauuauaauauugcaaaugcaauuuuuaugccauaauuauuuuuaaauuuuaauaauacauuuagguuugcauucauguaggguguucauagguugcuaaguacuuuuacgucaucucguguuauucuuacaacaguguugugaggaaggcagggaaaguuacugugauuuccauuuugcagguaaagaaaagucucugaaagauuaaaugauuuuucugaaauuacguaugguaaauggaaaugcuguuggaaaauuugagguuuugggcuuuacagugucuuucaaagugaucauucaucuguagaguucaggauugucuguucuuauugauauuucuagugauacuuuuguauaauacauuauuaauauugugauaccaguuuuuuucucucagacuauuuggcaaaguuuuguuuguuuugguuuacuaauuauagaucaugagcaggcuauucuaagacagguaucuucacuuugcacuucauugcaagagcuuucauacucugaguagaugcaucagauauaaauuaauucugcuucucauacauaacugcuggauucagcaaauuguuuagcuucuauaaacucagcuuuccacgucuuuaaaacugaguuaugauaccuucuuguggguugaaugugagaauugaacaggucaaugaaugcagagaacuuaacauagaacaugaccuuuauuuguguuuuuaaaaacaaaaugugaaaaccgucgaaguacauuaacuguuaugugaagaauguaaaaucugugaagaauguaaaauaugaucaaguuuagauuuguauccuugaguaauacacuucaugaaauagauaauacuauucacuuauuauaaacauuggaaauauauuuacacaaacauacauuuuauuuuucaaauuuauuuauuacauuuuaauuccuauuaauuaucuugcugguuuagcuguuacaucccuaaaggagaaauaaagccuuaaaugacugucucuauuuucccgugucuuucaguaauguauccugcauaugcaaaauggguacagucacacagagaccugcccaucaagcucaaucaguggugcaauguggugguagguauucacccccucuuguauucuauuauuauucauguucuuuuuuuuuuuuuuuuuaaagcacauuuuguuuuuauuuucaaaggauugggaguauggaacuguuuuugaaguauuuaagauaaauuguaauuuuugauuacuuauuauauaaaaugguaauaaaaauuggaaaguggcugggcguggcagcucaugcuuauaaucccagcacuuugggaggucgagccgacagaucacuugagcccaggauuuugagaccagccugggcaacauggcaaaaccacaucucuacuaaaaaugcaaaaauuagccagcugcauuggcgugcaccuguagcccagcuacuugggaggcuaagguagaaggaucauuugagccugggaggcagagguuucagugagucaugauugcaccacugcacuccagccugggggacagagcaagacccugucuccaaaaaaaaaaaauugaaaagcucuuuauaaugacuaaauuguuuucuugccucuuccagcguugggaauucaagcauccucagccuuuccuacguacucgugaauuucuuuggcaggaagggcacagugcuuuugcuaccauggaagaggcagcggaagagguauaaaaaguuauuuuccauauuaacuauguuccauuauuuuuguucagguucugcaauuuuguuauuuaaaauguauguaacaccuguuaaaagcaaaaucaaauuaauucaaauguucauggauuuaaguaacugcuuauuggaauguuauuauuaaggaaauaggcucuuuuaaauuuuuaggugaaaauacuucuggacuuuaauguguagaaaaaauuauuuuucaggaaauuugcauuuugauacuguauaucuuucuuaacauuuauuuucucuuauauucuaaacauauauacauuuuaaaaaguuauuugacuucuuuuuacauugcuucauugaauaucuuucuuaauaaguucacacuggcugcuuuaaccuuuucauaaaaagagguuuuuauuguucagauugcuuuucccacacaauuagucuuaaguagugcaguuuuauagaucuuaaugaauaaauguacccuaaauuugaacacauuuacauuuaaaauguuacaggucuugcagauacuugacuuauaugcucagguauaugaagaacuccuggcaauuccuguuguuaaaggaagaaagacggaaaaggaaaaauuugcaggaggagacuauacaacuacaauagaagcauuuauaucugcuaguggaagagcuauccagguaucaaacugccacacaggauucguaggucacuguaagcacaguccauggacagauccaauaauuucuucugucaucacagaaguagacucuuaaaaaauaaguguuucauguacuuucguauaauaauuucaaacaaaucuaucccauuccucugucuccaugguucguuaagucauaguauguauccugaauuacuacuaaaauaugaauuccuuuuuaacuguuguagguaaaauuacugcuauaaaaggggcugcccagagcaaaaugcuuguaaauaguauuuuuugacuaaucuuaaucucuuauuaugguaauuaugcuuauaauuaaaaaccuuauuuaauguaaaaaaagggagaaaaaaaguguagugccauuuuaaagcaugugaucuuauaguaaucauuuucaagggcauaauagguuauuaaaaaugaagcuuauuuuucucucucuauuuuagggaggaacaucacaucauuuagggcagaauuuuuccaaaauguuugaaaucguuuuugaagauccaaagauaccaggagagaagcaauuugccuaucaaaacuccuggggccugacaacucgaacuauugguguuaugaccaugguucauggggacaacauggguuuaguauuaccaccccguguagcauguguucagguaaggaaaauauuccuguuuaucacucauuuuauaaaauacaagccauauuuacuaaaggaaauuugaaagggugauuuucugaauaucauucaggcagauuucucugauaauaaaaacaacguggaaugcagucuggacccuaguguuuugugacuguguguauuauuuauuuauuguuucuuacucuuuuaauuuuuaagcuacuuauauaaacauuuuuagaagucauuuuuuaaaaacgguuuauaguauguuaaaugagcugggcaugcaggcucacgccuguaaucccagcacugugggacgccaaggcgggcagauugcuugagcccaggaguuugagacuaagccugggcaacauggcaaaaucuagucuacaaaaaauuagccaggugugguggcaugcacugauagucccagcuacuugggaggcugggggggaaaaaaaaauauauauauauauauauacacacacauaugaaaaauagauuaagugaaauauagugggucagaugaaaaugcauuuagcacggguaagugauuugcagguaauuaguagacauuauauauaagauuagaaaucacacagcugauucguguuaauaauauagccacugguagguuucgacuucugagagcucauuacuucuauaucuguuucuuugcauacauuugggacauugugcugauucuagguggugauuauuccuuguggcauuaccaaugcacuuucugaagaagacaaagaagcgcugauugcaaaaugcaaugauuaucgaaggcgauuacucaguguuaacauccgcguuagagcugauuuacgagauaauuauucuccagguuggaaauucaaucacugggagcucaagguaaauuccuaagcuuuaucuuuuacccccaacaucugcaauuugaguuuagauuuuccucugcauguuuuuauaaaacgagguuucucauuacuuuccucuauuuugauaguugugaguuuucuucuucuucacuuaaacuguugagcacugacacaguucauagcuuugcaauagugauaccuaaauuuaaaauaguuuuuguggaagcuuauuuuuauuauguuagaauaaaaacgaucucgagcgcuuguuuaugauuacccucacguaacuaguauacuaaaauguuuaugccaggaauucauaaaauaaauaaguuauuuacauagaccaccagaauaacaguacauggacaucacuuagcuguguuuguuauagcuaauagugaaacaucugagauuaauuuuauucuugaguuuucacaccacauuguuucauaccaguuuguugauuuuuauuuuguuuauuaaagccagucuaaauucugcuuuauuguuuguaauauaacuuucauguauugcacauugucauuaauagauuaucuguggccuuaauucugauuuauaaacuuacaacauuuuuuucuuaugcugaaagagggaaucuuacuggaucuagaaauuaggaaucgagacuauauaaauugauauuauaggugacaguaugagagaauguauugagauugcagcugcaugcuuucaaacuauggaagcucagcaauauugggauuuuuagguauuuauacaucuaggguucccaaaguugcuaauauuuaucaucuuauuuguuucacauugccccugagguaaauuuccugugcugaggaaugguaauuauauugauaauuguuucccuuuuauguaauauaccagcuucuuuauaugcuuuucuaaacaugauuuuuuuuccaugucauuuccuuuuuaauugcacuccuuuuugcuuacuuauaaauagcuauugugugaugccaguagcaguuucucuaaacuaauuucuacuuaaccugggcuauaaaauguuaaaggagaaauuuacugcuggcuacuagcgggauuaaaaagaaaaaaccauccacguucauuccugaauucuuuguacccuuuccucuuuuauucauuucucauccuuagacugacuuggcuuugucuuugucacucuucuuuuaguacucuagugagccuauacuaugcuggggagguauucuuaguaugaguugggucuucuacagcuucguugucuguauuccucaggaaagaaaauaaagcaccuaaguucuaaacuugacgccucaaguuaaagaacauugagaaagagaguucacuaucuagugaagguauuaguuauacuuuuuaaugccauuuuaauuccauuuagucaaagaauuucuaagaaaaaauauuuuaggagaucuggauuuauauuuauuugacagcgauugaccaaagugugugagcgauguguacgcgcauuuugaaacuuauucagauuaauaaaugagcuauaauauuguuugauugugaggccagaacccagcaacuccuguaauucuucuuugguaccccuuccuauauuaugaaaguauaaaggggaaaauaaucugagugaauuaacuacuuuucuuuuuacuauguggaaagaguaagauaauucuguguugcuauagaaacaaaacacgaaucuuuuaaaguuaaauuuguaacuaguuuuagaaaaaaacugucaacaaaauauuugccuccuccaugauuuggcuucagauuaccuuuccaacuuucacuuuucauuauccccuuucauaugccguuuucucucuucuucacagacagccuguuuuuccaccucugugucuuuacuugugcuauuucuucuaccuggguuguaaaauuuuuuuaucaugcaacagucaccaacuuauaacaaagcaaguccaauacaaauaauuaaauuuuccugcuugaaucauuugaaaauaagaugcuaaccugaugcuccaucacccugcaaacauacucuccuacauaaucacagcacaagcaacauaguacaaccaacauauucuccuacauaauacaauacaaguuaguauaguaguguucauacauuacaauagucuaauucuagacccccauucagcuuucaggagcugucugacuaguguuucuuuauagcagaaugaccuaguucagaauuauguguugcauguaguuauuauguaucuuuagucucuuucagucugcaguaauuucucagguuuucuuugauuaucgugaucuugacacagcacauuuuuuauuagccuuucuauuagcuaauucauauuuuauggauccaugguuuccaguauuaagcacuggguuauagaaucuguuacugacguuauuuguuuugaugcucaaagugucuucggcuugaccauuaggaucccuuaaagcuggcuuuuguguccuuuuggcauucuccaucauucuuuaagcacuuccuugcugcuuggcacaagauguuguaggcuuaucuuguacuuuuucuacccuggcccaggaauuagccauaucucuaagaagcucugguucuuuugaguggagaaugguauuuagugcuggguaugcucauugcuuuugagcuaucacuucucccgggccuucucaguagauggagcuacugaauauguauauauauguagauauccauacacacauacagauauguguacacuuuuaccaccauauuuccauaucuauuuauguauguugaaaaccaagaguuuauaucuauacuuuaaauuccaauaaaaaaccauaggguggaccuggcgugguggcucaugccuauaaucccagcaccuugggaggcugaggcagguggaucgucugaggucaggauuucgccaccagccuguccaacauggugaaacccugucucugcuaaaaauagaaaaauuagaugggcuuuguggugggugccuguagucccagcuacucaggaggcugaggcaggagaaucgcuugaaccugggaggcggagguugcagugagcccagauugcaccauugcacuccugccugggugacaagagcgaaacuccaucucaagaaaaacaacaacaacaaaaaccaccgcaggaugcauucuaguuuuucuccauuuugugcuuguaauucccuuuucugacaaugaaaagccuagcucaaauuauccuuaguacaugaauuuauuagauuagucacccuguaugccaccaaucucucguugccauugccacccccuccucugcgugaaugggcuccuuaucccucgugggcucugucacucuaugcaaagcuguucucaugugcagaugcccucuugccuaacugaggcucagacacccugcugugggcuaccaguggcccucuccuuuuucaguguaggauccaguccuauugcauuuugccaucaugccuuuuaguuuucuuuaaucagaaguaguuccucagacuuucauuaucauuuaugacauaggcauuuuuguaacuauaggucaguuuuuuauagaauguuuuuuaauucggacgaauaauuuacuuauuaauuuuuaccuucuccaguaacuuuucuucucucuuccagcugaggaauauucucucacugcuaacuuucuguauuaauuuuuguuguuuauaugugugccuuauuuacccuacaaagcaugaagcuucuagaggacaagauguauuucuuauucaucuuguaaaucucauugcacuuagcacuguaucuuacaaaugcauguaauacauccaguauaauacauuggauaaauaacuaaagcaauaaaauaauguaauauuuagcauacaacaguugguuccauugugguuuuuuuuuaaauaucauuuuguaaaauaagucuucccuagggguaaauaaggacuucuagaguaauauuuaaaauuuuuccuauggcauuuuuggggugaccaccugucaucuaaauuguauauggaagcauguaacucaggaaaaucccaaguuaauuuuagaggauuauucauucaaaaaaauuacuuaaaaucuacuauguaucagauaagguucugggcccuaaaaaugugguuuuucccuaagccuuaaggauuuuaauccccuuacgggauacacauucacaagauugaacauucccaagucguaaacuugcauauagucuguccuuaaguugcuuuggaaaaaccaaagaguauaggggagugguucuuaaacugugguccuaggaccagcagugucagcaucacuuggaaacuuguuagaaauacaaacucuuggccaaguacgguggcucacgucuauaaucccagcaauuugagaggcugaggccggcagaucaguugaggccagguguucgacaccagccuggucaauguggugaaaccccaugucuacuaaaaauacaaaaauuagccaggcauggugguaggugccuguaaucccagcuacucgggaggcugaggcaugagaaucaauugaucuugggaggcggagguuguagugagccaagaucaugccacugcacuccagucuggucaacagugagacucugucuucaaacaaacaaaaaaaaacaaauucucaggucgcauccccaaccuacucuaauaaaagacucuggaggcaggaccccaaaaucugugcuuuaacaauccuuauaaucauaaugcaugcuaaagauaagaguacccagaaugaggacuuuucaaccagagaauaccacuguaucaggaaugagucaaaaaugugucauguuacugauccccucaguggcuuguagccucaaaaagucuucguuuaaccccauuccuaugcaaauacguuuucuggaugcuauuuugugagaaaaguugggaaugcuggucuagaaacuacucuguuucuccaugaagaacuucuggggcaguagauuuuuuuuuuagguuuaugccuucuuacuggaauagguuucuacaguaucucagcaguauuaccuguuuuuuuuuuuucucuuguuuuuuuuggcuuugccuuuguuuuuuggguuuuuuauaauuuaugguagcuaaagccaugaauuacaucuguauauucaacuggagacauucauauaucauuuuaacugccuuuuuuaucuuauagggaguucccauuagacuugaaguugggccacgugauaugaagagcugucaguuuguagccgucagacgagauacuggagaaaagcugacaguugcugaaaaugaggcagagacuaaacuucaagcuauuuuggaagacauccaggucacccuuuucacaagguaguuucuuaaaauugcuuaugucucucucuccagaucuuccaccaccuuugagaucuuuaccaaggaauuuuugggguugccccaauuggaagcaauuguucccucccucugaacccccaugcuacuuaauuugccacucucuggguuuuuuacuuguauuaugguuauuuuucuaagugccaccugcuuccuacuagguuugcaacaaugaaguuucuguccccuggacuaauuuggguuaauuuaaaucuaggcuuuuaugagauauaaaugugagggcuucaggcauugacugucaucugcuggguacacauuggcagcaccugggaagcuuuaguaaauaccagugccuuccuagagauacuaauuuaauuggacuggagagggccuggaaacuauacuguuaaaagcucccccaggggauuauaauauagccaaggcugagaaccuccugacugggguugggaaugagggauagaggaaggccuuagggccgcccucaccuauggagagagucauuuagaaucauagaucucaagguagucaaggcagaggcaccagaagauuaguggcuuagcguggcacccuguuuucuuucucugccuaccuggagcagaaagcagagaggaaagcccacuaccacugaggauggaggugcaguuugggagaggguaaugccugcaucuuauauaagggcacuuauauauugauaaaagauauauauauauuccucugaaucuggaaauauuuaagaccagggagguuuaaaaaauaacauagacucccauagguaauguguuaaugccaggaaaagaaugauggucauuagagauuuaacagcaguaacaaaaguuaugaucaccuguugugugcuuaacacauuucccaugcauuuaaggcucacaauagugcaaugauaagguaacucugauauacugauggucacuaugagugauagacuugagauucaaauugaguccuucucacucccagguugucuuuucauuaaauugugcuuauguguuucauaaaacuuugucauauuugugagaacaauuauguauuguuuucuaauuuuguuugguagggcuucugaagaccuuaagacucauaugguuguggcuaauacaauggaagacuuucagaagauacuagauucuggaaaggucagagaguuuggaaaacuuuucaguauaagaauauuuaaguaaauuguauuuuaaggcucauugaauuuaugcaugguauuaauaccuuuuuaagccaaucacauaaaaagauaguacauuacucaacauuuauauguacguauaaauauauaaucuaauuauauagucuuuguuuuacauuuauaugucauauaaauauauaaucuaaauauauagucuuuguuuuauauuuauauaugucauauauaaauauaguguguguguauauguauauauauauagucuuuguuuucuacuggcuuuucuaaagcauuacaacauuauaccauuuuggggguaauacuugugaacugauuauguaaguuuuuuuuuccccauguuugauaugcuacuuucuaaagaacauuaauucuguaugucuccuuuuuucuuuauugaaaaucuguguuauuucaguuucugguaaguuccuaaaguaaccauuguucuagcuuuagagcugucauaugcggcugccuaaaacaaggugaaaagucaguuucuuuccauucccugacuguacauacucagcucucaauugauugaacuuucugaauaaugagaagaaaaguguugcuuauucuaagccuguuuuucauaaugaggggcuaccuggcuccuuagaacuccauaggcuuuccuaauuagguaguuaauggcucuuuaagauuuaauugauuuuauauauuggguauaugcaguuguuucgagcugaaacuuuaaaguuucauaaagaagaauuucagauuugcaaaguuauuuaauuauuggaaugaaucacuuauggacuuuaguauucugguauacauguuugaauauacaaccaauccuguguccucagguuacaagugagaaaaccaugggccagugucuuaaaugaauaccccaaacuauacagaauuuagaucacucuucugacuagguuuaaugcauuuuccucuguaucuuuuuuuguguuuuaaauucaugcugagaaugagcaugaauuuauguaaagcuuuaauuuuuauggucauaacguauuaauaugucucuuauuucuugagcugggaaaauuaaucucucuggcuuucauuuuacuauucuguaaaaugaguacaaaauagauaauaucaaaauccucuuuagaucuauaauucuucaguguuuagccuucuauccuuauuggguuauugcuuuuguaauuuuucaccuuucugguuucuguaguuuuucacuugacucaaacuuccugcuuuuuuuuuuuuuugguacagggucuugcuuuguugcccaggcuggaguacagugccgugaucucggcucacugcaaccucugccucccgaguucaagcgauucuccugccucagccuuccacguggcugggauuacaggcgccugccaugacacgcagcuaauuuuuguauuuuuaguagagaugggguuuugccauuuuggccaggcuggucuuaaacucugaccucaggugacccaccugccguggccucccaaagugcugggauuacaggcgugagccacugcaccuggccuuaaacuuccuacuuuuaauagaaggcuagacaguggguagccaucuguagcacuguguuuuuucuuucacuuuauuuacgauuuucuguggcugagagcaguugaugagaagcugcugaagaagcuggaagcauguugcuguuacugccaaugucucuugggucuccaccuucauagaucucuagauuuucagcugcuuuacacuguauuucuaauauguggagauuauucacaacuuugcuauuccccucauuaacucuccaggaauauuuuauagggcuacuacauaauuguuauugaagacaaaccucauuuugaaguagacaugcuuuaaaaauuagcauucacaacugggagaaauuuuaauacuuguuggcugggcccgguggcucacaccuguaaucccagcacuuugggaggccgagguggguggacugcuugaggccaggaguuugagaccagccuggccaacauggcgaaaccccgucucuacuaaaauuacacaaauuagcugggcaugguggcacacgccuguaauuccagcuacacuaggaggcuggggcacgagaauugcuugaacccaagaggcagagguugcaaugagccaagauagugccacuguacuccauccugggugacagaguaagacugugucucaaaaaaaaaauuuuuuuuuaaugcuugucuagucugacauccacaauuuauuaaaagaaaacccagagcuagagauuuucaaacacauggcaaauuucaaaauuaaaauaaaauccuaaguaucuugauucggccuuuguuuuauguagucuaagaaugaaaaauugaaagguuuuuuuuuuuuuccuuacacaaaaugauuuuaggacuuuaaaaaugauccacuuaccuauauaacauguuaggaacauuguggcauaaagugaaauuugcgugauuguuaauuguugcuguuaacaacacauuaaaaaucaguuugcuauuuuugauguuccuuuucuccuccugauaacuauuuagauagguagagcagguguaguccagguuugaaaugagggagauauaacuggaguucaacuucuuuucagccacuguguuuuagccaguuuaugggagauuugaggguacugcaaagaugucuuuguugugucuugaugugcugugagcguagguuuuggauaguggaaaaacauucuuuccuaucuuuuauaacugagcaaaguuccuaguagguuugcaaagguaucauagccugaaaaaagguugggagaccuauccuuuuugcuugccaguuuaauauagaacucaaauguuccuucugcagaauagaauugaaggaguuauaaauacugauuacuuuuccuuuucuuaauuagauuguucagauuccauucuguggggaaauugacugugaggacuggaucaaaaagaccacugccagguaaaccuaauuaacuggcaaaacuuuugaaaaauugcaauggaaaggaauagcaauuugcagcauaaaugaguggaauucuuauuuguuauuaauuucagggaucaagaucuugaaccuggugcuccauccaugggagcuaaaagccuuugcauccccuucaaaccacucugugaacugcagccuggagccaaaugugucuguggcaagaacccugccaaguacuacaccuuauuuggucgcagcuacugagggaugaacgaaagcccccucuucaacuccucucacuuuuuaaagcauugauauuaguaucuucucagauacagaccguuuuaugauuuuuuaaaaaguaaaaguucuaaaaugaagucacacaggacaauuauucuuaugccuaaguuaacaguggauaaaagacuuuucuguaaacaacuccaguaauaaauaucaugaacuaa

SEQ ID NO: 191175 - RNA, 222221 nt, Homo sapiens
uaauguuucaccauguuuauuugauaucaugauuucuuaguccuuacacaaagggaaauaagcacucccuucccuuuuuuguugcauguguguuagcaggagucggaagaacagaauaugagggaacaagcagagggugcagaaaauagaaagauggggaaagaaagaugcuguugaagacacagagugaguguuuauaugaacccuucucuaaauaagcaguaucaacaaagaguacaaagcugacaacauggagugucuucuuacagaaauaaucugggaccacauucaacauacauuauacagcaucaggguacagguuuuccgucagaaauuauguguauauucuuuuuucucgcuuuuaaguuucauugaugacauuguucauauacuuuuaguguauuauuaagcaaauauuaauuuaaucauauaaaccaauccuggucagcaaaaagcacuguuagcugccauguaaagguccuucugucaaguaaaacuucauucuacacuucuagcuuccuaucagaggaacuucuugaaggaacucuuucaguuggcuuuacaacucaucugcaacaccaaauguggauuaaauucagaucacaccuugguuguguauauauguauauaacagccccuggcacaauuagcuaauaucuuguaauuguaaacgaauuguucucuuuuagccauuucccccccauuuccuauaacggucuuuauccaaaugcuuuggugcuccauaaguaacugugagucagaggugccucagugcuggagaugccugucacagagaagaucagaaugugugaagauaacccugcauuacguucaucucaucaguucugcccaauccacagggguaaaaaauggaugagauuugauaucuucaacaccagcaacuccagcaccaagucguuccagaggauugaacugcaagagcuaaaaaaagacggacuuagugaguaacaggaauccaacuggcaaaucaaaggaaaaccaauauuugaaaagaaacaacuucuaaauucaacccugguaacaagcagucuugauuaauagccaagugaccauuuuucuugaaagggagcuaugucuaauaccauucuagcuguggggugugagagacaccugaacugaguuuauggcuuuucaacugaugggaaacauggccuugaguaacuuacuuuguuucccucauccucauguaauauaauaggauaguuauaccuaucaauuuccuaccccaaaaguacaccaugacauuaauuagauauugcacuagauucugagauagccaguuacuuccuucaugauuagaaaauuugggaagcacaguaaaucuuucgaccccuaaucaacuauguauguauugagacuaaacuuuaccuaaagugugaauaagcugauuaguauuccaaaaucacuagucuuuggcauaguugacacaaaugaaauaauuuaauauaaugaaugaaacaaguuuugguuucuucagaaauaggaaucauguguaaaauaaguaaaaaaaaauuuugugguuuaauaaugucaaauuuuuguguuaacaacuuuacugaaggauaauuuauauaaauucaucccuuauaaguguacaauuugaugacuuuuaguaaauuuaaagaguugugcaacuagcaucacaauccaguuuuagaacauuuuuuuuuuuuuuuuuuuugagacggaguuucgcucugucgcccaggcuggagugcaguggcgcgaucucgacucacugcaagcuccgccucccggguucacgucauucuccugccucagccucccguguagcugggacuacaggcgcgcgccaccaugcccggcuaauuuuuguauuuuuaguagagacaggguuucaccguguuagccaggauggucucgaucuccugaccucgugauccgcccgucucggccucccaaagugcugggauuacaggcgugagccaccgcacccggccuuuuagaacauuuugauuacccuaaaaaguuuccucaugccaucuacaguuaauccccacccccauccccagcccucggcaaccacugaccugccuuuugucucuauaaaguugcccuuucugaacauuucauauaaguaaaauaauaaaauauguagucuuuugacgcugccuucuuucacuuaucauuauguuucugagauucauccacacuguagcagguaucaacaggccauuccuuuuucuuaguauuccacuguuuggauguccacauuucauuaauccacucacuaguuuuuagauacuuagacuuuccaguuuggggcuauaaugaauaauguugcuauuaacguucauguacaugucuuuguguagacauauauuuucauuuuucuugauuacauugcuagaagcagaauugcugggucacauaaugagcuuauguuuaacuuuuuauaaaauugccaaacuuuucuaaaguaguuguaccauuuuacauucccacaaaccuuuauguaugaggauuucgguuucucuacauccucagcucuugguacugucauuuugauaauagcccuucuccugauguuaguaguaucuuguuaugguuuuaauuuacauccccuaacaacuaauaauguugagcaucuuuucaugugcucguuagccauucaaauagcuuucuuggugaaauaucuaacuuuccgcccauuuuaaaacugaauugucugucuuacuuaauuacaagaguucuuuauauauucugaauauaagucccuuaucagauacaugauuugcaaauauuuucucccagucugugacuugucuucauuuuccuucuuuaaaauuuuuauauuuuuauuauuuauucauagaggcggggucucacuauguugucaaggcuagucucaaacuucugggcucaagagguccuccuaccauggccucccaaagugcugggauuacagguauaagccaccacacccacucuauugucuucauuuucuuaauggugacuuuugaaugcacaaguuuuuaauuuuaaggaaaucuacuuuaucaauuuuuccuuuuauggaccaugcuuuugguaucacaucuaauacuucuuugccuaacucaacaucaaagauuuucuccuuuguuuucuucuacaauuuuuauggcuuuaacucuuauauacaaauauaugagcuauucugaguuaaccuuugcaaacaguaugaagggucuaaguucauuuuguuuuuagcaugugcauauucaauuucccagugccauuuguuagaaaaacacuguggucuuaaaacuaucgugguuuuauaguugguguggaaaucagauaguguaaguccuccaacuuuguucucuugcaaaauuguuuuggacauuauagcuccuuugccuuuuuaugcacaguuuggaaccagcuaaagguuucccaauuuugcugaucuuugcaaagaacuaccuugugguuuuacuuuucuuauucuucuguuuucuaucuuacugauuucugcuuccuuucuucugcuugcuuuggauuuacuuugcuuuuuacaguuucuuuucauaguuucuuucuuuuuuaaauuuagagacagggucucacuguguuucccaggcuggucuugaacuccuguacucaagugauccucacaccucagccucccaagcagcugggacuacaggagcacacaaccacaucuagcuuuguuucauaguuucuuacggugcaagcuaagauucugauuaaaaaccuucccuuuuuuucugauauaggcauuuaaacuuagaaguauacuguuuuaauuuucaaauauuuguggauuuagcagaucuccuccucuuguugauuucuacuuugauuguuaugguuauuauaaucaguguacaauguaauucagaauacaguguaugaauucaauuccuuuaaaugcuaaaacuuguuuuauggccuagcaugugaucuaucuuggagauuguuuuguguguacuugauaagaauguguguuccgcagucacugggugaaguguucuauacaugucaguuacaguuuguucaagucuucaauguccuugcuaauuuucuauaaaucauggagaaugggguauugagccuccacuuacuauuacuaaauugucuauuuuuccuuucaauucaguucaguuuuguuuccuauauuuugaggucauuauuagugcauauacauuuguaacuguuacagcuaccccuguacuaucacuaugaaacaugugucagauccuaguaaaucuaucuuaauauccauuuugucugauauuuaauauugccacuccagcucuuucgugguuacuguuaguaugguuuauccuuuuccauccuuugucuuucaaucuguuuguguuuuugaauuuaaggugugucucucacgcacagaagauccagcuuaacagaaucugccuuugguuuggcauguuuagauauucacuuuauugacacgguggguuuauauuugcuauuuugcuacuuguuuucuagauuuacugucuuauuuguucuuccuuuacugccuucuuuuguguuaaaugcuuuuugcuguaccauuuuaguuucucuacuaauuuucauuuaguauuuaguuuuuagguuuuuuuuuaagugguugcuguaucccuacaauaugcaucuuaucacuuaauauaucacuuaucuuauaagaucauuuaucuacuucaaaauaauaguaacuuuaauuuagcaaaagguagaaacuuugcucuaccauagcccccuuccuuugucuauuauugucauauuuagauauugcuucuauauauguuaaucccaauagcaugguuuuauaauuguugcuacaugcaauuuuaugucuuuuaaauaaaaaauauauauuuauauauacaauauauaaauauauaaauaaauuauauauaaauaaaauauauauuuuuuugucuuuucuaugaacucauaucuacaauuuucaguguuccucauuuccuccuuggacuuaaguuacuaccuggugugucauuucucuccagccugaaggaauuccugugguauuucuuguaaggcaguucugcuagcaauaaauccucccagucuuucuauauuugggaaugucuuuaugcaccuucauuuuugaaggauaauuuugcugaauucuugguuuacugcugcuucuugauuucagcacuuugacugugucauuccaauaucuucugaucuccauguuuuugauaauuaguuagacauuacugcuuccuucuauguaaguuauuuuccuuuuacuguuuccaaaauuuucuuguuuuuaccuuucaacaauuugguuaaguguggauaugucuaaauauguugcaguguagaccucuuuguauuuuccuacauagggucuguugaguuucuuggaugcauaaguuaauguuuuuaaucaaauuuggaacguuuuuagccauuauuucuuuuugcugucccuuucccuuucuccucuccuucugggacuaucauuauauguauacugguacauuugcuauugucuuacagauuuccauaguccuguucauuuuuuucaauuuuuguguccauuuuucugauucaauaauuucuauuaauuuaaguucauuuauucuuucuuccucuaucucaaauuugcuguuagccacuucagucauuuuuuuucuagugaauuuuucaugucagucauuguauuauucaacuugugacuucuacuuaguucuguuuuuuaaaaauauacuuucugucuccuuauuacagaaucucuuuguugauucauuuuugucauacuuuccuuuaauaauuuaaacacaguuucauuuaguucuuuggaaauauuuacaauagcugcuuuaaagucuucauaaauccugugucuggguacacucagagacaauuucuacugauuuuuuuucugaauaugggacauacuuuuuuuguuuuuguguaugucuuacacuacacuucacugaaaacaggacauuuuagauaguauauuuuagcaacucuagagucugauuuuuuccccaugaaguuuaucauugcuguuggauuguuuguucuuuguuugguaacuuguuucaguuagaucuguaaagcugcuaaguccccuucccacugcauuguaaugugcagcugcugacaacuuuccacauuuuuuuuucuuuuuaaaguuggcuuucucggggucaccccugugucuguauagccuaugggucaaccagugacugaacagagguuguauucaaauaucucagcccuucaagcuucuguucucugccaacgcauagcagaacacauucaaaguuuaggccacaaaaccacaucugcccuggcuuuuacuuucugcugggcccacucccuguuccugugcacauuuauacagccucaggaucaguccucaugguuuacccuacccuggcagaaccuuugcaccugaccaagcaggaaggggagauugaaagcaggccugagucaagagucccacuguucuugcccagaguucggcuguuuuuuguuuguuuguuuguuuguuuguuuguuuguuuguuuguuugagacggagccucaauauuguugcccaggcuggagugcaguggcgcgaucucggcucacugcaaccucugccucccagguucaagcaauucuccugucucagccucccaaguaccugggacuacaggcacccaccaccacgaccgacuaauuuuuguauuuuuaguagagacaggguuucaucauauuaggcuggucucgaacuccugaccucaggugauccacccgccucggccucccaaagugcuggaauuacaggcaugagccaccaugccuggccaguucagcuguuuuuuaagcauaaacaccuuucagauuguuguauccuuugauccauuuccagagcacugaaaugacugguuuuuuaccaaaucugucuaacuucauacuuuuugggggaaagaaacucugccaacuaacucaugaagccacagccacucaaauuuaagaauacucacaguacauauuuuuuuuccacagaaaguagucaagugcaacugaaauauuaaauuauuuauuuacaacauuuguaguccaauauauaggaaauuccacucuuggauguuaaccaaaacuucuauuucuucucuuuuucauuauuucuaauuuuucuuucauucauaauucaauuauuuguauaaguaucaauuguuugccuauuauaugccaguccacuacuuuuuuggaauuuuguugaccugugucaauagcaauagccucauucuucauuaguagcccuauaauuccaauauaugcuucaucaaauugcaaauuacugugucaugaauguucgucacuguccuaucaauaauaauaacaaagauauacacgacacuuaucacaugccagguacuuauucuaagugcuuaugauagguuaacucauuuaacucacaacucuaugaauagcuacuauuaucuccauuuuauaguugagaaaacagaagcucagggaaauuaaguaacuuguuuaagauaacacagguaguaaguggcaaagauuugaauucaagcauucugauuccagaauccaugucuuaacaacaacauuacacugccucacaaaagugagaucugcaaaugcuaagaaucuauuacuucacuuggguauuaccaaauccauaaggggagugaaacauacacuucaaaagacuauacuaacagucuuuuaccugaaauuauuucuagcacucaaauugaaccauacuacacuguugauuaaaccuaauugcucaaagaauuuuuauauuaguaguugcuacgauuuguuaagagaaaagcuauuguuauaaaacaaacaucacaggaauaucccacauauaucaaauccacuuucacaaucagacaauuuaugucuacugacuaaaauguggaaggcaccaaacauuuuaauauaaaucuaacauuucaaauauuuuuaagaauuaacugcaaugacaauuauauuuaguauuucaggaaacacauaaacauguaaguucuuucuucuucauuauaaauaacuggcuucuuucuaaaauauacuuuaaaugugaaauucuaaagguucauauuuugacuuuuacuaaagucaauuuaauuaguucaugaacuccucuauauaucugcaaguauaaaucuauaggcaaaaguauaauuguuuuaacuaugacuaucuugcuuauucugccauuuuaaaggcuauagcacaccucaagagaggucacacaaagauucuacugcuuaagaaaaugucagccaguggcacauucaaguuaaugaauccaagacagcagcugccaaccuccuuucuccugaagaauaggcaacagagcugagcaaugagggcaugaaaauuuguuuuggucuuuuccucacauaauuucuuaaaacugaccaagcaacugugucauaauuaacuaauguacaugcuaaagcacaaacauacaugcucugagggacuuuuuuaagauugcauuuaaaauguaauuauguuuacuuuggcaccauuugcuugacuuggacagauaacugaaccagggguacaggggauuaugagaucuaagaacaaagcaaggagcuaaaagaccaaagaggagaaaauuucccccacguagaauuauuuccauauaaaucauuuugugauuuuuuuuuaaagugaccucuaugaccugugagguaguggaaaaggaaagucaaaaugacaaauugcuaaucaugccaagagaccccuuuucccuuuccugaugauguuuccucaacaugagugguaguuuccuuaggcaggccaaugacacaaugcugauuuacuauauaagcuauacauaucugaguuuggggacuuaccauaucuuaagccuagauuccuuuacaaccuaacuucuaauaaagacaaaagcagaacuugguaacuuauuaugaggaauuccauuuuuaauauuauauaauaaugacuacuucuuuaaggaagagaaacaaaaaauagcaguugccagucuuuccuaaacuacuuacuaaaaaauacuuggaauuuaucucgugccacaacgaauaagaugaaaucaaaugaauagcuguucuuuuuuucuccauuagaaugaaauguuuuauguaucucuucauuaccucuuaaucuaaagugcucuagguauucucaucucaacauuuccaaccugauuguuucuuuauaguuugcauacucugggcaaauuaaucuuccugaaguacaacucuaaacuguuuacucuucuccacaaacuccaaaucucaaauuuuaaugaauuaaauauuaucacauuacucuuguguuugugaugauagaaccccauaagaaaaccccaacuuauuuuuuuaugcucaccuaucacccauaccuuuauuuaucucucuauuccagauaaaucaaacuuuguuuccuaaacuugggucuuucagacuccuuccuugccuuuguucaaaccauucauuccaccaagacuauucuccccacauccuugccaugcugaaauccuaaggcccagcaaaaguagcauccauuccacaaaaacuuccccuaauacuaccacuccacggauuauauccgcccccuucuuuugacuugccacaguauuuuuuaaaacucuuugacagccuuuaucaauuuccaugugguaugguuauuuaccugucuuaccuuuguagcuuauagcacugugccuuguauauaauauuuguugaaugaaagcaaaaucacucuucaagagaauacuagucaauuaucuuccuaauauaugcuccccugcccucuuuuaauuuuuguuuucccugacuuuuuuuuuuaaauccauguuucauuacauaauuuuaguucuugauauuuuucaaggaacuuuuuccauuauauuuuucauaaaagcauaaggaucccaggccuucuuguuccugcugauagcccagcaaugggccugucacaccagaguacuaacaacccucaauaucagcaaaauucacuacacgaaacuagaagaguaauuuaaguaugaggaaucaaucuaagaaguucacuggaguuccaagccugucucugggauacugaacuuuaauuaucaauggucucuuucuucaaagccaccagaaauauaaucacugacaccaaugcccaaguuccaccaaugaugaaguaucuaacuugacaagauuuucuaauaugucucuccuaagcaaccugaguagcuuuauaaauaccugaguaaacuuauaaguaagaauuaaaaauugaaaauagccauucauauacgguuacaaaauguaacugcaaaauuagagcagccucagacaagcuaaaagcaauacucaaaucacagaguuacacaaauauacagaaaugacugugagcccuaaauuuuugggaaaaaaauuaauaccaagaaguuuuaacuauacucucugaccccaucaauacuuugaugauagcaaagccugaaaauauacaguauuaauucugaacgugucuuuguuuuacguuaaauggguuuuucuugcuccaaacuaaucucuuuuuaagguuuuggaguugugggcucugcuaaucugcaugguugauaaaccuggccaauaggucaguuaaauuaccuguugaaugagugagcgagccucuucagagacacauucuggcauguucaaaguagugugaguauuuauuccugcuggauggcauucaaccagagucugaaacaaucaaucagguacacuucuuaucccaaauaacaucauauuuuguucuaucauaggauuuauggacagcaaguacagagagcucaacaaccauuuuaacuggaaguguaguaaucaacacagugccgccuaagcaguuuaggaugagggcugugagccuauagaacuuuuaacugaaaugaagacaaucaccaugaucacaucauaagcuuaugcuacugucccgucguccuuaguuauaaaauuaauggcucagaauauuauagaaaagcuuaaauuauacgcaaaacuaaaaagagauuugauaccuuuaaaauguuuuaauguuuuaaaaacccuacagaguuuagaauuuguuagucauaauacuuuacauacauauauagcacuuuacaguuuaaauguauguaaaggugauuuguaaacuccccagcaaucuuaggucaguauuaucuacacacguagguagaugacuauuuacaaaaguguaacuguucauuuccuucauuuccuucauuuucuucccaggaggcaaucugcacaauacuuuauuaaagucuacuaacucaaacaucauauucaaaagucauucaucugagaguauaauuucuguccuuaagcuagaacagauaggaaaaauuuaugguacugagaaaaagauaauguuaacuuuaauaucuacguuaauuuucuuaaauaagaauucucuccugguuucagacaauauguuuaaaacauccagagaauuuuaauacauccuuacauaaaccuuacagauuugacccuguuaaagcugaaucauggaaaauuaaaagaaaaaaguuuuagucauauuucacuaugaaauauugugacauaaaauaacuuuaccaucaauuuauucaauguaaugcaauccaacuuuuaaaaaaaaucuggacucuugauaaacuugcauuucucuacuugcuuucgauaucaaaguuuuucuugcuuagucccugauuuaaaaacuaagggugaaggcuaauguucuuaauuugaaaucaagguagcaucugaguaaauuuauuaaacguccaggccacugcuuaccuugccagugagaaguucaaagaggacagcacccaaacuccaccaaucacaggcuucaguuucuucagugauugcuccaaccucuaaccacaccaaaaaagguugauauuaaaauuccaaaggucaauuaaacuuucaaaauuaacauguauuagcaaggugaccuuuuuaaugcugagagagcauauacuaaauacuacugggcuuucaaaauuccugaaaguuacuuaucccuuuggucaccuacugcgguugcauauauuuuuuuuuuugaugcagucauauauuaaacucagacauuuguucuucaguugauagagggacaccuucaagaugcuuuacuuaaaaguuaugugaaccuacuagaucagcauuuugcuuaauuuuuuacauuugagaauguauagccaauucuaccucaugggugauuuuuuuguuguagaaauaaagacccuucagguucuaaaggaacuuuaaaaauuaucuaaaccaauauuaaucauccuuuuacuugcagguuagaaaccagagagacgaaaugccuuguccaaugucacauuguaggagaacgaagaccuaguuuauaguaucaucuucccuuuccuauguaaucaguuguuuucaaccaaaggaggagcaugugaaaugcaaauccacccauuuugcuaaaguacagauagauauauuguuuuaagccacggcugaaacuauuggcuaagauaagggauuuuagaauaucuacaaauuacacuuuuaucuguguuaucccuaucucucgccagcacaaguuccugaaauguaauuugaguuuucaggugucaucuuucagguuccugcaccaaucagcaacaacuccucauuucaccuuuuuuuuuuuuuuuuuugaggcuuuuagcccuuacauuaucuugugcuuuccuaauggcauuaaauuagucccgaagccuugccaauaccugcccuuucauuuccaauugacugaaaaaaaaaaaaacccuacuauuugacuauagguaacccacaauucauaacuacuuucaaguuuauaaguaguuagguuggaacuuggaaaguaaaacauguaagugguacucaggugccuagccuuuuaaccaaugcuuagucaauguacuugugugggagaaccccaaacuuacaaaauagcuugagcaauagucuuaaagcaaaagucauacggaccagaaaaagaaaaagagccauuccugugcaaaacacugaaauuacuccauucagcaaccuuuuucuacaucccuuuuucugagguucaaacagccuauauggaacucuaccccuucacagcccuucccaagcccacccucuuccugaagugcuucaugccaaaucacaauuuccauucuccaacuagcugcucucaacuagguaguaaaaagaaaccagauauuaacuaauucgaacuaguaugugaaugacucgaagucuccuaacguucuuagaacuauuugcauuuauaaaauaguugcuuguuugaaaaauugagaacuaccuaacaauagagauuuaaucauauauguuguggcacaucuguaugauggauuacuacuacauaaccauuuuaaauagggccaggcgagguggcucacgccuauaaucccagcacuuugggaggcugaggcaggcggaucaccugaggucagagguucaggaccagccuggccaacauggcgaaaccccaucucuauuaaaaauacaaaaauuagccaugcaugguggcaagcgccuguaaucccagcuacucaggaggcugaggcaggagaaucgcuugaacccaggagguggagguugcggugagcugagagcaggccacugcacuccagccugggcaacaagagcaaaacuccaacucaaaaaaaaaaaaaaaaaaaaauuaaaaaaacaacaccuacauauacuuaagugaauguuuguauauauaaacauauaaaaagcuauaaaacaauacaauucuaauuuuaaaaguacacauuuagaaaaaagacugguaagaaaacaugacaagauguuuuacugauuugccucugggguggugaguauuuuuugagacggagucucacucuguagcccaagcuggagugcaguggcacaaucuuggcucacugcaacuuucaccucuggggcugaagcaauuauccugccucagccucccaaguagcugggacuacaggugcgugccaccacacccaguuaauuuuuuuuguauuuuuaguagacacgggguuuuaccauguugcccuguauguucucgaacuccugagcucaggcgauccacccgccuuggccucccaaggugcugggauuacaggcaugagccaccgcacccggccagugagauuuuuuuauuaccuacaugaauauguaauugacacaaauguuuaaauuuuuaaaguacagcaagaugauaugaaaacauucaggcuuguuggaaaaguuacucuggagcagggaagaaaaacuacguaaaccaauccucccuucuguucaucugcauaguuuuuuccacaacuuuaaugcaugagaaagaacaaugaacuaggaaucaggaguccuggguugagucaaggaauucacuugaugucaucuauaacaugaggguuagagcugaggggcucuaggaacucuaugauuugauacucaaggauucucuaaaauaaugauacucaugaaggacauaucccugggugcucucuuucaaaguacauaugcuaccccucccagauucaaauacauaacccucacccccauucccauuucacagggagccacuaucaccuuuggaaguguacucuuagacuuuauaaaggguguguguuauuagaaauguuagcaaaguaaaagggaaauuuaucauaguucuaucauaaaauauaaccuuuuguacauuuccuuccagucuaaaacaagcgaugaaugacaucauuucccugcucaaaauucucacugaccauuagauaacauucaaauuccuugcuuaaucagguauauauauacaauucggcuuccauaauaagguaucaacccaucauauucauucaaccaacacacaugaagcagcacaaauuaggcacuguacuaggcacuauuccuccauagaauucuaugcuuuggccacacuguuaaauuaugugaagcuaaaaucaguuuuuccccuaguauaguuagugguuuuauuucuuaaauaucuuuuuguucaagaauuucauuugcuccauuuucuuuaaucauaucacaagcaguguauacuucuuaguauuauaaggaucaccugaagucaggaguuugagaccagccuggccaacauggcgaaaccgcaucucuacuaaaauacaaaaaugggccagugcgguggcucaugccuguaaucccagcacuugggaggccagaucaugaggucaggagaucgagaccauccuggcuaacacgguaaaaccccgucucuacuaaaaauacaaaaaauuagccaagcguaguggcgcgcaucuguagucccagcuacucgggaggccgaggcagaggaauugcuugaacccaggaggcagagguugcagugagcugagaucaugccacggcauuccagccugggcaacagagcgagacuccaucucaaaaaaaauaaaaaauaaaaauacaaaaauuagccaggugugguggugugcaccuguaguccuaacuacuugggaggcugagauaggaggaucacuugaacuuaggaagcaaggguugcagugagccaagaucacaccacuggacuccagccugggcgacagaguaagacuccaucucaaaaaaaaaaaaaaaaaaaaaaaaaaaaaaaaaaaguuuuaccuguuuacaauucaagauccaaaguuaucugucagccaucaguuuugaaugugccaccaaccagcuuuacuuuccauuuauaaugcugcuuuguucacaguagguacacauugcaauaaugauagcagcaauaauaaaauagcagcuaccauuuccuggcugcucacuacauguaagaaaccauguuuaauacuuuacaugaauuauuuacaaucucuaagcaaccuuauggaagaacuuauuuggguauggugacuuugggagagaauauuguauuuaugugcccaggaagaagcaggacaucugauccaguuagcuuagagauguaaaaauuaaugagaugguuuauagggucuaauaacaugugcuaaggagcucuagacuaaagccccauucuaagucucugcucaugagguuccucguuaaaacugagcagaggauugcccagaugggucugucuaaucgauggcuaacauacuuauaaagguaccuuuuaaauucagcaaaagguccaaagugccaccaacaacguagccuagauccucaaaagcuacauguuauguuuguuuuccacagcacugcagggaacacgcaccccagaugaaauguguuaguggggaggccgagggagaguguguucuugaagccacaagauaagcacaguccauauuccugagccucagagacuuuuguauguggggaggggauggaguauuguuuuacuauuacuauuuuuuaaaauaaauagaccuauuauggaacacaauguaaaauuugcauggauuugcaagauaaaaagacuucaaagaaaccucagaaucuuauuucacugguccccugggauacucauuucguaucaccucuacagucaaguacauaagcagaaaaauuugagaggcacuucauaagacagacaagguggauuccuguauugguuucugugaacuugcucaacugcagagucuaagaaguaggcuuuaugcugcuuugaaaucccuaaguaaucuucugccaggguccauaacagguaaauaaugaccaauguacugcuccaaauguggauugccacagugucugaugagccccaaucugaaugggaggcaacacagacagcagcaagagaccuaagaauccccuagaggaagccugugcaacccacaaccugugggcugaaugcagcccaaugcaaauuuguaaacuuucuuaaaacaucaugagauuuuuuuugcgacuuuuuuuuuuuuuuagcucaucagcuaucguuaguguuaguguauuuuauguggcccaagacaauucuucuuucaauguggcccagggaagccacaagauuggacaccccugcaaagcuuacuuacauucccacuccucagugggcuugcuagcuaguccaagacacgaaguggcaccugagauaacugcuggagacacuuuagcuaagcugucaaccacagucuaccucuuucacuccccauuuuccaucuuuccuggaucuucaucuccucucuuccacggacagccugcuucauuucuuccccauugacuuucuuucuugccuccucucagauaugauuaguucagcuuucuaacacacuuaggccuaaagacacugcuggucccaucuaaggaaaacugcuuuugaaacuaugaaggcagcuaggcugaaugucaucuuuaaucugacuggaguaguagagaaggauaagaacuguaaaaagguaaauugguuuuucauggaaaccagaaaagaagacauugaauaauuuuuaaauccauccccuuaacaaugcagcuugaaacuguucaaaaugacuuuauaucaagcagugauucauuaauuaaugugaaauugguaacaugaccaacuguccuugauuuucauacaugacucuaagcuacgacaaagaguucugcauuuaggcuguauuuagguaagauauaaagaagaacuuccuaacagcuaggaagcuuaaauauuagaacaggugaagguaagcaguuguagaauuucuuuauagguguuaaaacagaaaaaaaauucuuucaauuaucagaacaaaggacuuuauuugguugcccuuuuaacauccuuaaauaucaguaauucuuagauuaaaaauuuuaagauacacacugaaacuguauugccaaaaagaagccugagguuguguggcuaucaaaacuacuuuacuugcaaacucuauauaaaaaaucuaagcauaaaccaacaacacugauuuauauauaaagcaacacgauaguuacuauaaacaucagguauauguaccuaaaaucaaaaguagagaaugaaaagaaauaccauguaagucucugaggcuauuuuaaaagacuaacacagugaauuugagaaauccccuuuaacuccuaccucaaauuugaaaaaucucuagaaacaaguagaaaaacauuuuguuuucuuuuccuuuuuuuuuuuuuuaagguucucauccugucaccuaggcuggagugcaguggcaggaugaugacucacugcagccucgaccuccugggcucaagcaauccucccaucucagccuccuaaguagcugggaccacaggcaugggucccaggaccacaggcaugggaccacacuuggcuaauuuuuuuauuucuauuuuuuguagacagaggauuucaccauguuguucaggcuggucucaaacuccuaggcucaaguaauucuccugccuuggucucacaaaaugcuggaauuacaggcacgagccaccacgccuggccuagaaaaauauuuuaaaggauaaauucuaccacuuuuuuuuuuugccaauuuucaaaacauuuuuccuauaaaacacaagguguuaaguuucugggcaugccccauucccuaccgcuacauucuauaauugcaauuucuaggcuugguaaaacaguauccuuauucuccacaaguguaguggcacacuacaggcauuaagaaacaugaucagagaaaaacaaacuauuaccucagaaaacaauuucucaguuuauucccacaaaaacucaaaaagagauggugauaucaaagaauccuggauuuuuguccuuaagucaaacagauguauugccagggcucugguuaugcugcugcuugagcuuggcugaguauaucacuaugcuucucugaaaaugagaacagccagaccucuaacauucuuucagccucuuauaaucuguaauuuuaugauccugaaaguguuuucaaaagcacucaugagccuuucucauaacuucuucucccuccauuaaccuaagaugcccaaaaaguggauuaugcuaagaugagcaagcauuccucaaucuucuuccuuuucuccuuucuauacauagccacuccucucuuucccuaaaagauuaauuaccuggugguaagugaaaugaaucagggucacuaaaucuaaccauuaucaucuuuuaauguaauggagacacagaaucagcuccugauuaaauuucaacucauccauaaauuuuaaaggacaucaaacaugugcaaacuguuuaguaaaauucuagaaauuucacuucaguauucugauauucuaacuacaauauagacucuuacugauuaauacuaaugauucaaacuaugauauuucacaagugaauaaauaagauuaaauaaaacaaagauaucaaaacauaaaaugugcuuugccuaccuuugcuuuacucauguuuaacaccucauagaacacucuucaauaagccaagauauuuuucagaaaaauaaugcugucuugguagcccauauugccaaagagcuugcuaaaacacagaauaacaaaguuuuauaguccuuaugauauucagagucuuccaagucucccucuuacagccaaaauaauaauguuuacccuaaauccagaacugcaacuauaauaagcuuggcucccaaaaguaaaggagcaaaaaagcagaaagcuuggacucaaccauaagaugucuauauagcgaugggaaaggaaaggaaagaagaacaguacacacucucagacuugaggaagucugaaagacauuggagagacuaugugauuccaacauacuaaaaucaugauguaugcuucaugacauacguuuaucuaaggguacaggccuugccuuuuaagauuauacaauuuaaacugcauggauuugucaaagacaugacgcaaaaauaaccaaagacagaucuaacauuauacuggaaauugaaucgaaaauugagaaaacuagaaacugcaaguuaaacucaagcuuuaaucgaaaacguuuccauaaaguuuuaaaaacaugaaccaucuugcauuuuaagcaauuguggggccuucaauaucccaaauucagaauuuacuuuucuuuaaaagacaucacuuuuaaaaugcuuaauaaggaaaucugauauuccacauuuacagauauguguuaagacacaccgucagacuggugaggccaucugacucaguucccugguuuuuccacuaaaggagcaccacauagaucaucucauucuucacuuuaccuuuacuaacaauauaguuacccauccccauuccaaaaauucccagagacaaguccauaaccuccuucuggcaauauauucuguuguugcuaucuucucuccccaagauacagcaggaaauacaguauguucagaaucuucuuagaagagaauuucacuuauagagaaauucuauuguaauuuagaacuccuaaacuauuuuucuuaacuaggcuuuuuuaaaugaaaagacucauuucuuuuuacucucaaaguuauagcaacuguggaacuguuauuaagaagucauagaaaauuuaauuaaaaagcagccaucauuguaaauaaaguguuuauguaauacucaaaauaaaccaauaguuagaugcuggaagaauuuaucacauaaguaacauaaugcuuuauccaaauagcagaaugauaggccaauuuuaaggccacaagauccauacaacacauuaaaaugauaaucaguaguaaauacacuagggaagaaggugaaagauaaauauaguuuucuaaugccacaggauuuuuucucaaaauaauaaaaaauuuucacuuuaaauaucugaccuuaaggauuccaaaguucucuuugggggaaaaaaaccauaaggaacaaaaauauauuaacuuucaggaucaaaaaaagaucucugguaaauaagacaacauaagaacaaaggcaaauucuuacaaaccuuaaaauuaagcacaauguauaccuuuauacuaucagaaaggcagcuggaaugucuaaacuuucuauaaauucuuuaaguguucaauuagaaauguuguuacaauuggucaagaauuuaacuuucuuccaagggaaucagacuucauuaauggauuuaggaguagagaaagguuaaaaaaaucuaaucugucauuggugacaacuucgaccaaggaaaagaacaucuuucuuuuugcaaugagcauuccaugucagcuagggcacagaaacauuaguacuguguuccuacacagacaaucuuucccugcagcaucuguugcuaauugaaagggacuagaauuacaaaauccuagucaauuucucucaccagcucuugcuguguauaaagauuuucuaugcaggggcugagcauuagucuuccacugcagccgaugacuaaagagcaaagagaaagaaacacagaagaaagcauuuuuuguauccaacaauauauggaacuaaacugugggaagggggacagcuaagcaugucuuuuguuugcucagaaaacuaccauucuauaaauacaacuauucaccuauaaaggucuauuaacauccuaguuaaccaauuguauauuucuucuguuuggguagacuccuuuucauguaaaucuucaaaaguaacugucaauauuauaccaauuaugucuuuuauuucuggcuccuaggcacagugccugggacacaggaggcauuuaauaaauguuuguugaauaaauauaucaaucuuguauuuuguagcacuguccauucaaggcauucaaagcaccuccaaagcccucaucacauuuguuuucuuuaaguuccauugagcaugcagaucuacaucaaguccuuuugcacuuuuacaaguuguaggcuaaagaguuuaaaacauuaucuaaagcauacucagcagcaggaagaaacaaagauuagagggugagaguggaagccagucagcugacugcacuauuccaggcaagagaugaaggcagccuaaacucaggugguggaauggacaccuuccagugcuccccaugcaaagcacaaugacugccucuggaagguacaguuugcucuggcacagguggcgugugcuacaucaagaaaagaaagcugggcugggaacgguggcucacgccuguaaucccagcacuuugagaggaccaggcagguggaugaccugaggucaguucaggaccagccuggccaacauggcaaaacuccgucucuacuaaaaacacaaaaaauuagccagggcauggugguggccaucuguaaucccagcuacuugggagacugagacaggagaacugcuugaacccaggagguggagguuauagugagcccagaucacaccacugcacuccagccugggugacagagcaagacucugucucaaaaaaaaaaaaaaaaaaaaaagcugaaaaaccugggcgaauaaagaagacaggacugggagauaacucaagguuuuuucuaucccuguucaauuaaaggaauuuaggcaccuaauuccauaaaaugugccacaaauuuguaagcugguucuauuuggcuggugggcuggugagaucauuuguaucaauuacaaauauuuuuuaaauguuaucaaaaacaaauucauuuaaauguauuguaggacaacuacacuaccuagccaugguauuauuuuaaauacagagacaauuuuuuuuaaguuuuuguauaugacaauggaaaauguuacaaccgaaagcaaaacuaaaagccauagcaacuaugagaauaaaauuucauuuuaauuccagguucggaaugcuccucuaauaguuauaaacuaaaacaucaaaguuuaauagcuuaaaguuuacaaguucaaaggcgcaaagcuguucacagggaccuuguacuugaaaugagucaagucagacagaagaaacuucccuauagucucacauuucugaggcagaucuucauucuuacaugauagacuaacuagagccuggaauuuucauuuccuagcccauccuuucaaaugggcauuuugcuccuuuuuucuuauuuuauacuauuucagaaaacauugacugccuaauuauccauucuauauuccauaaaguccuccagcauuguacucaauugcuuauucaaaugcuguauuuguugagcaggguacaugaacuguuugaaaguuccuggaaucacauuacucuaauuagcguauuauccagagaagaccaaugacagagacuggcacuuuccagagagagaagucugcagcagcuggggcccccacucuucucccagugcugcaaggugacaggggauauguggugcugcuccacccuaauacgcauucgcuuuuucggcucaccucagucucuagccucgcuuccugccaccaccucaucauuuauucaguugguuuuuagguaauucaauuaccugaaucccugggccugcuguauuguggggaacuggacgugagugcagaccacacucagcuaguucaggcuaggcuuggcuacaugucuaauuccacuuuucucccacuaccuagcucugaauuucuuguugucguggugaccuggcaaccauguucugagcuuuccugcaauuaucuguacaacuuaagucaaaacuccuuaauuucacuugauucggcacuccagagccaagaauuacuuguucaagggaguuuauagguaucauuacuauacgguuuucuugugagauaaaauaagaaacgaguaacuaccacaugacuucugguugaccgauuauaauucugagcuguaaacaaucuugcuuacucucucacccuguauuucuaguaggaaaaaaccaacagcaugccccauuuuccauugaucauaucacaacaacuccauucugaguagccaucaggugucacaguguuacccaaccaaagccauuacaguugauugaugagaaaaaggcuaacugaaaauugugagaaugacaggcauagcucucucgcuugcuugcgcucucucucugccgcucugcugcuguguuaggcagagagcuacacgcauggcuauuaaaggagcuucagaaauccuacuugccuuauccucacucauuuuuaaaaaccuuagcauuuuuaaacauuuauucgaaggaagaauuugugaagaacugcucagaaggaauaagaccugguaaccuaauggagauuaaaauuuacaaaauguuaugggauacagaaacugaugauuugauaaaaauaguuagccaauugcucugguauauaauguuuaagacucaguauuacaucuuuguuaaacaucaaaggcaaaagacaguucacuuucuucuuuauaauaaugcaguggugaggccaauuacugaauaguugacaaaagucaacugagauacgaaaaauaaaaagcauuacacuguagcuaauacuuuaaacuauaagucucuagucucauguuccucuucugaaaaagaaauuugcccaagaucaucaagaaaaaagguuugggguaaauaaaagguuaagauuaacuuauuuuuaauaaucuaaagcuugacauaaacccuucacuccaaauaucagguaguauuaugaaauguacagagacauuguuuuucaccucuucuguaucaaaacaucaauucauugaacuucucuugggaugugcuaaugugucauuugcuaagaugccaaauaacugggacugaauucuuugcucuuacuuugucucauucucaccacuagagacaaaucgcauucuggcuugauaggagaaucaugauuucagaauagucuguuucaauauggagcaaccuuaacugagaugugauggugacuggcccauggauuccagcauucuagacccucaaguccuccuaaagugauccuuuaaucuucuuugcaccacaagggccuugccuagacaagguaagacuuguguuaacuugaggccuuuuuugcuuguacucuaaacucacguuacaaguuucauggauauacaguggugaaguguaucaagaaauuuucuucaguggaaaagucucacuauucuauggcaaacugaaaaauuaacugguucuccugaagaauaaauagauuugguuuuuaugacgauaagaacugagggcaaaggacuaaacauacuuguuaaucauucaaggaaaacauuaaaauacuauguacaagauagcuagcuauugcugaaguuuugcuuaaggguaaauaaaacaguuacugucugaaacauaauauuuaaauauuaaccauaaauauuuuacucaaaauuauuccuauaguucccucuugcugccaccuucuuucuguuuuaggaaaaaaaguaguaucuccugguuaugucauuauuauuuugaaauauacaucuauauuuauuugcuuucucuaucaaucuuacauucuuaaaauuagauuucucauguuugcugaaauuacccaggucccauaaauuaucacaucuaaauauuucuuucuuauuuaaacaauuuuguuuguugagaaucuugacauucaacuuucaccccaaacaaaaguuguuuuggcuucauuccucuaaaugaaaguauuuuccauaaaucccuuauuucuacaugauauacuuuauguacaaacucuauaaaugaguaaaaauauauacucagucauccuaaugaaauaauuuuuuaacucuacuaacauuagauaagaaaucaauauuuacccuuggggggaaaauccugccuuaauaugaugaacuucaauuuugaguacauuuuguguaaggaggaugucagaugaucugacaucugugauuuuacuuauauccaacaaaucuauuuuacuacuguuaaacugaggccuagaaagucuuaaauaaauuucccgaggucaagcaaucaguuaauacaugaucugggacaauaugcagguuugguaguucucaauuccaucuaaauguucuaaaccuuaaaaacuucugauagccucaagauauuuuaaacuccauccauggucugaguccuaguuuuaauuaucagauacauaacuauuacauggagcuccaugccuaaaaagaaacaaaugccauggaaagcauguuuauggagaagggcaggggaaacuauuccccaaaauauauucauggauuauuugauaaagucaggcuaggagagcaaagaaagguagucaauaaaugucaugcucuaaaacugaauuuuuacagauaguuuucagcaugauuuuucuauguuucacuuuucaccgucagcugugagcuguuuccaagugugaaauugccuaagagaggaagcaaagcugucauuugacaucugggagcauggagaucgggcugcagugaaaagcauuuuggacuucuucaauuuacacacauaugcaccuauaaauucucaagugugaaaaguauucaaugacaaauaucaauguaaauuucaagcauuuaaaauuaaagacucauaauagggcagaaaauaaaagugaaggacacacacugauaggauaccauaucaacuuguucaagacuagaaugggaaacuuaagugacuauauuagguuaacuaacacaaauaauuuuaugcacuugucucagauuguauauuaagcuuucaaauaucauuuucuuguauuuuucuuuaagagacaaggucuugcuauguugcccaggcuggagugcaguagcuauucgcaggcaugaucauagcacacugcagucucauacucacagccucaagcaauccucccaccucagacucaguuuuuuuuuuguauuuuauaugcuuaguaguacagguucuauuuucuagcuguuuuugaaugauaagagucaagaaaaaaaguaguaaaaaaaaguacuuugacauuuuauuuuuccuuuauacuuaaaacacuauaaacaaagguuuauucuuuauuaucauaaguuaauaaaucaaaugauaaagcacauaaaaucuuuuggcuaaaacuuuuguguguauguguguaaaaacagauauaaaaucagaguaaccagaagaaaguccuccagagaaaaauaaccaauuuacuccaguuuuuauucucuaaucccucacaacaaaaaaagcagaagaaccuguguaaaaguauccuaauaaaguaucuacaagucuccuaauguggaaaccagacaguguuauauuuauauugucaugcuauacaaucuguuccuacuuuguggacuauuucuuuugccuuuucucuuccugaacuccauucuguguuucugugguaugaaaggaacccauuuaccaugaaugauguuuauuuaaaauaaaaccuuucuagagaaucauccuagauaaucuaaggauacaaagugaaccuaaaaggaauggcuucuacuuugaaaacagggcuggguuugaucagugaauucguauucucaagacccucuugaugggucugcagcugcagccauuuaugcgcuggcuuuuucacagauguagccagagaaagcuccaugguuuuugucuuuuuguuguuggauuuguuuucuuuaauauaaaaaaguggcaacuuuuuuaaaaguucucaguuuuguuauagaaacuugugaaucuugggcauccuugggaguauacauuguugaaauaauuaugacuuuuuaaaaucuaggaucacuaaguuggcagaaacuauacuuaaauaacagaaggugaucauuugcauuucaaaauuuaucugucuugcuuuuccccucaauuagaccaaaacauguugauucacagguuucuguguguguguuuuuucuuuuuuaaacuuauuuauagagcagaauaauggccccccugcuaguuuggcauuugcucaaguuucuguccaugcaaaucaaaucuguuacuggaaauuuuucucaaaauauaaaggcacaucauccacaagauaaaaagauauacugcugauauuauaaagcacagggcagguggauaauguuuucaggacaaauaugugauaaggauucccaggaggugaaguggcaggguagagggugcacacuguuuaaacagaagugaguugcucucaucauaaucuugugacaacuuuucuuucuaaccaaacaucagcugcuuaacaugcuuuagaguuacuuggacaauaauacuaagguuagacuugggaaguaagagggaggggaucacaugaaaggaaauuacuucaaccuuuaguguuccuaaggguagaucaaaaggugguuaaacaaucuaugacccauguaguuacugauuuguauuuuuaaguauugaaauauuaacauauuaucauugcuuccauccuuugaggagaggaaaaccuaucuguaguuuugauuuaucaguagcacugccuaugaacuuuuggagcaaacaguaauucacaaauuuuugcuccaauuucccuugaguuauaaguaagggguacgagcacauagacuuaaccaaguucuauaacucucuagauuuaaggucaucuuaauaagaacacugguauuacuuuucuguuaaggccauuacucguuuuguuuuaccugguugcuaaaauuaacaggcccaaugaauggaaagccuuuccacauuguucacaaagcaugccacaacacuagaacacuuuugcaacucacaaagcuuggaaguacaauucuuuuaugcaaauaaugacaacaaagcaccucuucagacuacagcuuuuuucaaaugcuagugaaggacaaccuggaagaggacagcaaaauccauuaaugguagacugccaccugcuggucaacuaagagaauuguaauuucugggacaaggcuuaaaaauuagaacuuagaaaccgaucuguauuaaauucgguauuucaguauaugaaauugaaaguguguaucuguugaugaauguaauaugguucuguuccacauauauuaaaacucucaggauaccaacauguuauggauauuaaaguaaauaugacugugcuugagaauaaagaaaaauaaucugcuagaauguucaagcacaaauuuacagauaguuuccaauaaguaacaauauauacacuuacuaggaaccaggagaaaaaaaagaaaguaacaacaaaaauaagaaauaagaaacuacuuacaaauauuaaacaauauuccauaaaugugugguuuuguuuuguuauaugguucccacuguacuucacuuuagcauguaacaggcuugacucaaaaaaacucccaaauuaaguuugauucuaaaacuuccaaauucauuauaauuaacaaauauauuucuaaguacacuggaaccuaaaauguuauuucuuaucaaauuagaaaguggggaggaucugguuuuuuuuuuuaaucgaguaacuguaauaaagugaauucaacaugcaauuuuuuauccuauuuacuaacaugauuucaaaacauaacaucacauuaucuauuugagaaaaaaaaauguaagugugcucuauugucucuaacaauaaacaaaaaccaaacagucuuaauuugaaggaagaaggaggaaagaaaagaaaacccuaauaguugcuuucaggaacguuuuaggauauuuauuuuauagguuggaaaacuuugguauucucuacugcagaaauaauucuuaacaaugaaaguuguaacuagaaacaaucuagcucuuuuaauccuuauuaucaucacuucccauuaugcagagaaacaagguuagcaucaauacacuaguuagcuguuaaguauuaaauacuauauugaucaacaccuaagcagacuauaucaaaaaaaaaucagcuugaaacuccuuugaaggccaauggggcaacaggugaagugacucuggccauccaaagaggcuaaaugguaagcaaaaggugaacaaacuuuggauucauaauacagccccaucugcacugaugacugagaaaaaccaacucaaaugcaauucauaugcuuaugcuaccuauaauugucaauaaaagaucuaauacccacagaauaaaucucuaauuuuuaaaaaauaaagacaauacaguaaaggcaagauaaaacuguuuugucuauaaaaauuuguuauaaaaugccagguuggcacaucacuaaaaucauauugcauuuuuaaaaccuccauugugccaggcaccaugggcucaugccugcaaucccagcuauuccagaggcuggggcaggaggauugcuugaggccagguguucaggaccagucugagcaacacagcaaggcccuguuucuauuuaaaaaaaaaaaaauuuuuuuaauuagccaggaauaauggcaugcacccguaaucccagcaccuugagcccaggaguucuagaccagccugggcaacagaaagaccucaucucuacaaaaaaugcuuuuuaaaaaaauuagccaggcaugguggugcacaaauguagucccagcuacucagaagcugaggcaacaggacugccugagcccaggaguugggaggcugcagugagacauaacagcaccacugcauuccagccugugugacagagugagguaugucucaaaaaaaagaaagaaagaaaaaaaucaugcaucuaaagagggucaggguauuuaaagguccuuguaaacacuaagaaguuaagacauuucuaagaauucacugcaguucuuaaugagguauuaaacucauuuaacaauaauaaauauguggacacacauacauauauacacauauauaccuaugaauuacuuaauugguuuagccccaaauuuucuuuuuugaaggguuaaacagauaaccaaauccaacacauauguaaacugcuagugaacaauacaaaaauacaacuucuauaaagaaaugagagcugccgaaccacuuuuucaagugaaacauuuuaggagauugcucuaaccuggggcacaguacauucucucuauggcaucgcugucacaggaaucuucaaccucacuccaccugcuaaaauacguuagcugaauguguccuaaaaacaaaacgacaggagaaaucaaaacauuuuucucuuccauuuucugcagaagugaacuguaauuacuccuuuuguagcuaaaaacaguaucauuaagaauaauggcaucauuaaguacuagaagcuauuacugggggugaauuugcugcacugauaaugaagcucuagacaggaaaugaagauacuaauuacaagauaaaacgccuacucaguuaauuggaagcaacagcgaauaaaaagaaaugcauuugcaaaaguuccugaccucuaucauucaauaagauguuguuuggguucaaaucgcggcacacaauucccucucuauguaaagcaucaagggcuaccaccauuucagcugcccaucuuugaaugcagcccucugggauguaaaaccuggaggcuagugcuaauuuuuuaucaagguccucaaaaaucugauguauuuccuugucuccuucuagcacuaaaccacuuucacccuuagucucagagucucucuggaauaaagaaguugguuccucuuuagccaaaucaucagucugaucuguaaacagcaauacuucuucuguuuuuaaagugucugugcuugcaauauauucauuagcaccugagaguggacuacaaauacggaauaagcuuucuucuguguuguuugcaguuacugcugacucaaccacuccaaguccuugaaacuuaggaucugagcuggguaacaaagacauaucuccugaacuacuaugaucaacagcugcuacaaauaacauccugggauccuccugugcauaguguuucucuguuauacuauaggauuugggcccagagggaucacucaguuccucuaugccuuucuccucaugugcuuggcauuguucaguacuaagccugaggcauaaaacaucaggggcuuccaagaguuuauuuucuauuaucccuauauuaguuuguguaaacuuaguaggucccauugcugcagcuucucuuguugacuccaauucaccagguaaauuuacaagaagaucaggucuuccuucaucaguaccacugacaucaucaaaagcagcaucuuuaaaugaaauaacuggcacugagucaucugagccccugcuaaugguguccugagcuuuaaacucuaccuugcuuucacuaguauuaaaacuccuagaagcacugucuccaucuggaagaguaaagaaugguuucaaagguucugauuuuagacuauacaauuuuucuccaaagucaagucccaggaguucacuugcgcuauccuuacugucuauccuaaagaauuccauggggcuauuuuuugaucuacugagggaaucugauguucuuggagaacuaacugcuucugggucaucguuggggaagaacuucagcucgugagcucucagcugugugcuggggcugucacugucagcagcaaggugugcugggaagcuuuuaauagcuuuuguaucaacaccauucccuucagucuucaugaagggcuccucauucaaagacccugguucaaucuuuucuugcccauauucauugcauaauguuaaauaacuaguaguacauucuucuucugaacuugaaccagaaucuggccacuuuggagagcuaucuuggccaucaucuuccugguugcugucaucuugagaacuuggaguaagacuacucuucaaaggcagagcuuuaagcaugcuuccaccaucacuuccucuggauucaaagcuacugcuguccugaggacuagaaguuggcugcugcaggugaacuuuugcaaguguagguuuuuucacuuccuugaugucaaagcuuucuucaggacuucuguuuagaaauuuacugauauaugaccacaguuugccaccugugaacaaguauaacaaaacaaacaaaaguauuaagaucuccaaauugacaguuauuuaagccauuagaaaaacaaaaacuaucuuaaaaaucaaucaaaacaagucaauaauauccauuaauaucgugugccauaagauaagcauauuuaauaaaaugcuuguuauugcugacuggugaguacgguuucaagcauaucuccugauaucaauuuuuuuuuuaagugacaaccuauuucuuccuuugaagggaaauuaguuauaacacauacuaguaugaaauuucacagcuaaaauucuacucuaaaguuaaauaucauuuagucuuagaaacaucugauuauguucuguucuguuuauauaauaauuuuuucacgcauggccccuuggucaaguggaaauacauaaauaagugcuguuuaaaauuguauacuacaauggggggaaaaaucaacaauauuauuccauuuugaaaauguccaguccaggauuggaggaauuuggcaugugguauauaauuaugccuuuauaaaugacauauuaauauuuccccuuuuaugcccagccuuacauguaauauguuauauaaguaaagcuacugaggaaaauuaauugggcaaccauuaauaaagcaagcuacggaaauuccgacuguguauucugacauauaucuuuaaaacuaaaaucauaaaaaucacuuucauguaaaucagagaaauaaaaaaaauccaguauuuuaucagcaauacuuguaguuauuauuucaccauaguuuucuuuuauuuuaaccauuaaaacaccucaaucccuuugucaauuauaacuuuuacguuaaacaauuauggcuaaguaccaaaaaccugcuauaacaguagugauuagaaacaguauuauaagaaagaauaauuaauuaaauuugauccagaaaucucaaaagcaguaacuacagaaguauacuuugcggagacagaauuguaguugcaaagaaaugaaaaauuaagaauaauguguuaaaaauaaaucccucuauucauauaaagaagacaauuuuucagcacauauuuauuguaaucauuaagcaucauaugccaaggguaccuaaaccuuaaggaaaauaaccacugacagucaauugcauguguaaaaaagucaacggaaacaucaaaaauaccucuuccuacuucacauuucauuuugagaaauucaauaaauacacauagcaccugacaugguaccuagcauagaauaaaugcucaauaaaggcuaauugucauaauauuaauccuaggauucucauacaccucuuuguagcagcgaucuaguuaaccaccuucucuauuuuauuuauuuaacuuuuuuuuuuuucuuagagucucacucuguagcccagacuggagugcaguggugggaucucagcucacugaagccuccaccuccucgguucaaguuauccuccugccucagucacccaaguagcugggauuacaggcgugugccaccauacccagcuaauuuuuguaucaucuuccccauuuugauaccaguuagugguacaggauauuauggcauuuaacuuuuuccucucauuuuuuucuuagcuaaugcuuucuguccucuuuauacucaguguuucacauuucuccauauuucaacugaaguuuaaaaggagcuaugcauugagucuauauucuuuagucuauugacaacaauacucacauucucuuaccacaaauaccuauauuguggcacucuaacaaugcuugaaccuaaaacuaagauucuuguaugcaauccaaauaaaaugauuugggugguuuucaauucuccuagaugaugacuacuuugaggaaaggaucaagucuuuuucaucuuuguaugucuacugccuacacaaugugcaggacauaaaagucacugcuuguuaaaucagaugaugagauguaccguauaagcaauccauaaaguuccacugaccagcaagaaaugguaccuuuuaauaaaguucuaagaaaagcuucauucauuccuaggccaauuccaccugaauaaacuacugaaaucuaaaauucaauguacuuaaagucuucauuuuuggggauaaugcuauaacuacgacuagauccuuacuuuaagucccucuuguaucacucuacccuacuaauugcugccuaauuaaucuucuauuucagcacagaucuuaugccauuucugcauucaagaagccaaguucccuccaucuacugaaucauauaccaacuccgcauaggcauuugaacuccugaguaauacaguuaucaacccaugauuugguccucucccccuacucaacaaagaauucauaaugggcuuuuccccauaccaugcuugcacuuggaauguuuuuuucuaauaguuuccccaguauccacuugugaaaaucuuaccuauucuugaagguccuucagaaucuguucucuuuuaccaauuucuuuguaucccuuaacuggacaucauauauacauucucucaauccucuaucauccaccuucauacuccuuaugacauuuacaucauauuaauauuacuuuuaugcuuuuauuaucuccuucaugagacuguaaagucuuaauagcugcaggcagaggauucuaucuagcauguaaaacagguauuaaauauuuauuaaacugaguuauaaaaagauaacaucuguacaaauuuuuugaaaaccuuucaaggaaaagaaucuauaaguaagaaucuauaaggaucuauaaguauaaugucauuuugggggccguacguucuuccaaagacauauauuaaccuuaaaaaaaaccuguuauugcuaagguacauaaaauuugucuaauuuuuaacacucuaagacuguaaaugauacuuuucuaagucuuuuugaagcacauaaaauuguagauauugaaccauuuuaagauuuaaaaauuagaauucauaauguuuaauuaaaacucuuugucucuccucagauuuuaagucuauuguuuuucuauaagauugcaaaguaaguuuguuaauuugcuuggucagaauuaggacuuaaauuucauauguacgauaaaacacugcuaucacaguaaucaaaaucaucuuuuggccaagcaauucaacuugaaaaaaaucuguccuacauauaauucucaaaaaauacaacaaaaacauguauguauaaauacauguuuauacauguauuuauaugaguacuggaaacaauuuaaauaucaauuaauaauagccauuugcaaauacauagugcuuaccauguaccagguacuauucuaagcauuuuacauauacaacuauuuaauccucacaucaacccuauaagguagguaauuaauauuaucucuauuuuacagaugaggaaauugagacacagaaagguuaaauaacuuucccaaagucacacuaguaauggugagccagcauuuacauucacauagcauggcuccacaguccuuauuuuuaaucacuauaguguaugccucucuuaauauggaccuaaauauacucauaaagauauacuaaaggcguccaagguacacuuuugagaugggggaaaaaaugcaagcucaaggcaauauguaacacccauuuaaguuuuuuaaaaacagacagauagggagugaauguuuauaaacauagaaaguuauuggaagauauauaauuacuguuaaaagaguaccuauuucuggggaauaggucugggcaacaaagugaauagggagggauaauuuuuauuuuuacuuuauagacuucuauuuuguuugaauuuauuuuauaaauuaguuuuauaauuuuagaaaacuaauuaauaaaagaaucauuuuacuccuuggggccuuaaguaacuuggagagaaauucuuuucuaccuccuuucuguuuuguauauccacagucagagacuuuugcaacuucugucuuuuaauuuggucuuucaucuuugacugacccaguauucaacaauuauacacugagcaccuucuaaauaccaaguauuuugcuaauucaucauacauaugaugaauauuauauaaucccuaaucuuagaaacuuaaacucucauggccuugacugaauacauuuuguuuccccaccuuucucucucaaauaguuuaagaaagggcuuuauuaaaagcaauaguaaauauuuuaaaccucucuccuaaaauccugacugauauagccugucuacuaaacaucaccugaauauuuaauaagaaucucaaauucacauguccaaaauggaauccuugauuuuccuucuaaacuuacuucucccacagcuuagcaaauggaaacuccauuauuucaauuugagccaaaaacuuugaaaucauguaaaacagaaucaugccguucuaccuucaaaauacauucagacucuaauaaccauucuuuacgaccuacgccagcaguucccaaccauuuuggcaccaaggaccaguuucauggaagacaauuuuuccguggauggggacagggguguggguggggguagaaaguguuuuggggugaaacuguuccaccucagaucaucaggcauuagauucccauaaggagugugcaaccuagaucccucgcaugugcaguucacaauaggguuugugcuccuaugagaaucuaaugccacugcugaucugacaggaggcggagcucagacaguaauguucacuuguccgccacucaccuccagguacccgucuguggcccggagaccccugaccuacacacuaauaccuuguccaagccaucagcauuuucaccuggggugcugcaacaacuuccaaauuggucucccugcuuuuccuucugcucuccuacauucuguuuuccacagagcaggccaaugaucccuaucucaucacuccuuugcucagcaugccccaauaacaucuuaucucauuuagaauaaaaguccaguucuuaacguggccuacaaugcuauacaggaucugccugccugccuccucacuucucuaagcauuccuccuacugcucuuucuguucugcuccagccacacugauccugcuguuucuugaacaccaagcacaccccugccucuaagccuguggaccuauuuguuuucucuugccaagacauccuuuccuuacauauccacaaugcucccucucucacuuccugaaggucucuggucaaaugucccuucucaauaagaugaccacccuauauaaaauagcaaaccaccccucucaccccuuuggcauucccuuccccuuuccuuuaauuuuucuccauagcauauuuaccuccaucugucauauauuuacuuaaauauuugcuuauugucuguucugccucuauaauguaauguaauguaagcuccaugcaggcaaagucuucuguuuuguucacugccaaauuagaacuaugucugugucccagcaagcacucaauacauuucuaaugaaaugaauuaaaaauggaaagaaagaguccaagagacucacauaaaucaugaguaguucuguaagcaguggaaagcuaaagccacaaaucguaaguauucaaagcauucauguuauggagaaaacaacuguucaagguuugcuuucucaguaauaacuauucacacauaugaaaaguuacuuuucuaugacacaggccaacuuccuaaucuacggaggugccacugauguguaaaagaaaacacacuguucaucauccaguucacugcauugcucaagccaaaucugagaaauuacuguagauuuuccucuuccuaaucucaaauccauuacaggucccauuacucuacccucaaacaucucgacuggugccccagaaggccaagccagcagcaccuuuucacuagccuccuguauuagccuuuuuacugcuucuauucuugccuuucuacaacccauuccccauacaagagccagugaccuuuuuaaaauguaaaucagauucugucaccccuuaagaaguccaaugguuucccaaugcacuugaacaaaagucaaaguccuuacucugcuguacaaggcuccugccuacuucuccaacagccucacguaccaacaugugccucacguuguccucacucugcuccauuccaaccaaaugauaccuuucuuggucaucaaacaucccaaguuuguuuuuauacucaucccuguaccuguaucuuacauucaaaugauuguuucuuuugccauucagaacuucucuuaaaugccaccuucucagagagggcucccucuacuacuuaauucaacauagucccccaguuguuaucuauuagaucucccuuuguuaaagaucuguauaguuccuuuuauuauccaauguucucuugcuuuuuguuuuucuguuugacuuuucacaacaagaauuuaaguuucaggccuggcgugguggcucaccccugcaaucccagcauuuugggaggcugaggcaggagaaucgcuugaggccaggaguuuaagaccaauuugggcaacauagagagacccaaucucuacaaaaaauuuuaaaacuuagccagaugugguggugcacgcauguaaucccagcugaggugggagaucacuugagcccaagaguucaagguuacagugagcuaugauuguaccauagcacucuaaccuaggagacagagcaagacccuaacuaccccccaaccaaaaaaaaaaaaaaaagagagagagagaauuuucuugucuuguucaccuaaaaaggagccuacucuacaguacaugcucaauaaauuugcugaauauuuaauuaauccagagucccuauuugcacuauaauuuacuaucuuuauauuauaaaaccaucuuaaaaauaaacaauagacaccuaaaaugaauggucaaaagagacaaauuuuauggucaugugagcauucaaagucagguaugcucgauaguaaagaaggaucuaaaauaguagaaaauuuaaaagucguaagucuaugauuuuaagagauuauacaaauuuucuacauuauucaaguaaaaucaauugaaacaucaguuucaagagguauaugggauggugagaagaugguagaaaaaaaugaaaaaugauauggagaaggaagaggaagaagaggaagauauugcuacaaauaacagguaaguuaagacugaaaauuuugccauagauaaucuccaacaugaauaauccacacuggguaauagaauauugacuauaauuacauucauccuacugaccuuguucuaaauuauuauggauuauuacuacgcaaguuauuuuguuccacaccagagguggcuguauuucgcuaucagaugacaugaccucuaauucaauaaugucuguaaugcacugguauccucagauaaaagcugucuauaaugucugaacaaaggugaauuaguuauccaauucacacacacaauuaacucucuuaauaccugagagaccacagagccccuuuugaauuuccuauuaaauacugcauauggaggucuucccuccaucuguaguuaucuugugcuguacuucacaauaaacaauauuaauuguuuacugcccccaucaaaaaucuugcauucauuaucaugagaccucauuccagaaagcaaugacuucuuuuccuaaaaaauuauauuaaauacaaauguuaugccuauuaguaaaguacaauaguuauacaaaaauaacaaugccuucacgagauacggaaaacaauuuaaaaauuuuuuacuauuuuacgaacaccucuuaaaagccaaauggcaauauguauuaaaugaauuuauauuuauaugcuguuuucagucauccuaaauaaaagacuacuuauuuaaauucagguauuaaagggcaaaaaaaaaucaaaacauuauauuuuuugccaccuguucccucuacaaagagcugaaauuucauaaauaguuugaaggcagagaacugugccucugcuuuguacccauaugugaugccaauggcuguauucauaaaaacucagaucagaaugacuagguaaugucaaauguuaagccaacacccuugccuucuaaaagaaggagguaauuaauuaauucuucaggggaugcuuuucauuuuagucaucuaacauaauguauccuuuuagcagggaacaagcgaacaaaauaccacuaaaauaaaaucuagcucucuuagcacacauucauauuaaaguucucauuauauuagguaaauuccaugagaaaguaaguagugaaguaaaucuacaaaugguaccauaguucacaugaaaucuguuguucaccuggguuuucauuuucccucacaacucaaaguagggagguagagcagaggaauaggaaaugguuucuuaaacguguuucauauauucuaucugcucaugaaaugacagagagaaacuggaagcuaaguaggugacauucuucacugcauaaacaauccaaacuacaaaccaaccuuccgcaugcugcagcacaagaaauacugacuccucagagaugauguacuuaugcagacacaccauguugggcacacagcgggggaugauggucuuucuguuccugcuguauucacugcuuuuccuuagacccugacagagaacaaaaaggucaguuguauccucaguugcauccucaguugccuuuggagccugcugugcucuguguuuaucaaccaaacuaaucuauccgaguuacucugggcuucagagaaaccacucaucugcugcucuaugccccccagucccuggaggcucugcugauggcaucuggcgugaauccagagaaggaagaugccacaaagcugccauuaaaaucaauuacgugggucaguguuuuuauuagagaugcucucaaacuaagucaucaggaugacacacaguuauuucucugugaccuuuucuuaaguuuuauuuuacuuaucuauaucuuuaaagcaguagacauuguaagaccaaugcaaacuccugagacacaaaagguauucuuagauuaagcaggcaauuuuaaaauccuaucccccaaaaguacaaacaauauuaagucuucuuacaaggaauaagguuugucuauuuucuggugucauacucuguuuuuaaagaaaugucaaugauaaaguauauucacacacacacacaaaauguguuucaguaugugucaaugugaccuacugccaugccuuaucagcaaaagaaaaagcaacagaaaaagaaauauaaaauuaauaaauucaccuucugaaugcuguggaaaugcuuaaauuaggauauuuucagaauauguacuaucacaguccauuccaaauacaauuucaaaauuucaaaauugaggguucucucucuccuuauucauuuaguuauaaauugcauuauguauagaaucaaaauugaauuuagaucaaauagaggaccaggaauguagauacacuuucccaaaauaccuguaacuagauuuuaaggcaaaauuuuagcucuuaagaacuguagugauaaucgaaggugagacuguguguagucuucacaauuaaacaaaauguucuugagauguauuuaaacaacacacuacacauucaaacaacacaaaaugguucuucaguuuauccaaauuauuuccuccauacucuguaucaaaaacaauguuguuaaaugcaugcuaucaaccgugaugaaaggauagaaagaaaaguaaauaaacaucaccagaaacaacauaaaaggacauucaaaaccuaggggggggauauauuaacuacuuaguuaauauuaacuaaauauuaacuaaaauauuaacuuuucuuucagaagcauaauuugaaauucaaauuuuaaauucauuaaacauauaaauuuuacuuacucuuuuuuuuuuuuuuuuuuuuugagacagggucucacucuuguugcccaggcuggagugcaauggugcaaucuugguucacugcaaucucugccuccuggguucaagcgauucuccugccuaagucucccggguagcugggauuauagaagcccaccauuauacccggcuaauuuuuguauuuuuaguagaaacgggguuucaccauguuggccaggauagucucgaacuccugaccuuaggugaccugccuaucucagucucccaaagugcuggaauuauaggcaccgcgccuggcuacaaauuuuacuuacuuuuaaaaugaaagucuguucuguccuuguguccauuacaaguaaaaccuacauaaaagacacgaguaauaauuuauuaacaauacaaugaaacauuaacucuuagcuuuaaacuaaacuuuaagaguagggcagggcugaaauuuaauccccuccccaaaauuguucauuucugaauaaauuuuuuuaagucagcaaauuauaggaucaaaauaaucuuauccaaaauagguuuuauuaugguuuccuuuucuaaaaaugccguauuuuagaaacauuacuguuuccuaaaguauuuuaaaauguauuucuuagaaguaaaggaaauacuauuuuaaacagaguuuuuccucuuggaacauauaugaucaacaggaagugguucaaaaaaaauuguucaagucucaauuuucuuccuaaaaucuccuauguagcaacuugcuauaaugugaucucaauaacucaggcucuagccuaaggcauccuuuugguaucucuucacccuggauucaccuuaacaccccuuuccaccaccggcaaauccugucagcucugucuucaaaauguauccagaaucugaacucaccuuaccacuuccacaguuauuacucugauucaagcaaagaucaacucuuaccuaacuuguaacuacaguguuccaacugaucucccugcuuccaucuuugcugcccuguugucuauccucaaaacagcggccaggguuuucuuuuuaaaacauaaguuagaacauggcacucuucuuaucucacugagagaaaaagcuuaagcccauaaaaugaccucaagacccuucauaaccucucacacauugccccccuaaacuacucauucccaccccucaucuugauggauaaaauaaauuaacagaaguaugaaauuauccuacccuauuaaagcuuuauuauuuuggaaaaacuacuguagcaaagauuggcaaacuuuuucuuuaaagggccagacuguaaauauuuuaggcuccgcaggccuaugcagucucuguuacagcuuuucaacuuugucauuauagaacaaaagcagccacagacugaaauuggccaugggaggaggauuuguacuacagaaaucagcaaacacugcaaaugagccuucuucccccuaccagagagcuggcugucaaacauuuaccagcccaccacuggguaaggaaagacagaauuuaaggaugaaaaaaaaagauguuaagcuugaaaaaaauagaagaauuuuuaaaaggugagaagaaacaaggaaguugagaugggaaaccaguucgagaagauggaaaauuccauuuuagauauuaaaguugaaaaaauagugacaacuucaucuuugucuucuguuugaccuacacuauuuaaauuuccauuaauuucaauacaauauucucacagguaccucauauccucuucccaaggcccugccuucaccaaacaaacaaacagccugcugcuccuccuauaguacuaagaccaucuuccaugcaugcucugaaacuaaacguggucuaaguuacucugaacugucuccugucucccaccuucagaacaagugacugauccaggauucaacaauuauacacugagcaccuucugaauaccaaguauuuagaaucaauucuaaaucaaucaaaucaauucuaccuccuaagcacuucucuuauccacccuguauucucuaaucugccauguuuuaagcauuuacuaugugcuauacuuuacccagguguaaucaauauuaauccucccaaaaagccaaugauuuauuuuauuuuauuuuguuuuaucuuauuuuuauugagacugggucucacucugcuacccaagcuagagugcucuggugugauuuuuagcucacugcagccucaaccuuccagguucaaacgauccucccacuucagccucccaaguagcugguacuacaggcaugugccaccaugccuggauaauuuuuuuuuuuuuuguaagacaggggucucaccauauugccuaggcugaucuugaacuccugcgaucgcucaagcaauccuccugccuuggccucucaaagugcugagauuacagggauaagucaccaggucuggcucagugaaauaauuuuaccauuccuauucuacauuagaagacacuacagacaugucuucuuauggacauaaggcauucuuauuauguagaagcuauaauagucgguaacaguaucuaacacuugugaggauuucaguaagauaaucuuauaaaaguacagcuaguugcuauuacugcuaucacuauuauugcuuguuuuucccugaaauauucccccaggcacuuaucaaacaaguaugcaucuuuccauaugcagcacaaaugucacucuagcucucaguaacacugacuacuuucuuccuuucuucugcuguuuuacacagcaccaacaucuauuauagaaucucuaacccuucgauuugggggucugucucccagugagacuucgagcucuuuaugggcaugcuguaaaggcaggauaaugggccccaaagauguucauaccccaagaauccccaacauuugugaacguguuauguuacuggcaaaaaagccuuuucagauguaauuaagguacagaccuuaaaacagagagauuacacuggauuaucuggguggguuccaaaauaucacaugaauccauuucaaaaacagagaacuaucgucuaugaaaagaaaggcaaagcacagaaaugauaaggcugaaagggaaaucauauucaaagcaugaaagggaugcauggcugcuggcucucagguggcaaaggcccacaugcaagaacuggagagaggcuucuaggaucucauagcaagccuaagaaggaaccuaggcaacuucuaggaguauagcgcaguccuuggcugacagccagcaaagaaacagaguucaguccuacaacucuaugaaaagaacagaauucagccaacaaccugaaugagcuuggaagcagauuccucuccugagcuuccaguaaggaauauagucuugccaccaucuugauuucaacccaguaacugugucagacuucugaccuauagaacuuuaauaauuuaguuguuauaggcugccaacuuugugguaauuuguuaugucagcaacagaaaaccaacagcauaaaaauuauucuaucacauaacacacuguucucacacaguaaauguuuaauaaacauacgguuagugaauucaacucuaaaaguuuguaagguagaugacgacaugggaauagagcuuagaaaauaagucgguacuaaugauuuauauuugagcauucuccauaaagauaaaaacuaaagacacaagaaugaaucccacugggacacuuccuuuauaucaggcacugugcugggcuuuaaggaauuaaaucauguaauucucucaacaauccaaagagguagguaucuuuuauuaaucaaguuuacagauaaggaaauaagcauaaaacugauuguacucucuggagugcacucugaaacacuggaacuucuuuaaccucaggacuuuguccauacucacaaagauaauaagugguagaggguagucuggcuccagguuucuuccucuuuaauugcuaagcgauacuauuuauuucugaauuuugaaaauauacauaguugaaauauugugaguaaauaagacaauaaccaaaaguguaaugagaaaaguacaaagagaaaacauagugguucaggugacagagaaagagaaugcuuaagaugaguguaaucuaugcuaaacaacagagagaagccaugaagaauaaggacugagaaaccaucacugguuagggcaguuaggaagucauguguaacuuucaauacagcauuguacaguucacuguacaaugaacugaggauaaaagcagauugcacagaguucauaaugagugauaagaaaauagaggugacauauauaagccuuucaauaguaaagucugucagaagaaggaaaaacacuaaaaugaaauagugguaucaucaguugaaacaaaggguuugacuuuuauuauuuuucagauaggauagacuuauucucuccauagcugcccuuugaguuacaaugaacacaaaucuugagccuccaaaacaugaaaacacauuugugaacuuuaagaguuaaaucaacauaucaagaauguaaaaggaggcaccauggccuuccuucugcaaaggagagcucaauaaauaucuguugaacaucuguugaaucugugaagacauuuaguguuccuuaagucucauuuguuuuuacaugaggugugacuuuuuuuuuuuuuuugagacagagucuugcuuuguugcccaggcuggagugcaguggugcgaucuccgcucacuucaagcucugccucccggguucacgccauucuccugccucagccuccggaguagcugggacuacaggcgcccgccaccacacccagcuaauuuuuuguauuuuuaguagagacaggguuucaccguguuagccaggauagucucaaucucccgaccucgugauccgcccgccucggcaucccaaagugcugggauuacaggcaugagccaccacacccagcuuacaugaggugugacuuuuaagucacuuaccagaaagccaauucuauuugaacaagacauaucuauauaaaguagaacacaucucacuagguaaaaggcauggaagcuguauaaccaaaggaaagaacuucucccuauuaaaagccccuuaauugacucaacaaaauauaccugcacaaaucaggagugauaccuccuuacugaucucacuuagucaugaagcaugaagcagaucagauaaaaaggccaaaccggcugggcgcaguggcucacaccuguaaucccagcauuuugggagaccaagguggguggaucaccugaggucaggaguuuaagaccagccuggccaacguggugaaaccucgucucuacuaaaaauacaaaaauuagccgggcauggugguggacaccuauaaucccagcuacucgggagggugaggcaugagaaucacuugaaucaggaggcggagguugcagugaauugagaucgcgccacuccacacuccagccugagcaagagugagacuccaucuccaaaaaaaaaagcaaauuaagauggauaaacauggcugggaaaugcugcuuuguuuauauuuacuuucuucuccuacaaaguuugugugcaacuagacaacguucacauugaggcaauaaacacaagaacauaugugauuuuuuaaaaaugugcccuuugacugucaauuucucccaaacagguguuggcuaaaugauuauaaauuggccucuggauauaccucuucaacugagccguacagggcuggugauaauauaauuagacccaaaaacaucaggcuggugaaugcuuuccaucuguuuggcaauaauguuuaguuaacaauagucuuuaaaagaagcaccuucaacuucaguucuuaaaguuauuuauagagccauucuuaacacaccagcacuccugcuaacaagagcuuuagcugcuuggaaauuauuagccauacagcuguacacaaagagaaacgacugcauuuaacaucuguaucuuuccaaauuuacacgcuucaaccucauuuaaagucauuucuuaaugaacagugcuauggugcugcauuaauauuauaguugcaugcacaaagaucauaaggagccaaacauuuuuuuaaugccaacaguaggccaaucuguaaugaaacugucagcauaaaggacaaaauaauagcuucuuuaacccucaaacagaauuuguucauguguagacuaaaacacaucaauuuaaaaacugcucauggguuugcucaccuuuauaaagacaaaaaucuaauuuguacuagcuugauacaauugucuuuccaauaaaaggcuccuaaaacaaucuuuuauuucaugauaaaacaaguacuauaacuaaaacugucaugaaauaauuaccuuggauagcauaccuuauugaaagaauacaauuaauguauuucucccuuucauuuuucacacuuacuuaucagcccuauauuagcauauggucuaacagaagaaauuacuucaucuuugcccauacuaauacaugaaauaacugcuccuaacugggggaaaaaaaagaaaaagcaggcaacuuauuccuuaaggauuagccucaucuguucuucaauuccacaaguuucacuuuucccacuuuucugucauaauaguaguaggaaaagcuccaacugauuacagguuugagucuauuuguuaacuagaauuaagaaaggacuaauauuuaaguaggcaaccaucuuugcaaagaaaagagggagaagggguacaccaaaaguaucaaaugaugauuauuuuuaagcaaauaaagaaaaauaauauggagaagagaaaagagauaugcuacuaugaaggcacuacgacuguggugaagaaguguggagaguucccuucaguggggauucagugucuccccauucaugaaucuuuuuagauauuuaauuuaaauguugacacuggaagucuggaagucccugaaaauaacuucagcuccaauuccuuuuaaaagaaagauuacuuggguaauuucagggacugucugucucuacuuuagugccaguuacuucaugggacuccagaacaauuaauacaaguuaaaauaaugcuuaagucuauagaaaauuaguacaaccacuauggaaaacaauauggagauuccuuaaagaacuaaaaguagaacuaccauucuauccaacaaucccacuacuggguagcuacccaaagaaaaagaagucauuauaugaaaaagacacaugcauauacauguuuauagcagcacgauuagcaacugcaaugauaccgaaccaaccuaagugcccagcgaccaaugaguggauaaagaaaaugugguguauauauacuccauagaauacuacucagccauaaaaagaaaugaaauaaugucuuuugcagcaacuuggaugaagguggaggccauuacucuaagugaaguaacucaggaauggaaaaccaaauaucauguguucucguaagugggagcuaagcuaugaggaugcaaaggcguaagagugauauaauggacuucagggacucaggagggaagguugugaggugggugaaggauaaaauacuacguauuggguacaguguacauugcucgaguaauggaugcacuuaaaucucagaaaucaccacuaaagaacuuaucuguguaaccaaaaccaccaguaccccaaaaacuauugaaaaaaagaaaagaaacaaaaagacuacaggacaaacacagagcaucccuuaauggugucacauauaaccggauuuguguuugcugcuuauaaucuggaugagauaucaacuguguaagucaugcuccccguaauucacauauaaauaaugacaacagaaagaaugagaucaacacaauaaagaaacuagagaaaauaguacuagaccgauuuugcaaauaaguuuuucccaacauacuuucaugugaacaugauuguacuugcuacacucucuuucaaagguaauccauacuugacuaguauuagaucugaauuuuuaaccagaugggcaaauuuacaagagcugguaauguuauccuucuauagaaauggauuugaacaacaaaccuagagcauuaaaacuuugcuuuccuccccuaacaccaugcauaauuaucaaauguuauucauauuuucugcuaaaauaaaucucauuuuguauucuuaaaacauccaaaauguguuucuacucuuaauuccacaccuuauucucaugaggcaucuuuauaaaaauucaacuacuagaaaacaaggaauaguacucggugggcuuuaauaucaacaauucucccaacuggggucuaacuucucuuucuuuggcaucagaaggccagcaauguucccuguaccauugcccagcaacuccaaaagcaaaagauguugcaccuacagcuucaguccaucagaagcugcaccaucaagagcauuagcaugaacagaccaugcagagaugcuucucucauguuaugccaugaaaccaaucuguccuugguuucauaaguuuuccacugaugaaaauucaagcauaaagaguaaaauuugacagggauacuuauaacucuagucuacaagauauuuucagcuauuacucucaaggauacauuuucaauugagaaaaguauauaagguacccaagauuuauggguaacaaagaaaauccuuuggagccuuaccaauguuucauuugugcuagaacuucccacauagcagauuaucaugaagugaacaaauaauccaaaaagguuagcaauguucccuguacccacugcucaguaacuccaaaagcaaaauauguugugccuacagcuuuagcucaucagaagucgcugcaucaauuucugcaaaguuaacaaaguuaagaacggcagagucaagaaucaccaacuaauuuagaacaaaaggaaauaucucuuugaggcagguugaguucuucaggcuccuauuugauccagaaauaccuucaaagguagaagaaaacagaccaaaucuaccagaauuauaugaagauuguacuuaaaauccacaucucuucuuaguuauuaaaauccaaaaugccauaauucaaaauauacuuuguuuaugcaaacacccaagauuccuaaaaacaaccuauauuucaauuuauguaguuaucugauuuaucuuaacuaccaacaaacugggguagaaacagaggaaaaagaaccagguuaggaagagcaaguaacauaagacuaaacugguaaauaaauacuucuauaagaacacaacuaauuguagauuucuuuaaaugcccagacauucacaaagguuuuaguaugcuaauuuuuaauuaaaagauauuucagcagugaaaguucuuucauaugcacuacugauucuucaucaaacguuaacuuuccaacuuaacaccaguuuagcugguggcagccugaagguuuaccaucugcugcuacccaaagucacuguggccaccuucagaacauaugcaucaaagccccaagauaagagacugaagaaauauugccuaagucagcauaagggggaugacgaacccagaggcaggcaacaggcaagcuaccagaaaacacagaacgucaugaagcaucaguucgccuauggaaaaaguacccaaggucacaggggacuccaauggcugaacaaaaagacaagagaaauacuacuccuaauggaauauacuuaagccauuaugugaucuuucuauuaaaaaaaaaagucuagucauauuuaaaaucaccuguaauuuuauugaaaauaggcauuauggugaauaaaaugaaacauaaaauguaagauguuuuauucagucuauggauaauaauaaagauuguauuuuuuauggagucauaaaaguagaguauuuuguuuugaaaggccuguuuuucuggguacuaucauacccauacuucaaacauaacaugagaaaauagacuuugagacagauuuaacaaaauccacaaaauaccacuuuaaaaaccugaugccauauauuuaagguaaugaucacauuuaccauaauacuucauauaaaaacaaaauacuguggugucuuuuaaaaacagaaucucaagaaucuaacuauauucaauucuaacacugaauaacuggcauacauuuauuguaaaagaaauguauucacgggaaauuugcuuagacuucauuuuugcuuucugcuuuuuaaaauguauuuuaaauguaguuagaagaaaauaaguauaaaagauauuuucuagaaaauuauacaaaagcaucuuuuaacucuuaguuuuaaaauggcaacagaaggcugggcacagugacucacaucugcaaucccagcacuuugggagacugaggcgggcagauugcugaggccaggaguucgagaccagccugaccaacauggugaaacccucuuucuauaaaaauacaaaaaucagcugggugagguggcacaugccuguaaccccaguuacuugggaggcugaggcacaagaaucacuuaaacuugggaggcagagguugcacugaggugagaucacaccacugcacuccacccugggugacagagcgagacuccauuucaaaaacauaaaauggcaacagaugcaauuuuuuuguguuaauucugaucuuaauucagauuuuuagauucuacaaugcuuccacagagaauuaguuauaaacuaauuuaaagauagggcauuauuaaacauuaauguaccauaaaaauuguuguaauaaaggacauuuaucuuacccuacauuuaaaccugauuaauacaaacauaaccuguugaauguaaauaucaauauuucuacaauacaauacuguauuguguguguauauaucccaucugaauucaauucauaccuauaaauauuuaguacuuuggguaaauaugauggguuuuuuuaaauuauuauacuuaaaguuuuaggguacaugugcacaacgugcagguuuguuacauauguauacaugugccauguuggggugcugcauccauuaacucgucauuuaacauuagguauaucuccuaaugcuauaccuccccccuccccccaccccacaacaggccccggugugugauguuccccuuccuguguccauguguucucauuguucaauucgaccuaugaaugagaacauguaguguuugguuuuugucguugcaauaguuugcugagaaugaugguuuccagcuucauccaugucccuacaaaggacaugaacucauccuuuuauauggcugcauaguacuccaugguguauaugugccacauuuucuuaauccagucuauuguuguuggacauuuggguugguucuaagucuuugcuauugugaguagugcugcaauaaacauacgugugcaugugucuuuauagcagcauguguuauaauccuuuggguauauacccgguaauggaauggcuggaucaaaugguauuucuaguucuagaucccugaggaaucgccacacugacuuccacaaugguugaaccaguuuauagucccaccaacaguguacaagucuuccuauuucuccauauccuuuccagcaccuguuguuuccugacuuuuuaaugaucgccauuguaacuggugugagaugguaucucacugugguuuugauuugcauuucucugauggccagugaugaugagcauuuuuucaugugucuguuggcugcauaaaugucuucuuuugaaaagugucuguucauauccuucacccacuuguugaugggguuacauuuuucuuguaaauuuguuggaguucauuguagauucuggauauuagcccuuugucagauaaguagauugcagaaauuuucucccauucuguagguuggcuguucacucugaugguaguuucuuuugcugugcagaagcucuuuaguuuaauuagauaccauuugucaauucuggcuuuuguugccauugcuuuugguguuuuagacaugaaguccuaugucuauguccugaaugguauugccuagguuuucuucuagggcuuuuacaguuuuaggucuaacauuuaagucuucaauccaaauuuaauuuuuuuauaagguguaaggaagggauccaguuucagcuuucuacauauggcuagccaguuuucccagcaccauuuauuaaauagggaauccuuuccccguugcuuguuuuucucagguuugucaaagaucagauaguuguagauaugcggcguuauuucugagggcucuguucuguuccauuggucuauaucucuguuuugguaccaguaccaugcuguuuugguuauuguagccuuguaguauaguuugaagucagguagugugaugccuccagcuuuguucuuuuggcuuaggauugacuuggcaaugugggcucuuuuuugguuccauaugaacuuuaaaguaguuuuuuccaauucugugaagaaagucauugguagcuugaugaggauggcauugaaucuauaaauuaccuugggcaguauggccauuuucacaauauugauucuuccuacccaugagcauggaauguucuuccauuuguuuguauccucuuuuauuucauugagcagugguuuguaguucuccuugaagagguccuucacgucccuuguaaguuggauuccuagguauuuuaaucucuuugaagcaauugugaaugggaguucacucaugauuuggcucuccgucuguuauugguguauaagaaugcuugugauuuuugcacauugauuuuguauccugagacuuugcugaaguugcuuaucaguuuaaggagauuuugggcugagacaaugggguuuucuagauauauaaucaugucaucugcaaacagggacaauuugacuuccucuuuuccuaauugaauacccuuuauugccuucuccugccugauugccuuggccagaacuauucaacaauacguucaauaggaguggugagagaggguaucccugucuugugccaguuuucaaagggaaugcuuccagguuuugcccauucaguaugauauuggcuguggguuugucauagacagcucuuauuauuuugagauacaucccaucaauaccuaauuuauugagaguuuuuagcaugaaggguuguugaauuuugucaaaggccuuuucugcaucuauugagguaaucaugugguuuuugucauugguucuguuuauaugcuggauuauguuuauugauuugcauauguugaaccagccuugcaucccagggaugaagcccacuugaucaugguggauaagcuuucugaugugcugcuggauucaguuugccaguauuuuauugaggauuuuugcaucgauguucaucaggguuauuggucuaaaauucucuuuuguuguugugucucugucaggcuuugguaucaggaugacgcuggccucauaaaaugaguuagggaggauucccucuuuuucuauugauuggaauaguuucagaaggaauaguaccagcucaucuuuguaccucugguagaauucggcugugaauccaucugguccuggacuuuuuuugguugguaagcuauuaauuauggccucaauuucagagccuguuauuggucuauucagaguuucaacuucuuccugguuuagucuugggaggguguaugugucaaggaauuuauccauuucuucuagauuuucuaguuuauuugaguagagguguuuauaguauucucugaugguaguuuguauuucugugggaucgguagugauauccccuuuaucauuuuuuauugugucuauuugauucuucucucuuuucuucuguauuagucuugcuagcugucuaucaauuuuguugaucuuuucaaaaagccagcuccuggauucauugauguuuugaaggguuuuuugugucucuaucuccuucagcucugcucugaucuuaguuauuucuugccuucugcuagcuuuugaauguguuugcucuugcuucucuaguucuuuuaauugugauguuagggugucaauuuuagaucuuuccugcuuucucuugugggcauuuagugcuauaaauuucccucuacacacugcuuuaaaugugucccagagauucugguauguuaugucuuuguucucguugguuugaaagaacaucuuuauuucugccuucauuucguuauguacccaguagucauucaggagcagguuguucaguuuccauguaguugagugguuuugagugaguuucuuaauccugaguucuagcuugauugcacuguggucugagagacaguuuguuauaauuucuguucuuuuacauuugcugaggagagcuuuacuuccaaguauguggucaauuuuguaauaggugugguguggugcugaaaaaaauguauauucuguugauuugggguggagaguucuguagaugucuauuagguccacuuggugcagagcugaguucaauuccuggguauccuuguuaacuuucugucuuguugaucugucuaauguugacagugcgguguuaaagucucccauuauuauugugugggagucuaagucucuuuguaggucucgaaggacuugcuuuaugaaucugggugcuccuguauugggugcauauauauuuaagauaguuagcucuuguugaauugaucccuuuaccauuauguaauggccuugucucuuuugaucuuuguugguuaaaagucuguuuuaucagagacuaggauugcaacaccugccuuuuuuuguuuuccauuugcuugguagaucuuccuccuucccuuuauuuugagccuaugugugucucugcaugugagauggguuuccugaauacagcacacugaugggucuugacucuuuauccaauuugccagucuguaucuuuuaauugagcauuuagcccauuuacauuuaagguuaauauugucaugugugaauuugauccugucauuaugauguuagcugguuauuuugcucguuaguugaugcaguuucuuccuagccucaauggucuucacaauuuggcauguuuuugcaguggcugguacugguuguuccuuuccauguuuagugcuuccuucaggagcucuuuuagggcaggccugguggugacaaaaucucucagcauuugcuugucuuuaaaguauuuuauuucuccuucacuuaugaagcuuaguuuggcuggauaugaaauucuggguuaaaaauucuuuucuuuaagaauguugaauauuggccuccacucuauucuggcuuguagaauuucugccgagagaucagcugcuagucuggugggcuucccuucauggguaacccgaccuuucucucuggcugcccuuaacauuuuuuccuccaugucaaguuuggugaaucugacaauuaugugucuuggaguugcucuucucgaggaguaucuuuguggcauucucuguauuuucugaauuugaauguuggccugccuugcuagauuggggaaguucuccuggauaauauucugcagaguguuuuccaacuugguuccauucuccccgucacuuucagguacaccaaucagacguacauuuggucuuuucccauagucccacauuucuuggaggcuuuguucguuucuuuuuauucuuuuuucucuaaacuucucuucucacuucauuucauucauuugaucuuccaucacugauacccuuucuuccaguugaucgcaucggcuacugaagcuugugcauucgucaugaaguucucgugccaugguuuucagcuccaucagguccuuuaaacacuucucugcauugguuauuccaguuagccauucgucuaaucuuuuuucaggguuuuuaacgucuucgccauggguucaaacuuccucuuuuagcucagaguaguuugauagucugaagccuucuucucucaacuugucaaagucauucucuguccagcuuuguuccguugcuggugaggagcuguguuccuuuggaggaggacaggcgcucugauuuuuagaauuuucaguuuuuuauguucuguuuuuuccccaucuuugugguuuuaucuaccuuuggucugugaugauggugauguacagaugggguuuuggugucgacguccuuucuguuuguuaguuuucauucuaacagucaggacccucagcugcagguccguuuggaguuugccggagguccacuccagacccuguuugccuggguaucggcaguggaggcugcagaacagcgaauauugcuaaacagccaauguugcugccugauuguucuucuggaaguuuugucucagaggaguacccggccaugugaggugucagucugccccuacuggggggugccucccaguuaggcuacucgggggucagggacccacuugaggaggcagucuguccauucucagaucucaagguccaugcugggagaaccacuacucucuucaaagcugucagacagggacauuuaagucugcagagguuucugcugccuuuuguucggcuaugcccugccccgagagguggagucuacagaggcaggcaggccuccuugagcugcgcugggcuccacccauuucgagcuucccagcugcuuuguuuaccuacucaagccucagcaagggcgggcaccccuuccccagccucgcugccgccuugcaguuugaucucagacugcugugcuagcaaugagcgaagcuccguguacguaggacccuucaagccaggcgcgggauauaaucuucuggugugccguuugcuaagaccguuggaaaagcgcaguauuagggugggaaugacccaauuuuccaggugccaucugucaucucuuuccuuggcuaugaaagggaauucccugaccccuugcgcuucccaggugaggcgaugccucgcccugcuucggcucaugcucggugcgcugcacccacuguccugcacccacuguccgacaauccccagugagaugaacccaguaccucaguuggaaaugcagaaaucauucgucuuccgcgucgcucaugcugggagcuguagacuggagcuguuccuauucggccaucuuggaacugccccaguaugaugguuuuuuaaaaaucauaguuugucauugugauaauagcugaaaacagagcaaaugcuaccagaguuaaguuuaucuuccaagauaugaguagauuaugaauaauauuagaaaaagaaaauaagcauauuuugauaguacuaaaacagauuuacaaauaaaauuuacucaaaauucaaaagcgucauuccuacauuguuucauuccuccaagggccagugaaauaugauuggcaauguuuuucuuugacagacuaauauuaggaucauuaaagauaaagaaaaauuuuaaaugauugucuagugguuaucaacgaacugauucuaaacuuuauguagaaaugcaaaagacccagaauagcuaacacaauacugaagaacaaagcuggaggacugauacuaccugacuccaaggcuuccuauaaagccacaguaaucaagacagugugguauuggcuaaagaauagacaaaccaaucaaugcaacagaacagagagcccagaaggagacccacauaaauauacucaacucgcuuuugacagaagagcaaagggaauacaauggagcaaagagcccuuucaaaaauggugcuagacagccacaugcaaaaaugugaaucuagaacagaccuuacacccuuaacaaaaauuaacaaaauggaucauagaccuaaauguaaaauauaaaauuauuaaaauccuggaagauaacacaggagaaaaccuagauaacucugaauauggugaugacuuuucugagauaauaucaaaggcagaacccacucguaugaaagaaacaauugauaagauagacuuuguuaaaauuaaaaacuuaugcuccaugaaaaacaaugucaagagaaugagaaaacaagccacugccagagagaaaauauuuauaaaugauacaucugauaauggaccauuagccaaaacauacaaagaacucuuaauaauuuuaaaaaccugauuaaaaaaugggccaaagacuaacagacaccucaccaaacaagauauacagauggcaaauaagcauauaaaaagauacucaacauugcaugucaucaggaaagugcaaauugaaacaagauaucacuacauaccuacuagaauugccaaaaucccgaacacugacaccuccaaaugcuggcaaagauauaaagcaacagaaacuuucauucauugcuacuggaaaugcaaaauaacacauccacuuuggaagacaguuuggcaguuucuuacaaaacuaaacauacucucaccauaaaugaaccagcaauuacauuccuuggugucuacucaaaggagcugaaaaugcauguccacaaaaaccccugcacauggauguuuauagaaacuucauucauaauugccaaaacuuggaagcaaccaaaacauccuucaauaggugaauggguaaacuggggucauccagauaacagaauaccauugagcauuaaaaauaaaugagcugucaagccaugaaaagcaugaagaaaccuuaaaugcauauuacuaagugaagaaagccaaucugaaaaggcuacauacugauuccauacugauuccaacuauaugacauucuggaaaaggcaaaacuguggagauagaaaaaaaaaagaucagugguuaccacauguuggcagggaaugaacaggcagagcacagagauuuuuaggguagugaaaauacucuguaugauauuauaaugcuggauacauggucauuauacauuuguccaaacccacagaauguacaacaccaagaaugaucuuaauauaaacuaugaacuguaagucauuaugaugcgucaaugaaaggucaucaauuguaauaaauguaccacucugguggggguuguugacaauaggggaggcuaugcaaggguggggucaagggggcacauggaaaaacucugucucucucucaauuuugcugucacccuaaaacugcccucaaaaaacagucuuaaaaaacaaaaugcuucucuacuucccaucuaaaaaucacuuggccagauccuuggauuacacaucuuuacacaaauaacuaaaacaaguccugcacuaaagugaugcaaaauccaggucauucuccaauaaauaaacuacaaacacaaauuuaaaaucucucauauucauaugagccaaaugucaaugaacauaagccauuccucaaugaugucucauacuaaaaugugaaguuaacgauuuagugaacaauaaaccuaucaaagaaauaucuuuuauauguauguaaaaagaauuuuacuuuguauaauuuuucaaauucuaggccaauacaucuauuacuuuauaaaaccugcuuccaaaggacaauggugugucuuuguaaggaaaauggauauaaauauagcagaaggcagaauauaaaagacagagaaauuggguuuaaaacagaauugcuaaagagcuagaagaaacaaccacuuaggaggcucuucucagauccaaaugcuuuaaaagcuagaucucuccacaccuuugucauucucauuuugauugucuguuuucuguuuuugugaagaaucugcccaaggccauaaacggauuaugcuaaagagagguuaaaacucuaaaguucugguuuuauaggcccaaguucggcucaugccauucaaucccauaaugaauacauguauucuauuuuucuaguuugaauucugaaguucaccugggaugauaacuugacacuguuaaauuuagaugaaaauuaauucaauuaaaaguauagucuauuguauuuagcuuuaguuccuuauuugcauuugcuagaaaaaccaaauacucugaugcugauguaaacuauuucacuguccauucauacccuaguuuaauauuuucuguccgcugcuagaugugcucuauaaauacacuuaaaauaagucccuaaaaagcaccaaauacauccacauaguucucguuuauagaaucagggcaguauguagucagacaguuaauaaauguucucucauaaugauaacagacacagaagcaacauucuuaagucgaucaauacauauccaacuaaguugccaaugucaaagguagccugauuccaauucagaagaaaaugccucaagggcaaggaagcuuuaaauguuauuauuuuuaaauguguucagugaguuuguacuuuuguagcagauggagccaaacuucugguauugauuaaaauuuaacauuauuuuuaaaugaccuagaaaauuuauugaguauaagaacacaauguguucauguucugaaaaauuccaaaauguuuuaaagcacauaugaaacacaaaggcacaauacucauucucaaauugacaaguucaucgacugcaacaaaguauucugucaacagucuacagguacacucugugagaaaagguggaaacaggagaagcaggaauguuuggacgguuuucaguuuguaauauccucuugcucugaugcuucaaguguaauauauuuugaggcacagauuuacagauuauuugaaauguuaagacacaauuuugucucuuuuuguuaccuucaaacuuacucaacaaguauacuuggucaaguacacuucagaaaucugaaggcuuauuggaaaaggcacagaaauaacaucaaaaacuacuguauaauauagauaaauauuauugucagagguguucaaaccagagcaacuccaccuugaacagggguuggguaaaaugaggcugacuccugcugggcugcauucucaggaggucaggcauucuuagucacagaugagauaggagguugguacaacauacaggucacagaacccccacuaauaaaacaugaugcaguaaagaggccaaccaaaacccaccaaaaccaauauaaugacaaaagucaacucuggucguccucaccgcucacugcacacuaauuauaaugcauuagcaugcuaaaagacacucccaccaugacaguuuacaaaugccauggcaaugccuguagguuguccuauauagucuaaaaagaguaggaacauucaguucugggaaauucacaccccuuucccaaaaaacucacgaauagccuaccccuuguucaguuucuauaaucaagaaauaaccguuaaguauccucagucaagcagcccaugcuccuacucugccuacagaguggcauucuucuauuccuuuuuuuuuuuuuuuuuuuuuuuuuugagacggaguuuugcucuuguugcccagacaggagugcaguggcaugaucucggcucauugcaaccuccaccucccagguucaagccauucuccugcuucagccugccaaguagcugggauuacaggcaugggccaccacaccaagcuaauuuuguauuuuuaguagaaauggaguuucaccauguuggccaggcuggucuugaacuccugaccucaggugauccacccaccucagaauaccaaagagcugggauuacaggcaugagccaccacaccuggccuccuuuacauucuuaauaaacuugcuuucacuuuaaucuguggacucaccaggaauucuuucuugcgugaaauccaggaauccucucuugggguuuggaucaauaucccuuucugguaacacuaucaaagauaaguuugaggugguaaaggaauacagguaaaagauauuuaaaucagacaguagaugaaagugagcggggcuacugagagaaaacaacaauuaagaauaagaaauuguggaagaaaaggaaaagaaggcacuccagguagagggguacaucacaugugaaaugugaugcguuuguaucccuccaaguucaacgggcuguagccaacauaguauguugugguguggucuuaguucauccagaaggggaagaaccaaguugaaccaauagagaaaggaaggacuagaucacaaagaacuuuauaggcuuagcuugaaguucaaacuuuacccuuaaaacugugaaaagguuuuagauuuuaaguauauccugaaauuaucuccuaaaaacaggaggacauggaaaaaguauauauacucuaugccacugcacagccagcaagauagccacccuuuucuacacaagcagaagacuaaagguucaaccucugaagauguggaaugagacagauacuacaaacagcuaaaggugggacugaagagugguacugaaaacagaggcauuaugugaaaaccuguacaccaaauggugaggacaucauuccugcuuccaccacugggcucccacaaugaugcuggucuuaaacuaacucccugagcagauuaugagguucuucucuaagaaaaccaauuggcccaagagauaaaacaugcagauacugauauuuguuugaucucccaacaaaacaucuagauuguuacccaaauggaaaaaagauaagcaaagacacagcucaaaaaaugagaaagauuuccacaccacaacaucacugugaaauuauagaacaccagggacaaaaagaaaauccuacaggccuccaaagagaaaggcaaaggaggagaaaaacaagucacauacaaagaaucaggaauugaaaaguaauacagaagacuggugaagagauucccagaauaacaaaaaguggaaguauaaagaggagagcuagguaguaugccaagagaggaaaccaaugcaaacuugagcagaauaaugaaagaauccagaagagaagcuucugaggaaaccacauaucugauggauuauuugagguguuuguacuugagagauauuuuaaaauuccaucagaggguugggagacagagauagauacauauaagaauacgcaaaugggggaaaaaguaacauacaagagcaaagaaaauuuuaauuccucccccuucugaagguuugauaauuugugucuauaaaacaaacugacaauagacagauuagcagaagaaaagguauucaagaccggguacgguggcucaugacuguaaucccagcacuuugggaggcugaggcaggcagaucacuugacguauggcguucaagaccagccuggccaacauggugaaacccugucucuacuaaaaauauaaaaauuagccagcauggagguggacaccuguaaucccagcuacuugggagccugaggcaggagaaucacuugaacucaggaggcagagguugcagugagcugagaucgcgccacugcacuccagccugggcaacagagugacacagugucucaaaacaaacaaacaaaaaaaaagguauauaaauuuauaaacacgcacaugugcaggggagccacacaaaauaugagacucuaagaagggacaaaugacugaaguuuuuauaccauacagaaaauacagaaaagagucaggggcuuggagcuccagagugggggaagauagcuuacagguuguggaagggugaggggaggaaaugcaagcugaacaaaagcuauuuuguauuacaaaugaaaucucucagguagcagcccucagaaagaauagaugguagccuguugaaaaaguuucucugucacaccuuuaacagugucagaccuucagucucuuuuccugaguuaguuuuuuccuaaauccaaauaaggcagauaagggauucucaaagaaaguccauuucugucugcuguuuacuuuccuaguguggauuucuaccagggaugcaaaucucccccacaaauggacagcuuuucagagcuauuccucuuucuguagcuuuucugaauagccaucucaaaauaugccaaagcaguguauuuugggguggcauauuuauuccacagaagcuauauauauauacauauagugagucucacucugaugcccaggcuggauugcaguguugugaccucagcucacugcaaccuccgccucccagaguugugauucuccuaccucagccugccgaguagcugggauuacaggcgcacagcagcaugcccggcuaauuuuuguauuuucgguagagacaggguuucaccaugcuggccacgcuggucucaaacuccugaccucgugauccgcccaccuuggccucccaaagugcugggguuacaggugugagccaccacaccuggcccuagaagcacuauaugaaccccaagagaaaaaauuuuguacaaggaagauccaaaaauauuuaacaaauuguaauuuaggccaauuuuaagcaagauaaaagaaauuaacauacaaacaauaccaaucagaaauauaacuuaacuaucuugaaauaacugaaagaugaucacuggagaagggcgguauuuagaccuaaagaagcaguauuuggcucaagagaaaaaaggacuuucuaagacuuugaacuguguaaaaugaaaugacuuugugacauuaaguggcucugucuuuuuucaugcuuuuuuauggccucuucugugcugcuuuacaacuuauguauuuacuuauaucuuuccaacuagacuaaaaagaagaaccaugucugauauacuguaauauguccagcaccuaacacagugccugccccagggcagcauucaaaagguauuuguuaaauugauaaauaaaaggcccugaagcugaagagccauuuaauggggcacuguagauagaccacaagaucuguaaugcacugggucagauaaccuuaaagcccuuucuaauccuaagauuauaaaacccaagcccuaggagguaaaaggaaacuaguccuuuuauuucaaaauuacuuaaagguuguccuauuauaaaaguguccauacaaugcuaucucuaaaaauguuaggaaaccgugcuuuaaauacuaagggaauuugagcucuuuggaauaaaaacacccacaaauccaaauauaguauucaaaugcaaguacagaaugcacuguauauacaaguugagcaucucaaaucuaaaaauccaaaauccaaaauguucuaaaaucuaaaacuuuuugagcaccaacaugauguucaaaggaaaugcucaucggagcauuucagauuugggauuuuuggauuugggaugcucaacugguaaauauaaugcaaauauuccaaaauaaagagaaaacacaccaaaaucugaaacacuucuggucccaagcauuucgaauaagagauauuuaacuuguauacucuuaacuuuaaauaauauauacauuuaacugauagggauacagaauaaaauaucaaagcauugaauugaagaaaaauaacuauaauuuaugucaaaaauauaugguugcaucuuauuuucaaaauaaguauauuagaugaaguccuuaagaugauaucauuaauuauaaucaaauacuaugcugauucuauauauaaaaccuaugggacugcuacauucuuuugaaauauauauauauauauauaucuauauauauaaaugaguuuguuguuauuaacauuaucugcauaaucuggugguauaaguaacuauuccuuagguucuuggucguucuuaaagcuuugauuaagagggcuacuucccaccauccacaucauagugacucaaacugcuucaugcauuaccuuaucacuuucuucacaucacaaugacugauguuccaugggacucuuaaaagcaugacuuaucuuuaucuagcuugcuguccuuccagaaucccaauauguaacaauugucuucagcagaacaucucaagugucucaccauggcuguguacuaaugaaucaguagaguagauuaaaaaguagaaaguacauugugauagcaacuuucuuuuggugauacucaaacagacagguaaaaauuuaauggauuaagcaagguauacaacacaauucuacuuagagcauggauccaaagagauguaucugauacuauaacauaccauaagcagccugggaguaguacaaugcucacaaugcccaaaaauacuuuggccacuaaucaaaaugagauguauucaugugcuaaaugcuaggguacuuuuaaaacaaccaaacugauuuaaguccauuauaaaaagugaggccaggcauugugguuuaugcuuguaaucccagcacuuugggaagccaaguggaagaaucuccuugagcccaggagacugagacuacccuggacaacaaagcgagaugccaucucuacaaaaaauaaaauuaaaaaauuagccaggcaugcuggcauacaccugugguccuggcuacacaggaggcugaaguagaaggauuccuugagcccaagacgucgggacugcaguaagccguaaucauaccacuacacuccagccugggugacagagugauauccugccucaaaaaaaaaaaaaaaaaaaaagugacaauuaaauuagaaauuguuuaauggcaaauuauuuaaaaauguuuuccuuacagcacgugcagauuuaggcugcuauaagugagaguuuagagguauuuauauugucuauuccagcauacucuaauacuaaaaugagauuuuucaggaauaccaacauggaaaacaaacuuuauuguacuacaaauaaaggauacaaaaaguuaucuuucugguuauuaaaaagaaacuaauuaauagcaucaaaggcaaaccauaaaggaaaaucauaaaaagauaaaagaaauugacauuauacauauacuuggauguaugaugggaaagugugcaaauaggaaggugucuaacucuccaaucgaguauuaaaauucaacaaaagucaauucaacacauauuuacugaaugccugcuauguacacacagauaucagacauaaagaaaaaccaugaacacagcagauagggucugugcucuacaagagcugaaaguuuagcauggaggagaggcaauuaaaaacaguuuaagaaguacuaugcugaagaauuacaggugcaacuggaacaaagaagaggggugucuaauucagacauggaccaucaggaaacuucuggaggacuggaaaauggcggaagaauaggagcuuccagcagacacacauucauucucaaacuuauuugagaccaugcucucagaaauacuuccgggaugggaaagguagaaaaggacaucccgcuaauuaacagguaaaagcuaccaagucuuuauaauuuauauguuaaugucauuaugaccuuaugugaaaacacaggcuaauggggcccuuaacaguguauauaugugcagaaagaagacagcaggaguauaaaucaaaauguaaaaauaauucucaguagguagcaggguuauaggugaauuauaccuuuuuuuagcuuauuguuugauuuuucuauaaugaacauguaagaaacagaaaauuuuugucuugaaggaaaauaccccuguauauucaagacaaaaguuuacauauucuuauaaaaagagcuucugaaaauucaguaagaacauauaaaccucuaauaaaaaaauuuaggaaaaggacuuaaaacaggcauuucauaaaagaagaaacacagucaauaaaaaauuuuaaaaauauauccuauuaacaauuaaaauugcacauuaaaaugacagugaaauccaaauuuucaucagcaaauggcagauguugucaguaaggauacgaggaaguaaaccuucucacauacagguugagcaucccaaaucugaaaaugcaaaauccaaaaugcuccaaaaucggaaacuuuuugagaacugacaugacacucaaaggaaaugcucauuguagcauuucaaauuucaaauuuuuggauuuggaauucucaaccaguaaauauauauaauacaaauauccccaagucugaaaaacuucaaaaucugaaacaccucuggucccaagcaucucagauaaaggaaacucaaucuguacuacuaguaggaguuuaaaacacuguaauauuucuggagaguuuaaaaugugcauauauacuguuugacccauaaucuccaacucugaaaaaauauacuaaagaaaacauaagaugacugaccucuaagaauauucaucacaggcagaaaaaaagaggaaaacaaccuaaagagaacgaauuaaauaaaccacaguacauaguagaaaacuaugagaccauuaaagagcauuuagaauagcguaauaauguuauauguuucccauuuuuaauuuuuuaaucaauaaauacaaucauaauuaaaauauuuuugucuuuuaaaaugguuugaaagcaucgagguauuuauaaaacacacaaugauggugucuaguaaggauaaaauaagacccuaacucagccauucaauuaacccuauuugucacuguaggggguuuugacugaugucuuuuuugguuuguuuuuuguuuuuguuuguugguuuguuuuuuguuuuugagacugagucucacucuaucgcccagguuugagugcaguggggcgaucuuggcucacuacagccuccaccuccugaguucaagugauucuccugccucagacucccaaguagcugggauuacaggcacccgccaccacaccuggcuaauuucuggauauuuaguagagacaggguugcacuauguuggccaggauggucuugaacuccugaucucaaaagugauccaccugccucagucucccaaagugcugggauuacaggaaugagccaccacgcccagcugcuguaguuuuuuuaaaugcuauuauucauauuguaaauucauuaauuagggcacacugauuuuuuaaaggaaguuuaaugaauaaugauacuguaauacaguaaguugagaaggaauauaaauguuauaauaaucaaagaaauucaguucugaauaaugauaaagagcuauaguuuuggaaagagaccugaguuuaaacccuugaucuguaacuuaguguguuuauacaaaacacuuaagcucucuggcuucagguuuuuuaucugcaaacugucugagagcauuaaauaauuuauguagagagcuuagaauucugcaugguguacacauaauauguaauccuaagacuuugaccccaagcaaacuaaaaaccaccuagaaacacaguggucugucccacaucuggaauagcuagccagcugucugggacacucagcucaaaauuucuccuguaucucuuaaaauuuuaacaucaacuauaguaucacaauuuuagaugaaggcacacuauugaagguaccacaugccuuucaccaaacauggcagugacuguauugauuuuucuccuuuuaaacagacuucauuuuuuagaacaauuuuagauucauacaaauggugagcagaaaauaaaaaguuccuuuggccucaaacacacacaaccuccgcaacuaagaacauucuguaccagaguggcacauguguugcaacugaugaaccuacaccaaugacucauuaucaucuggaguacacaguuucuauuaggguucuaucuugcuguaguauguucuauagauuuggacaauccaccauucuaguauacagaauaguuacacugcccuaaaaauccucugcacuccaccacucaucccuaccuccugcccaauaucugguaaccacuaaccuuuuuacugucuccauggguuugccuuuuccagaagucauacaauuggaauuauauaauauaaagcuucuucauguugucaucuuucaauuaguaauaugcauuuaagguuucuccaugucuuaaggcuugauagguauuucuuuuuuaccagugaguaacauuccauugucuaaauguaccacaguugauuuacccauucaccuagugaagaacaacuugguuguuuccacauuuuggcaauuaugaauaaaguggcuauaaacauccuugugcaggauacuguaugaacauaaguuuguuuuuuuaaaguucagggguacaugugcagguuuguuacauaggcaaacuugugucaagggggucuguuguacagauuauuucaucacucagguauuaagccuagugcccauuaguuauuuuuccugaaccuauucuuccucccacccgccacccucugacaggccccagugucuguaguuccucucuaugugucugaguguucucaucauuuagcucccacuuguaaguaggaacaugcgguauguggucuccuguuccugcauaagauuguuggcugcauguaugucuucuuuuaaaaagugucuguucauguccuuugcccacuuuucaauggggcuguuuuuuucuucuuguaaauuuaaguuccuuauagaugcuggauauuagaccuucguuggaugcauaguuuccaaaauuuucucccauucuguuuguugauaguuucuuuugcugugcaguuuaaaguuugcucuuuaguuuaaauagaucccauuugucaauuuuuguuuuuugccauugcuuuuggcaucuuugacauaaaaucauugccagugccuauguccuuaaugguauuaccuagguugucuucaaggguuuuuauaguuuuguauuuuacauuuuagucuuuaauucaucuugaguuaauuuuugaaaaugguguaaggaaggagucuaguuucugucuucugcauguggcuagccaguuaucccagcaccauuuacugaauagggaauccuuuccccauugcuuguuuuugucaggucugucaaagaucagauaguuguggguaugcagucuuauuucuggguucucuauucuguuccauuggucuauguaucuguuuuuaugccaguaucaugcuguuuugguuacuguagccuuguaguauacuuugaagucauguagcaugaugccuacagcuuuguucuuuuugcuuaggauuaccuuagcuauucagguuccuuuuugguuccauaugaauuuuaaaauaguuuuuucuaguucugugaagaaucucaaugguaguuuaauagaaauagcauuaucuauaaacugcuuugggcaguauggccauuuuaacaauauugauucuuccuauccaugagcauggaauguuuucccauuuguuugcaucaccucugauuuauuugagcaauggcuuacaguucuccuuguagagaucuuucaccucccuaguuagcuuuaucccuagguauuuuauucuuuuugugggaauuaugaaugggauuacauucuggauuuggcucguggcuugacuguuguugguguauaggaaugcuagugauuuuugcacauugauuuuguauccugcaacuuugcugaaguuguuuauuggcuuaagaagcuuuugggcugagacuaugggguuuucuagauauagcacugugcaaacagggauaauuugacucccuuccuauuugaaugcccuuuauuucuuucucuugccugauuacccuggccaagacuuccaauacuauguugaauaagaguggcaagggagggcauccuugucuugugccaguuuucaagggaaaugcuuccagcuauugcccauucaggacgagguuggcugugaguuugucauggauggcucguauuauuuugagguauuuccuucaauaccuaguuuauugagaguuuuuagccugaggaaauguugaauuuuaucaaaagcauuuucugcauguauugagauaaccaugugguuuuuguccuuuaguucuguuuaugugaugaaucaaucauguuuauucauuugcauauguugaaccaaccuuauaucccagggauaaagccuacuugaucgugguggauaagcuuuuuaauguggugcuggauucaauuugccaguauuuuguugaggaauuugccuugauauucaucaaaaauaauggccugaaguuuuccuuuuuuguuguaucucugccagguuuugguauaagggugauacugaccucauaaaaugaguuacaaaagagucccuccuccucaauuuuguggaauaguuucagugggaaugauaccagcucuucuuuguacaucuguagaauuuagcugugaauccaucugguccugggcuuuuuuugauggggaggugugguaggcuauuuauuacagccucaauuucaggaccuguuacuggucuguucauggauucaacuucuuccugguucagucuuggguggauguauguugaggggacugaaguuuuaauuuuauuuggguaaauuuaaaaacugguaauagaauaaugcuggccucauauaaugaguuagaaguauucccucuacuucugucuucuagaagagauugcagauaacugauauaauuuauucuguaaacauuugguaaaauucaacaguaaaaccaucugguccuggugcuuucuauuuuggaagguuauuaauuauugauucaguuucuugaaaauauacauacuuacucaguagucuauucuucccauuugaguuuugacauuuuguaucuuuucuuccuuccucccuccuacucucucuggcauuccugaggaagaagagaaaucuaaaaguuuggaaaacuuauuuuagggaauaauccaggaaaacuuccccaggcuugccagagaucuagacaucuaaacacaagaagcucaaagaacaccugggaaauugguugcaaaagaucaucaccuaaggcacauagucaucagguuaucuaaagucaagacaaaggaaacaauauuaagagcugugaggcaaaagcaucaaguaaccuauaaaagaaaaccuauuuagauuaaaagcagauaguucagcagaaauucuauuagccagaaggaaaugggguucuaucuuuagcauuguugaacaaaauaauuaucagccaagaauucuguauccagcaaaacuaagcuucauaaaugaaggagagauaaaguauuuuucagacaaagaaaugcugagagaacaugccacuaccaagccagcacuacaagaaaugcuaaaaguucuaaaucuuaaaacaaaacaucgaaauacaccaaaauacaaccuucuuaaagcauacaucucacagggccuauaaaaccguaacacaaugaaaaaaaaggccaugguuuucaggcaacaacuagcaucaggaauagaacaauaccucauaucucaauacuaacaucgacuguaaauggccuaaaugcuccaugugaaagauacagaauggcagaaugaauaaaaauccaccaaguaucuguugucuucaagagacucaccuaacacauacggacgcacauaaauuuaaggaaaagggauggaaaaagguauucccugcaaaugaaagccgaaaguaagcaggaguaacuacuuauauagcagacaaaacagacagaucauauaccuagaaaacccuaaagacucauccaaaaaguucuuagaucugauaaaugaauucaauaaaguuucaggauauaaaaucaauguacacaaaccagcagcacuuauacaccaacagugaccaagcugagaaucaaaucaagaacacaacaccuuuugcaacgacuacaaaaaauacauacauacauacauacauacauacauacauacuuaggaauacaccuaaccaaggaggugaaagaucucuacaaggaaaacuacaaaacacugcugaaagaaaucacagaugacacgaaaaaauggaaacacauccuauccugauggacggguagaaugaauauugugaauaugaccauauugccaaaagcaaucuauaaauucagugcaauucccaccaaaaugccauaaucauucuucacagaacuagaaaaaaagaguccuaaaauucauauggaaccaaaaaagagcucacauagccaaaacaagacuaagcaaagagaauaaaucuggaggcaucacauuacccaacuucaaacuguacuacaaggcuauaguuaccaaaacaggauaauacugguauaaaaacaggcauguagaggccgggcacgguggcucaugccuguaaucccaacacuuugggaggcugaggcggguggaucgccugaggucaagaguucaagaccagccugaccaacauggagaaauccugucucuacuaaaaauacaaaaaccagccaggcaugguggcacaugcccguaaucccagcuacucaggaggcugaggcagaagaauugcuugaacccaggaggcggagguugcagugagccgagaucgcgccauugcaccccagcccgggcaacgagagcaaaauuccaucucaaaacaaacaaacaaaaaaaggcauguagaccaauggaacuuagaaauaaagccaaauauuuacagccaacugaucuucaacaaagcaaacaaaaacaugaaguggguaaaggacacccuagucaacaaauggugcugggauaauugacaaaccacauguagaagaaugaaaccagauccucaucucucgccuuacacaaaagucaacucaagaugcaucaaagacuuaaaucuaagacccgaaaccauaaaaauucuagaagauaacaucagaaaaacucuucuagacauuagcuuaggcaaagaguucaugaccaaguacccaaaagcaaauguaauaaaaacaaagauaaauagaugggauguaguuaaacuaaaaauuucugcacagcaaaagaaauaaucaggagaguaaacagacaagccagagagggggaaaacauaucugcaaacuaugcaacccacaaaggacuaauacggagaaucuacaaggaagucaaauaaaucagcaagaaaaaaacaaauaaucccaucaaaaagugggcuaaggacaugaauagacaauucucaaaagaagauauucaaauagccaacaaacauaugaaaaaauggucaacaucacaaauuaucagggaaaugcaaaugaaaaccacaaugcaauaccaccuuacuccugaaagaauaaccauaauuaaaaaaucaaaaaaaaauaauuuuuugguguggauguggugaaaagggaacacuucuacacugcuaguggaaauguaaacuaguauaaccauuaucgaaaacagcauggagauucuuuaaagaacuaacaguagaacuaacauuugauccagcaaccugaguacuggguaucuacccagaggaaaagaagucauuauaugaaaacgacacuugcacacacauuuauaacagcacaauuugcaauugcaaaaauaugaagccagccuacgugcccauuaccaacaaguagauaaagaaaauaugguauauauauacacacacacacacacacacacacaccauggaauacuacucagccauaaaaauaauaaaauaauggcauucacagcaaccuggauggaguuggagaccauuauucuaagugaaguaacucaggaauagaaaaccaaacaucauacguucucacuuauaaguaggagcuaaguuaugaagacgcaacaguauaaguaugauauaaugaccucugaggacucaggagaaaggcuggaagggcagugagggagaaaagacuauacaauggguacaguauacaaugcucaggugauagaugcaccaaaaucucagaaaucaccacuaaagaacuuauucauggaaccaaacacgaccuguucuccaaaaacuauugaaauaauuuuaaaagacagaccaauaaacacguuacgaauuuuuaaaacuuuuuauuucagaaauaauuguagagucacuagaaaguugcaaacauuguacagaaaauucccacguaccuuccauuaaguuuucucuaagggcuacauuguauguaucuacaguauacuauuauaggcagaaaauugacacugguauuauguguguacauauuaauaguucuaugucaucuuaucaauuguauacauucucauaaccacaagcacaaucaagacccagaaguguuccaccaggaugcucacucugugauucuccuguuaaauaaauguguuugccuuuucuccaaaagggacaaaaacaaaaaaacuagaaaauuaaaaaacaaaaguguugcaucaccacaaaccucucccugcugcuaucccuugcaaaucacccccuaacacacacacacccuucucuccuccaccaucucuaaucuaaacacuggcauccauagaucuguucuccauuuccauaauuuugucauuuuaagaauguuauauaaaccagcagucaccaaccuuuuuggcaucagggaccaguuucauggaagacaacucuuccacagacuaguggggguaaugguuuugggaugaaacuguuccaccucagacaauuucucuuggggacaggggguacauguagggcaugguuuugagaugauacuguucuaccucagauuaucaggcauuaagagucucauaagcagcacgcaaccuagaacccucgcauucacaguucacaauaggguuugcgcuccuaugagaaucuaguguuaccacuaaucugacagcaggcagagcucaggugguaaaugcucacuugccugcuguucaccuccuacugugaggcccgguuccuaacaggcgauagagugacaccugucuguggcccagggaugggggaccccuggguuauaaggcaguacuugcaagccuccugguaacuucaaaucaaaaaacuuaccauagauacacaaaaaguaagaagcaagaaauuaaaucauaccaucagagaaaaaucacauucacuaacaggaauacaggaaggaaggaaaaaaggaaagaccacaaaaucaccagaaaacaaaauggcagaaguacguccuaaacuaucaacaauaacauugaacauaaacagauuaaacucuccaaugagaagacacagaguggcugaauggauuuuaaaaaacccaaugcugcuuugccuacaagaaaaccacuucaccuauaaagacacacaggcggaaaauaaagagauggaaaaagauacuccaugccaauggaaaccaugcagagcagaaguagcuauauuuacaucagacaaaauagauuucaagacaaacuauaagaagacacaaagguaauuauauaaugauaaaggggucaauccagcaagaggauguaauaauuguaaauauauaugcacccagcacuggagcacccagauauauaaagcaaauauuauuagagcugaagaaauagaccccaaaacaauaauaaccguaggcugggcaugguggcucacuccuccaaucccagcacauuuggaggcugagaugggcagaucgcuugaauccaggaguuugagacuagccugggcaacauggcaaaaccccauaucuacaaaaaaugcaaagcuagcuaggcaugguauugcgcaccuauagucccagcuacucaggaggcugaggugggaggaucguuuaagcguggagguugcaguaagccgagaucuugccgccacacuccagccugggugacguagugagacuccaucagaaaaaauaaaaauaaaaacuaaaaaaaacuauagaccucaauaccccacuuucagcaucagacauauacuucagacagaaaaucaacaaagaggccaggcaugguggcucacgucuguaagcccagcacuuuggguggccaaggcggguggaucacuugaguucaggaguucaaggccagccugaccaaugugguaaaaccucauuucuacuaaaaauacaaaauuaauuagccaggcaugguggcaugugccuguaaucccaacuaaucaugagacugaggcaggacaaucacuugaacccaggaggcagagguuacagugagccaagauagugcaacugcacugcugccugggcaacagagcgagucucugacucagaaaaaagaaaaaagaaaaucaaaaaagaaacaucaaauuuaaucuguguuauaggccaaauggaccuaacagauauuuacagaacacuccuuccaauggcuauagaaaauacauucuuugccucagcacguggaucauuuucaaggacagaccauauggcaggucacaaaacaagucucaaaacaguuaaaaaaaaaaaaaacuggaauaauaugaagcaucuuuucugaccacaauggaauaaaacuagaaaucaguaacaagagaaauuucuggaaacuacagaaauacacggaaauuaagaaauaugcuucugaauggccaguggguccacaaagaaacugaggaaaaaaacugaaaaauuucuugaaacaaauaauggaaacacaacaucccaaaaucuaugggauacagcaaaugcaguacugagggcaguuuacaccuggaagugucuacaucaaaaauaaaagaaaaauguaaaauaaaccaccuaaugaugcaucuuaaccagaaaagagcaaaccaaacccauaauuaaaagaaaagaaauaauaaagauuagagcagaaauaaacuugaaaugagaaaaacaauacaagagaucaacaaaccaaaaaguugguguucugaaaagguaaacaagauugacaaaccuccuagagacauacaaccuaccaagauugaaccauaaagaaauccaaaaccugaagagaucaauaacaaguaaugagauugaaagcauaauaaaaagucuccuagcaagagaagcccaggucccaauggcuucacugcugaauuaucccaaacauuuaaagaacaccaguccuacugaaacuacucugaaaaacagaggugggaauacuuccaaacucagucuaugaggcuaguauuaccccgauaugaaaaccaaagauacaucaaaaaaaagaaaaccauagaacaacaugacugaugaauacugauggaaaaauacucaacaaaauacuaccaaagcaaauucaacacauuaaaaagaucauucaucaugaccaagugggauuuaucccagggaagcaaggaugauucaacauaugcaaauaaauuaaugucauacaucauaccaacagaaugaaagacaaaacccauaucauuucaacugaugcugaaaaugcauuuuacaaaauucaacaucccuucaugauaaaaacccucaaaaaacuggggauagaagaaacuuaccucagcugggugcaguggcucacaccuguaaucccagcacuuugggaggcugaaucgggcagaucuacaaaaauacaaaaauaagcugggcauggugacacgugccuguagucccagcuacuugggaggcugacucaggagaaucgcucgaacaugggaggcggagguugcagugagccgagaucaugccacugcacuccagccgagcgacagagcaagacuccaucucaaaaaaaagaagaaaaaacuuaccucaacauaauaaaaaccauauacgacagacccauaucuaguaucacacugaaugggggaaaaacugaaagccuuuccucuaagaucgagaauauaacaaggaugcccauuuucaccacuguuauucaauacaguaccagaagucuuugcuagagcaaucagacaagagaaagaaauaaagagcaucuaaauugaaaaggaagaacucaaauuauccuuguuuacagaggauaugauuuuacauuugaaaaaaaucuaaagacuccccuaaaaaacuauuacaacugacaaacaaauucaguacaauugcaggauacaaaaucaacauacaaaaauuaguagcaugucuauacgccaacagcaaacaaucugaaaaagaaaucaagaaaguaaucccauuuacaauagcuacaaauaaaauuaaauaccuaggaauuaaccaaagaagugaaagaucucuacgaugaaaacuauaaaacacugaugcaagaaaauugaagacacacaaaaaaagggaaagauauuccauguucaugaauuaaaagaaucaauauuguuaaaauaacuacacuaaaggaaucuacagauuuaaugcaaucuuuaucaaaauacuaauggcauuccucacagaaauagaaaaggcaauccuaaaauuuauauauaaccacaaagacccagaauagccaaugcaauccuaagcaaaaacaacaaaacuggaagaaacacauuacauuacuuuaaauuauacuaaagagcuauaguaaccaaaauggcaugguacuggcauaaacacagacacaaagaucauggaacagaauagagaacccacagauaaagucauauaucuacagugaacuuauuuuugacaaaaggugccaagaaaauacacuggggaaaggacaaccucuucaauacacagugcugggaaaaccgaauauccauaugcaaaagagugaaacugaaucccuaucucucaccauacacaaaaaucaaaucaaaauugauuauuaaagacuuuaaucccucaagcuaugaaacuaaaagaaaacacuggcgaaacucuccaggacauuggaaugggcaaaaauuuauugaguaauacgcuacaagcgcaggcaaccaaagcaaaaauggacaaauaggaucauaucaagcaaaaagcuuuugcacagcaaagaaaacaaucaaaaaagugaagggacaauccacagaaugaaagaaaauauuggcaaccuacccaucucauaggggaugaauaaccagaauauauaaggagcucaaacaucucuauaggaaaaaaucuaagucuaauuuaaaacauggacaaaggaugugaauggacauuucuaaaaagaagacauaaaaauggcaaauaggcauauaaaaagcuguucaacaucauugaucaucagagaaaugcaaaucaaaacuauaauuagacaucaucucaccccaguuaaaauggccuuuauccaaaagucaagcaauaauaaaugcuggcaaggauguggaaaaaagggagcccucauacucuugguggaaaucuaaauuaguacaaccaccauggagaacaguuuggaggcuccacaaaaaccuaaaaauagagcuaccuuacccuccagcaaucccacucuuagguauauacccaaaagaaaggaaaucaauaaaucaaagaaauacuugcacucccauguuuacugcagcacuauucacaauagccaagauuugaagcaaucuaaguguccaucaacagaugaacggauuuuaaaaaugugguauauauacaaaaugaaguacuauucaggcauaaaaaagaaugagauucagucauuugcaacaacauggauagaagcugaggucaaauuacauuaagugaaauaagucaggcacaaaaagacaaacuuugcauguacucacuuauuuaugggaguuaaaaauuaaaauaauugaacucauggagacagagaguagaaggaugguuaccagaggcuggaaaggaucguguaggguucggaaggggaagugggaagggacaauggguacaaaaaauagaauuaauaacaacuagaauuugauaaaacaacagaaugacuauagucaauaacaacuuaauugcagauuuuuaaauaacuaaaagaauauaacuggauuauuuguaacacaaagaauaaauacuugagggcauggauacccaucucccuugauaugauuauuacacauugcaucccuguaucaaaauaucucauauaacccauaaauucauacaccuacuauguacccacaaaaauuaaaaauaaaaaaaauuuaagaagugugaggauaugucaacguacacuuuuuuuuuuuuuuuuuuuuugagacaaaggcucacucugucacucaggcuggagcgcacuggcaugaucucggcucacugcaaccucugccuccuggguuaaagcaauuaucuugccucagccuccggaguagcuggaauuacaagcacccaucaucacgccuggcuaauuuuuguauuuuuaguagagacaagguuucaccauguuggccaggcuggucucgaacuccugaccucaagugauccacccacuucggccucucaaagugcugggauuucagacguaagccaccaugccuggccaagguacacuuuuauugcuagagaauacccaguuacucuagcaauauuuguuggaaauauuaaccuuccuacauuauacugauuugaaccuaugucaaaaaucaauuagccauauuugugggacuaugucuacauuuuguaugcuguucucuaugugugugucucuauaccagcaccacaaaaucuugauuacuguaaagucaugaaaucaaacagagugacucucccaccuuacucuuuuuugaaaacuauuuuagcuauuauaguuccuauaacuucccaaauaaguuuuagaauaaucgggucuauauuuacauuuaaaaaaaaaaaaaaccuugcggaaaauuugauagaaacucuguuuaaaacuguguaucaauuuggaaagaauuuacaucuauggugagucugcuaauaaauauguuucuccaauaauucagaccucugauuucuuucaucagugcuaugaaguuuacagcauaaaagcuccuaugucuuguuauauuuacaucuaguaauucaauauuauuauaaagguauuguauuuuuaauuccaguuuuuaugugugcauuguucauacauagaaauauaagugcaagcuguuuucacgccccccucuccaauagaaaaacaaacaaacaaacaaauauguaagugccaagauuuuuaccaguaacaacauggaauucaaauaugagaaugagauaauuccuggggccguggagaaguaagaaaaaaacaaacaaacaaacaaaaaacaacucugaacagauggcaagggaaucagaccuccacaucugugacaccccucccccuccauucugccuggcaccaagcagaaaaucucacccucccuccacccaacuacauuucuauaacuguaaaagguaagacugagggggucauccagguuccccaacaucuuggguucccaagcaggagacuuguccccaccuuaauccaugggaagcaucgugacugccuaaagggagaaauacuccugaggacaggcagagacaaagacaggaggugggacuaucacccccaacccuggaaagucugcucugcuacucagcaaacagagaugcccaaucugagaggcugcucagcagaagagguauggacuccugggcacaaaccucuagcuagccuuaacacacugccagccuaaucccuuugggaccucucaccuucagagcaggcaucacucugaucauuuaccagagcugaggucaacccaagcuuaagguaccuccuagagcuaaaaagaggcaguuaccuagauguaaagauucacuaagcaaauauauccaguagaaaccaaaacaagauggacagaaaaaaaacuagaauaaauaacuauucuauaaauaucuauuaauaacuauccuucaaugcaaagacauaaaauauacccacaagaaacaacagcaaacagggaaccaugaccuccccaaaaggacaaaacaaaaauccggcaacugauccuaacaagaaagcaauuugugaguucucuaaccacaaauucaaaauaguaguuauaaggaaagucagcgaccuccaagauaacauacaaaagcaacucaaaaauuuaucaaagaaauuuuaaaaaagaaauuaggccaggcacaguggcucaugccuauaauucuaacacugugggaggccgaggcagguggaucacuugaggccaggaguucaagaccagccaggccaacauggugaaaccccgucucuacuaaaaaugccaaaaauuauccaggcauaguggcgcaugucuguagucucagcuacuugggaggcugaggcacgagaaucaccuuaaccugggagguggaggcagcaaugagccaagaaccacugcacuccagccuaggugacagagugagauccugucucaaaaaaaaaaaaaaaagaagaagaagaaaaaaauuuaaaaaaaagaaacugaaauaaucuuuuaaaaucaaacagaggcuaggcaugguauaaucccagcacuuugggaagccaaggcaggagaacuguuugaacccaggaguucaagaccagucugggcaacauaggaagacccccaucucuacaaaaaaaauuagccagguauguuggcacaagccuguggucccaguuacuccggaggcuaagaugggagaaucacugauccuaggcaauagaggaugaaaugagccaugauugugccacugcagucaagccuaggcaauauggugagacgcugucugaaaaacaaaaaaucaaacagaagucuucgaacugagaaacacauuugcugaacugaagaacuuccuggaggcucucaaagcagaugaaugaagcagaggaaagaacuggaaagcucaaagacuggcuaucugaaaauacaugaucagaagagaaaaaagaagaguagaaaagaaugaagcugccuauaagauauuaaaaauuaucucaaaagaccaaagcuaagaauuauuaguguucaagagggagcugagcaacaccaagggcuagaaugcuuacucaaagaaauaacagaaauuuuuccgaaagauauacauauccagauacaaaaaaaucucagaacacaaaauagguucaacccaaguaagacuaccucaaggcauaauaaucaaacccucaaaggucaagggcaaagagaggauccuaaaaacaacaagagaaaagaagcaaauaacauauaaaggaccuccacauugucugacaagacuucucaacagaaaccacgcagacaagagugaaacaacauuuucaaagugcuuaaaaaacaaaccaaaaauaaaacugccauccgagaauacuguauucagcaaaauuauacuucagauaugaaggagagagaaacuauuucucaaacuaaagcugaaagaauucaccaccaucagaucuacauuauaagaaaugcuaaagggaguucuucaauuugaaggggaaaaaaaaaagguuuaaaaaaaaaaagaaaaaacacuggugaaauuaaguauauaaacaaacccagaauccuauacuacuguuaacagugaugcaaaauccacugauuuuaucaaauuaccugauuuuaucaaaucagguaauauagaaaaugaaaagugagacaacuaaaacucaaaaugugggggugaugauguuaaacugcagauuauuuuuguguaguuuuuuuuuuugccuuuguuucuauucuuauuauuugugaccuaagaugaacugucucuuguuauauuuguaagauauuuuuuguaagccucaugguaacuggcaaccacagcacaaaacccauaagacacucccuaaaauaaaaagcuacaaauuaaaacauacuaccagagaaaaguacuuacccacaaagacagacagaaccacaaaggaagacaagaaaaaagacaggagugucaaaauaaccagaaaauaagcaggaaaaaaaaaagauuguuaaaauaaaguaaguccuuacuuaucaauaauaauaauaauacugaauuuaaauuuuuuuuuucuuuuugagacagagucuugcucugucacccaggcuggauggagugcaguggcgcaaucccagcugacuacaaccucugccuccuggguucaagugacucuccugccucggccucccacguagcugggauuacaggcauggaccaccaugccuggcuaaguuuuguauuuuuuaguagagaugggguuucaccauguuggccaggcuggucucaaauuccugaccucaggugauccugcccaccuuggccucccaaaguggugggauuacaggcauaagccacugugccaggccuuaauucucuaauuaaaaggcacagaguggcugaauaaagaaauaagacccaacuauaugcugucuucaagaaaccuacccuaccuauaaagacacauagacugaaagugaagggguggaaaaagauauucuaugcaacuggaaaacaaaaaagcacaggaguagcucuacuuagauaaaacagacuacaaaucuaagauuguaaaaccaagcauauaaaauaaacauaauagaucuaauaaagaaaagacagauugcaauacaauaauaguagcagacucuaacugccacucucaguaauggacagaucauccagcggcaaaucaacaaagaaaccagaguuaaacuacacacuaaaucuaauaggccuacugacauuuucagaauauuucacccaacaguuagaaaauacacauucuucucaucagcacaugguacauucuguagaacagaccacaaaauaggccauaaaacaaguaugagcgaauuuuuaaaaaaaucaugucaagcaucuuuucugaccacaaugggauaaaacacaaaaucaauaacaagaggaacgucagaaauacagaaacacacggaaauuaaacaauaugcuccugacugaccaaugggucaaugaagaaauugagaaaauuaaaaaacuucucgaaacaaaugaaaauggaaauacaacauaccaaaaucugugggcuauggcaaaaucagcacuaagagaaaaguuuauagcaauaaaugcccaauuuuuuuaaaaaagaaaaauuucaaauaauuuaaugauguacuucaaggaucuagaaaguaagaacaaaccaaaccucaaauuuguagaagaaaauaaagaucagaggggaaauaaaucaaauugaggcaaaaaaaaaauacaagaucaaugaaaugaaaaguugguuuucuugaaaagauaaauaugaauuuaaugaaauuaaugaauuuaaaugaauuuaaauaauaaauucaugguauagaauuaauuuuagauuuuguugcuauuuucuaauauuuuguugaagguuucuauaccuacacuuaugagaauauuggucuauaguuuucuuucuucuaaugucuugauaucagaguaauacuggucucauaaaaugaacuggaaacuguuucucuuucuuccauuuucaggaagaaaauguguaaaacugguguugacucuaaaaguaugguagaauucucuggugaaacuauuugagccucaagauuucaucuuaguaguauuuuaauuauaaauucaguucccuuaauaguuaaagagccauucaaauuaucuauuuauuuugggugguaauucguacuuuucuaugaauugguccauuccaucuaaauuaucaaauuuacauguguagggcuguuuguaguauucccuuguuauccuuuugauguaggcaagauccauaccuguuucauuccugacaguaauaauugguguauucucuuuuuugucucucuuguuagagguuuaucaauuuuauugaucuuugaaaagaaccagcuuuacgcaaaaauuuuugucuacgguuuuuuauuuucaauuucauugcuuccugcucuuuacauuccuccugcuugcuuuagguuuauuuuguucuuuuucuaguucuuuugaguuaggaaccuagauuugacuguuccuguuuucugauauaaucauuuaguguuauaaguuucucucugaacacuggcuuagcugugucccauaaauucugguauguucugcuuuuguuuucauucaacuauaugcauuuuuuuuuaauacccuuugagauucuucuucaacccaugaauuacuuaguaguauaacuguuuguuucuagguauuuggcgaguuuccuguuaucuuucuguuacugauuaauaauuugauucagacauggucagagaacacacucaguaugauuucaauacuuccaaauuuguugagguuuuucggcccuagaaauggucuguuccaugggcacugcaaaagaauguguagucugcuguucuuagguagaguguucuauaaaagucaguuacauuuuguugguugaugguauuauggaguucuucuguauuguugcugauuuucugucuaaccguuuuaucaguuuuugagacaguugaagucuccaccuguaacugccuauuucuccuuucacuuucuaucagcuuuugcuucauauauuuuacaguucugaugucugguauauacauuuguaggauugcuauuucuucuugguagauuguccuuuuaucauuaucuaauguccucucugucucucauaauuuucuuugguaugaagcauauuuuaucuuguauuaauauagccacuccuguuuucuuuaauguuugcaugacaugucauuuccauccuuuuacuuuuuacauauauauauaucaugauauauaagaaacuucaaacaugauauauaucaugauauauauaugauauauacgucauauauaugcaucauauaugauauauauacauauauaucaugauauauaaaucaugauauauaagaaacucacuucaaacaugugauauauaaaauauauauaucauauauaucgauauauauguaucaugauauauguauauauaucauauauauaucucauuauauuauguuugaagugaguuucuuauaaacaccauaaaguugggucauaucuuuaaaccaauaucaaucucuguuuuuuuaacugguauauuuauaauguguuagggcuuaaguuugcauguuauauuuugcguucuguuuguucucucuguuuccauuuuccugaauuuuuguggguuauuugaacauuuuuuagaauuccauuuugguuuaucuacaguauuuuuuguuuguuugagauggagucucacucuguugcucaggcuggagugcgguggcaugaucucauuucacuauaaccuuugccucccagauuuaagcgauucucaugccucagccuccugaguagcugggacuacagucgugcaccaccaugcugguuaauuuuuguauuuuuaguagagacagguuuucaccauguuggccaggcuggucucaaauuccugaccucaggugauccacccaccucaguuucccaaagugcuggaauuacagaugugagccacugcacccaaccuauauagcauuuuuuaguguauacuuuaaaaagcuuuuuagugguugcucuaguuauauuauauauacauaacucaugcaaacuacuggugucaucauuuuaccauuucaagcuaagcauaaaaacuuuaccuuccuuuaugucccuuuacucucccucauuuauaauugccuuaaauauuuucucugcauaaacuuagaacuacaucagagaguguuagaauuuuugcuucaaccauaaaagauaauuuccaaaacuaaagagaaagaaaguccauuguauuuacuuguauuuuacccucuccaauguucuuucuuucuuccuaacgugacaagauucuugcauguauuguuuccacuuuguuuagagaaugcacuuuauucuuuuaggguaggcuggucagcaacaaauucucuuugcauuucuucaucugagaauaccuuuauuuucccuuaacucuugaaagguauuuucacaggauauagaauucugguugauaguucuuuccuuuuagcacuuaaaaaauguugugcuauguccuuuugauuuaauccaguucaauccaguguucccuuaaugagcaaauaccugaauauugaugcuucuguguuccaaauacauguuuuuccacauauuaucagagaagauauuacuuagguaccuuaaaaaauaaguaccaguuuuucaacagcuacucaauuugagcaauuuccacacauuuucucaauuauauuuuagcuacagaauagaaaugccuacauuuuuccaauggcaagucaacuuaagaauucugccuggcaggcaucagauaaaguugggaagcuaucuugauuacaaaaugugaaggcaucugaccuaguaaauagucauagacuuacaaaguguguggcaucucuuauaacgaugacuugcaaagcauauuuaaguuguuuuucagugacaauaaauuugggcgauccagauauacgaucuucaccgaucuuccuugugaauaccauacacacauguacacacagaaugacucaggcuacucacaaaccagaagaguuaacuggccaugagggaaucaaaucuuaguauacucuggguuucaagucaucaauguuccccuuacccuuuucuuguuuuaacucacaggaggcugcaguacaaagagucucauguacccuucacccagcuucccccaguggugacaccuuauauaguucuaauucaauaucaaaaccaggaaaguaacauugguacguuacuguauacuaaacuaugggcuccuuuauacuuuuuauagagaaguuauacaacagugaucuuucucagaaacucucuuagcacuugggcauucuacuaccaaacuaccaaucuagacucuucuaacccaauuacaaauuaccauauauaaacaaucuuuauacacauacaaauauaagcacaucccguauauucguaccacacaaauacaacaaaaagaauugcacccaugucuauaaaaacuuauauuaaaauaauaguaaugcauccuccucaucccaucagaguuuuuuuuccgcuaauuucuucucuccccugcuauugcuacacaaagacuauguaaauaaaccugcaggaucaaagaaauaauuaaaaguuaucuaauguaaaauuccauccaguucauucuauagcaucccaaugaucaaucuuucagccuucacuugaaugucucaaaugacaagaaacucuuaagaucuaaaggaaucuagcacaccuuuggucaauaugcuaauucucaaaagguauuucuuaucaugagcaauaauuuguuucucuugaauuuguacuaauuugguucuaguuauauccuaugaggauauuagcaugcaagucucuucccuaacuaccuuuuucacagagaaaccagacuuccugguuuaacugagaugauuuuaguuugcacuuguuguucugacacaauuaauagcccuuuucacccucaagauuagagaaaacauuauacaguuccccuauucaagacagcccucaacuauuugaagacuacacauuuuuuuuuaaucagguuaaacauuuccuuguuuucuggcuauucuucauauacaauuuuugcauaucuauguuaaugagggauuuuauaaucccaauugaagaacagaaagucauuuacuucucuuugaauacuaaaucaacauacagcuauggaauuacuaucccucuggguaaacacuuucugaguugucaccucauacaaucguaccagguagcagucucauauuguaccaguagaugucauucuauauauauuuaaaauuaauuaaguuucaauucauuuauucaacaaauauuuauugagcacccauuaugugccaagcgauucuagguacugagaacauaguggugaccaagaaagacacaauuuuguuuucacagagcuuacagucuagauauuaauaaaaaaucugcuuuauuuuuuucuacauaaaaguuugugaaauccuaauccuaaugcaguucaauucagaacuguauuuuuccuagguuaauagauagcacucaaaauaacucauaaaaaccaaauacuguaaugaaacagaaucaaagaaacuguguucuguaggacuagaucaauauauccuggcuauuuucuaaccuuuugaauuuauucaacauuuauuuuccauacuucaaguuucuaaaacccaaauuuuagguaguccucaguacaacagaaaguaacuuaucuuuaaaaaacaguucaacuuucaaaaaauguaccugcuuuuuuuuuuuuuccucuuuuuuuugagacagggucuggcucuguugcccaggcuggaaugcaguggugcaaucuuggcucgcugcaaccuccaccucccggguucacacaauucuccugccucagccucccgaguagcugggauuacaggcgcccaccgcaaugcccagcuaauuucuguauuucuaguagagaugggguuuccccauauuggcuaggcuagucuugaacuccugaccucaggugaucugcccgccucggccucccaaagugcugggauuacaggcaugagccacagcucccggccuauaccuacuuauguuuucacaggaauauguuauaaauuuuaaagacuuauuaauucccaaagcuucuuaauuccccaaauacauauucccuuaucucuacuaagaaaaguuaggccaggcaccauggcucacaccuguaaucccagcacuuucagaggccgaggcgaguggaucaucugaggucaggaguucgaaaccagccuggccaacauggugcaacccugucucuacuaaaaauacaaaaaacuauuagccaggcaugguggugugugccuauaaaucccagcuacucaggaggcugagacagaagaauuguuugaacccacgaggcggaggcugcagugagccaagauugugccauugcacuccagccugggcaacagaaugagauucugucaauuaaaaaaaaaaaaguuaaaugucaccuucuaaacaccaaacauuuuucccagcuaaacagaguaaguaaagacaguaccaaauuaucccucagcagaacuuaggaauucuucuacugucaaaaguccuucuauuuucuuucuuucuuuccuguuuuguuguguuuuuuuuuguuuguuuguuuguuuuuuugagacagagucucagucugucgcccaggcugcaguacaguggcacaaucucggcucauuguaaccucugccucccagguucaagugauucuccugccucagccuccagaggagcugagauuacaggugugugccaccaugcccagguaauuuuuuguauuuuugguagagacgggguuucaccauguugcccaggcuggucucgaacuccuggucucaagugauccacuggccucggccucccagagugcugagauuacaggcaugagccaccacacccagcauuuuuccuuuuuuuuuaaagacuugauauuuauuuauuuauuuauuuauuuauuuauuuauuuauuuauuuugagacagagucucacucugucacccaggcuggagugcagaggcaugaccacggcucacggcagccucaaacuccccaggcucaggggauccuuuccccucagccucccgagcagcugggacuacaugcccagcuuuuucuuuuuuuguagacgcagggucucaccauguugcccagauagucucaaacuccuaggcucaagugaucugcccaccucggccucccaaagugcugggauuacaggugcaaacuacagcacccagccaaaagcccuuauuuaaacaaaccugugagacuacuagcuauuacuaggacuucaagguaacuuacucacacuuauagcauagcaaugaaaggccauacuuugucaaagaaauagaucuaagagagggggcagacacuguaccucaagaagguauacuugccugcaaagaaaucugagaaccuagaaacuacucaauuacuauauugucuucaucuacucucaaacugaauguuuuccaaacuggaaaagccacagaaaacacgguuaugaaaauauuucaggcucuuaaaaaaagaaaaauccuacuacuuagaauuuuuuaaguucaaaauucaguaauaugaauuugagaaaaaugauccuugccagaacuuaagacaccgacagcuuuauguaauauccaacuuaauguucccuuuggaaugcuucaaacuuuuacugucuaaauugcuagagaauacuacauauugcucaauuuuaggauggaaucacacgcauacuucacaaauaauguauaguaaguuaaaaaugaacauuaaggugcuucauaaaaaaugguuaauggugaaaaaauaucuaaauuaaccuaucccuuaauauuaaauaaagcauuuuauuuacuuugaaugguaaagcggugguugagcaaauauacuuaaaacaugguuuguugucuguggcuuuuaaauuacacuuguaaaccaucugauaggaacaguacuguuaauauuuggcgugagaugucaccaaauuugcacauacacaauggcagauaacucugugaggccaguauuuuuaccccuaaaauuaaaaugcaugugggugugaagugagggguuaguguacuagaaaaaguacagcuuuugagucaaaaaaaguaauguucaaaucccagcaccauccuaaauuagcuaugugacuuugggccaaguuauuuaaucugcucuaaacaucacuuuuccaccaagaugcaaauacaauuguaagaaagauuguaucauauaaaaugccuaacauaggguccgacauauaguaggugcucaguaaaugguaauuacaaggggauuccacuuuuuugaccauuacaaugaccguauuaauuaauguugaacaacuacuggcucacaauuguuauuaacacaauacaucuuuacucugcuauaacacuucuauaaaaccaaaccccuuacucaacugaaugccaacaaauaugcgccuucuccuuuagcucaaauauauuuugcaugaccuuacaugaauugcucagauaaaagcuuuuucucuuuugcuuuuguuauuguaaagugcacaugcauuugagucauuuucuccuuuuguuucauauccuuaagauccaaagcuucaaagacagaaugucagcaugcagucgauuuaugacugaacucuugaagagacacugaagaauuaccuugucaaucaccccaaggacucugaaggccuucagcuccucggcagggcuccuuagguuccaaaggggccuugaacuuagugauccuggaggcuaauggaagauaucaaagauuauacaucaaucagggagguacuugaaggaaggcugccugcugaagcaaaugccaggccaaaggaaaguaaauucaucauaaaucagagaauggaaagaugaaaggaagaaguuucuguuugucuguaauauaaaauuuuuaaaaauaaaaacuaaagaaaaucaaaaagaaaaagcaagaaaaaaguugcaaguaaauaaaucauaacauugaaaaaauuuuaaaaagaaaaauuaaugagcuggcaguuucuagagcaauaauucaauucagaccauacagcuaucauaaaacuuuguaacaaauggauaacugggccaacaaucaaucccagucuuauauuuaacccagacaccucaagaguaauuuggaagugggggaacuaaaaaacaauauaauaauaagcacacauggggagggaggggcacaagccauucucucucaucauaaagcuacaguucuauaauuguuacuuuauguauuauguguuuucagagggacugguccauucaaauucaaccagaaaaauuaccaauaauugugaaaaauuaagaagcuucaucauauaaccaauaauuacuaaaacugagccuguuuaagagaugauuuguaagagaaagaaauuuuucuucaaauauuugaauaucugugauguggaaaacagucuguuagcuacaaaaaagauuuaaaaaaucagugaacauaggaaggaagauuuaaauucugcacacaauuuuaaaauaaucccaacuuccauuuauuaguuuuaguuuuucccuaucaguaauauaagccauuaaauuagauaaauucuaagggcaccuccauacgacauuuacaacuauaaaguacugcuacauugauccuguauuaaaauggugaugcugcaaaggacaacaggagacacaaagccuuauuacuuacuuagagcagaccuuauugcuaucaaaaaucuauuagaauacagcggaaacauucugacccuaugaauggaagauaaaauauccugaucaaacaccaugguaagggaauuauugagauaccauuuuugauacuugaaguuccuguacagaccaacaucaccagacaggcagcuccuugagaauagaaaugugccuuagucaugucuauauucacagugccuagcauauugcuaguauuuaguuaguuggaaaaugugagggagagcagaaaugaggagaggagagagaaaggagggaaucuagggagggagguuacuuggaaaauuaggugucauuuacaacugggaaaacuaccauuugugaauuuuucuaaaagcagcaauucuaauucuuuucaauuuuuuuguuuuguuuucagauuuagcaagcaaauaauaauuuaacuguaccugaaaugauguuuaaguuuuaaaagagacuuuuuauuucuaaagaugcuugagaaaguuggugauagugacaauuagacuagauaauaaccuuuaaauugauuuaauuuaugcuucuuagauacauuucaaaaauauuuauuuaaugucucaauucaugaggugcugagcuagguaccauaaaaaaaacggauauauuucugccucccuauaagcuuaaaaacuaaggggaaccuuuuuagggauauaaaaacauuuagcaagauauuuuaguguuauaauauguaaacagacauguaauagcaauaaccucuuuuuuuuuuuuuuuuuuuuuugagauggaguuucgcucuugucgcccaggcuggagugcagcggcucaaucuuggcucacugcaaccucugccucccggguucaagcaauucuccugccucagccuccugaguagcugggauuauaggcgccuaccaccaugcccagcuaauuucuguauucuuaguagagacggaguuucaucauguuggcgaggcugguuucgaacuccugaccucaggugauccacccaccucguccuccgaaagugcugggacugaaggcauaagccagcacacccggccaguagaaacagucuuuucuaucuucauuuauauuguuucaucucuauucuucaccccauaccaggugauguacuuacaggaaguugguauuauauaauucccauuuuacagaugaauaaagggauucucagaaugcuggaguguuugucuguggucaggaagagagacaguggaagaacuccaacuacuauucuaaagcuugcaauccuuuuacuaaccaacacauucugaaaauuaaaaauucuuuucugcugcugccucuugcuacaagaacaaguaagaacugcuugugauuuuggcaaaaggaaugcuaaggaaaagucauaaggagggaaaaaagaauacuuuaaaugauauuuaauccauuacauuugucuuagaaaauauggccaaguaucuccaacaucccuaucuccuauuuauaccuccuuauucacagaugucacuguuucuuucaguuuccaaagaaaguuauuuguucacuuuggcaauuuaaagagcaaagaaagcaaacuaugaaaucucuauugcaucuuucaacaaauaauuacugugcacccacuaugugcaugauaacugaaagggcuauaaauuaucaaaaggcucagucuaaccucaagaaguucaccauuugagaagauaagacaaauacaugaacaguuaaauaacaauaaaacacucucuuaaaaauacgggacuacauagauacaucauuaguguaugaaaaacuguggucucagaaagaugugggacuaaaggugauuuuaaauguuauguggaaauuagauuaggaaaaaguuauucuauacuguauacaauuggaaagcauuagccuguuggggaaaaguuguucaaauuggagaacagaggaaaauaaaauuauauacuuagggucaguuuucacaggccuugaaugccgagaagaaaagucuugacuauacagucuccgaagucuagacaacaagucuuucuaugagaaauaacccaaugaaaacagugauuuaguaagguuacucuugcaaagacaggaauggggaaauugaaggacaaaugaccaaaggcaaagugaucauuaaaguucucuuuuuacuuuaaccaucuauaaaaguuugagaucacagaaacgaacaaagaaagaccaugaaauaaaaucaucaauaaaaaaauuguauuucucauauguagugcuuaaauuggguagaauccuauagaucuacuccuuucuucagauggcaaaaggacauacaaauccacagaauuuuaagagcagaaagagaccuuagagaucaaguccaacuuuuuuuuuuagaugagaaaacugagacgcagcaagguuagcaaaaguagguaauagauaagaggggauuaaaucuuacuuaugaaauaauagaauguuguuaggggaaacuuggcccauugcgcuaugaagcgcgacgggagaagcaauguauuucuagguaauaugauugaguuccuugauggaaaaguaagauuuucacuuacauuuauuagcaauuauagcagaagaugcuaagagaggcaaagaaugguuguauucaucuauaccaggacuaaagacaagggaagagaggcaggaguacaugaugacccaacaaucuucaaaagcagagguggcaaguacauaucacucaacuggucaaguccacggcaggcaucucuguuaaucccacagucucacaacucuucucaauacaaugcucuuggcagccacuacgcauggauuagaauuggcacacuaguuaaaaccuacuuacuauuguuguucucgcucugucaccaaggcuggagugcagugacacgaucucggcucacugcaagcucgaucucccaggcucaaacgauaaccuugugccucagccuccugaguagcugggguuacuggcaugugccaccacaccuggcuaauuuuuuuauuuuuuuauuuuuuguauuuuuaguagagaugcaguuucaccauguuggccaggcuggucucgaacgccuggccucaagugauccaccugccucagccuuccaaagugcugggauuacaggccuguuguacauucuuuaaaaggcuuuguuucuguuuggggauuuguuuuugaaguugguguucagccugcccacugucuuuuucacuugauauuauuuccuguucucagugagaucucucucucuauucuucccaaucuguuggugcaguacuucuuaaauuuuaugugcaccaccugaugaucuuguuaaaaagaagauacugauucaguaggucugauauucugcauuuccaccuagcucucaggugaugcugaugcugcuguuucaccaaccacauuuagaauacgguuacuuacuccucaaauaaccugagagagaguaaccauuacugcgggaaaacaagcaaucaagggcaaaaggaaagcaccacaaagaauguaucaagaaaccacacucugaacucuacugucuaauuaugacaaagcuccugaauuuggcuucauccaugaauuuuuggcuuugcaaagacuuucacgggcaaucuaccaacccuaauaccccgucuccugagccgcacuaggucacauuucaagccugacacuaaauugcagaccuauuacugacuuaagcaaaugucucacugagggcaaauuuaaaauauuuucuaaggaauaauggaauaauaucaauuaauaauacaaguaaacaaaaugcacaauagaaaaauacuugcaauauuauaucaguuguacucaaaaucuacaaauauucaggaaaggcacacauucuacauauuaauuuucauucacaccuuguaacugcauaaaaacauauucacacuuuagaaacuacacaaauauuuuaugugcuaaauuuagaucauuuauugucuuuuucuaaauuugaucuuuaguuucaaauuccuauagcuaaaaaaagcaaaaaaacuauucuaaaucuuuuccagggaaagcuucuuucaacauuaauucuuaaaucauucaacguugucuaggauuuauuugaaaaaaaaaaaagaaagaaaucugucuccuucaguuaagauucaaccuuuacuuuaaaaaaaaccucauuuccuuuuuaugugaaaccugcuccuaaauuuucuuggagccuuuuaguaaugaagcaaugaagaaaaagaguaagagagugcuuuuuuuccuuucugugcuuuugcaaaaaggauauuaacaugaaugacugggaaacuuagaacuuuuauauuuauuauauaaagaucucuaaaguucaauacaaacacuuaaaacaucacagaaaaccuggguggaagaagucaugauagacuguaccaaaggagaaaacaauaauuaacaaaaauuuaaaaagccaaaaaggguuccuuuauugucuuaaucaaccaggcuagaaagaaauguuugcacacugauuccagagagaaauaauaucugcuuugcaccaaauuugagcuaaaggggccuuagaaaucauuuacacaaauccucucauuguguugguugaaauucagacccaaagaugguuaaagaagugaaauaauaaaugcaccaagcuaaucacaauccucuggaagacuuuuaacuuaaauuauacaugagaaaauaaucaaggaugcucuuggccaaaaagggccaggcuuaacaaaauaacauacaaaaggaaaauuuaaaaagcaaauguuuaccauaaaagaaaaauacugugccuacucuccucuagccuccuugccuaagaaccgaaaaaauccuacaugucaaaucagauucagaaggcacuccuuuuuauccuuucugauagaauuucccauuaggauggcucuuaccaguguaacuuuguuugcucaacuauguacauauacagguccucaacuaugcuacaggauuugcaagagcaggcugugucaucaucuuuuguauaacuccaaaguauaucuaguuugauucuauauacagucuuaaaagaugcuuaaugaauuacuguauaaucaaauguaaucagcuuuccuauauuagaucucuucuguuuuauucucauuagaaguuauacuugaagaaauucugacugauauacuucaugguucuauucuucuaguuaaaacuauacaggaggcucaacauacuuauuuaccuaagaaauuauugcuucauagauaugccuauaggaaacuaacagggaugcaaaaguaggaggauuacaugaauaaguauagguaaaccauucaaauuuaauguuauaagaaugaauagaauacugguaauuuuaaaucccuaaaacuuuuagaauacuggccaggcguggugacucaugccuguaaucacaagcacuuugcgaggcaaaaguggguggaucaccugaggucaggaguucaagaccagccuagccaacauggcgaaaccccaucucuacuaaaaauacaaaaauuagccaggcauaguggcaugcgccuguagucccagcuacucgggaggcugaggcaggagaaucgccugaacccgggaagcggagguuacagugagcugagaucgcgccacugcacuccagccugggugacagagcgagacuccaucucaaaaaaaaaaaaaaaaaacuuaaaaauuuaaaaauuuaaaaaaacuuuuacaauauuuauauacaagauggauuuaguaaagcaaguucacagggaauuauguuaaugcuuucaucaaugcccccccaaaaugaaauugaguauauacacauuaguacugcacacgaggaagguugucaaucccacggaaaaugggaauugaaucaaaguaauguuuacauaaauauuccacuuaaaaagauaaaauucaauggugaaaaaguaaaggaaauaaauuuaauauaauuaaaagaacaaugauagagaauaggauaagauuagcaaacagaauacagacuaaaagagucgcaguaauucacaaucugaaaaucaaucagcagaauaaugucauuuaaaacacaaucauuauguuagauuauguuagagcaacauaaguauauauggcuugcaaguugaaacacaaucuuuuuguuuuauaagaaauggucaaacacuuaacaucagaaauucucagaaugucuuacacugauuaguacaguuuugacaacugcuaucuuaucauuuucaaaaagcauacaaagcauaaaaauguguaggaaaaaguauauaagccgguauaugaaggggaaaugaagaaugaggcuaaaacuuagucuuuggcuuaugggcugaucuucaugcuagagaggcacuugauuuauguguauauguguaauccacagaaauuuuuuuuuuuacuucauuuaauccuaguaacuacccagcaaaaaauuacuauauucucauuauucagauauagaaacugacaugcagaagugggauuaaguaucuuguccaaucuucuaugacuucaaguggcagagcuggauaugaacaagccugccugacucuuagaucaauuaagaaaauaaacuauuugggaggcugaggcgggcagaucaugaggucaggagaucgagaccauccuggcuaacauggugaaacccugucucuacuaaaaauacaaaaaaguuagccgggcauguggugggugccuguagucccagcuacuugggaggcugaggcaggagaauggcgugaacccgggaggcggagcuugcagugagccuagaucgugccacugcacuccagucugggggacagagugagacuccguuucaaaaaaaaaagaaaagaaaagaaacuaaacccuuucucccauuuccggaagacacaauucuuaaauugcauuugauauaaagaaaaaaaauaacagaaaaguuuccuccagaaauuugccaaauccaggucgauacagcauaaaaacaauaauaaccugcaauguuucuaauguuuucaguauucaucugcguuuuagacaagucuagcagaagucccaaauaacauaacuaucucugcuagaauuaugcuuuuauaauuccaggugaccaauagcauauacuuguauaacuuaggcuuaaaaugaauaguuuuaacaugaaucaauaaaacuggagaacaauuauacaagaaucacaaucuaacuuuaaaauguccaaauacaaauagauaucauaacaguauaaauuacugucaaucuacagaugaggagauuaaggguacaguaagaaacuaauaaaagaccaagaaaaggagaaagcaagucuuauuuuauuccacuuuuggugguuugcuauaaugcauuucuuucuaccaacaaccuuuaugaaaaucauuaauaaaauucaaaaaaucaaaauccuauaacauucuaauuagaaauaaagcagagagaccagacagcaaaaaaucacugaagaaaacacacaacaaaauaugagacauaccugagauacaucaucaagcugagguuucccauaaagacuagagauacuuucugcccgcaugagguacucggcuguucuucucuucacagcuucucgacggguagggcuugacucuccuaaaaaaaaaagucuggacauguaaaaaauaaauuuuccucaguucaaccugaaaauuaacuuccuucuacccaauacacugcuuguucacauuucuaacaaaaaagaagagauauucaaaauuggaaaagacaugaaaguuauuaguaucaaccaagucuaacuauuaccccccauugauuucauuuauccaaauucuaacauucuccuauuuaaauauguauugauaauuugauguauuuuuguaggagucaaauauauaagaaaugucuauuuguaaaaagcucugaagacaaaaagacuagcccuaguccagacauuauacaacuaagcaacucaacaaauaggaccaaaugcaacagcuguuguguguguguguguguguguguguguguguguguguguguguguguguguuuucaaccuugguuuuuuucuaaaaaccaaauccuacaaaacaauguuuccugguuugcugaacugaagugaacugaauuauaauaaagagauaauuucccccaaaagacuacuaguagaacccucuucuuauuucugccuggaacagcaucuucugcuucugggaaaugucccuuucuucuucccaucauacucuucuaccccuuccccucaucacuaaccaggugguuugaaugaaagcugcuuucuuguuucagauaucagucccucuaaucaccaagguccauuuagccaaggaugggccccccuagucaggagcugagccaaucauagaacccuauccuccuggccacaguugaagaagggaggaauuggcacaacacaaacuggacugucucuguuauucgagcuauaaauaagaggaguaggaacugccaacagcugguuucugccaaugcaaaaaaaggccaaugugaaagaacgaacuuaacucagaaagcagauauacgagacuuaaaagaaaaaauagaaagaaaucccaguguuuucaggugaaccuacuuuccucuaauguaacuggcaucccugauuucaggcaaagcuacauuccugcccuucuuucccugagguaguccgaauuuggauuuccgcacaugcaaaccaaagaauccugacuaaauacggaccucaacgaaaagcugcaacaaaguugggauugcaauuucgcuaaauaacuuucauuucacaccuuuuacauuacuauuccaccucuucucuccuucaugaggaauucacaaauauaacuggucuugguggggggaaaauuucuauugcuuuuuaacuguggaaccaucuacauuuauuuauuaacucuccaacuccucaacccgcaauuaaaaugucaguguacuucugccucuacccuuacaaucugcuuacguccuaaaggcaagguuuuagagggcuuuucuacucaguugaaaaaugaguauauucugugaaaaucacuuaaauaacuauaacauacuuugaagauaaaacaugccacauaauaaaagcuaucuauuugcuauuucuacacaauacuaguccuuugguuuaggguuuacugugucuggagucugcuauuuccauugucauuagcucuucucauuucagauuauauaaugccuuccaagcccuaauuuaaauccccauuuaagauuuuugauucaccuuaggcucaaauauaauaaaaacuauggcaauuuacuuuuuaauucaguguguuuaagcuuuaauaaaguuucaaaauuugcuucguaaaaaaaaaaaacucaccaaauaauuuggaauucgaaaugucaagauauggaacaacuaguuaaagcuagaauuaaagccauauuuuauaaucaaauuacuauuuuuuaaacuuuugguuuuucugccacuuucuaggcagucuccauaguaacagaaacaagaaccagaagccagaaguugaaauggacuccugcugaauauggugguuccacuuccaaggaaacuacaaugaugugauggaaauacugaaaggcuuuuuaaauguagccuuauauauaggccaggugcgguggcucgugccuauaaucccaacacuuugggaggcugaggcagauggaucaccugaggucaggaguuugagaccagccuggcccacacagcaaaacccagucucuacuaaaaacauaaaacuggccgggcgcgguggcucacgccuguaaucccagcacuuugggaggccaaggugggcagaucacgaggucaggaguucgagaccauccuggcuaacauggugaaaccccgucucuacuaaaaauacaaaaaauuagccaggugugguggugggaaccuguagucccagcuacucaagaggcugaggcaggagaauggugugaacccggaaggcggagcuugcagugagccaagauagcgccacugcacuccagccugggcgacagugcaagucuccaucucaaaaaaaacaaaaacaacaacaacaacaaaaaaaacacacaaaauuagccaggcaugguggcgggcaccuguaauaccagcuacucaugaggcugaggcaggagaaucauuugaacccgggaggcagagguugcacugagcugagaucaugccacugcacuccagcccgggcaacagagcaagacucaaaaaaguaaccuuauacauaaauacuacgguuccuuccuuaucaaucccuuaaaaggaggucauaaucacugcugaucaacagcagcauccaagaauaaaaacuaucucuugaagauuucugcuccugaaugcuuauucagguuugucaguaccagaaaaaaaaaaagaugacucuauagauuuccaggauauuucuaacuagucaaauuauugacaaaugugacuuuaaacagauuuuaauugaccaaaaaauguuuaauuaacucuaaccugcuugauuucuuguucucccuuuuaaaauacacacacacaguccacaaugauuaucuguuaaucauucagcuacagcaagaauuuccagugggcuuaggcauucaaaaaagaaaaacuaggcuguggcucacuccuacaauuccagcacuuugggaggccaaggugagagaacugcuugaucccaggaguucaacacaagccugggcaacauagcaagaucccaugucugucucuauugaaaauacaaaagucagccaggcguguuggugcgcaccugugguuccagcuacuugggaggcugaggcaggaggaucacaugaaccugggaaaucauggcuguggugagccacgcucaugccacugcaugaaccacugcacuccaaccuggggaacagagcaagacucugucuuuaaagaaaaaaagaaagaaaaauuguucccauuauuuaauaaccuuuauguuaaaaaguucugguguaucauaagagaugucuuaauguggauugugacaaccuguguuucuucaccuucucaauuucugaucauacagggugauuauagugugugaucucugauagggaguagcugaguagauaugaggagaaaauccaaaguuguugaugaaauuuacagaaacacucaauuacccaugcuguguuucucagugcaccaucucugacuucagucacuaagaaaaguuuauagaaggcacgguauacagauaacggaauccagaaauucuaacuuauccaagaagccaucaccacuuggcacccuucauuauaccauauucuauuuauaagaaauauaucucuucucuuuuauaagaaaauuaagucugaggaaugugaaaugucuuucucaguuacacaguuacuauaagagccugaaccuaaaccaugucuuacaccauacuucaggguacuugccacuauccuaagcuaccuuucaauauaaaguaccauaacugaauuugaauuugauuauucuacuguuucugaguaggacaagaaaaauacagagcacaggagaaguacaggugaguauggaaacaaagauacagagaaauaaacauaagaauuugagaaaggugccuguuaggcaacaaagcaaagcagaaucagaauggagagacaacagacaaacauacaggaaaacuggagcuacaaagaguuauaugucauaccauguaaaagagaacaggucuuucugagaaaaacuggucucuugaacaucuuuauuacccaaauauguauuuggauaacaauggccuuuucucauuugcccauuuaaaaaaaaaaaaucaagaggcauuuuuacucauggaacuaauaaaauucaguuucgcaaccuagaauaaaaaacgguucuuucaauucuacucuuagucacuaaaaagaauauaacuaacagccucaucauuuguucaacaaaagaaaagccaugcuggaggaagaacaagccaauuuaaacaucuugaaagacaguaugucuauaucuguguuucgugggaaauuuuaaggggcuauuaagaguauuuugacucuauuugauuucugccacaugcacagaaguuaauccccacauaagacucuacuuagucacauuuuauuauauucuuaucuuuauuucucuacaccacaaauacucucccaaugggcccugugcuuagucaagcaugcuugauuucauucagauuuaucacaauagaaagaacauccaaaucaaacucgguuugaguuuuuguuuguugcugcuuuuuugccuucuuuuuuguuguuguuguuaacaacuuuagucacauaaaagaaaacucacacuugagauggccuugguaguuacaguuaguuuuuuuuaagugcugauuuauuauguuuaaugguguuuuguucuuuucagguacagccuaccauuucugccuuaugcuaaguguucugacaacaaaaggcaaccuugagaagaacaguaauuuauaguucuacacaucuaccacaacucugaagccaucagucuuuccauguauaacaugaaccagucagggaaucugauuuccauuugcauuuagucaacccccuauuaauguuuuuucaaaaccaauuucaugugacccuagaaauucagagagucaccaaagaauaguaaaagucauaauauugaugcccaggcaaugccucaauuaugauuguuuucaauaaugucuagcaguuuuucugcuaucaguaacacuaacugaaaacaaauauuauacaucauuauaucauagaguguuaaauaccuacagagacaguguucuuagauucaacaauuucuuucugcucccuaaccuauuuuuccuuguuaugcaauuuuaaagagagaauccaaagacuuauuuacucccuucaaaauaacauugcuggccaaguauggugacucacgccuguaaucucagcacugugagaggcugaggcaggaagauggcuugagcccaggaguuugagaccagcugggacaacauagugggaccccaucuuuacaaaaaauuuuuuuuaauucgccaggccuggugguacacaccuguagucccagcuacuggggaggcugagaugggaagauugcuugagcccagggguucaaggcugcaaugagcugugauggcaccacugcacuccagccugggcaacagagagagauacuggccaggcaauaaaaauggccagucucuuagugaugagaaacucuuguccaaauaauuauuugcaguccaaacucuuguccaaauaauaaugauagcagucccuuaaguuucucuuauguucuaaagucaaauggcuuauaaaaaauuaagauuaaaacaucacaaagaucuaaugacagacaccaaacgaaaaagaaagagccaaaacuaaggaacuaaaauuuuuccuuaugagaaggaauaaaaauaucaucagagaaaauuuggaaaugaaacuccacauaaauuaugaguuuuuaaucugguaaacauggaaagucuccugacccccaaaaaggauuuuccucauucuuucacuggccaugagacacacaucuuaagagaaguagaaaaucuacggaagaaucuagaguccaauaauuguuuucuugaugccaugauauuaauucccauauuuuuccuuugaaaugaucuaaagugaucaagacaauuacugauaacaagcaguuuauuauucucaacccaugaaguuucagacuccuuuaaugcaucucuaccauaaaaauuaaauugacuuaguguauuaauacaucagaaucagaauagacuccauuucaucuuuuuucaaauggcuguuaacacaaacagauauaucuccauauuuaaaugauucaaagaaugagggcaggugcagugggucacaccuguaaucccagcacuuugggaggccaaagcagguggaucauuugaggucaggaauucaagaccagccuggccaacaugguuaaaccccaucucuauuaaaaauacaaaaauuagcugggcaugguggugcacaccuguaaucccaguuacucaggugguugaggcaggagaaucauuugaaccugggaggcagaagcugcaguaagccaagauggugccccugcacuccacccugggugacagagcgagacuuugucaccaaaaaaaaaaaagaaugagucaaguaauacucucagacuauaucacauuugaaaacaauuucagaguaacagagaaaauccucccuaacaauuaacuuccuuuauauaaacuaccagagugaaaauguucucuaucauuuauuccugccccuccuauccccuuuaaaagaugccuaauaguuucugaguuaucuacuauguuccaggcacauggucaucucaauguuuauagucaucucagcacugucauagaacauuacauguagaagaccuucaauaaaauuuuguuaaacaaaugaauggauaaguauauaaauuacuugccaccacuauuuuuuuuauuauacuuuaaguucuaggguacaugugcacaaugugcagaucuguuacauauguauacaugugccauguugguuugcugcacccauuaauucgucauuuauguuagauauucuccuaaugcuaucccucccccauccccccaccccaugacaggccccagugugugauguuccccacccuguguccaaguguucucauuguucaauucucaccuaugagugagaauaugugguguuugguuuuguguccuugcgauaguuugcucagaauuauguuuccagcuucauccaugucccuacaaaggacaugaacucauccuuuuuuauggcugcauaguauuccauguuguauaugacuugccaccacuauuauaaggucugauaacaauaccuucaugccuacugaugucucaauuaccucuuucuauaacuuagugccuuucucuaacuuaaacaauaguuacauaaaaugcaugucagggaaaguaucuuuaauuauggucuucaucauccguguagcugaaaugcaaacaaaaggaauacaggugaacauauuccaaaagaugcaugauuggacuaaaaggagaaucuauauuuugauuuaauuuuaugaaaaauuguaauaacaugaggaaaauacagcacagauauucuaaguaauuauaaaccacuguguaaacagaaugaugucuacaaagcuaucuuuuuauuguuugacaguuauaauuuugaaugauguguuccguaauauuuuguaaagguaaaauaucucuguauaaugaccuggcuauuuuucagaugaaacccauuuugagaacacuaacggcaacacaguaugcuucugagaaaaggcagauuuacaguuuuaauacuucauaagagagaacaaauaagcugaacuguguaauuuacacaugacaaaguuuaauuauaaagauauaauaagcuauaaguaauauaaaacugcauaacucaaguaauuacaaaauaaugauuaacucuuucucaaggugccuaauaaccugucagaacuaaaauaauagauuuucauuuaggguuuuuuggguuucauuugguuuacuuuaaaauaaucguagauauccacauuucuucugaucagaaucaaagauuuuugaguaaucacagggaauaaaucagcccucucaaauguuuuuaaacuguauugcuacagauauaaaaauguggugauacugaugagagaucgacuaauaaaaaacacuucgagaauccucaucuaucucucugcuuuugcuauagagcagcugugccucacagauucacaugaaugaaaauauuuagacgagaaaccacccacuuaguuuauuuuccauaugacuuuccuguaauuauuuuguaaacuguucauacaacaauacauaaaaacaucugcaaaaacagguaauuaaugugucaagccaaacuaaugcauuuuuuaugguguccaugcuucgucaacuguaauuauaacucuuuuuuaagcaaaugaugauguguuuguugcaacgugcaagugguuauuuuagaugcucuguuuacuguucauacaaucugaauauaaaacuccacagcuacuuuaccccacaucaaugcuuuaccuagcuuucuacugaagcaggaaaguggcucucuuuuccaagcuauaauuuccaguaaacauuuuugucauuaaaacaugaaacucucaacauaaaauuugacaccaaaauagccaacaauucaagaagcauaugccaggaaacuacucguccagacuuucuuccuucagugguaacccuggggaaaauucagcacuuuaugccaauaggcuauaguauacuaagccuccugaguaucaacagaaguuuaaggguuguuuuuuuaaugauacaaaauccauuccaucuagauccaccaaacauauaucuugaaaugacaaaugaagaagcaaaacauacuguuuugcauaugaacuuuguccuucuugaguucucacuacaugagagaucaucauaaccauuauuauuacuacuacuauuauauaauaaguaauaguguauaccaauaaucauucccagauagacauuccugaagguucuggguaaguaaucucuaaaguucuauguuuccagaacaaauuaaaucuaagauuaaggaagaacuacaagccuacacuaguuuucuaggguuccuucucuuccuuaaaaaaggagggcaauuuuuuacauaucugugacuacuaauuuuagcacagaaaaaacuugguaauaaacaacucucaggaaacaugccuuucugucugaauguuuucaaaaaaaguuuaaaaaaaaauacuggagaaguagcucuauguguccaagcuuauuuaacucuuuauuucgauacaaaucauucuaaacugggcuacuccauuuguaaguacaauaaacuaaaauuaauuaaacuuugcuuucccugaauauuagcuacugugauauguuauggguaucugucuauccccaccuuguucccacaaagaucgggaaaguauuauaacaacuuaaaugagaguuucccagcugccaagccugaguuuuaggucaaaugguuauuuugaggaagcuguaggugggucugaucaaaacugaacagagcccuaguuucaagggugcuggaauagcaagcacauugccaagacaaggcaagagaacaagauagaucuuaccuguuaaggcuaguaaccaaacacagggugagaguagcaagaagucacaguacugauuuaccuggcuuacacagcuacaaauguauuuaacuagugccauuucaaauggcugaauucuauacauugucaaacauuaaguguacauaaacauguuaaucaaaagcagagauuauuucuaagacuggauuaaaaaaaaacuauacaggaucuaacuauauccugucuauagaagauauacauugauucaaagaagcaaccagguuguaaauaaaaaaauggaaacauaccgugcaaaaaguaaucauaagagagaacagcuauaccaauaucugacaaaaucuauucuaagaaagaaaaguuaccacagacaauaauagacauuuuauaacauuaaaagguuauauuaaucaggaaacuauaacuauaaacaugccugcaucuacuaacagaucuccaaaacagaugaagcaaaaaaugacagaaauaaggaaacagacaauucaacaauauucaucagauaugucucaauaaucgcuagaacaaagagacagaaaaucaguaauaauauagaaaacuugagcaguauuaucaaccaaccugaauucugaaucuacagaauacuccauacaaaaacagcagaauauaugcuucuuauaagcacacacagaacauucuccaggacagaccacguacuuggccacaaaacaagucucaauaaauguaaaauaauuuaaaucaugcaaacuauauucaccaaccauaacaauuaacuagaaaucaacaauuaaaggccgggcaugguggcucacgucuguaaucccagcacuuuggcaggccgaggcgggcagaucacaaggucaggagaucgagaccauccuggcuaacacggugaaaccccgucucuacuaaaaacauaaaaaaauuagccggacaugguggcaggcacuuguagucccagcuacucaggaggcugaggcaggagaugaggcaggagguggagccugcagugagccgagaucgugccacugcacuccagucugggcaacagggcaagacucugucucaaaaaaaaaaaaaaaauuaaaaauuggaaaauucacauauauuugaaaacuaaagaaugcauaucuuaaaaauacaugaaucaaagaagaaacaaagauaacuggaaauuauuucaagcugagugaaaaugaaagcaauauaucuaaauuuaugggauguggaagcagugcuuagagggacacuaauaguuuuaaacaccaacauugaaaacaagauaucaaauugauaaccuaagcuuuuaccucuuaagauaaauucuaaaaaauuaaagcaaaccauauaaaacagugaaaggagaaaaaaaugaaacagaaaauagaagaaauacagagaaaacaaaugaaauuuaaaaaauuaauucuucaaaaagaucaacaaaauuggcaaacuuucagguagacugaccaagaaaaucaaagagaaaacagaacauacucaucacucccaaacaauuccuuauuuugccuauauuuuuaaagauauuuucauuggguauagaaaucucaguugacagguuuuuuccaccuuuuucucuacucagauauauucaucaauugucaucucucuuacauuguuuucaacacgaaaucugaugacauucauaucuuuguucauacaugaauugucuuuuuucuucugccugcuguuaaucucaagguuuucccuuuaucacugguuuugagcaauuugauuaucaugugccuugguguaguauucauguuucuuugcuugggguuuaucggacuuuuuggacuugcaaauuguuuuuauuaaauguggaaagcuuucaggcauuauuucuucaaauauuuuguuucccccucuccauuuucacacgucccaguuccauauacagaaauaguucuauaguucagugaaguccuuuuuuuuaauuuuuaaaaauacuuuuaucucacuguuucauuuuggauaguuucuauuacuauguccucaaguucauuaaucuuuccuucuggaaaaucuaaucugccacagaucacaaccuuugcauucauuucugacacuguggaugcuaccuauagaaguucaguuuggucuuuuguaauucuuacaugucuccacuuaacuuuuucaagauaauaaacaaaguuacaacaacacuuaaagcccuuaccugaucauucuaacaucucugucaauuccugguaggauuagauugauuaauuuucccucaauuaaggggguauuuuuccugcuucuaugcaugaaugguaacauuuugaauuuuaccauguugggugguggguguuuuucuaacuacuaucaauauuuuugagcuuuguucuaggauacagaaaugguucuugaauauaguuugauccuuuuaggucuugcuuuuacgauuugagagaguggggacgguggaacaagacagcagaauagaaagcuccaccaaucauccccaagcccacaagaacaccaaguuaacaacuaucuacacagaaaaaaacaccuucauaagaaccaaaaaucaggugaguacucauaguaccugguuuuaacuucaucuuacugaaaggggcacugaaaagauacaaaaaaaaagcagucccgaauugcugacgucacccccugcaccccagcuccuacuggagcauggugcagagagugucuaugagagcgucugggggagggagaacacagcaacugugagguacugaacagcaacugcuguccuguuagagcaaaaaggaaaacuggaccaaacucagcuaaagcccacccaagaugggagcauuuaaacccacucuagccagaggggaaucacugauccuaguggucagaaauugacugccugcaaaccucgccaacaagggcuacagcacucugugucuccaaguaaauuugaaaggcauuugaggccauaaggacugcaacuuguaggcgaguccuaguacugaacuaggcccagagacaguggacaggaggacacauggcauacugagauacuagcugaggcagucaagggagggcuggcaucaccacucccuuaaccccaggcugcacagcucauagcuccaaaagacacgccauuccuccacuugaggaaaggagaggaaaguggggaggacuuugucuugcaucuuggaaaccaccucagccauagcaagauagggcacuggucagaguuguguggucccuauuccagguccuaguucccagacauuucuauacacacccugagccagaagggaaccugcugccuugaaagaaaggacuucgugcuggcagcauucaucaccugcuaacuaaagagcccuuggacccugaauaaucagcaacauuacccagguacuacacuuacggcuucaggcgagccugugagacuugcagacuuuaagugagacucagcacauuaccaauuguggugacuacagagcaaaacuccuucugcuugagaaaagcagagggaaaaguaaaggggacuuucucuuguaccuuagauaccagcaaggccacagaaggguagagcaccaagcgggcacuuaaggugccccaauuucaggccuugacuauugaacagcauuuccggaccugcccuuggccaguggggaacccacuacccucaagggugagucccaguccaggcagcauuuacaacaagcugaguuaagagauccugggacuuaagagaaugccagcaguauucuggcaguaguccuauggucuggggugaguggcuaugggguaaggcuugucugccuucagaaaagggaaggaagagugggaagaacugcaccuugugguuugagugccccaacagugcaauacaagauaacaccggguagacuucuaagguuuuugauucuagucccugacucccugacagcacuucuauauccacgaagggauugggagacuucaucaccaggaagggaaggacacaggccuggcuggcuuugcugccugcugacugcagagucccagggccuucagcaaacauaggcaguagccagggaguggcuauaacaggccuuggacaagacccagcacugugccagcuucaggucugaugcagagcagucauaguggugguggccccaggggugucacuccaccuccagcuuuagguggcuuagaacagagagagagauuuuauauguuugggagaaaguaaggaaacaacaagagccucugacugguaaucaagagaauucucccugaucuuguccaagaccaucaagguggcugguaccucuaagagucugcaagaaccauaacauuaccaggcuuguggugagcccuaaagcagaaacagcuuagaucacaacacacaaguccuuucaaaugucuggaaagccuucccaagaauuacauauuuaacaugcugaagaaauaaaaaaaaacauuuacccuagaagaguauagccagcaaaaguauccuucaagcaugaaggaaaaauaaacaccuucccagacaaacaaaagcuaacagauuucaauaucagaccuguccuacaagaagugcuaaagggaguacuucaaucagaaagaaaaggacauuaaugagcaauaaaugaucaccugaagguacaaaacucacuaguaauaguaaguacacagaaaaacaccaaauauuauaacacuguaaugugguguguaaacuacucuuauccuaaguaggaagucugaaugaugaaccaaugaaaaauaauaacuuuucaagacauaggcaacacaauaagacagaaacaacaaaauguuuaaaagcugggggacaaaguuaagguguagaguuuuuauuauucuuccuuuugcuugucuguuuauacaaguguuaaguuguuaucaaguuaaaauaauggguuacaagauauauuugcaagccucaugguaaccucaaacaaaaaaacauauaaugccucugccucugccccugccccugccccugccccugccccugccucugugccugccucugcgccugccuuugccucucccucucccucucccucucccucuccccacggucucccucucccucucuuuccacggucucccucucaugcugagccgaagcuagacuguacugcugccaucucggcucacugcaaccucccugccugacucuccugacucagccugccgagugccugcgauugcagacucgcgccgccaggccugacugguuuugguggagacgggguuucgcuguguuggccaggccggucuccagccccuaaccgcacgugauccaccagccucggccuccugaggugccgggauugcagauggagucucguucacucagugcucaauggugcccaggcuggagugcaguagcgugaucucggcucgcuacaaccuccaccucccagccgccugccuuggccucccaaagugccgacauugcagccucugcccggccgccaccccgucugggaagugaggagcaucucugccuggcggcccaucaucugggaugugaggagccccucugccuggcugcccagucuggaaagugaggagcgucuccgcccggccgccaucccaccuaggaagugaggagcaccucugcccggccgccaucacaucuaggaagugaggagcgucucugcccggccgcccaucgucugagauguggggagcgccucugccccgccgccccgucugggaugugaggagcaccucugcccggcggcaaccccgucugggaggugaggagcaucucuacccggccgccccgucugagaagugaggagccccuccgcccggcagccaccccgucugggaagugaggagccccuccgcccggcagccgccccgucugggaagugaggagcgucuccgcccggcagccaccccguccgggagggaggugggggggucagccccccgccccaucagccgccccguccgggagggagguggggggggucagcccccugcccggccagccgccccauccgggagggagguagggggaucagccccccgccaggccagccgccccguccgggagggaggugggggcaucagccccccgcccggccagccgccccguccaggagggagguggggggucagccccccgcccggccagcugccccguccaggaggugaggggcgccucugcccggccgccccuacugggaagugaggagccccucugcccagccagccgccccguccgggagggagguggggggguuagccccccgcccggccagcugccccguccgggaggugaggggcgccucugcccggccaccccuacugggaagugaggagccccucugcccggccagccgccccauccgggagggaggugggggggucagccccccgcccggccagccgccccgucuuggagggagguugggggaucagccccccgcccggccagccgccccguccgggagggaggugggggggucagccccucgcccggccagcugccccguccgggagggagguggggggggucagccccccgccaggccagccgccucguccgggagggagaugggugggggggucagccccccgcccggccagccgccccguccgggaggugaggggcgcgucugcccggccgccccuacugggaagugaggagccccucugcccagccagccgccccgucugggauggaggugggggggucagccccccgcccggccagccgccccauccgggaggugaggggcgccucugcccagccgccccuacugggaagcgaggagccccucugcccguccagccgccccguccgggagggaggugggggggucagccccccgcccggccagccgccccauccgggaggugaggggcgccucugcccggccgccccuacugggaagcgaggagccccucugcccggccagccgccccguccgggagggagguggggggguuagccccccgcccggccagccgccccguccgggaggugaggggcgccucugcccggccgccccuacugggaagugaggagccccucugcccggccagccgccccguccgggagggaggugggggggucagccccccgccuggccagccgccccauccgggagggaggugggggggucagccccccgcccggccagccgccccauccgggagggaggugggggggucagccccccgcccagccagcccccccauccgggaggugaggggcgccucugcccggccgccccuacugggaagugaggagccccucugcccggccagcugccccguccgggagggagguggggggggucagcccccugcccggccagccgccccauccgggagggaggugggggggucagccccccugcccggccagcugccccgcccaggaggugaggggcgccucugcccggccaccccuacugggaagugaggagccccucugcccggccaccaccccgucugggaggugugcccaacggcucauugagaacgggccaggaugacaauggcggcuuuguggaauagaaaggcaggaaagguggggaaaagauugagaaaucggaugguugccgugucuguguagaaagaaguagacaugggagacuuuucauuuuguucuguacuaagaaaaauucuucugccuugggauccuguugaucugugaccuuaccuccaacccugugcucucugaaacaugugcuguguccacucaggguugaauggauuaagggcggugcaagaugugcuuuguuaaacagaugcuugaaggcagcgugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccucugugagaaacacccaagaauuaucaauaaaaaauaaauaaauaaauaaauaaauaaauaaauaacauauaauguacauacaaaaaaauaaaaagcaagaaacuaaauccuaucaccuucacuagaggaagacaggaaggaaagaaagaagaaagaccacuaaaccaccagaaaaaaaauaacaaaaugguguaaguccuuacuuauaaauaauaacauugaaugcaaauggacuaaacuacaaucaagacauagacuggcugaauggaugaaaaaacaagacccauuagucuguugccuacaagaaacacacuucaccuauaaagacacaaacagacugaaaauaaagggauagaaaaagauauuccacaccaauggaaacuaaaaaauauuuuuucugauauauuuguaucagacaaaauagauuucaaaacagaaacuauaagaagagacaaacaaggucacuauauaaugauaaaggggucaauucagugagaggauauaacaauuuuaaauauauuugcaccuaacccugggguacccauauauuauaaggcaaauauuauuagugcuaacaagagagauaggccccaaucuaauaauagcuggagacuucaccccacuuucugcauuggacagaucuuccagacagaaaaagcaacaaagaaacaucaggcuuaaucuacacuacagaccaaauggaucuaauagauauuuacaggacauuucauccaagggcugcaaaauccacauucuuugccucacuacauugaucauuuccaaggacagaccauaugucaggucacaaaacaaguuuuaaaacauucaacaaaaauugaaauuguuucaaggaccuucucugaccacaauggaacaaaacuggaaauuaaugacaacaggaauuuuggaaacuacagaaauacacggaaauuaaacaauauguuccugaaugaccagugaguaaaugaagaaguaaagaacugaaaauuucuuaaaacaaaucauaauggaaacacaacaucccaaaaccuaugggauacggcaaaagcaauacugagagggaaguuuagaacuacaagugccuacaucaaaaaagaggaaaaacuucaaaugagcaucuuacacaacuagaaaagcaagagcaaaccgaacccaaaaugaguagaaaaaaauaauaaagaucagaguagcaaugaaugaacugaaaugaaauaauacagaugaugagugaaacaaaaaguuggauuuuugaaaacguaagcaaaauugacaaaccuuuagccaaacuaagaaaaaaaaagaauauacaaauaaauaaaaucagaaauguaaaaacagacuuuauaacuguuacugcagaaauucaaaggaucauuaguagcuaauaugugcaacuauaugucaauaaauuggaaagucuagaagaaauggacaaguuccuacuuauauacaaccuaccaagacugaaccaggaaaaaacacagaaccugaacagaccaauaacagauaaugagauugaagccauaguaaaaaaucucuaaguaaagaaaagcccaggacugauggcuucauugcugaauacuaccaaaaauuuaaggaagaaaugauaccaauccuacucaaacuauucugaaaaauagaggagggaauacuuauaaacucguucuaugaggccaguauuacccugauaucaaaaccagacaaagacacauccaaaaaaaagaaaaccauagaccaauaucucugauaaauauugaugcaaaaauccucaacaaaauacuaacaaacugaauucaacaauacauuguaaagaucacacaucaugaccagggggauuuaccccuugagaugcaaagauggcucaacauaugcaaaucaaucaaugugaaaccucauaucaacagaaugaaagauaaaaaccaaauaauuauuucaacggaugcugaaaaagcauuugauaaaauucaaugucccuucaugauaaaaaccccucaaaaacuggauauauaaggaacacaccucaaccuaauaaaagccauauaugacagacccaaagauaguauacugaaugcagaaaaacugaagccuuuccucuuagaucaggaacaugacaaggaugcccacuuuuaccacuguuauucaacacaguacuagaagcaaucagacaacagaaagauauaaagggcaucuaaacuggaaaggaagaagucaaauuauccuuguuugcagaugauaugaccguguauuuggaaaaacuuaaagagacaagaaaauuauuagaacugcuaacaaauucaguaaaguugcaggaugcaaaaucaauguacaaaaaucaguagcauuucuauaugccaacagugaacaaucugagaaagaaauuuaaaaaguaaucccauuuacaacagucacaaauaaaacugaauaucuaagaauuaacuuaaccaaaaaagugaaagagcucuacaaugaaaacuauaaaacacugaugaaaaaaaacugaagaggacaucaaaauauggaaaaauauuccauguucauggauugguagaaucaauauuguuaaaauguccauaugacccacagcaaucuacagauccaauggaauccugaucaaaauaucaaugacguucuucacagaaauagaaaaacaacacuaaaauuuauauggaaccacaaaagauccagaauagccaaagugauccuaagcaaaaagaagaaaacuggaggaaucacauaaccugacuucaaauuaugcuacagagccauuguaaccaaaacagcaagcuaccagcaucaaaacagacacauagaugaguggaacagaauagagaacucagaaagaaauccacacaccuacagugaacucauuuucgacaaaggugccaagaacauacacugaagaaaagacaguuucuucaauaaaugguacugggaaaacugaauacccauaugcagaagaaugaaauuacaccccuaucucuugccauacacaaaaaucaaaucaaaauggauuaaagacuuaaagucuaagaacucaaacuauaaaaccacuacaacaaaacauuggggaaaaucuccaggauauugguuugggaaaagauuuuuugaguuauaccccacaagcaccagcaaucaaagcaaaaaauggacaaauggcaucacaucaaguuaaaaagcuucugcacagcaaaugauacaaucaaaaaagugaagagacagcccauagaaugggaggaaauauuuacaaacuacccaucucacaagggauuaauagaauauauaagaugcucaaacaacucuauagggaaaaaaucuaauaauccaaucaaaaaacgggcauaagauaugaacagacauuucucaaaagacauacacauggcaaacaaacauaagaaaaggugcucaacaucacugaucaucagagaaaugcaaaucaaaacuacaaugagauauuauccccgcccaguuaaaauggcuuauauccaaaagacgggcaauaacaaauacuggugaggaugugaagaaaagggaacccugguacacuguuggugggaacguaaauuaguacaagcacuauguuguacauaguucaacaguuuggagguuccucaaaaaaaauaaaaauugcaaucccacggccgggcacaguggcucacaccuguaaucccagcacuuugggaggccgacgugggcagaucacaaggucaggagaucgagaccauccuggcugacacagagaaaccccgucucuacuaaaaauacaaaaaauuacccgggcaugguggcgggcgccuguaaucaaccccagcuacucaggaggaugagcaggagaacuguuugaacccaggagguggagguugcagugagccaagaucgugccacugcacuccugccugggcgacaaagcaagacucugucucaaaaaaaaaaaaaaaaauugcaaucccacugcuacgcauacacuccaaagaaaggaaaucaguguaucaaagagauaucugcacucccauauuuacugcagcacuauuuacaauagccaagauuuggaagcaaccuaaguguccauuaacagaugaacagauagagaaaaaaugguacauauacacaacaggguacuauugagccaugaaaaagaaugagauccugucauuugcgacgccauggauggaacugaaaauuauuguguuaagugaaauaauccaagcacagaaagacaaacauugcauguucucacuuauuugugggaucuaaauauuaaaaaaaaaaaaaaaugaauucaugagcacagagaguaaaagaauggguuaccagagucugggaaggguaguggggggguuacagggaggugggaugauuaacauauaccaaaaaaaaaaaaaaaaaaaaaaaaaaacagaaugaaugaauaagaccuauuugauaguacaacagggugacuauagucaauaauaacuuaauuguacauuuuuuaaaaacauagcguguaauuggauuguucauaacucaaaggauaaaugcuuaaggggauggauaccccauucuccaugauguacuuaucugacauugcaugccuguaucaaaacaucucaugcaccccauaaauauauacaccuacuauguaccuaccaaaaaauugaaaaaaauaaaaauuauguauuuuuuaaaagacuugugggagugggccuaauuauuauuccacaguacuauuacuccuucuauguauucuaccuaaugccacaugauugagguuucugagacuacuucuuaggaagacacuauucccagcucugugugagcaaccagaauugugucucguaauccuuuugggauaucuuuuuuggucucgaguaguuuccccacagcauacacuaaugaguacucuguguauauuccaggagacacuaccaaucucuguaccauuaucucuccucuagacaacacacuggacaucaggcaauaauucuaaauaucguauccugcaagcucuaacuacaaacucuaacuucauucuuccuagccucucaacuucaucuucuuaacucagagagaacguucugccaggauccaaauggcuuccuucucccugcaccacaaccuagaaauucaagacagcaaucugggacaaucaugagccuaacuucauuuguuuccucucagaaaucacugucuuucauuaccugaugcccagugucucgaaaaucauuguuaaauauauugucugguauuuuuaguugcuucaggaaagacuguuaccuaucuuggucagcaguauaaaucuuuuuuuuuagaugggagucuugcucugucacccaggcuggagcgcaguggcgcgaucucagcucacugcaaccucugccucccagguucaagugauucuccugccucagucuccugaguaggugggauuacaggcacccaccaccaugcccagcuaauuuuuguauuuuuaguagagauggguuuucaccauguuggccaggauggucucgaucuccugaccucgugauccgccugccucagccucccaaaauucugggauuacaggcgugaaccucugcacuggcccugaaucuuuuuuuuuaaugugacuacuagaaaauucaggauuacauauguguugauaugauauugcuauuguacacugcuguuguagacaguuauuaaaguauguaauccugaaaucaccuaaggagaauaggguaaagagccuaagaagguugauaaccaagucacgaugaauuucagcauuuaaagaucaaguggggaagaacaagcugguaaaguagacuuagaaaggucaagaaagggggccaggugcaguggcucacaccuauaaucccagcacugugggaggcuggggcuggaguacuucuugaggacgggaguucaagaccagccuaggcaacauaguaagauucccauuucuaugaauuuuuucacagcuauaaucccagcuacucugaaggcuaaggugggaggaucacuugaguucaggaguuugaugcugcagugagcuaugauugugccacuguacuccagccugagcaacaaggcaagacccugucucuaaaaaauaaaaaacuaaagaacuccaacugccagaaaauuaaacaauaugcuuaugcuauuuaugacauacuucuaaguaauucacagguacaggaggcagaauaaugaugggacucuugaagauguucaugcccuaagcccagaaccugugucuauguuauuuuacguggcuaaagaaacuuuacaaaugugauuaagguuaaggguuuugauauagggcaauuauccuagauuauucacaugagcccaauccaaucauauagcuccuuaaaaccagauaaccuuuccuggcugaggaucacugugaaauguaacuaugaaagaauggucagagcgaugcaaaacugcuggcuuugagauggacaaaggggaccauaagcaaaggcaugcagguggccaccagaagcuagaaaagacaagaaaacaguuauuuuuaugugcaguuuccaggaaaaaaaaaaaaaaaaaggugcugcucacaccuugauuuuugcccagugugguucacgucagauuucuaaccuacaaaacaauaaaauuaaaaauuuguuuugaaaaucauuaaguuuauguuaaguaguuaaagcaccaauagaaaacuaauaaaaugagauuuaaaaacgaaaacaaaacaugaaaaauauuuugaacugauaauaacuaagguuugacauaucaaaaucuauaggagguagcuaaacaaauacuuuauggaaaauuuaauaauccuaaauguauauuaaaaaaaggcugaaacucaaagauguaaucuucuaacucaaaaauaaaaagaauauucagacuucauguaaguagaaugagaaaggaauacaaaucuauaaaauagaaaacacagaacagcaaaauaaaaguuaaaaguuaauucuuuugaacauuaaaaaaacugauaaaaugcuaacaugagugaauaagaaaaaaaaauacauaacaaauaaccaaaauccagaaaaacccaacagacauccaaaagauuaggagacacuauaaacacuucuacaauuaaauuucaccuuuuaugugaaacagacaaauuucuugaaaaauagaacuugcugaguuucacgaaagaagaaauauacaaaacaguugaauaucuacuaaagaaauugaaucuacuauuaaaauccuucccauagaauauguuaaggaugauaaauauauuguggauaugaagaagaaugacccuauauucuagagauauaaacuacacaacgguaguaaaggccacgaugucucuaauuuacuuuuaaauuugcuaaauauaccuaaucuaagaaaaauaaaaauauauauacaggcauaucuuuggagauauuguagguucugauccagaccacugcaaaaaagugaauuugaugauaaagcaagucacacauucuguuucccggugcauauaauaauuacguuuacaccauucauaguguacuacgagugcaauagcauuaugucuuuaaaaacaauguacauaccuuaauuuaaaaauauugcuaaaaaaugacaacgaucauccgagccuucaguaagucgcaaucuuuuugcuguuagagggaauacugcuuuuauguugcuggcugccgacugaucaggguagugguugcuuaaucgccaucuaccggauggcagcccaaacuucaacaucaaaaauacuuugcaacccugugaaaccaaugccaagaaaucagccacaagcaaagacccuuuacaaacuuucauccaccugaaaacauccagaaauaaagccaauugacuauacucaaauuacaccacaguuaaaggaagaucagcccacacagaugagaaagaaccagugcaagaacucuggcaacucuaggagccagagugucuccuuacauccaaaagaccguacuagcuccccaguaaugguucuuaaccagaagaacauaaacagauuaaaugccccaauuaaaaggcacagaguggcaaguuggauaaacagcaagacccaacuauauccuaucuucaagagacccaugucacaugcaguaacacccacaggcucaaaguaaaggaaugaagaaagaucugucaagcaaauggaaaacaaaaaagagcaggguucccauucucauuccagaaaaaaaacugauuuuaaaucaacaaugaucaaaaaggacaaggaaaggcauuacauaaugauaaaggguucgauucaacaagaaaacuugacuauccuaaauauauaugcacccaacaauggagcacccagauucucgaaacaaguucauagagaccuauaaagagacuuagauaaucacacaguaauacugagacacuucaacauuccacugacagaacuagacagauaauugaggcagaauaucagcaaauauaaucacaaccaaaacucaacguuugacuaaauagaccuaacagacaucuacagaacacuccacccaacaaaacuaaugaaaaaagaaaaaaaaaaagauacgacauacuagaauuucugggacauagcuaaagcaguguuaagaguaaaguuaacagugcuaaacauccacauuaaaaagucagaucucaaauuagcagccuaaugucacaccuagagaaaccugaaaaacaagagcuaaccaaucccaaagguagcaaaagaaaagaaauaaccaaaaucagagcagaacugaaugaaauggagaugagaaaaaccauacaaacgacuuuuuuaaguugguucuuugaaagaacaaauaagauucagacuucuagcuagacuaaaaaagaaaaaaagggaaaauauccaaauaaacacaaucagaaaugaccaaaaggacauuacuacugaccccacaaaaauucaaaaaauaaaaauaaaaaaaccuucagagacuauuaccaacaccucuaugcacacaaacuuagaaaaccuagaagaaauggguaaacuccuggaaacauaccaccucccaagacugaaccaggaagaaacugaguaucugaacagaucaauaauaaguugcaaaacugaaucaguaauuaaaaaccuaccaaacagaaggcccuggacaaaaugaauucauagccaaauucugucacauguauaaaaaagaggggauggccaagcaugguggcucaugccuguaaucccaacacuuugggaggcuaaggcggacagaucaccugaggucaggaguuugaguccagccuggccaacaugaugaaaccccgucucuacuaaaaauacaaaaauuagccaggcauggugaugggcgccuguaaucccagcuacuugggagguugaggcaagagaaucacuugaacccgggagggggagguugcagugagccaagaucacgccauugcacucccaccugggcaaugagugaaacucuguuucaaaaaaaaaagaaaaaaaaaaugaggagguaccaauccuacugaaacuauucaaaaaaaaaaaaaaaaucaagggauuccucccucauucuaugaggccugcauaauucugauaccaaaacauuucaaaccacuauccuugaugaauguaagaugcagaaauccucaauaaaauacuagcaaaaggaauccagcagcacaucaaaaagcuaaucuaccaugcucaaguaggauuuauuucugggauguaagguugguucaacagaugcaaaucaauaaaugugaucaccacauaaauagaacuaaaaaugaaaacuacaugaucagcucaauagacacagaaaaggcugucgauaaaauucaacaucgcuuuguguuaaaaauccucaaugaacuacucaucgaaggugcauaccucaaaauaauaagagucauccaugacaaacccacagccaacaucauacagaauggacaaaugcuggaagcauuccccuugagaaccagaacaagacaaagaugccaucucucaccccuccuauucaacacaguacuggaagucccagccagaacaaucaggcaagacaaagaaauaaaaagcauccaaauaagaagagaggaagucaaaucaucuuucuucgcaagauacuauaccuagaaaaccccacagucucugcucaaaggcucccagaucuuaugaacaacuucagcaaaguuucagaauacaaaaaucaaugcacaaaaauuaguagcauuucuauacaucaaucacgucuaagcugagagccaaaucaagaaugcagucccauucacaacagccacaaaaauaauaaaauaccuaggaauacagcuaaccagggagguaaacgaucucuacaaugagaauuauaaaacacugcugaaaggaaucagauaugacacaaacaaauagaaaagcauuccaugcucauggauaaaagagucaguauuauuaaaauuaccauacuccccaaagcuauuuacagauucaaugcuauuccuaucaaacuauuaaugacauuuuuucacagaauaagaaaaaaaauucuaaaauucauuuggaauaagaaaagagccugaauagccaaagcaaucauaagcaaaaagaacaaaccuggaggcaucacacuacccaacuucaaauauacuacaaggcuauaguaacaaaaacagcaugguacugguacaaaaacagacacacagaccaaugaaacccuucuuuauuucuagguuauggaacccagaacaccuauaacuaucugaucuuugacaaagccaacaauagcaagcaauggggaaaggauggccuauucaaaaaauggugcugggauaacuggcuaccauaugcaaaagauuggaaauggacuccuacuuuuuaccauauauaaaaaucaacuaaagauggauuaaagacuuaaaaguaaaaccuaagacuauaaagacccuaaaagaaaaccuaggaaauaccauuccacacaucagcccaggcaaagacuucaugacaaagacuccaaaaaaauuugcaacaaaaacacugacaacugggccuaauuaaacuaaagaguuucugcauagcaaaacaaacuaucaacagaauaaacagacaacccauagaacaggauaaaauauuugcaaacuauguaucugacaaaggucuaauauucagaaucuauaaggaacucaaaucaacaaguaaaaaacaaccccauuaaaaaaugggcagggacaugaacaggcacuucucaaaagaagacauacuagcagccaacaaacauaugaaaacaugcucaauauaacuaaucaguagagaaaugcaaaucaaaaccacaaugagacagcaucucauaccagucagaauggcuguuauuacaaagucaaaaaauaacacaugccagugacaucgcagaaaaaauggaaugcuuauauacugcuggugggaauguaauuuaguucagccacuguggaaagcagucuggagauuccucaaagaacugaaaauagaacuaccauucaauccaacaacuccauuacuggguauaugcucaaagauacaaauuauucuaccauaaagacacaugcacacauguuuaucacaacacuauuuacaauaacaaagacacggaaucaagcuagaugcccaucaacggugaacuggauaaagaaaauaugguacagauauacuacagaauacuaagcagcuauuuaaaaaaaugagaucauggccuuugcagcaacaaaagauggaacugaaggccauaaucuaaguaaauuaauauaggagcagaaaaccaaacacugcauguucucacuuauaaguggaaguuaaacauucaguacacauggacacagaagggaacaauagacacugaggccucuuugaggguaaagggugggaggagggugaggacuggaaaacuaccuaccaaauauuacaccgauuaccugggugacaaaauuaucugcacaccaacuccugugacacacaauuuaccuauguaacgaaccugcacauauaccccuugaaccuaaaaugaaaguugugaagaaaaaaaagaaaauggccccaaaagacuugcucaauacaguguugccacaaaacuucuauuugguuuuaaaaaaaaaaaucugcaaagugcuauaaaguacaacaaaacaagguaagccuguacauaaaugaauaaauauuagcaauuaaauccaaugauauauaaaaaggauaauccauaucacaaccaaguaaaguuuauuuuaggcauacaaaaguuguugaacauucugaaaucaaucugugugaacucuugggccuagaggacaacaauggccaccaaauuucaaaugucuccacauaaccucucaagaaacaaacaaaaaaucaagagcacaaauaaauccacauauggcucacauuuucagcaccacuaggaaacaaagauaccaugaccuuuggauuaucuguaaauagaaaaaccaaccaaacuacaacagcacucccagggcccccuauuguaagccaauggauguggugaccagaggaagaaaagcuuaagagaucccuugguggggguggggggaaggaaaaaaaaaaaaaaaaaaaaaaaaaaauauauauauauauauauauauagagagagagagagagagagagagagcaaacuggacuuaaaccaaagcacaggaaaaaacaaacgaacaaacaaacaaaacagaaaaaggaagcccaacuaaaugccaaacacagguuggcaucugauaguuaaaggacaggcuuuggcaaggcacgguggcucacgccucuaauccuggcgcuuugggaggccaaggugggcagaucaccugaggacaggaguuugagaccagccugaccaacauggagaaacaccguuucuccuaaaaauacaaaauuagccaggcgugguggcacaugccuguaaucucagcuacucgggagguugaggcaggagaaucccuugaaccugggaggcagagguuguggugagccgagauugcgccauugcacuccagccuaggcaacaagagugaaacuccaucucaaaaaaauauauaaauauaaauaaaauuuaaaaauaaaaaaaacaggcuuuauaggcucgaaagugaagaaaauaaaaagugagagccuugguaaagccuuccuacuggggaagaaucagauauauagaaaaugagugauaccccuucaagguguggcagugaaaggccaaagggaaagaagaaaaugagagaaaggucaggauccuacagaaauaaaagagaaacaagaccccaacccauuccccaucaucauccauaauggaaauugcagagaagaggguggaaacaacagaaagcaggcucucaaaacuggaacccugcccuuguaaggaaugggaauagaaaaaagcagaccugagccaggugccauggcucacacugaaguccuggcuuuuugggaggcugaggcaggaggacugccugagaccaguucaagacagucugggcaacauagcaagacuccuucuccaaaauauuucuuaaaagaaaaagcagaccucuugcacucaacacuguuaaagaucagaauaauaauuuccuuugaagaggggagaugaagaagcuucuauggugcuggccaaauucugcuccuugaucuggaugccagucacaugggagugucccaugugugaaaauacauucagcuauaugauuaugauauuuacuuuucuguauauauaauauacuuccguuaaaaguuuaaaaaaaguagauaccaugccgguucucuagagaauuaucaucuaagaaacauguaagagaacacacaugaacaaccaaaacaaucauuuuuguuuuuuaaggccaggggagaaaggauaauaaacggcacuguugggccaugacagauaagcagaagauaacauuucaauguguuuuuuuuuuguuucugccuaacaucccuuccucauuuugauccacuccuuccacauuccaugguuaugccguucaguucaugcagugcaucagggauagcucuguccaccuucccagggaugaccaaauaaccuaugccuaaucagguuacaaagacagaggugaaagcuaugugacgcaugccaggccaauccucccugaggcuuuuauuggagcuaugagggaaaauacccucuuccuccaggauccugaggacaaagucuuuguaaaccuggagcuagucagggguuaccuuucaugccaugaagauaaaaucaaauaagagaaaggggauagcaaauacagggugugaacagagacaggcaaauaaaaagacagagaccuguuggcauuucuugaacaccugaauugagcuauauguaaucauuuaaguggaauaaaacacucuuuuucagauggacuaaaacaauguuuucuaugugagccucuuugaguugguuacgauuuugcuaccuggagcugaaaaucuagucuuaacacaaaaccugaaagagaauuaccugaguauaggauaauuuaaaaagcaacucucuuuucauuugugaauauugagaacagagaaucuguaagucuucucucugaaccuaugaaauaguuccuucugaguucacugcauuaguaacugcugacuccuauuggcagacacuuccuggaucaacuaaagaaaggaaaaaacagaaugcugaugaggagggaagacagaagacuaaguggcauauuuaaaucauuucaaaucucuauuuuuaaaaaucuuaauuagacuguuuuaaaaugcuuccuucuagccaguuucaaaacaguuaagaucugaaaaauucucaacuaaggcaauuuauuaaaucauagugaaaaguacacauuuuauuuuaaaacagaaaaagcuguggaaaauuuucaugacauucaggucacaggucacaacugaaggaaaaaauaaaauaaaauaagaaauauucuguauuuguuuaauacuccucccuauugaaaaauaagaucucaacuuccagacagagacggauagaaggcucauaccucaauaagcagucccucuuuuccaaccauauuacaaugauaaacaaaauacacaagagauaccaaaaggcacaacuggguucaaacuuaagauaaaaaucucuguggcaagugggauuuauccuaggaauuccagagugguucaauauaagaaaagcaauguaauauaccacauuaauagaacaaagaagaaaaaaagcacaauuguuucaagugaugcagaaaaagcauuugucagaauccaacaccccugcaagagaacauacaaaaaacuaggaauagaauagaacuucuucaacaugauaaagggcgucuaugaaaaaccaacaacuaacaucauauuccacgguaagacugaaaucuuucccccugagauaucaggaacaagacaagaaugucugcuuucccaauguucuuguacauuguacuggaaguucuagccagagcauuaggugagaaacagaaauaaaagccauccaaauugaaaaggaagaaggaaaacuaccucuauucucagaauuauaaucuuauacaguugcccuucaguauccacaggggauugguucuaagauucccuaaauaccaaaaucacaugacuugcuucccuuuaucaaaccuaaacuuacuacguuuuucauauuaucuaucuauuuccaaagccaaaaacuuuauccuuuggguuucuaaauauuugaguaacucuuauucauggaauaaaucaaugguccaagcuccauacaaggucauggugucugaaauacgucuggacaucccugauagccuagcacauaucuacccaagaauaaacuauaaaaaaugguuugguacugcuuauuauaccauuuaccagaaugaaaauguuugcaucucuuaaucugaguacuaacauuaaaaauagucucacuggucaaaaauaucaacaaaaucuucaaagaaaaauuggauaucaacaauauccagaaauacauuaugaaaugucacucauaauguaugcaagagaagagaagaggagaggaaaggagguaaaagggaaggagaggagaaggaagaaaaugagagaggaagaaaagaaaaagagugagaagggcagggggaaauaaugggguauuuuuuaaguguggcaucaacaucaaguuaagugaaaagcaacggguauaacuauggcagcaaaucuaccagauauuuucaacaagauauacacuacaaaaucaugggucauauuagcaugcuauuaaguugacagaaacaucucaucuugaagggccgucacucaauuugauucuauauuuuuagaaaauaaccauuuuauauucccuauuacagggccugcuacauacaagaaauaaaugcuuguugaaagaucaacuagaugaauagauggcugagugaaaacaaacaaauggauagaaggaaaaaugacaaauacucaaaauaagaaaguuuucaaauauucuacaauggagaggauuucccacuucuccaucuuaaaaugcuaaucuaauuaggaggaacaugugagaaguagcauagcacaauacgaagaaaauaugauuuaggcucagaaagaccuagauuaaaaucguagcucaacuuucacuaguuuguguccuugagcaaauugcuuaauuuauguaagucuuaguuuucuccaccuauaaaacagggaucacaauaucuaccuuacaaagacaucaaaccaguacuuuuggcaccuggaacaaacuacacaaaaccagcucucaaaucgacucuguaauucaugauguagcccacagauggguguuacuaacaaugcucgccaucugguagcuuccuguuuuaaauaauuauucuugcuaacuaggugccaagcuuuuagaaucauuauauuaaauguuugcacccucuaaauuuugguguccuuagacaaaguccaguauggccagucauaguucaacuuauaggguuccuuugaagauuaaaaauaauguaagaaaaauaccuuguacagugacaggcauguaauaaauuacuuaaacauuuuauugauaccuuuauguaauccauuuaccacucuauauuaccacaaccacuccaauaagcccacacauagauuaaucauauccgccacuuucaguaauauauaaacaagauggacaggaaagugugauauauauauugcaacauccuuuucaaaaauucaaguugauuccuucaacucugacuuuuggauuuucucucuuaaauccauaaagaccugagaauuuagaagaguagacaguccuuucauuccaagaaccauuucuaagagggaguaagugaagugucagguucaaagagaauucaaaguuaccacuaucaggguauacuuauucucugccggaugggcaaagagagcuguugcuauuguguuuugcauguggucucagcugugcaaauaccaguuaaauaagaaaaacaucaagccaucuuuaucagaccuacuaacaacccagauaaacuucuuuaggaugaauaguuuaguaacaaaauaacaaaauuugccaacccacaagaaucuuuguauaaagcauuacuuagcucugaaagauuauuuucucuguauuaucagauauccagaaauacuuauuuuauuauaaggcaugccaauccaugccaauaaaggucacaagaacaaauguuaugaagaguucaauuuaaaugauucauacguuuuacuggcuauagagauauuucacuaacaguuuuguuaccccagaacaaacuuuacccaaggaaacaucucuucugaaaauaaaggucaaaucaagcucauaacuagagcccccaguuuccccagaaauugaaggacaauguccauaugucuguuagguggugacuaguaugcuaguacagaauccauggacuggaagcacuguccugaucuuacauuugacacagggucaaauguguaaccaggaggacugaaacaaagguucuuuuauauacugguuaaaaauuagaauucuaugauugugguucccauaguuugucugaauaaaaauugaucacauuaugaauaaacaauaaaagacuaaaaucaauuuagucaguuauuaacuucuggaauuguggcauauuaauaacagaaaccaauccagagcaggaauggauauugugcuuucaaaaagacaaacaugcauuaaauaggagauacaugguuaaaugguaauguuccuuaagauagcagucuaguagguuugguaucaaguucuaguggagaaauaauucaccaccauaaucagcaaaguaacuaaccaaaugacacauuauuuguuauuuucugacaugcaucuauaauucucauuuugaagcacagauuuuuauuuuucuggugccaucaagugguaacauuaugaaauguucuaagauuaaaugcaaauaacuuaaaaaaugucacacugaccacacugauguguuuuauuugugucaauuaaacaccagugauguuuuagcacauaauucucugaaaacaaauggaaaaaaugucagagcagauuuuuuuauaacucauacccauuuuaaacucccaacccaaaaugagaguuaaggcaaagaauaaaaaugaauagauauuuaagaccagaaugcuccacuagcaaacaaaaaacccaacagauggccuggugcaguggcucacgccuguaaucccagcacugugggaggccaaggcagacagaucaccugaggucaguaguucgagaccagccuggcaaacauggugaaaccccguuucugcuaaaaauacaaaaauuaguucggcaugguggcacacaccuauagucccagcuacuagggaggcugaggcaggagaaucacuugaaccccggaggcaaagguugcagcgagcugagaucauaccacugcccuccagccugggugacagaaugaaacucuaucucaaaaaaaaaaaaccuaacauuauaaaaccauuugaaaaauaaaauuagggugaaaaugaucuuuccaucaaagcaagaaaacaaguaacuucaaaauuagguaucaauuagaaaccuuaaaagugauagcuaauauuaaucauaucaagaugacaaaauuaaugagaaaugaauuuagaaucaauuauuugaaacuguguuaacagguuccaaaugguuauauaagcaacuuuaguaagacaauaacuaaugaaaaaagaaacaagacuccaucuccucuuauugcuauacacacaaaacauuaaucgcuguuugauccucaggcccaccgaaauuaaguaucaauugugaaaucugaauucccaguugaagauggcaaacugaacacauuucuuuagcuauucucccuccagaaacucuauuaacauggcagucaaaaauuucuuuaagacaaaaccccacaagaauaaagaaacugagaagguaacagcaacaaaauuuuagaauauaaaagcugccauggaauauaauuuaaaaaaaaaaagguagauggaugagaaguuacuaaaagggaaucaagaaaguugccugauuuacauggcaugguaaaacucuccaaaaauucaggaauugguggcauuaggaaaugggagugaaaccuaaaaacaagagaaauggucaaaauccugguuaagaagcaguuaggacccuccauauacagacagguacaccauuuuauaaaacugaaaguuuauacuccagaaauaacaaaaggcuucuggacuacaggauacuaggcauagugagaaguacuguaguaaaaaguguuaguaauacaggagacugguaaucugaaugguaccgacaaacccaagaccacagaacaaugaaaaugaugaucuucuguaaaugaaaccacuggaagaaugucaauaucaaucuuugauuacugcauccaaaaagucaugcaacuaaaugcagaaugcuucauucugcuuuuauaaggaaaaauuuaaggguuaaaacaauagcugauacuucaaaaaaguaaguucuauauacagacauucaguuacagucagcucuacaugucccacaucaccuccauuaauuaaaugagaauuuacuacaacuacaaagaacagaauagucggcaaacccaagaaucuuuuaugcucuuaguuuaaaaauccauuucauuuugucucuucaggucaucaagaaucucugugaauuacuccugagagagaugaaggccgguaaaacacugccuuuucaaaucagaaaagaaagauuauuauucauacaagagacuucaagacaugcugacuuuuuuuuaaauccuguuuuuguggauuaauugauuaaaaguagaggguuaaguaccuccgauaaugucuaacaucucaaggaacuuaaaguauauauccauauauaggucuuuuaagcuucaguaauuucucauuuucaguauuauuuccauaagacuauacagaagauauauguauguacuuuuuuuucccacauaccaacaaaagagcaugccaaaacauaauauacauaaaaccauaccuugaacaccuucuaggaguaaaucaacucccuuccuauaaaaaucagaagcagcuucauagucgucuucuucuuccuuuuuuaaagccagcuuuauuaauucuccugcuuucuccaaauaaucucucuugccaagcuucggcuuuaaacugccaggaaagaggcuacgacuuucccguucuucuucuguuuugcucuguucacugucagaagcaacagccccuagugcugaagaauccgaagaaagauugagaccaaaaguucuaaugggagaauuuugauuggaagccauuccaucaucuaacucagcaagagaauccacaucaacaguaagagauaccagaucacugucacuggagaagccuagaaauaugaucacaauaguaaacagauauuaaauugagaaucagccaaacgaauacaaaucaugcuaauuauucauuuuucauauuauccaagucaauuuggaaggcuguaauuuacugauggaagucagugucuagcaauuuguuuaggcuuaguccauucauuuuacugucucucuguaacucuggaagacaacuucuugccuuaaucaucaaacuaaaauugaagacaaaucuuuaucuaguuugguugccaaaaagagccuuuaccacaagauccuguaagcuauuuacagaaagcuguugccuguacacauaguugcuauaaauaauagcauuuuaauaaaggaaaaagcacuugaaucucagcucucuuuuuuuuguuuuguuuuuguuuuugagaacagcaucuugccauguugcccagcugcacuccaacucgugggcucaagcaauccucccacuucagccucccgaguagcuuagauggcaugagccaccaagcccagcgccagcucuuaaaacuuacugugugaccaacagcagguuacuuaauaguauuacuuauuaugcaagucuuuaaaugaggaauagaguuaaugcauauaaagcauaauagacuaucauuauauuauaacuuuuauaacaauuacauaaacagguugaauauccuucaucugaaaugcucgggacagaaguguuucagauuucagauuuucagauuagggauacucaaccuguaacuauauaacaacuacacaaugcguccucagaagugugcuuuuagguaaccauccguaacuggaaaauguaugcuauuuagcauuuuuuaaaaacugaauuuuuagacauuuucaucucagccucuucuacaagcuucuggaaagguauauuuccaccuuaguuuucagacaaaaaagagguaauaggugcuacugaauuauuuagcagugaaaauuccuucuccuaguucauauaacugacaucaugguaaaugagcacgauccacaauacauaucagacuuucugcucccaggacagccuuuuauauucuucaaaaugauuguggacucuaaaaagcuuuuguucaugugaauuguaucugugaauauuuauuaaauaccaauauugauauuuacaaaagaagucuagaaauguauaaaauaaagcauuaaagccccauuacauguuaacauaauuuuuaugaaaaauaacuauauuuuccaaaacaaaaaaaguuagugaaagaaguggcauuguuuuacauuuuugcacuguuuuacauuguuuuacauuuuuguuaaugucuggauuaacagcagauagcuagaaucucauaucugauucugcucacaaucuguugucauauguuguuuuggaugaaagauaugaaggaaaugucacauagauaauguaacugaaaaagaaacaaguauuagccuuuucaaauaauuaugaauauuguucuuugauacuacaccaaaacucaacaagugauagguuuuuaaagcuuaguuguaauguggaauauaaaauccuaugaaugaaauuucuguuucuguuacauucaaauccauuggucugucuugcacacugaauggaucuuuuaucugugcaugaauuuauaacaucacacauuggucauccugaaaauacugguucccuuaguuauaaagaucuucgaaauguugacagcacauuucauuaucccaaaaaaucauaugucaacauuucauuaucuaccaaucucaucagaaaacuaaguauugggaaacugucaaacccaaaguggcagacagagguuaucugaaaauccuaauuuugaauugaaaacuccaauuuuaugauuggcaacaaauaauaucaguuguuuuccuugaagugucagcuuacuucacucccuuucaagaaaaaaagugccaaauacacaagucugaauaaugacaguuuguuaauuguucuuucaagcaaaauggugucccaugaaaaaagcagcuaguucagcuaauggcucaaacaacugcauaagugcuuuuccucaagacgaccaugguaguucaguaugcagagugcuuuauguauaauucucauuuuuucacacagcauauuaaaaagacaagugacaaggguuaagauuuaacaaaauguaacaguuucuacuacuuaggaaaaauuagcauugguuuuauaaguaugugcaaugaguacuguuacgguuuggugacacugccuugauucaugcccaagcacagcaguuucaccuaccauggcuuuugcaucaucagggcaaaugucaauauggugaaaagacaaagaauguccuggcauuauuaucaaaacaguuuugcuuuaugaacucccugaaaauaucucagaaacacccagagaucugaagauuacauuugagagccagugaucuauaccauuaaauaagacugacaacagaguuauauaaaaacuaguuuggaaauaacugagaucugcauucaccacugaacauuaucugccaaguuucucaggaaaaaaaaauuaaaaagaaaaugauauccucaggauuauauacuaaaucaaaauuaaaaguggauuagacuauacaauucuagaucagggaucagcaagcuuuuucuauaaagggccagaaaguaaauauuuuaggcuuugcaggccauauguggucucugucaccacucaacacugccauuguagugcaaaagcagccauagacaauauauaaaugaauaagcauggcuguguuccaguaaaacuuuauuuacagacauugaagugugaauuccuuauaauuuucccaucacaaaaccacaaaaucauauucuuuuaauuuuuuuaacuauuuaaaaaugcaaaaaccauucuuaguuuucaggccauacaaaaacagguggcaggccagauucagcccauagaacauaguuuugccaaccccuauuuuaaauucaaauugccuacuucauaucaaauaaaguaaguuaggguaaaaacauguuacuggccacuaagcucaaauuucuaaucagcuuuagaugcugcuuuggcacccugucaauauauauccucauuuucaacuuuuuuucaacuucuuagaaugccccaaaagaacaaauucuauucccaaaaagcaacagauuucauuaaaccgacaaucucaaaugagauucauugagccuagugaaaaucuuuucaguccucugacauuucagccauacggacaguaacaguacuucauaauaagaaucuuuuauagcaaucuacaguuauuuaucuacuauccuaagaaauauauauaaauuuuaugagauuuuucuugucauuuuaaauauuuuauguauuucaauguaaacuuauuuccuuaaaugaugccaauauauaaucuagcccauugaaacugauaaacaaauagauaagguugaaaaaaguucugguuuauauagcuaaucacaaaagaaaggaaaugcuguauuagagaucucuuuugucuguucucugguaucuugucacuauaaccuucacaccaucuaucacauuguucuguuucauguuuugccccauuuuuccuuuuaacaauaacaauaacaccaaagggcaagcgggcaaaguuauguauacucuguuucuuggcuuuugaccacaaaaaacugguaccauagucauauuuccucuuaccuuucaaaucauauuuuauuagcaaugagaaucaugauuaaaugagauuagaucaaaaaaguaagaccauuaaaauaccuagagagaaagauaguaagauuaaguaaauaaacauucuauacaaagcauuccuuuucaaauucuaaauaauuucuuaauucggcaucuuuaaaagcaagcaaacacacacacacacacacacacacacacacacacaagcagauaaaaaagagaaauuuauauagccaaaccagaagaagcaaagagaaauaaaaagacaucuacuuuaaccuuuuuagaggacaauuugccaaugcauaucaaaagcgcaaaauugcuucuuucacccagaaauucagcaauuuauaccaaaaccuaucagagguguacaaaaaagaucuacauacaagaauguccaucuguccaucacaaaaauuaguaaaaauguggcaauaacaaauuccuaauaauagauuaugauaucuccuuaugauaaaauauuauacagcuauuaaaaucauuuuauagaauauuuaaugcuaaagugucuuauauuaugcaaaaacaacaaacuacaaaugaguauguauacuuaauucuacuuuaaaaacaaacacacacagaaaaaaggcuagaaacauacacuauuaacagugauuuucuguguaugguaagauuauagguaauucuauaauauagaauuuaauaauauacuuuguguaugguaagcccuuaaguucaguaucugaaagauaucaaaagagaugcaucaagggccaauauugggaauuuaucugaguaaaagaaaguuauacaggcaucauuugugaaauauaaaccucuauggaucaaccagcagcuagcgucaagaauuccaaacuuaaaaaaggaguuagacacaaguacaaaggcagaucuguuuaaagcaggcaaaccccugacaccucuuccuugcccaccuuauuccuuuaauuauccucuugaaguugcaucuuaccaugccugaaaagccuaacccuaccauaucuccucgaccacacaaugcaaccaaucaucuucuaguacucacugauaucuuucucuuccauauuuaagcaguuucuaaauucccuucuucucaaugacguauucuccggccagcucgaggaagauaacauuuaaaaacuccuuucaccaccacagcaaugaaucuuauuuauaaacauauuauauguaaauauucaaugccuaguuuauuuauauuauauacuuaacacaucugcuuaauacagugcuuguucaacuccuagaaaucacacuacaauucaacuuauuucauacaaaacuauauauaaauaucauacgaaacgcaaacuagcucccugaagcccagaaagaaaguuaacaagaaagauauagggagcaacaagcaagugacagguucucagucuagguaggaaggacauuguggauaaggcagggcaaucacugacauuugacauaauacagagacuauuugucaaaaguuaaaccaaccugaagucaaccccauacuuaaagaggcccucugggccaucgcaagaguaaaaggugcauccuucaccaacaccaucaaggcaaaaaccuaagcuuuuuuuggaagugauacaaggggaaaaagucaaagguucuaugaaagcguucugccuccagguucguaucacagaaauucaagucucagggcuauuagagggccccaggugacuuguuaaaaagcagcuacagacauaggcguuuauuuagcaucccaguucaccuaccuacccuuaccucugugcuuugaacugcucagaguagggcaguauagugaaaucugucuaggacaccaucucugaaagacaggccccaggggaacagguugaguugccauagaauaaaucuuuauacuauaaacuaucagaaaucuguauuugaagaccaucuguaaaaagagaucgguuuccuuuagaacaacagguggucucucaugggugacuauauauaaaauacauggccucauuauuauuagcugauagcuuucacugagcccugagguucaaauauugccauagucaacaaaaaggaauuucuauuuuuccuaguagcaaugacucaugcgccaugcacaaagcaaguuaucuagccaguagaacaaagguuacccuaagguagaagacauacauaccaguuuccauuaagaaagaagcccuuauaaauaugauuuuaagugaauaccuaaauccaaagcuuaaugcuaguuaagauuccuguaugugauucccuauucaucauuuaguaauagcuauuguuacaaaaaagaaccuuuccuuugaaguuucacauuuuuauaacguucuugggucaugucuauuaugcuucauccuugaaaauguacaaaaagagccucagaauaccucguacagauuugguaaaacaacaaaauaagcccagaaaacaacacagcaaucuuaauuacaacccuaauacugcuaucuuaucauaauaaagauccaucacuuggcuucauuuuuugccaaaugaacuuuauacucugcuacucuccauaacuuucucuagccuccaggacaucaagcccauuaccaguaugcaaguagcucaugcugaguuuucuauaccaaauaugucuucuccccgccuccccuccauaaaaugaaaucucuucauuucaaaauauaguucugugagugcuaucaaauaccuggaguaucuucggcacauggcuaaacuucucugaaauucaaacucuguaauugugaaauaagacauuuaaguguaucauuuauaaugauucccauggcauaccaugaauuuucuguuauuugucccacccaaccccuaaacuccuaauauccaauauuauccucaauagcccuagaauuuguaagagucaauauuuaucaucagugucauguguaucauuuacacacacugguacauucucauuuguggcuaucuuggggggaaaaaaugaccuguuguuuuugucaagcuccacuaccaaggaaaauucaacugggggcagggaauaaaaauaaguuggguaaauaagcacauaacagaaaaaagaaucucuucaagcugaguaugcaagagauauucuaacauacauaacaccaaagggccuagaaaaauaccaguaacaagauuuagaguucuuauggugccaccuaguggacauuugcacuuaauuuuacuuuaaauuacuugcacuuucuauaaauuuacauuuaaauuaauauuuaauacuuucuguauuuugucaucucacacuauauuauguaguaaauagacuuuaaguuugucuugaaaauagauuuagguuauuaaguaaccaaucaugugacaaauauuccuauuuaaaaugaucuugccucaaagugucaaguuuaaaucuauuaaaugaaaauaacacaaauaauaagacaaaauaaaugguauuucgauacagauuuuuuucaaacuuaaauaacuauacaccuuuccaauuagaccaaccagugcuuuaaauauaaucaacgccauucaauuuaacacaguuuaaucacaaucuucaugucugucuacacaccguaaagaauuauuagguggcuguaaccacaaagacaaauugagugaucagcuuauugcauguagcagaucuuaagaauuaauauucuuaaaugucuccuggaauaacaaaaucuacccccaccugccaucaaauaaacauacaaaucuugaccuuaaugucauuuaagggauccguuacaaagacgagcaauagaugcuauccucaaaaugcacauuucauuuacuuuaaaauaguuaauucaagacaguuuaauagauccuuucgugucucuacaauaguuacaauaagcacuugaggaguucuuaauucacaauuuccagccaaaaaaagguggggguagauuuuguuauucccagaagacauuuaagcauauucauucuuaagauaugcuacauacaauaagcugaucauucaauuuuucuuugugguuacaauuaccuaauuauuuucucucauuugcugcaugaaccagaaaaaaugucccuccccaaacugaaaagugauguauuaggaagaggaaaugacacagguuaccagaugagacuauaccaacauccaagucucugauaucaaggccagcauggcaccaaagcaaucuacacccuucaaaaaggccaacaggugagagaaauaugucaaggagcucaacugauaugcaccgauuugggcagguuucuacaaauguccuaguaacuucacggcuaaauuuaauucaaggaaaagacauaaguugaaauagacauaauagaaauaagauguuagcaaccaauuacaucuucuuucaucuuugaaaaaauauaguuuaacuucuuugaacaaaggagauaaagaguaaccaggauuucauuuuuaaaauguaaaacaauauuuuguuuaaaaaccuaccaaauaauuucuuaauuuucaauuucauauuaaacaaacuauauuuaccaguuuaucaccaaauuauuuuuuacaaaaccuuaaagggguuucucuaucccaugcuacuacaaaguaacuguaauuuuaaaaaacaggccaagcacaguggcucacacccauaaugcgagcacuuugggaggccaaggccaggagaaucacuugcgucuaagaguucgagagcugccugggcagcacagugagaccccauuucuacaaaaaauuuaaaaagaaaaauuagccaggcaugguugugccugccuguagucccagcuacucaggaggcugaggaaggagaaucacuugagcccaggacaugaaggcugcacuaagccuggguaacacggugagacccuaucacaaaacaaauaaacagacacccagaucgucauguuuuccucagaaaacuuucauuucaaaguauauuaggaucuguugacugcauuuuaagauauuaacaaaaauaaugaucacuucaccucuaccucuguucucugagaagugaucaacuugccaugucacucuaacuguaacuaaagaacauugaaacagcagacuauauauuaagauuuacccccucugccucacuccaccagcuagcuaauucacaaauaugaaaaaugacaauccaccuuuaaaacauggcuuaaaauaguacauuuagagaaguuuucauggggugaaucacuuccucacauuuuagcucuaaauccaaaacacaagcauuugucaccacgaucccucuaacaacccuccauuucacugcguaccuguggggcuuggcuggcugcuggcuuuccugcucuuuugcuacuagauguuccucucccugguugucuccagaguuugcagaccuuuugguaugaaguaaaucuuccacuuucccacuaugccaaacaaucuuacgauauuuaaaagccauuuucccucucaaauaacaaugaauuugcaagcugucugacacuuugaucuaucuguauuuaucaaccuaauaucuuucagcaggauuaauuugccaggcaugcaacuuuuaaagggaggggagaaaaacaacauaaccauuaacagcauuuccaguuccaugguuuucauucuucauggaucacaguguguuucagagaugguaacauaguugaaaaacuaaaccgcacugacaggauaaaaugucaauauuccuuuuagaugucauaagucauuuuccguguuuuugacagaaauguuagccccaauuucucucauaaaagcacauuccuaaaagauaaauccuuccaaagaaaacacaucuuuuugaaacuucagagguaaacucugaaacaacugcuuuaggaagggucacccuuacagcucaguuugccugaggcuguccugugucauguuuguggucuugguauaauuauuaauagcacugucuauaauucucagaagugucccaguuuggagaauaaacuacaugcucacccuagcuuuagguugugucuccuuuagcauuaauacagccaucuguucaccuugaacagcaucaguauuuuagaauaccaucccaagaaaccucauuccuaauaaucaugcuucucccuuucuggccuagacuacagcaaagaacagaaagaucucugcagagcuugcauccaugauugccuuauacuaaaauaggcuccuaagauaccguucuuucaccaugguugacucccaccuaguaacagaagcuuauuauagauaucagaagaauauaacuacucccauaucacagaaccuuugauucuuguaucaaaaaaauagagaaaagaaacauucugcauuucugacuauugcacuccucauugaauacucucauauauauauauauauauauauauauauauauauauauauauauauauauauauauauauauauauauauauaugcccaggcuggagugcaguggcgugaucuuggcucacugcaaccuccacccccaugguucaggcaauucucaugccucagccucccaaguagcugggauuacaggcaccagccaccuugucuggcuaauuuuuguguuuuuaguagagacaggguuucaccauauuggccaggcuggucucaaauuccugaccucaagugauccgccugccuuggccucccaaaagugcuaggauuacaagcgugagccaccaugcccagccucuccuacaaauauuucuaacucuccuacuuguucucacagaaucaguauggaaucagguggaaaaugugcacuccucuuucucaggaguagggaaacugaggcaacagccagcuuagguuauacagaaaagucaccuuccgaggaaacugguucuauuagaaucacauugggaucccaagcagggacuagauuuuccaaaccuucgcaaggaucucugauuaaaauaggucacaaagaacagauauuuuaccaccaccgcccccgacacacacacaaaaaaaauaauagauuauaaaguaaaauuacugucaacaauguuuuucuaugacccuggcagaaucaggguggagucaaagauacugagaacucagugaagaccccugggcauguggcccccaugcauuacacagaacacuaaguuuaaauaaauagaugcuaagucaauggaaaguacaaugaaaaagaauaaaagcuaaccacuucucaauacgguaguaccaaaagaaaaaaaaaacuuaagugcaccagcccacauaauaaauaagaacacguugcucuuaccaaaucacgauggaaauuuacugcaagagauuuauguuaguguggcugcugcuguaugacaggaguacauacccucacaaaaacaacacuacaaugagaugauggcuaccucauccucauaaagcauccuccuccaccauaaacucuuacucaugaaagagauaagcaauauuauuuaguuuauuauuuuaccuuuaauaaaccaaaccuaagccaccuaaaacaaaucuaauuaucuauuuugauuuuaaaaaucccuccuaccccugcccccaaaucuuuuuuuuuccguaaccuucccugaaaaaaaacuaguuacagaaauccaaaggcugaaauguauaaauucaaguguaccuuaauagaagaauaaaacaagagauuaagcauucuugaaugaaagugauuaaaacuugauuuagacucauuuuauuuaaaaacauaucaaaaacauuaaaacugccuuaggguuuauucuuuguggcuaaaugacuaaaucucuaaagccagucuugaaauuaguucucuaaaagucagaugcgcuaaagaaaugaguaaggcuuuuuuuuuuuuuuuuuugagacaaagucuugcuuuguuguccaggcuagagugcaguggcacagucucagcucacugcaaacuccaccucccagguucaagcgauucuugugccucagccucccuaguagcuaggauuacaaaugccugccaccacacccagcuaauuuuucuguuuuaguagagacaggguuucaccacguuggcucggcuggucucaaacuccugaccucaggugauucacccaccucagccucccaaagugcagggauuacaggcaugagccaccaugccuggccaaguaaggccuucuuacacuagacaauacaaauucugaacuacucauuauaccauauuucaucaauucuaagauaccauuaauuggaggaugaaucauuauuuuauauaccacuaugaaaaaaaaaagcugccaauuaaauaugagauaugccugacccaauaucaugcacccaacaucagugauaauaaaauguaaagaaaaaaagcaucuuagaaucagugaaauacccucaaauuccuauauacaucugucuuuuugcaaugcagauaugauuuauagucuucuguaauccaaaccuuugaaaugcaaaaaaauuaaaaucucuuaccuuccguacuacacucaggaaagguaucaaugagggaaucugagugagcuucagcaggaccaauuaauucagaacuaucauuaauuauuccacccuaaagagauaagagcaauuguguuucauuagcauuaagagcauaaacaacacuaaauaaaaaauaguuaucccaauuaaguauguguaaagauguacagaaacgacuauacuaaucuauuaaacuagaugacaaguguuuucaaaaaaaaacaauagguauaucucaucgacuguaacaaacguacuacaccaacccaagauauuuaauggcagaaacugggggcuggggaggaagaagagauauaugagaaaacucuguacuuucugcacaauuuuucuauaaaccuaaacugcccuagaaauagacuauuauuuuaaaauucaaaaaauguuaagagcagccagagagaaaggucagguuacccucaaaaggaagcccaucagacuaacagcagaucucucugcagaaacucuacaagccagaagagagugggggccaauauucgacauucuuaaagaaaagaauuuucaacccagaauuucauauccagccaaacuaagcuucauaagugaaggagaaauaaaauacuuuacagacaagcaaaugcugagagauuuugucacuaccaggccugcccuaaaagagcuccugaaggaagcgcuaaacauggaaaggaacaacugguaccagccacugcaaaaucaugccaaaauguaaagaccaucgagacuaggaagaaacugcaucgacuaacgagcaaaauaaccagcuaacaucauaaugacaggaucaaauucacacauaacaauauuaacuuuaaauguaaauggacuaaaugcuccaauuaaaagacacagacuggcaaauuggauaaagagucaagacccaucagugugcuguauucaggaaacccaucucacgugcagagacacacauagcucaaaauaaaaggauggaggaagaucuaccaagcaaauggaaaacaaaaaaaggcagggguugcaauccuagucucugauaaaacagacuuuaaaccaacaaagaccaaaagagacaaagaaggccauuacauaaugguaaagggaucaauucaacaagaagagcuaacuauccuaaauauauaugcacccaauacaggagcacccagauucauaaaguaaguccugagugaccuacaaagagacuuagacuaccacacauuaauaaugggagacuuuaacaccccacugucaacauuagacagaucaacgagacagaaagucaacaaggauacccaggaauugaacucagcucugcaccaagcggaccuaauagauaucuacagaacucuccaccccaaaucaacagaauauacauuuuuuucagcaccacaccacaccuauuacaaaauugaccacauacuuggaaguaaagcucuccucagcaaauguaaaagaacagaaauuauaacaaaauaucucucagaccacagugcaaucaaacuagaacucaggauuaagaaacucacucaaaaccacucaacuacauggaaacugaacaaccugcuccugaaugacuacugcguacauaacaaaaugaaggcagaaauaaagaugccuuugaaaccaacaagaacaaagacacaacauaccagaaucucugggacacauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuaguagaaggcaagaaauaacuaaaaucagagcagaacugaaggaaauagagauacaaaaaacccuucaaaaaauuaaugaauccaggagcugguuuuuugaaaggaucaacaaaacugauagacagcuagcaagacuaauaaagaaaaaaagagagaagaaucaaauagacgcaauaaaaaaugauaaaggggauaucaccaccgaucccacagaaauacaaacuaccaucagagaauacuacagacaccucuaugcaaauaaacuagaaaaucuagaagaaauggauaaauuccucgacacauacacucucccaagacuaaaccaggaagaaguugaaucucugaauagaccaauaacaggaucugaaauuguggcaauaaucaauagcuuaccaaccaaaaagaguccaggaccagauggauucacagccgaauucuaccagagguacaaagaugagcugguacuauuccuucugaaacuauuccaaucaauagaaaaagagggaauccucccuaacucauuuuaugaugccagcaucauccugauaccaaagcugggcagagacacaacaaaaaaagagaauuuuagaccaauauccuugaugaacauugaugcaaaaauccucaauaaaauacuggcaaaccaaauccagcagcacaucaaaaagcuuauccaccaugaucaagugggcuucaucccugagaugcaaggcugguucaauauaugcaaaucaauaaauguaauccagcauauaaacagaaccaaacacaaaaaccacaugauuaucucaauagaugcagaaaaggccuuugacaaaauucaacaacccuucgugcuaaaaacucucaauuagguauugaugggacguauuucaaaauaauaaaagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcagaagaaggaaauaaaggguauucaaugaggaaaagaggaagucaaauugucccuguuugcagaugacaugauuguauaucuagaaaaccccacugucucagcccaaaaucuccuuaagcugauaagcaacuucagcaaagucucaggauacaaaaucaaugugcaaaaaucacaagcauucuuauacaccaacaacagacagagagccaaaucaugagugaacucccauucacaauugcuucaaagagaauaaaauaccuaggaauccaacuuacaagggaugugaaggaccucuucaaggagaacuacaagccacugcucaaggaaauaaaagaggauacaaacaaauggaagaauauuccaugcucauggguaggaagaauccauaucgugaaaauggccauacugcccaagguaauuuacagauucaaugccauccccaccaagcuaccaaugacuuucuucacagaauuggaaaaaacuacuuuaaaguucauauggaaccaaaaaagagcccacaucgccaagucaauccuaagccaaaagaacaaagcuggaggcaucacccuaccugacuucaaacuauacuacaaggcuacaguaaccaaaacagcaugguacugguaccaaaauagagauauagaucaauggaacagaacagagcccucagaaauaacgccgcauaucuacaacuaucugaucuuugacaaaccugagaaaaacaagcaacggggaaaggauucccuauuuaauaaauggugcugggaaaacuggcuagccauauguagaaagcugaaacuggaucccuuccuuacaccucauacagaaaucaauucaagauggauuaaagacuuaaacguuagaccuaaaaccaucaaaacccuagaagaaaaccuaggcauuaccauucaggacauaggcaugggcaaggacuucaugucuaaaacaccaaaagcaaugucaacaaaagccaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaccccaucaaaaagugggcgaaggacaagaacagacacuucucaaaagaagacauuuaugcagccaaaaaacacaugaaaaaaugcucaccaucacuggccaucagagaaaugcaaaucaaaaccacaaugagauaucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcaauuccucagggaucuagaacuagaaauaccauuugacccagccuucccauuacuggguauauacccaaaggacuauaaaucaugcugcuacaaagacacaugcacacauauguuuauugcggcauuauucacaauagcaaagacuuggaaccaacccaaauguccaacaaugauagacuguuaagaaaauguggcacauauacaccauggaauacuaugcagccauaaaaaaggaugaguucauguccuuuguagggacacggaugaaacuggaaaucaucauucucaguaaacuauagcaagaacaaaaaaccaaacaccgcauauucucacucacaggugggaauugaacaaugagaacacauggacacaggaaggggaacaucacacucuggggacuguugugggguggggggagaggggagggauagcauugggagauauaccuaaugcuagaugacgaguuaaugggugcagcacaccagcauggcacauguauacauauguaacuacccugcacauugugcacauguacccuaaaacuuaaaguauaauaauaauaaauaaauaaauaaaaauaaaaaaaaaguuugagaaccacuuguauacaauauagguaaaacaaaaaaaauuaagguacuuuuaguagagauauuuuuuaaagauauaaaaaauaaauauaaaauugauuucucuauguggcuaucauuuuaauucccuauuuagguuugcaaauucacgccucagaaaguuaaucuuacucuacaugcagcuagagaaugauaucaccagacaaguaguggugguaugaugcugugcuauagcuuuauguaugcuccaaucacaauagaagagcuuauaauccuuaaauaauuaaaacaauagcucuucugcuccuuaauaccuuccccucuaccuucuaccaacaguucuaugccuccaaacacuacuaacagaauaauaaagcucaaaagaauuacaagcccccauuuccucucuacuucagcacaaaaaaaacucaauuacuaucuuuaccuaaucagaagucccuucucugucagcuuguuuuuaaggaacagaaauuugaaauggucccucucaaauuaccacauuuuacuucccuuaguguuaugugaacuaaaaccuuaaaaaugauuauucucuuuaggagcgacaauuuguauuacuuuauucuacacuuuauuacaauauucagauuacagcuuauauuugaacuuuucuccaaaaagaauaucuauucuagacuaagccaucuuuuaaacaauauccaaaccaaaucaagauuuccaaguauucuagagaaugucaaaagauaaaguuaauguuaaaacaaaguaucuuucaacuauuaacuaccucuucuaccacuaggugugcgauuuaaguuaccgaccuauaaaaugucuucuaacuaagacauuauuuuauuuuacauauuucaugcaaaauaaaaaauacacacagaguauuuagaacaauguaggcacucaauaaauguuuauuauuaguugacauaagaucuucuuguaagauaaaauuuaaaaugcaaaauguuuuagcucauaauccuaaauauuuuauuuaccuaguuuaacaaacacuguuauaaaaaauaaauaggaaagaacaaauauuuaaugaaacacaacaaaaacuguuauacaggaacuagagggauguagcaguaaaauaaugccacaauccuaauuuuaaacuucuaauucaaaaauaaccuuuuagguguuucugaguaugcaguaaaaaaauuucauagaaauuuugggauauauaguaucucaaaguuuuucuguuaaugaagagucuagcagggaaggacuucugguauaguuaagugaggagauccagcaaaugcuuuccccaaaaggcaauuauaaaucuggagaaaucugucaaaaccaccauugagggcucuggaaauugacuaaaagcauaaagcaaaugaaagagugguuaccgagaaaccacagaaccacagguaagaacuauggacgucugugauguucuugccucaguuccucccaacccccaucccagcugaguggucacaguaauuauauaagggcaaggcaagucuugaaaaccagcagguucacuuuugaggaggcuaaugugauuuggauugaagcacagaaaaaaaaaaaaauccaccccaaauauugucaauaauaguagcaaucucagggccaaauauauggcaaggaaaagugauggcucagcacaccugaaguugcagucaggaaaagaccagacagcagggagauccagaaaauaacacagccacagggggucuucauaaagcucacuacccaucuguguagagaccagagaggggucaagcuauccacgaauaccuggcaaaccaugagacagugcacaggcacagaggaaauucaagacuucagaggaaaguaaaagccagggcaaauuuuaaaacagcugagacuuugaaaacacauuaaaaaaucaucagcauuaaaaggaaagcauauaauggcacagguguuuaagcacaagcaaugaccgagcacuggcugaccacaaagcuaugcugacacaggucuaaccccuauauagccuggcuuaaaaauaaaauuagaauuaaauauugggcagagauaucagcagucacacacuucacaggaaauggacuccacagauuuacuauggacuaaacacacuaacaaaaaguauuaguuacuaaacacacuaacauaaaauggcaagaauccucaggaagaaaaaaaacaucagaacuuagaguucuaucguauauuauccaaaauauagauuuuccaacaaaaaaaaauuacaggacauacaaagacacaggaaaguaugugacccaaacaugggagguaaccagucaaucgaaacuaucugugagggaacaaagauguuggacuuggcaaaaacuucaaagcagcuauuaaaaauauguucauauuaucaagggaaaacaugauuaaagaauuaaaaggacuaugacucauaaaauagcaaauauaaauaaaucaaaauuauaaaaaaggaucaaaugaagcauuuuucauaacagccauaagcaaaaacaaucugaaugucuaucaacuaaugaauggauaagcaaaaugugguauauucauauccauucaaugaacuauuauuuagccauaauaaggaaugaacuacugauacaugcuacaaccuggaugaaccuuaaaaacauaaauauauguacauacauacacacccucuaaaucuccaauaaaaaaaaaaaaacuucccaccuaaauuccacuccuagguauaccuacgagaaacaaaaauaccugucugcacaagaacuuguaugucaauauucauaacagcaccauucauaauagccaaaaggggaacaacccaaauaugcaccaacacacacuguagauaaacaaaauguaguauauccauagccacacaaaagaauauuacauaaucacaaaaauggauaaaguacugaugcaugcuacaacaugaaugaaccauuaaagcauaauacuacauggaaaaaaaaacaguuuaauucaaaacagcaucauaagauuaaaaugcuuacaaauaaauuuaaggcaagaagcuccagacuuauacccugaaaauuaugaaacauugcuuaaagaaauuacagaauaucgggccgggcacgguugcucaugccuguaaucccagcacuuugggaggccgaggcagguggaucaugaggucaggagauugagaccauccuggcuaacauggugaaaccccgucucuacuaaaaauacaaaaaaauuagccaggcgugcuggcgggcgccugucaucccagcuaaccaggaggcugaagcaggagaauggcaugaacccgggagguggagcuugcagugagccaagauggcaccacugcacuccagccugggcaacagagcgagaccccgucucaaaaagaaauuacagaauauccaaauaaauauagagucauuucauuuucauggauugcaagauaauauuguuaaaaugacaauuuuccccaaacugaacuacagauucaauacaauucuaaucagaauucugaggagcaagccaaaauaacucaguugggagagcaucaaacugaaggauuuuagcagguguuuccaauaccuucagccagguguggugacucacaccuguauucccagcacuuugggaggcugaggcaagagaauuacuuaaggcuaggaguucaagaccagccugggcaacacagugagaaccugucucuacaaaaaaauuuaaaaauaagcuggguguggugguuccugucccaguuacuugggaggcugaggugggaggaucccuugagcccaagaguuugagguuaaagugagcuauuauugugccauugcaucccagccucggugaaaaaagugagaccccaauucuuuaaaaaaaaaaaaaaaagaaguaaaauaauaaaauaauuuuaaaauucuaugagaauuuuuuguucacauggauaagcugccacuaaaaauuuuuauggaaguucaaagaacucaaaauugccauaacaauuuugaaaaaguaaaguaggcaaacuuacacuagcugacuucaauacuuaaaaagcuacaguaaucaagacaguaugguucuaggauaagacaggcacguagauuaauagaacuaucaacaguccagaaauaagccauuauaauuacagucaauuuacuuucagcaagagucccaaggugauucaaugaggauagucuuuucaacaaaugaugcucagaauauuagauauacacacaccagaagaugaauuuagaccguuccuucacaccguauauaaaaugaacuaaaaaugaaucacagaccuguaacauuaaaacuucuaaaaguaaacagaagaaaaucuucaugaucuugggauacucgaaaaguuccuggguaugacaggcauaacccaaaaaagaaaaaauauauauaaauuauacaucauaucaaagcuaaaagcuuuugagcuucaaaugacaccacuaagaaaacuaaaaggcuacagacuggggagaaaauauuuacaaaucacuuaucugauaagacuguuuauacagaauauauucagaacucuuacaacucaaugauaacccaaucaaaaaaauggguagauuuuaauggacauuucaccaaagauauaugaaaaaagcagaggaaaacaugcucaacaucauuagccauuaggaaacugaaauuaauacuauggugaaaugccacugcacaccugcuagaauggcuacaguuaaaaaaucagacaauaccaaguguuggugagguuguggaacaacugguaaguucaaacauuacuggcuauuuuccguuuggaaaacaguuuggcaguuucuuaaaaacacgaauuuaccauaagauccagcaauuccucuccucaggaaucacccaagaaaaaugaaaacauauauccacacaaagauuuguaggcaaauauucacagcagcauuagucauaacagccaaaacguagaaacauccaaacauguccaucaauuuaucaaugaaugaagaaaaugugguauuaucuauacaaugaaaugcauuucagcaacauaaaagaacaaaaugcugauacauaacaugaaugaagcucaaaagcauuaugcuaagugaaagaaaccuauauacuuauguugugaacaaaacgcuacauauauuguguaauuccauguauuugaaauuauggggaaaggcaaaucuauagacagaacaaggugguugccccaggcuggggauggaaaaggggaucaccauagcaaguagacacagaggugcgguaauggaaaugaucuaaaauuggauguuggccaggcacaguagcucacaccuguaaucccagcacuuugggaggcugaagcaggcggaucacuugaggucaggaguucaaaaccagccuggccaacauugugaaacccugucucuacuaaaaauacaaaaauuugccaggugugguggcacacaccuguaaucccaacuacucaggaggccgaggcaggagaauagcuugaacccgggaggcaagagguugcgguuagccgagauugugccacugcacucuagccugggcaacagagugagauucugucucagaaaaaaaaaagaauaaaauaaaauacaauuggauguuggugauaggugcaaaacucuauaaauuuacugaaaaucggugaauuguacaauuauaauuaguaacuguacuaauacuaauaaauaaacaaccagugaagaguaugggauggaaagguauagauaaaacaaguuuggcaauauacugauaauuucugaaaccaggccaugggucauagaaguucauuauacuauucauucuacucuuauguaugugguuuuuuaaagucaauguaagcaaguggcuauauggucauuugcauguggcaucaucaaugucucuaaagagaaaaauaaacuaugauacuauagcacacccugugaauuagcuaccccaaaaccuuccccacagccuucauccaugaucagaacuagaaagcuaagagucaccuuccgagacuccuucaaauuaaggaugggcaugugacccuguucuggccaaugagauguaagaaggacuaucucuagaucauguuucugggaaagcuuuuaaaaacugccauguuucuuuuggccuuuucccuuucacaccuaaacccagaaaccuaugucacugaugacauuacugagcuccauaccaguccuggacuaccuuccucauucauacuucuugucauaugaaaaauaaauaccuuuuuuuuuguucaagcuaauggaaugaguuuuuuuuucuugcuugauuaucucuauuuaaauagagauaaugacugaauaccacugcucugauauucccaaaucaguauccuguucccgccuagcacgcuguuaaagauaguucuaagauacuuuccaagauuaguuugacuucucuuaaacuguccaaucuuucacaaacucugaaaaugacagucucauuucccagugacuuccagcaacaauuacaaucaggaauucccauauccagaagaaauacaaugaacagcuaacuuuuacuuaaauuguuuaaaguauuuaauaggacuuccauaaucccuaauuuuuuuuagccauauggcaggugguaauuugcaugacagcuuuucacaauuucuauaaagcaauauucuuguuuaauaauaaagccuuuuuccauaaaaaacagacucccugacacauagaaacaauuauuaacaaagaacagcaaagagcuaaauacucuaucaauuugauuuggccuuuauccuaaagaucugcauagggccauaugcagaaaucacauuuauuaucucagccuaguuugcagaauggugaaaaauuaagcaacacggucaaucaucagaaauguuauuguuacuauaaacacuucuauuacuaucauuauuucuauuacuguaaauuugcaauaucuuucaaaagaacuuucuucaguagauaaaacaucauaaaaaauaaauuccuaggugaugaagcacuggcagaaaaaaauaaauaaauaaauaaucuguguagauccacuaaaaucagaaaaauuaaauaucucacuauucauacauaucacugguuauauaggcuaagaaauuuaacuuauacaagugaauagauuuuaaagaaguaaaaacaauuacagcacaaucacuuagauuucuuuuuuuuuagaagguuaacucaaugcaacagggaaaauguaguaauuaaauacaacaauaccaacugacaacauauaccgauacaguucaaaauaaguuagaaaauuauuauuaaaaaugguaaaaaaaaaaaaaaaaacuuaaaaugaaagcauuacauaucuaggaacuuaaaacacuaauauccaaugaucuccaguaauauaauuugcacuggccugcucucuaaaacugugcaguuuuauauuuuuguuguaucuuuauacaagucaacauaauaacaaauuuaauauagacuuacaguggcuuauauuccaagaguaaucugccacugaaagacacuucaaaaagugaagguaaguacuagaguuuuaugaugcuucauuuuuuuuaauguauuucaauuaugacagagugaguuaaacaaucucuaagcucuuugcaucaauuuuuuaagauccaugaaucaaaaacacucaggagucugaggcaacaggaggcuugagcccaggaacucaagacuauaguacgccaugaucacaccugucaauggccacugaacaacagucuaagcaacagagcagaaccaguuccuuuaaaaaaaaaaaaaaagcauaaauuucuauacuaaaaauaggaaauaugccauaaacauuauuauagagcuauuaauuucuacuuuuauagugaauaacgaaauucaaaaguggcauuuuuuauuuuacuuuacuacaaauuacaaaaguauuuaauaagauauaaaauauuccagaaagacuaccaaaccuugaaaaagucuucaagcuguuuacuauuguaaagagcaggaauauuggcagagaacuguagcaggucuucagcacauugucuucucucuucgauaacaguuucaucaaaucgcccuacaauuaaauaagaaucaacacuuaagggaagaaugaucaaacacugguuuaugauaguuuacguccacagaucagaaagcagcagcaggccuaucacuuaguugcuuugcuuauuaugcaaacuucugaagucaaaucuaaucucuacaauuagaaucagcaguacucucaguagaaaagaaaauguuucugauaaaacaagagacaaaggugucaaccgauaaauaaaugguacauucauaauuuagagccugucaauuuaagaaaguugacauuuaagaagcuggugauucgaaacuaaagaugaaaagagaauuuuaaagaagugaaaugguuuucuauaguaaucuaauacuguaauuacucauauaauuuucccuuuucuacucuuuuugauuuauaaaggggcugaagagaggaaauuaugagaacaucuguauuauuaguggggucaaaaaucucagcuugaagcaaaaagcuuuuaugcuaaauucaacgugugaugcugucagcauacauaacagcaugcuugugagaaaaaagaacacacauauggcaccagugaguucugcuuuacaaggugaucaaaaggugcuuuccauagaauuuuuaaaugauacauaaaauuugaaugcugauaagacauuuucaaaauaugaucauuuuguaguacuuagauuagauuaccaguugacauuuaucauaugccauauaucauacugauugcaauaaaaaaauacaaaaucagaaaaguagcaucaccacauaaacauuuuaagugccuuugcagaguauuaacagaaaacugaggcacaaagagauuccuaguuauauaggcaaggcaagugccuauaugacuggcaagugaaacugaaccacuaaaauacccucugcccagugugucucaugcuuauggugaagugucuauuucacgauaacuaaaaggaccugaauucaaauacuaccucuaucauucacuagcuauaaaaucuuaggcagauuauuuccucauuuuuaaaauguaggaaauggauaauguacuuaagguucccaguuucaugcgaggcacauaguaagcacuuaauagaauaucaugguucuuugaaucuucaaguucuaucauacugacuaaaauacagagcaugcuagcaagcuuuuauugacugugugagugaauaacaaaaacuuuuaaaagccaugucaaaauaaauaaauaaaugucuuacaaugaaacauuaucacagauaaucuuuuuuuuuuuuuuugagacagggucucacucugucacccagagugaucaaaaccucacugcagccucaaccucccaggcucaagcaauccucccacuucagccucccaagaagcugggacuacaggcacacgccaccacagccagcuaauuauuuuguagagagagggucgcacuacgcugcccaggcuaaugucgaauuccuggaugcaagugauccucccaucuaggccucccaaagugcugggauuguauugcaggcaugagccaccauacccagccuauaacaggaaaucuuaacaguggauccauacacaaccucuuaggcaaugguucauggaugggcuccagagacaauaaucccacagaauuccaugcauauauauacacaggugcauuuuucuaaggauagggucuauaacuuuuaucaguaucuugauagagccuaggaccaaauaaaggucagcaggcaaguagcagucaauuagaggauuccuaacauucuguauacugcuuuacuuacuauggaauaggcuguccacugcuauccaaauauuuguucuugcuuucuuccucaauuuuuauucaaauggguacaugacagcccaggaaaaaaaaaauuguaauugccagcuugcuuugcaguuaggcauagauauaaacuaaguucuggcaaauagcauauaaacaaauuauacuguagcuucccagaaaucuuuuuaaaagacaaaugacauacaaccucucucccuuucuucuuugucccuucccccuuucaagaagaaccaagaaguggaagguuaaaaaugacacaaacaggguacaguggcgcaaaccuauaaucccagcuucucaggaggcugaggccagaaggaucacuugagccuaggaguucaacucagccugggcaacauagcgagacuacaucucauuaaaaaaugacacagcaacaagacaggagcuuggauuccagaucacugggcagcugccacgcuugaggcuaccuccaaaucuuuugccaugaggaagaaauggacuucuaucuugaguuuucucacaaauaaccaaacccaacauaauccauuaugccacauuuguuuuucuuaguucucaguucaaaugcucucaguucaaaugcaacaauuaaacucaacccucccaauaacaauaccaaaucuaaaaugacacuacucgcuuaccuaucacuaauauuaucuagaaacaaaucugcaagaaccccaauagguaaaaccaauucucuggcuugaaaacaaucuaaaugauuuaaucuuaggaaaaaaucuacuggccaacuagauuaaaugcucauuauuccuuauuuugccuaaauaagaaaguaugaaucagugcuuaugauuauaguccaauauaguuaucgcuuaaagaaaaaaguaaauucaagugccuauaaauuaauauuaguaauuguguaaacaucuaaaagcuuagaaaaauaaccuagaaaaugcacacauuauuuuauacuuugacccacuagacuaccugagaauaucuuuaaaugcauuaacuacuuguugagaaaucuuaauggaagucuucuuaauauuuaauaguacccuaaaaagaucuuauuucuaucugaaacaaauacaaaaaaaaauuggaggcuuuaaucuucuccauuaagcuaaaguaaaacacuuaagcaauggaauaaaugucaaaagcauuucuuguacugcuauugauuuauuguuucuauuccacuaaacuuugacaagcagauaugaauugagacuuuuuuucagaguagugcacaaccaaaaauaaaggguuaugcauuaaauaagcuucaauuacauugaauccuauuaucagaacaaauacgauaaaggaacaugcucauuucuuuguuccuaaaauacuucagaauaacaacagaagaauggcauuaagugggcaaaggacaugaacagacagacucuucucaaaagaagacauacaagcagccaacaaacaugaaaauaugcucaacaucacugaucauuagaaaaaugcaaaucgaaaccauaaugagacaccaccucaugccagucagaauggcuguuacuaaaaagucaaaaaauaacagaugcuggcgagguugcacagaauagggaaugcuuauaaacuguuggugggaguguaaauuaguucagccccuguggaaggcauguuugagauuucucaaagaacuaaaauuaccauuugauccagccauccuauuacuggguauauacccaaaggaaaacgaaucauucuaccaaaaagacaccuacacucucauguuuaucguagugcuauucacgauaguaaagacauggaaucaaccuaggugcccaucaacaguggacuggauaaagaaaaugugguacauauacaccauggaauacuacacagccauaaaaaagaaugaaauaauguccuuugcagcaacauggaugcagguggaggccauuauccuaagugaauuaacacaggaacagaaaaccaaauaccacauguucucacuuuuaagugggagcuaaacacuggguacacauggacacagagaugggcacaacagacauugagaacuccaaaagcggggauggaaagaaggagauaacuguuaagaaacuaucuauuggguacuauauucauuauuugggugguaaguucauuugaagcccagaucucaacaccacacaauauaaccagguaacaaaucugcacauguaccugcugaaucuaaaauaaacuaauguuuucccauuuccugauaauaauaaaauuuuuaagagaccauuaacacaugaauagacgaacaacugacugggagaaaacauuugcaaaacaucaaacgacuggugucuaagauauacaaagaacuccagccccacaaaauagacaaaagauguaaacagauacuucaaaaaaaaaggauauaugaguggcuaauaagcaugugaaaaaaucuuuagccuauuagccgucaggaacugaaaguuaaaaccacaauaagauaccauuacacaugccccagaauggcuaaaauuaaaaaaggcugauaaugcccaauguugguaagagugugaagcagccagaaauuucauacauuguugaugggaauaucaaauauacaagcacuuuuggaaagucucuuaguuccuuauaaaauaaaacauacaccuaucuuaugauccagaaauuauauuccuagguauuuacccaagagaaacauauguccauauaaagauguuuauuguagauuuacuuaaaauugccccaaacuggaaacauuccaggugcccauugauagaacaguggauaaacagacugugguacauuuaaacuaaacagcaauaacaaggaaugaaccucugaugaacacaacaguauggaugaaucccaaaaacaugcugcaggagggaagccagacaugaaaaguuuguacagcgugauuccauuuaaaauccaggauguacaaaacuaauauauaguagaaaaaguuccuucuggguagcuuaagggcagggauugacagggaaggggcaagaagcaaacuuuuagguguugguaaugcccuauaucuugauagggguuuggguuauacagguauauguuugucacacauacaaugggauacuuaagauuugugcauuuaacuguguguaaacuuaucuaaacaaaauguaaacaaauacugaacucuuauuaaugacaauauguuaaaauauguaugggugaaagacacugguaucugcacuuuaugcugaaaugcauaaaaacaagacagauuauggaaagauauaugauaaggaaaauauagcaaaaugucacuguccacaucuuucaacuugucuauaugcuugaaaauuuucacaauaaaauguugcguaaagucuacuacaaagaaaaaaauaguacucguagcauaaaugaaaaaacacagaugaauuuuaaugaaauaacuucuagaacuaauauauuuaauaaagacaaccuaauuugaaaauuuucaaaaaaguagcagcaagauucaacagucauccuaauggcagacaauaaccuugcaaccauucucuacuuguguauccuucaacauaaucaaaauuucacuugaaaggcuguaacaacaugagaaaucauaaucaggugcuucuccuacuacagcuuugaauuucccuuuguaguaccaauguuuauuuuccugugaacagaguagaaaaauuauagacauagaaacauagaaaaugcaaaacaaauuuuucccgagguuuacagugcaauauuauauaccucaucuuauugaauuucaauuuacugcucuucacagauacugcauuuuuuuacaaauugaagauuuguggcaacauuuuuccaacagcaugugcucacuuuaugucucugugucacauuuugguaaaugucacaaucaaacuuuuucauuauuauuauaucuguuguagugaucuaugaucaguaaucuuugguacuggcauuugcaauacaauaacauuguuuugaggcaccacaaaccacaagaauauaaaacgcaaacuuaguuaauagguguugaguguguucugacugcuccaccaaccagcuguacccaaucucccuuuccucaggccucuguauucccugagacacaacaauauugaaaguacaccaauuaaccucuacaauggccucuaaguguucaagugaaaggaagaguuacaggugucucacuuuaaaucaaaagcuggaaauaaggcagggugcaguggcuuacaccuauaaucccaauacucucagaggcugaggcgggcugaucaguugagcccaggaguuugagaccagccuaaguaacauggugaaaccccgucucuacaaaaaaaaaaaaaaaaaaauuagccgggcaugguggcacaugccuguaguaugccuguaguccccuguagucccagauauucaggaggcugaggagggaggacugcuugagucccaaaguucaagacugcagugagccaugaucgcaucacuacacuccagccuuggaaacagagcaagacucgguaaggaaggcauaacacaaaccaagaaauguugaaaguuaggccucuugcaccaguuagccaagucgugaauacaaaaaauaaguuacugaaagaaauuaaaaguguuacuccagugaacacaugaaugauaagaaagugaagcagcguuauugcugauauggagaaaguaaaccagccccaacauucccuuaaaccaaagcauacuccagagcaaggcccuaacucucuaauucuaugaaggcugagagaggugaagaagcugcaaaagaaaaguuggaagcuagcagagguugguacaugagguuuaaggaaugaagccaucaccguaacauaaaagugcaaggugaagcagcaagggcugaucuguagaggcugcuucaaguuauacagaagaucuagcgaaaaucauugauaaagauggcuacacuaaagaacagauuuuuaauggagauaaaacagccuucuuuuggaagaaaaugcuauccaacacuuucauaccuagacaggagaagucaugcuugguuuccacacuucgaagcacaggcugacucuucuguuagaagcuaaugcagcuggugacuuuaaguugaagccaaugcuuacugaccauucugaaaauccuagggccuuuaagaauuaggcuaaaucuacucugccuguguuccaucaacagaaaaagccucgaugacagugcaucuguuaauagcauggucuacugaauauuuuaagaccacuguugagaucuauugcacagaaaaaaagauuccuuucaaaaaaauuuuuuuugagacagucucacucugucccaggcuggagugcaguggcgcgaucucagcucacugcagccuccgccuaccagguucaagugauucuccugucucagccuccugauuagccgggauuacagguacacacuaccaugccuggcuaacuuuuguauuucuaguagagacgggguuucaccauguuggccaggcuggucuugaacuccugaccucgugauccacccgccuuggccucccaaagugcuggaauuacagguaugagccacugugcccugcccuuucaaaauauuauugcucacugacaaugaaucugguucacucgaagcucugguggagauguacaaggagauuaauuauguuuucaugccagcuaacacaacaucaauucuacaguccaugggaucaaggaguaauuuuguacuuucaauccuccuuauuuaccuauauauuucuguguguauauaauauauauaagccacuuccucacccccaauuacccaacaaugguuuauuauuuauuauuuauuuaagaaauacauuucauaggcuauagaugacauacaagugauuccucucagaaaccuaagcaaaauaaguugaaaaccuucuggaaaggauucaccacccuagaugccauugacaacauuugggggaagguaaaacuaucaacuuuuuuuuuuuucuuugauacagugucucgugcugucacccaggcuggaguacaguagcgcaaucucaaaucacugcaaccuccgccucccggguucaagcaauucuccugccucagccucccgaguagcuggaauuauaggcguauaccaccauguccggcuaauuuuucaccauguuugccaggcuggucucgaacuccugaccucaagugauccacccacccugcccucccaaaguguugggacuauaggcaugagccaccaugcccagccaacauuaauaagauuuuagaagcugauuguaacccucauggaugacuuugagggguucaagacuucaguggaggaaguaacugcagaugugguagaaauagcaagagaaugaaaacuggaagaggagccugaagacgugacugaauugcugcaaucucaugauaaaaguuaaaugaacaaagaguugcuucuuauggacgagcagagaaagucguuucuugagaaggagucuacuccuggugaagaugcugugaacacuguugaaaugacaacaaaggauucugaaugucacauacacuuaguugauaaagcagucacaggaucugagaggacugacuccaauucugaaagaaguucuacuguagguaaaaugcuaucaaacaccaucacauguuacagagaaaucuuuugugaaaggaagagucaauggauacagcaaaucucaucguugucuuauuuuaagaaauugccacaacuaccccaacuuucagcaaccaccacccugaucaguuggcagccaucaacauggagacaagacgcaccaugagcaaaaagacuaccacauacugaaggcucagaugaaaauuagcauuuuuagcaauauaguauuucuuaauuaagguacguacuuuuuuaagacauagugcuacugcacacucaauagacuacaguacaguauaaacacaacuuuuauauguacuaggaaaccaaaauauucugugugacucacuuuauugcaauggucugaaaccaaaucugcaauaucucugagguauaccuauauauuucuguguguguauaauauauauaagacacucucccacucccaaucacccaacaaugguuauuaaaagcuguggaggggagggaauuaaauccaaacauucuaacuaagcucauuacucacuaaaaauaaagccucucuguuugauuuauaagcugucuuugguaucuucccuauguuguuuuuauuauuuagaagaacuccuaaauagcagaguuuacaacuuuuuuaaaaugcauguuagucaucaaaagcuaguucauggaacuaaaacuuauccuugaccaguaugaaauuaucuagaaaagcuuaaugcugaugauucuuaacuauaucaaaaguucauucacagaguaaaaagaaagagagaggucaagauucucuggauuaaauucucucuagccaaacagcaccaggaacacaccuguaguuaaacaagcugaauuuauuacuucuuacaacuaaggagaauacauaccauugggaacacuggggcauuucaccaagaggguaucagaaaggacuuacagggcuuuggcuuguguuagggaaggguucaaggaagugggguucugcccuggauuggaugcugucaggaaguggagguaauucuaugauucucucaauucuaauucuaugauucuaugauuuuuuaauguaucuuacuaugaagcaggaaaaauaaagcaaggcuaagguuaugauuuauaaagaagcaguagucauucauuguaaccagaaugaggauauuugaucauuuuugugacuugaacaauguuuauguuuuugucuguguucagacaugacuacaggauggucuuguuuuugucgucauccaaggacauggagugaucuugucuuaauguucaauguucuauggaauuguuuuuguucaauacgagaacaccacagccuaauugugaauuccaggccaacucuaagaaacaccaaggucaaaccaauauagugccuggccaguucuuagcuauugggagcugccugucucucucucacaggaagucauacucugaugacagauagaagaaaacaaacaacaaacaaugaucuauucaugagaaaacaaucagacagauauagcuugugaaacuggcaaaacuacuguucuacguucuuuaaaaaugucaguguuaugaaaaaucaaaaagaaaaaaaauaagaacuauucuagauuaaagaaaccaagagaggcaugauuaugaaucaaaaaaaaaaagcuaaaaaggacauuucaaggacaacuacagaaaucugaagauggacugccuauuuuauaauauugcaucaauguuaaauuucauaggugcaauaugguauuaugaucauagcagaaacauggggaguagggaugaaauaucaugaugucugcauuuuauucucaaaugguucaggaaaaaaugagaaacacauacauagagacagaaaugcagaagauguggcaaaauauuaacaauccaugaauuuggaaaaaaacguauauauauguguucacuauacuauucucuugguggggggggggagcauaaauuugaaauuuugucaauuuaaaaaaaauggggaaaaauacaugaguuaagugcuauacugaugagaugaauaaccaggaaggguaaacaguuaacucagcugaaaagaagcauggcaaacuuccuagaagagauaucuucugaaaggcuaaccagaaacuucacagcggagcaacacaaaacuaaagaagaagacacaagagaguaagguauguuagaggaaugguaaacucacugaguaacagauaauagcuaacacuagcugacaugcaucuagcauggagcuaaauauuauacagauauaauuguuagaacaguaagguauuauccuuaccuuaccaauaagaaaacuagacucagauauuaauuuguauaagaucacacuggcaguaaauaguuaacagaagauacgggucuaaaucuaucugacugcaaaaaauaaguacuucucaccauaccauuagaacaauaacuacaucagcucgaucauaugcaaaauuacaagaggacuccuuugcugcugaaguuuacuuacuaauguaagaggaccuauaaaaagguagaugauuggcugggugcaguggcucacacuuguaaucccaggacuuugggaggcugaggcgggaggaucaccugaggucaggaguuugaaaccagccuggccaacauggugaaaccccaucucuacuaaacuacaaaaauuagccgggcaugguggcagacaccuauaauccuagcuacucaggaggcugaggcaggagaaucucuugaacccgggagguggagguuucagugagccgagauggcgccacugcacuccagccugggugacagagcgagacuccgccucauuaaaaaaaaaaaaaaaaaguagauuauuaaccaacaauuccuuccacacaaccacagcugcugccuacaagguucauuacaguuaucaaacauuacaaaugaacgguaccauuuauuaaaagagauaaauugcuuacuuauuaagauuaauaugaaacuuucauucuauaauauggaaggauguggagaaaaguuuaagauaauccauuagcagcugauaauaacagcuaagaacuucaaccaauuuaaaagccacucuuucacccagugacaaguuucuuuuuuaagaagccagcuauguauccucuaacauuaaagauaaauguguuaaauuccacaguacagaaagugcaaugcaacaaguaaaaauaucccuccuaccacucccucagagguuacauacacuauacaaauguguauagguaugauucauauauguuuauuuacacauacacaggaucuuacuaaacaucauuauacgcguuuguuuuguuuagcuuaaaaacauaucuuggauauuguuccauacaaguguauuucuuuuuuuuuuuuuuugagauggagucuugcucugucacccaggcuggagugcaguggcacgaucugggcucacugcaagcuccgccucccugguucaagcaauuccccugccucagcccccugaguagcugggacuucaggugcccgccaccaugcccggccuaauuuuucguauuuuuaguagagacgggguuucaccauguuagccaggauugucucgaucuccugaccuugcgauccgcccgccucggccucccaaagugcugggauuacagacaugagccaccgggcccggcccauacaaguguauuucaaacagccccaaaauccuauuacuuggcuaaauuauggcacauccauacaaucacagauagagaaacauucaauuuucaguuuucuucuacugaauauaaugcugcaaugaacacccuguguauauguauauauguguguacguguguucucuaugagccauccacagacugcagaugaucccugcagggccuuucaggcaaucagcaaggucaaaccauuuuaauaauacuacuacaaaagcaguugcauuuuuuuacugcacuaacauuugcacugaugaucuaaaagcaaugguaauaaaacugcugaccucuuagcaugaaaucaaggcaacagcaccaaacuauacuuacucggaauauaaugauuacgaguauaauaugccacucacucauauuuaaaaaaaaaaaaagaaauguaaugccaguuucauuuagaauguccuugauaaagcaguaaaaauuauuaacuuuauuaaaucucaacccuugagaacaauaauuuuuuaaauucugugaaaugaaacaaacuauaacuauucagauuuggauauuugacagacauuuucucaaacauaaacaacugggccuaacaauucaaggaaaauaaccaacaguauuguuaucagugauaaaauucaagcugucaaaccacuguaagcuugacagcuucccaauacuuuaaaauuuuuuccuuagaaaucugugaugauauuaaugauuuuuaacacuguauaauaaaauggguaaguguuuacaaaaucugcauaauucaggaaaccaauauuuuucaaaugaccaauacaugguguuacaaacucaugcccagguaaaagauauauucaaaucuaagacagaccaacggauuguaauguaacaaaguacaaaagguucauuuacaggguucugauuccacaaugcaacuagccuuuaugaaauuaccacacaucaaguuuugguguaucaaagaauaccuuuaauuaucugaaaaagguauuaaaacacuccucccaggccgggcgcgguggcucaccccuguaaucccagcacuuugggaggcugaggcaggcagaucacgaggucaggagaucgagaucauccuggcuaacauggugaaacuccgucucuacuaaaaauacaaaaaaaaauuagcugggcgugguggcuggcaccuguagucccagcuacucgggaggcugaggcaggagaauggcaugaauccaggaggcagagcuugcaguaagccgagaucacgccacuacacuccagccuggacaacagagcgagacuccgucucaaaaaaaaaaacacuccucccuuuuucaacugcauuaucuuugugacccugaauuuuacucauguacuucaaccaaaauaacauaucucaacaggcugaauacagaaacagcuauaagaauccagcuaucuccucuuaagccagacauuagagauuuguaaaaacauaaaccaacaccacucuucuugcuauuucuuuuuugcuuuggaagaaucauuuuucauaaaaacauccuuuuauguuaacauguaguguauuuuuuauuuuuauuuaauacaauuucuaaaauuucuaguaugguaaauauuaauagcuaaaaccuacauaaacaacaguccuuugaagucuucaauaauuuuuaagaauauaaagaagaaucuaagaccaaaacaucuaauagucauucauauauaucucccauguagacaugagaauagauguguagaaaaauuaauuaaaaacagaauagaaaagguuuauuucaaauugcccuccaaagaaacuguaugaauuuauacucuuccuguuguauaucuauugcuccauacuagguauaaucaaacauuuuaauuuuggcuuugggauugacuuuugaugacaucaucaccuauaacuacucuaccuuuuaaaucuuaacucauacuuuuauuuugcucaacuuauuuauaugucaggcacaguccuacaugcugaagauacauucauaacaccaaagcagucucuggaucaugcagcuuagggucuugucaaggaaucaaagagaaagagagaaaauuauaauuaaagggcaaggcaggguucuuacuuuuagaacacaagaaaaaauacuggcuguagguuuagaagcaugauucuuaaaacuccucagacugaugacuucuuaaaauuaucuucaucuucauauuuagagugccacaagucuuaaaaacuugauggugagaauaccacauccugaaacaguucucuuucucaacucuggauccuaaugcucacuucuucaaccauaagacucuaaguuucuuagaggggcuguuugcaucaugauauccucagugccaauuuuuagaaagcuucuugaauuaaauaugcccauaaaauuucuagauaauugauagcuggacugaaauuagucaaagaagauuauuaauagcuacaugauccagagacuguuucagucuuaugaauguaucuucagcacguaggaccgcgccugacauauaaauacuugaaaaauaaguugagcaaaauaaaagcaugagguaauagauuuuuggcauguaaacaugcuugccaggcacuuuaacagcaaaauggggccgggcgcgguggcucacgccuguaaucccagcacuuugggaggcugaggcagguggaucaccugaggucaggaguucgagaccagccuggccaacauggugaaaccccgucucugcuaaaaauacaaaaauuagccaggugugguggcacaugccuguauucccagcuacucgggaggcugagacaggagaaccgcuugaaccugggaggcggagguugcagugagccaagauugcaccacugcacuccagccugggugacaagggcaaaacuccaucuuaaaaaaaaaaaaacaaacagcaaaaugguggucaaaagagguaguaguugcaaugggaaagggcacacacauacaucuuuaaaugggaaagguaucaagaaaaaaaguaaggaaccauugauauugaauaguaacuguaaagagaaaacaacagaaaugugaagcaccauggaauauaaggucaaaggccaaaagcaggcagucacaugcuaacagccuacaacgguaagaguucaugaacucccaaaugcuugguaggggaacagaauggauugaagacccaucaucagaacuaaugguucuauugcuauugaccuguugcccacaucccucaauugcuuucacauaagaaaauaaaaauguuuuucuuuuuauuaugugcccaaguuaccucuauuacauauaucucaagauauuaaaaaaucauaaauuguuacuauuaaauauuuguuaaaauuaaagaauaguagcaauaagcuuuugaugaucacuucauucuggcacaaaugccacugauguugcuauacuaugugagauucucuguaucuuguccccaaaucucaaguaggcgugaaauguaaaacguacugaggaagcaagugucaaguucagugaauacuguaauccuauaaucagccuggagaaaccccuguuccauguagacuaccagccaauggaaacaggucauucagaauuacuucagaucauucagaacucuuccuaaaucagaguaucaauauaggguucaaucaagagacagaagccacacaguaauuugaacagggaaaaguuuaauauaaaaaaaauuagccaugaggccaggcgcaguggcucaugccuguaauaccagcacagcacuuugggaggcugaggcggacagaucacuuugugcucaggaguucgagaccagccugagcaacauggcgaaaccccaucucuauuaaaaauacaaaaauuaguugggcaugguagccuguaaucccagcuauucaagaggcugaagccggagaaucgcuugaacccggagguagaggcugcagugagccaugaucacaccacugcacuccagccugggcaacagagcaagacuccaucucaaaaaaaaaaaauuauuagccaugagaguggaguaacaauaaagguaaaaagagaacucugaagaauauccuagggugagggagaauacccaaagaaggaacaacuuagaaaggggaacucuucuccaaggcugggauucggaucucuguagagaaggugugguuggguugcagccauuggauggaaaaaaaguuugcuagguucccugggccaucguugaaccacaguugccagaagaacaggaaagacuccuccagaauucaagcaugccaaggcugacaggugagcacacagucaugguaugaggaaccaacucaccagcaagguaaugcaaguccugggguaccuaccaucugcagugggaagaccauaggaaacaacuuucugggguuaaagcagaccaaggcuagcagacaggccuguagaaggagaggggguuauuaggagcguacucuccaggagggcaaccaggucuagaguccaaaauguguuggcagggagggggaacaagggacacaggaaacaacucugcagggugcuagcaggccaaagcugaggggcagauacacagacaaauuccggguacacagaaggagccagagaguuagaaacucagucuccaauaggacugcggcaccuugguguccuuagcuaggugaucaccaaacuggcugagccugcaagcuuaucaagagauuguguggccaaggcagaauggcucuggcaacaaugcaaaaagagcaagaaaaaacaaaauccauaggauacuggaagaaggaagacaagcccccuauacuccugaaauggagugcccuccguugcuaagcuuaacaguguauucaccauaaagaaaaaauacugaaagaauccuacccauuaaccaaggaggaaaugaagaaagagauuugaagcuaagaagcaauaaagggauaacuggcacagccucuuagaaccaauaauuaucacuguaagagccccaggaacuccaggcugaucuugaaaggcaauaauuuccccaauguugauaagaaauauagcugguauuagcuaucagaacauacucuguaaagccgcugcauaaaaaucaaugugauauagacauagguauuuauauaagaauagacaaauaaaugccacaaaagagaaaauccuuaauuagugaaaacucacaugaagucuauacauaacaaagauaauaauucaacuucauugagaaaaagguggguuaucuaacaagugaucuuauaaguccauuucaucuguaaaaaaaaagguaaagugaaacaucaucugacauccuguucaaauauaaauuccucaagaauuauuuuuuaaacuuuuuuuuuaacuaguacuauaauaaucaucuuguaaaacagguaggcauuaggagacauuucuagucaagaccagaaacccaaaaccaggaggugggaggagaguacaaagagaacuaaauauauaauugaacauauaaaauuuuguuucacuaaagguauuauaaacaauucuaaaauauauguauaucuauauaauacacgugcacauauacauauauauaugcagguuugcaaaugauuagagguauguauaaaugugugcauuauaccuaugcauauagauaaauguauuacauuuccuaucucuggcuguugaaaaaagcuuagauguaaguugcaagaagcauaccuacuguccagauagugaucucuguagcagccagggucuggacagaaaaugaaauccauacagcaauuuaaauagggagucuuauaaagaauuauuaacuauuuacccagaauuaacuacuaagaagaaauaaaagacaacucuuaggaaugccuagauugaggaggaaaaccaaaggaaauaccugaaagaggugccuccuugccaaggcuggaauucagaucucauuggaggcaauguggcuguaacccacugguugucccugacauagcuguucuaauaugauaguaggagggucaaacuucaugggcaaggaacuacaggcugagacuggcaagcaggaagcucuguuguggugccagcagauccaggcugaaaggcaaggagccgcaggcaguaacugacaacaaaauuuccuaggggaugaguaccacuaggcaucccacacaugccacuggcagcacagagcaaauaggaacggaagcacaccaaaacccuacuuccuacaguguccuuccaacaccuucuacugacuaagcucauccauaccagcuggaaaaggagaucugacaaagcaaugaaggauggauguggagcuaaaauacaauaaacugagaagcagcauagucuuuaacaccauuauccacaaaaagcaacuaggguuccuugaagaaaugguagauuucagggcaggagcagaauaaauucaagaugagcacugaacaucuuguuaugccuaaaaauaacaagugcugaaauuaaaaaaaaaagaaaauaggaugagaggaaguuacaaggacacagaauccagcuuaaaagggcuccuacugaucaaagcugggacaauuugugaaucaaaauaauuaaauguauuaaugcauucuaaacuacuagaaaaaaaagauaugugaguccagaucaauuagggauagauggacagauucauggauacaauauauagauauacagacacagauacacagcucuauagauacacagagaaacguagaugcauaaacaaagagacacagauaaagggagaaggaaggguaacagcaaagguggagagguacaggaauuggaaaaucauuauuuuguaacuauuauauaaacauugagucaggcaagaaucaucaauggaugcuaaauccaggggauaauuuuguuuucaugaucuuacaaauaucuacccaaagguuacuuauuagcuucaagaaagaaaaaaaaaugaauauacauuguguaguagucugaaaacugguucccuaaagcuaaucccuggaaccuguaaauguuaccuuauuuagagagucuuugcagauaugaugaaggaucuugagauggggauauuauccuggauuaucuggaugggcacuaaaugcuucacaaguguccuuauaagagagucgagggcaauuucacaaagagggaaauaugaagauggaacagagggagguuugaaguugaggacccugaagacuaaaguaaugcugccacaagccaaggaacauaggcagcuacgaaaagcugaaagaggcaaggaacagugucucuccucugaaaagagagcaucccugccaacaccuugauuucagcccagugauaccaauuucagacuuuggccuucauaacugugagaaaauaaauuuccauuguuuuacgccaccaaguguaugguaaucuguuauggcagccccaggaaacuaacacaguggaaaagcuugacaauaccuugaccaggugacacaaauucauaucacuaauaaggggcagacagacaucaugugccuucagaugagauacucugaggacaccuaugcaguauccagccaggaagaauucauaaccuagaacuaaacaugagaaaacaucagagaaccuaaaaugagaaucguucucuuuaaaaagggggaaagggauauggauagagaggcagaagguauucuucaaaaaugccaauauaaugaaaacaaaaaacggcuauauuaacauuccagugacuaaauaaaauaccaauccuagaauggauccuaucccagagagaagaaaaaugauauuaaaaggucaacuaacaaaaguggaauacagaugguagauuauaucaaaguauuguaucaauauuaaauuuacucaaauugauaacugaacuccauugauguaauacaauaucccuauucuuagugaagaacugaagugcuuaggaguaaagggacaugaaauuuggaauauaauuuggaauagcucauuaaaaaauuauggccaggugugguggcucacaccuguaaucccagcacuuagggaggcuaaagugggaggaucacuucagucugggaagucgaggcuucagugagccaugacugugacacugcacuccagccuggacaacaaagugagacccugucucaaaaaaguuagaaaagaaagaaagaaaaguuaagaaauuaaaacuuaaaauaauguaaaauuacgugcauauauuuuauaugugugugcugggggagaaaggggaagagggagagagagaggagacagaggaagagagggaaagggagagagggaaggagaaagagugagagagacaccagcaaaugauaaaguaaaugggauaaaagcuuaacaauaagugaaucugguuggaaaguauagagguguucuuguacuauucuucuucuugcaacuuucuguaaguuugaaacaucccucaucuccacaggcugccugaguguucucaccauaaagcaaccaguuuccccaaaacauguaacgacacauggaggggaggugggagcaugagcacacaagauggaagcuacagucuuuuuuauaaccuaauccuggaagugauauaccaucccuucugcauaugcuaacagucauacagacuaauccugguucagugugggaagggacuucacaagaacauaaacaccaggagacagggaccacugggggccaucuuggaagcuggccaacacagaccucucuuuggccucaaagauucacaccccucccacauacaagaucuccucacccuccucccaagguccccaaaagucucaucccauuauggcagcaauucaaagucuagaaucucaucuaagucacauccacgugugacugagguucuucaggugucguucccuaaguguagcuccuuaaguacaaucuuccuaaccugugaaacuauagacaaguuaccuccccucuacccacucaauacacaauagugggauaggcauggaauaacugcuauagacauuccuguacaaaaaggggaguaaaugcgagccccaaagaagucaauggguccauaguaauucugaaauccagcagggcaaauguuggaaguuucugauuaaggcucacaggcugggaauaaauucuccaaggcuauggcucugcccucugagcuacugguuccacccucugagucauaccuccuuuucggugaaaaacagcaagguguguggcuucgugguuguuuuuagccuuccuuccaguaaaauuugggggagacaaaagucucuuuucacuuuguacugcuuuucugcuugucaguccaagcuaacaauguuucugcauauauaauuacuuauaacuuuuuugugggggggucaccugugacucuuauugggguuuacucaauuaaacaaaagugauagccacaaaucucaaguuaaacccuucuguagcuuuggcuucugcugaguuggcagaggcuuacacuuccacgaagcccuacuauuugagaggauguguaaggcacaaccuuaaucuuuauugagagcauuuggucugacugaaucuuucuaaggucuuaaaaaacauuuuauuucacacugggcuucaucuuuaggccauauuugcucagaagucauuucuuaauuuuaguacucucugcuauccagaaagauagcauuuucaaaacaaguccuaggaccuuuuuguuuaacaauccuuccuuuaguuucucucucuccuuucacauuuuacuaugagcagcaagaagcaccauacuguaaacacucuggguggaaaucucuucagcuagcuuacccaguucauuugcaaaguacauuuucaacuuuccacauaacuguaggcaacaguguugcuaaacuuucugcaacuacauaagagggaucuucccuccaguuuccaguaacacuuaccuaacuucuuugggaaaccucacuugcagucuuaccgaauaccaugaggcuccaacuaaucacuacuuuuuuuuauuauuuauuuuuuugggauggagucucgcucugucgcccaggcuagagugcagugacacgaucucagcucacugcaaacucugccucccagguucaugccauucuccugccucagccgccugaguaguugggacuacaggcaccugccaccacgccuggcuaauuuuuuuuuucuuuuuuguauuuuuaguagagacgggguuucaauguguuagccaggaugguuucgauuuccugaccucgugaucugcccgacuacgccucccaaagugcugggauuacaggcaugagccaccgugccgggcccaauuaaucacuucuucaaggcacuucaggcacucaccaacacuccucaaagcccauagcucauuucaaaaccacuccacauuuucaguuuuguuacaaagucuauuaaguaguuauugcuggguaacaaauuaucccaaaacaugguagcuuacaagaaacauuuacuaucucacucagucucugagggucaggaauucaaaaguggcuuggcuggguggcucuagcucaggccccucaugaaauugcuguuaacugucauucaacgcuguagucaucucaaaguucaacugggacuggagaaucugcuccuaaguucauucacauggcuguggcaggcuucaugcuuacuaguuuuuggcuggaugccccuguuccucaccaugugggccucuucauaggcuaccagaauguucuuaaccauaggaaaagcugguaucccucagggcaaguuaugagaaagagaaaggaaaaaaaaaaaaaaaaccuuaagagagaugccacagucuuuuauaaauaaaucucaggaaugagauauaccaucacuuuuguuauuggucacacagaccaacccuaguacaaucugggaaggugcuaugguuuggauauggugugucugaccccaucaagucucauguugaaauuugauccccaacguucaaggugaggccuggugugagguguuuggaucacgggaauggaugucucaugaguggcuugcugguucucacucuuaguucccgugaacuaaaccuguuggaaaaagccuggcaccuccuccucucucucguuuccuucucucgucaugugguggccucucauuccccuucugccaugaguggaagcaaucugagguccuuccuagaugcagauggaggccccaugcaucuuuuaucuccuguaaaaccaugagccaaauaaaccucuuuucuuuauaaguuacccagccccggguauuccuuuguagcaacacuacacagacuaagacagaagggaagacacaaaggugugaauaccaggagaaaagaaucauaggaggcuaucuuggaggcuggcuaucacaaaaggcaugguccaaauauuuagcaaacuaaaauguggcaugauuucaauucccugauguaguauaaggaaaacagagacuucacuuacacauuuuucuuauguuggcacaguaauuguaacaauugaaccuugcagaacaaaauguaauugugguauaccaccugguguuauaaugaacaauauuugcucugucauaauaacguuaauaaggcagggugcgguggcucacgcuuauaaucccagcacuuaggaaggcugaggcaggaggauugccugagcacagguguuaaagaccagccugggcaaaauggugaaaacauguugcuacaaaaauuacaaaaauuagacuggcaugguggcaugugccuauagucccagcuacucggggggcugaggugggaggaucgcuugagcccaggagauggaggcugugggacugcaccacugcacuccacccagggugacagagugagacucugucucaaaaaauaauaauuuuauaaaugauguuuauuacauucuagcuuugagaauuauucuauacauuacgagcuuaauuaugacuauuaaagagaauauaaauauuaccaccuuugacaaauguuaaacuauaagcacagauuucaaauguuaaguggugaagagagcugaagagguaggaggaagaucaaaaaugcuauuagaaucaucuuagacaaaugauauuguccacacuuacagaacgagaaauaaagucaacagaagaacuaaaaauauuauguaauaauacagagaaacaggguaaacaagcuaaauccuuacccaccagaguagugagucaauagauacguaaaaguuguuaaaucaagaaaaaaugggccaggcgcaguggcucacgccuguaaucccagcacuuugggaggccaaggaggccagaucaccugaggucaggaguucaagaccagccuguccaacauggcgaaacucugucucuacuaaaaauacaaaaaauuagcuaggcgugguggcaggugucuguaauuccagcuacucuggaggcugaggcaggagaaucacuugaacccaggaggcagagguugcagugagccgagaucacgccacugcacuccagucugggugacaagagugaaauuucaucucaaaaaaaaaaaaaaagaaaaaaagaaaaaaugguauaagcuuauuacagauacagauauaaguacuugaaaaaaaaggauuaaaauucaguuaugucuagaagcaaaaguagguggagggaaggagcaggaaacuuguuuuuaucgugcauucuucaauacuaccuuuguguuuuguuuuuauuuuacuuagccacaugccucuuuaaaaguuaucugccaggcgcgguggaucacaacuguaaucccaggacuuugggaggcugagguaggcagaucacuuaagcccaggaguucaagaccagccugggaaauguggugaaaccccauuucuacaaaaaauagaaaaauuagccaggcaugguggugugcaccuauggucccagcuaccugggaagccaaggaaggagaaucaccugagcccaggaagucaaggcuacagugagcaagaucacaccacuguacuccagccuaggugacagagugauacucugucucaaaaaauaauaauaauaauuuaaaaguuauuccaauguauaaaggaaaaugauguuacaauuauuuaaaacaaugagacaauaugcaucaaaagucucaaaaauaugcagaccccuugacugaguaauucuucucccaggaauucacccuacuguacaccugcacaguaauguaugaacaagaauaguaacugcaguguuauuuguaacagcaaaaggccaaaaguaauauaccaguaaaagauugguuaauaaaucaguucaaaaacuggaauacuauguacauauuaaaauuaguaauguagaucuuuuuauugacaugaaaagacaaucauaauauacugucauauaaaaaauaaagaaaaaauauauauacuguuauauaaaaccagguuacaaaaucauacauagcaagauuccauuuuugagguuucuauacauagauggguaaaaaggcauauacauauuaauaagcacaaaaauacaccauacacacacacugauacagagucuagaauaauaugccaaaauauuauacuaucuaggagaugguauuauugcugaauuucucuuuacguuuuaaguauuuuucuguaccaccugaguuauuugcauauacuacuuucauaaccugaaaaaaaauugucuaguuugaaaaauaaaugugcauauaccuugacucugcaauuacauaugcagaaauugguugcaaaaaguaauaggauaaaauguucuggcccgggcacaguggcucaugccuguaaucccagcacuuugggaggucaaggcgggcggaccacuugaggucaguaguuugagaccagccuggccaacauggugaaaccucaucucuacuaaaaauacaaaaauuagccaggugugguggcagacgccuguaaucccaacuacucaggaggcugaggcgggagaaucacuugaacccaggagguggaggcugcaguaagccaagaucgugccacuauacuccagccuaggugacagaaugagacuccauuucaaaaaaauucuguccauauaagaacauuuacguuagaguuauagaaaaaaaacaugaauauucuauacuuccagucaaaauccagacaggggacagaaacuacaccaauuauuuugacacagaaacuuuaauauaaaauacuguuaccuagguauuugaaaacugaugaggcaaaaaaaaaaaaaaaagaauacuaagguaucaaaaagaaguugcaagaagcaaauacuagaaaaccacaccauucauacuauaagcaaagugucagggaaacauacaaaaugagacuuaauuuaaaaaaagaaagaauuuuaaaacuauaagaauaacugaauaucaccuuuucuuauguuccuacaggguuuuuuauuugguugguuggaacugaaguuguuuuguuucauagauaggaagaguaaauauauucuggguacacaaaacuauaacaagaacaagaaaagacaauuucaagugcuguugaacaauaugaauuaucucaauaaguaaaagggcuucugacuucauaguguaguuauguuagaguucaguauauauacaaaauuaauuauuuuuuuaaauuacaauuucaaaauaaucacuuaccaaacacuauuccuuuagcaaauggaggaaacaacucugaaugucggaauaaguuuuugugaauuugccauaguucuuuguguaguuucuuaaaaucacuguaucucuuccauacaauuaucuagagagaaaaaaauuaaacauguaucucauaaccauuuagguucagauaucugaacaacaaauaauccuuucauuaaaguguucaaaauugucaugcaaaggcaaacacauguccuaaacaauaugauuaacugacugaaauuaacuaauaauauuugcuuuaaaaauauaaggcagauuccugcugaccaggaaaauaauauaaaauaaaauaaaguaaaaauauauuacauauaaagcggcaauucuuccucaaacuauucuguuuugguuucaaauuuucauuuuaaacaaguaugguuuuauucauacuggaaaaauauucaacccaguauggagaagauuuauacuauauaaaaugucacuucaucucuucaaaaaccaauuacaauuggccugcaaaugaguuagaugucaaaacauguauccuuucucaaaauaauguauuuauaaagacaaaauaauuaauuuaggcaauuuuuaaacaaaaguacauacucgguauuugccuaaaaggauaaacuggccgggcgcagugguucacgccuauaaucccagcacucugggaggccaaggcagguggaucaccugagcucaggaguucaagaccagccuggccaacauggugaaaccccaucucuacugaaaauauaaaaacuagcaggguguggugguggacgccuguaaucccagcuacucggggggcugaggcaggagaacugcuuaaacccaggagacagagguugcagugagccgacacagugccacugcacuccagccucagcaacagaguaagacucuugucucaaaaaaaaaaaaaaggauaaacugaguaacacugaagaaguagcuaugcagcaagcaauuaacauggacuuucaugucauaaaucuuaauucacacuaguaauaagaugucugcaggcaagcugaauccugaccagaacaucauuaaaauuaguauauuuuuaaaaaacaaaauaucaucuagauuagacgacauguaaaaaaguguguuuuccuucauuagucugaauuauuauuuaaccuuacucagauuauaucuaaaaaaaaaaaccacuuuguaaagaaaaaggauuugaaacauggccuugauaucacagauucagccccucaaucucuagaaaauagaguaaaauugaguuuuaaaucccauuacuucagauacuggggucuucugaaaaacuuaaucaucucaguucuaacaaaguuuucuaacaaguuuuucauauacaauagaguauaaugcuaaugagcaaauaacaggucaagcagguaaccaggugugauuuaagagauuccugccaaaaaaccuacccucuguauguauaaaacucuucagcaaacuuuuucaugcugccaaaaauucuaccuuaauuaauguuuauuguuuuuaauacaguuauaauccuaggaggcuaggcagacuauaauaugaauuaauuuuuaaaaacugcuuccuccugaugcuucccuuguuccuccugauguucccuguucauuuacucaacaacaaaaagagucaccaaacaaauauuucuauggcccuacuuuccacuaagcaucauauucuuacaaaguaugaagagaagggaaauacagguccugccuucaaagaguucacagucuaguuaggaagaauaagccaacacaucacaagacaacaucaucauaagacggcuugaaaaaugcugagaggggcaguccaagagugcuguagauguaguaccuaaaucagccuuguaugucugagaaggcuucacaaaaaguacuaccuuagagaguccugaagggaaguggucaguagacugacaaaaauaaaauaaaaggggagggcaccgggggugaaguuucuaaaagaagagugagaugcuaaguauguauuacuaaaugaagacaauuaauuuaggcaauuuuuaaacaaaaguacauacucaguauuugccuaaaaugauaaauaaacugaagaacacugaagaauaaauagcuguguagcaaguuuugcuacagaaugguggugccaugcccugaagugaacacuaaggaagcagcagcaguucugaggcaagaaagagguucaauuuucaacacauuugacuuaggagcucgugagggagcugcuuggagcuguucagugagauagguuuaggguugaagagcaaaaacugagcaggaucuauuagcuuguagauuaaaagaucaguagcagauaggcaguaaucacucaggaaagguuucucagcauacgcagugagaugugaggauucuaacaaugaaaugaugggaacaaaaaauuguuauuuuuauauuuuaaaaauauaucaaauuacaaucauacgacauugccaaggaauuaaaggagaaaugguugaugggcuuauguaagcaguaccuuauauaagguaaaugucauuauaaacuggacauuacguaagguuaaggucauuaugaccuggacaugaguuauucaaaagacuguagcucauggaaacaauuagauuugcagauaaaauuuuuauucuaggccgggcgugguggcucacgccuguaaucccagcacuuugggaggccaaggcgggcggaucaugaggucaggagauugagaccauccuggcuaacacaaugaaaccccaucucuacaaaaaauacaaaaaauuagcuggacgugguggugggugccugaagucccagcacuagggaggcugaggcaggagaacggcaugaacccgggaggcggaguuugcagugagcugagaucaugccacugcacuccagccugggugacagagcgagacuccguaaaaaaaaaaaaaaaaaaaaaaaaaaaaaauuuauucuaguuaagucauuuuuaaauacugcaagacaaacuuaaggagcaaaauuuaacaauuuaaucauaauaauuauuaaaauaccaugguauaugaaccaguagauagucugucagagcaagaauuagaaccccccaggugagaaucuguguuucuucaccaugcccuaauuuauucaauccuauauuccuucuucucaacucuagggcugcagaaccaaaauaccuaacagcaucgcaaaaugucacauccacugccuccuuuucuucuuacuccuucuaaguucugagguuuccagaaaucuucaaaauacaaaagugaacaaagauauacuuccacuacaacagcaaguacugauguucauaucuggacuacacaaaguccucagagacacauuuagaaauuauuuucucuaauuaauguucaauacuuucccauugaaaaaauaggucuauaacaaccucuuucuuuauugaaccaagucuccauaaguuucuuauuuauuaaagucacucugaagaaaaugucucaaugaaauauuaauucagugacaaccauauaaaacauacaaauaaaagcuuaauuuuaaaaacauucccuuaaauauuuucuacauaaauguuuccuuuucagauaauuacacuuaauaacaccaaaaacuuuuuagauuccuguauuuuacagaaccaccaauugaauuaacuuuguccuuuucacgcucacauaguuuuaauauuuaaaauuugcuggauuaucucuucuuacaaccaacaucacuaccacacuauuugcuuauggauuuuauuuucccucuuuucaagagccuuuccuuucccgauauauuucugaguguguaccuauuuucuaaaaugauuuuuucucacgcuuguaaucacagcauuuugggaggccgagaugagcagaucgccugaggucaggaguuugagaccugccuggccaacaugguaaaaccccgucucuacuaaaaauacaaaaaucagccaggugugguggugggcaccuguagucccagcuauucaggaggcugaggcaggagaaucacuugagcccgggaggccgagguugcagugagccaagaucaugccacugcacuccagucugggugacagagcgagacuccaucucaagaaauaaauaaauaauauaaauaauaaauaaauaauaaaacuauuuuuuaaaaaaggauuuaaaaguuagagauuucugacauaauacauagaaaguccuguuucaguucuuuuccuuucccaaauuucaccagugaaauauccuaccuguagagagaaacagguacagguuaauuuguuuaaaaaagggugagggggagcaaaaccaucucuucuucacuuuucugcugucuauucauguucuacacaaucuacugaaugacaggccacagaucuuuuagcauucuuaggaagaaaacacugaugugguggcaugugccaagguauauauaaaagaaaaacaacaaaauuucuccuauuuuauaaggcuagcguauuacuagcccuacauuuuguuaaacuaucaguacaucuaguccucaauagcccuugugaagcuuuacuauauagucuaaagcaguaacaaaugaauaaguuaauggagagggaaagugaaaggaagugaaaaacaaacucuaaguggugaauuccucucccaaaugagaauucuaauguuuaaauacacuaagugggaaacuaaaaaaaguacuguuauaauuucaagauuauucuauauuuuaagaagccaacuaaauagaaaacuuuuaaaaauuuauaccacuucuaacaaagaaccaugcaauugucuaacuaaaagacacuuacaagaguuuucagaugaaugguucaccaacaguuguuauuauaaaagaguuuucccgaaaaaaggacuaagaaaauggcagagaguauguucauggauagguugguucaggauucucccuggaaaaugggaacaucaagcuacaaacuacagcacagcaaucagacaaugcauucaaaggaaauacacccauuuucaauuuuaagaguuguaaacuagaaaucuaaagaauaguucacacucaucaauugauacaaguaaagacagaaaaguacuuuaaucaauggugcaaauuacuuucacugauacauauauauguauguauacauuuuuuucuuucaaaauaacaauauuacaauauucuuucuguuuccugguagggaaugaauugucuuaaaacccaucaggaaaauaguauuaaaucuauuuuuuuuuuuuuuugagacagagucucacucuguugcucaggcuggagugcaguggugcaaucucagcucacugcaaccucugccucccagguucaagcaguucuccuaccucagccucccaaguagaugggauuacaggugccugccaccaugcccagcuaauuuuuguauaaaaauauaucuguuuuaaaucauaggacaaaaacaacuaugaaaucagacauagccagaaaugauaauguauaaaauuuaaauauuaucuaaaccuggggccauacacucauaucaaccaguaccaaacagucaccuuaaauguaugaaucaagccagguauuuucuguagaguagugggacccguggcuaaacagaaacaaccuaccacccaaagacauucauauuuaauuguggaaaaaaaaaaaacaauacuguugcagaaucaggacuguaaacuuaaaguaucuguuuuaaacacauuagggaggcggaaaaaauccugauauauguccuucuagucuuagugaaauugagcagggacuaaaaugaaaauaaaucaagaaacauucaaagcagcaagcuccucaguaaggauuccuaaagauacacaacaagcacaaaguaaauacaaauagagaauuccacaauuuuaagcaaaacauaacaggcugguaccauuauagaaagaaggaaaaaaaaugaaaaaaugcacagaagaaucugcaaaagaacuuacuaacuuaaaguuuaaaaaaaaagaaauaucuaugccuaaagcaguuuuccaagaugucaacaugucaauucaaucuaaaagugaaaguaggcagagacccauaauuuacuguuagaaucuuuaaaauaaauauuaguuaccaaauacuuuuuauuacacaggcauuaugaucuugaaauggguaaauaggggcccuuaagugauacugaaaucuuguaaacacuaguuaccagaacaaugaucacuuaguaaacagcaccauaauucauuaaauucuuauuuauauaacuuaacaccuacuaaaacuuaacaauuacuuaguaggucucaaauaggacacuucagcuacuguuuugugaaaugaagacaaucuucacgcaaacauauaaagacugauguacaggccaggcacaguggcucacgucuguaaucccagcacuuugggaggcugaggcagguggaucaccugaggucaggaauucgagaccagccuggccaacgugguaaaaccccaucucuacuaaaaauacaaaaauagcugagugugguggcagaugccuguaauuccagcuacucgggaggcagaggcaggagaaucacuugaacccaggaggcagagguugcagugagccgagauugcgccacugcacuccagccugagcaacaggagcgaaacuccgucucaaaaaaaagagguugauguacaaaugauucaggcaauuuccucaaaaaagcauuuaguuaaauuuuuaucaaauacauaaaauaaaaucuucauauaaauguuaccuccuggacauccucuggauuucuucgugaaacaaccuaaaacaaaacauacauagaaaucucuaaucauuaucaaaauuuaagauuucauauuuguauaauuaacuuccaauaguauuuguaugaaaaauucaauuugcuuaaaaaaauaaacacuauaucauuuauccaaaacucagcuauauaauaacuucacuaucugaaauucauacuguuaaaucaaguuuaaccuaaaguuaccucccuuaggcuacauauuuuaaguuuggccuaaaaguuucucuguacauaaugaaagagaaauagauauguaaauagauguguaaagacuguaaccuacucuggcgccaaucaccaaguuuuggccaaagagagccaacuguucaaacaguguucaaauaaggcaaaugcuuaguuggaaccaauacagcuguuucaguuuccuuuucuguacaucacuuuccuuuuucuguccauaaaucuuccaccacaugguugcgcuggagucucucuggaccuacacuggcugaggaggcugaccaauuugugaaucauucuuugcucaauuaaacucuguuaaauuuaauuuggcuaaaaauguuauuuuaacaauacuaaaaauuaagcaaaaaaacagcuaaaaguaaguccacaugcuaaaguucauauauucacuacauucuuaagaaaaagcaucuggccuuuacucuuacuuaauuaacauaauucuaacaaguuuguucacaucuccccuucccagcaagccuauauacaaauuagaagcauaaaaagcagcugcacuuaggcaaaguguacaagggaucucccuacauuauuucuuacaacuguauaugaaucuacaauuagcacaauaaaacuuucaauuaaaaaaaagcagcuacaaugcucggacacaacaugugagaaguaugagaaguaaucacuggcuaccuaugaugaagaaaacaaaaguaauauaaauuauuuacaaacauucagggacaaauaauccuucuaucaauacucccuaagcaaagaggaaaaggagagauuccuucagacuucccugaugacaaaggccaaaaagucuaacaccagguaaaaagauuuuuuucacaaaacuuuugaaaaggcuagguguuuaaaucaucaaacagcauccuaaauuaggaaaaucucacauuagauuacauaauacgguaccauccauguaagugucaaauuaacgguuuugaagcuacaaugguguauuuugcaaaaauaaacaaaaagauaaaucaggcuguucugccuauggaguagccauucuuuauucccuuacuuucuuaauaaacuugcuuucacuuuaaaaaaaauuuuaaaaaaagauaaaucaaacacacauuaaaaugguugccuaggagugugaggaagaaaagggucuuugauaucuaaugacaauacaccaugaacuagggauuauaauccauucagcaacaccccuaaaguccaaaauaagaacaaaaaauagaggauguaaagucagacaaaccuugguucaaauuacaguuccucuuacagguuugaucucaucgauaaaacggagauaauacuaacugccuggccuggcuguugugaacaacaaauaaggacacagcaagaacucuauaauuuaaaaguuuccuguccccuaccagacagguuaaccauuguaaaaggucccaccuaagaauuccagagaacaaauaucuugcacucuauucuccaacuuucagaauauauaaacuuggugaaaucuuguaguaauugucauuaauuuauacuacagugcuaugcaauagaacuuucugugauaacggaaaaaaagguucucuauuugcaguguucaacacagccaccacuagccacauguguguggcuacugagccacugaaauauggcuacuuugagaaacuacauuaauuuuauuucauuuaaauuaauucaaaaaaauuuuuguauuaaagagacagggucucacucugucaccuaggcuagagugccauggcaugaucauagcucacugcagccucaaacuccuggacucaacugauccucccaccucagccucuuguguagcuggaacuauaggcacaccacagucggcauacacacacacacacacacacacacacacacacacacacacauauauacacuuuuuuuuuuuuuugguagagaugggggucucccuauguugcccaggcugcucucaaauuccugggaucaagcaauccucccgccucagccucccacagugcuaggauuauaagugagaaccacuguaagccuuaauuuaaauuuaaaucaaaauagcuacaugugguuaauggcuaccaaauuagacaacacagauucaguauaagagacuauaacagguaacuaacaacuauacauuauucaaaucuuugauuuuagcuauuacuuucaaauaccagccuguccccucacacaccuuuccaaaaguauaguauuucacauaguaugacuaauuuugcuucuuauaaguguuucuuuuuuuuuuuuuuuuuuuuuuuuuugagacagagucuugcucugucacccaagcuggagugcaguggcgcgaucuuggcucacugcaaccuccaccuccuguguucaagugauucuccugccucagccucccgaguaccugggacuacaggcaugugcuaccaugcccagcgaauuuuuguauuuuuaguagagacaagguuucaccauguuggccaggauggucucaaucucuugaccucgugaucugcccgucucagccucccaaagugcugggauuacaggcgugagccacugcgccccgccguucuuacauuuuuaugaaauguauugagaagaaaagucauggauaaccaauccacuaauaauccaccccccaaaaauagcacaugaucacucacagcaaggucuauucaaauguacuuuaaauuucacaauuuauguuuuucucagcuuaauacauuuccugaauuuauaaauauauucagauaucuuaaguauuuuaaauaaucuuccuuaauauaagcaaaugaucuuuuugagacagaauaacuuauuucuuaguuugguguacauauuagaaguaccacauuuugguuuucuucagaugagccaguccuggaaaucaaauacauguguacugcauaaacaaaaacacauuagccauccccuaacaauagccacaauauuaaaaccaucuuaucagaaauaaccaauuugauuauuauuucucagccguccucuuagugguuuacauacaucuaugugcuggauuacaauggugagcaagucccuuuccuccuggagcucauagucuagugguacacagugguggggugggaggggagugcagagugaaggaggguguauuucccaaacauauuuccauaccucagauaacaguagagugcuaagcaaaagauugggaaacacuucauccuagauccuucccaugacacugaauccucacugugcagagcaaaguggcaucccaaaagcagucaaccagucaugguuuagugauguaaggcucuuaaugucuucaugauaauaaaagugaaacugacccaauggucccacggacaguuuuuuuggauaaacauggaaacugacccuucugguauuaaagcuugaaacuuaacauuuguuuuaucagaguuccuucuucaggaaagggcccucaggccucucaaaaaguauuaauauugugaaccccgaauaucugagacaggucuuaguuacuuuagaaaguucauuuugcuaagguugaggauccgcaccgguaacacagccucaggagauccugacaacaugugcccaaggugguaggggcacagcuugauuuuauacauuuuagggagacauaagacaugaauaaauacguguaagauguacacugguucaguccagaaaggugggacaacucgacguggggagggggcuuucaggucacagguaguuaaaagacaaauggcuguauccuuuugaguuucugauucgcuucuccaaaugaggcaaucugguauguauuaaugguuaucucagugagccgaggggugacuuugaagagaaugggaggcagguuggcccuaagcaguucccaacuugacuuucaccuuuagcuuaguuauuugggggccucaagauuuauuuuccuuuuacaauauuaaauaaacugaaauucaccagaucacugcauccaaacaaugagaugccagaccucucauccaucacaauugcuuccuuaacccucuguaguuccuguuuucccauagauaaucacauuuucucccugcuauauaaacuccuaauuuuagucagucagggaaauggaucugagacaucuccuugacugcaacaccugauuaaagccggcuuccuuagcaauacucauugucucagagauugcuuucugugugacaagcagcaggaccuagacggaaccccugguguuuugguaacaacaguaacucaugauuauuaugcaauauacagaaaaucaaaguugaaguauacuuaaacuaccuaagugaaggucuuuaauuuuaggcuuacaaaaggaacuacucuguacccaccaaauacuucacagugaaggaggaaauuuagacaggguuuggaaaaucaaaucaaaagcuacuuagguauuaccugacaagccuaaagcuuagugaaaacugugucuuaaaagcacaggguuauacuucccugauucucuuuccucuuuggugcuuuugcuucucuuuuguagguuauucuucauccuucugcccccugguauucugugaacacuccaagaauuguuuuaaacucuuguuuuuuagccuccuuuuuauuauuaacagucuauaucugugcuaauacuguucaaggcacugcgcuaggcauagggaaaauuugacucuguacauuuacauuugcgaagaauuuuauauuaaugaaucacuucauuuucucaacaaccuaugaguuaggcaggaguagcuauuaugacuuccccuuuuacagauaagaaaacaaggugguucagaguccugucuaaagccacauggcuauucaccuucaaauuuagaaugagauccucgacugucugacuccuggucuacugcucuuuccacucuauuacacugccucccucuauuuaucugcgguauuuucagcaauaaugaaguuuacuuauuuccauaaaauuccaucgccauuagguuuuuguuuauuucaccuacucauucaacacauauuagugccuacucugcugccagguacugcaguacaauggagaauauacuaggucugauuccuacgcaacugcauuauaaaaauacaaucacuucccaaauacauuaccaacuucaaccacuugguaccccacuauuagggauucaguauucccgaaugugucaucucauuuaaauacuucacaaaugugucccccaaaacggaaacgaaaaccacaaaauggcuaggauaaugugaauugagugcaaaaauccaugaguaacaauucuuucuguguaauuaucuuccgugacugaaaaguuaaugaaaaauaagaguaucaaucagaaaucugagggaagaauauaaccauacugacaauaaauaaaacugagcuagcaacucaguaauuuuucucuggauaaauuucaagagaguuugucacaaaguucaaccaauaaauuccacaaaaguuggaauuuaaaacagugacuguuuucauuaaaaguucacaaagggccagacacgauggcucaagccuguaaucccagcacuuugggaggccgaggaggguggaucacgaggucaggaguucgagaccagccuggccaagauggugaaaucccaucucuacuaaaaauacaaaacuuagccaggcacgguagcagacgucuguaaucccagcuacucgggaggcugaggcaggagaaucacuugaacccaggaggcagagguugcagugagccaagaucgcgccacugcauuccaaccugggcaacggagcaagacucugucucaaaaaaaaaaaaaaaaaaaaggccgggcacgguggcucacgccuguaaucccagcacuuugggaggccgaggcggguggaucacaaggucaggagaucaagaccauccuggcuaacacggugaaacccugucucuauuaaaaauacaaaguuagccaggcgugguggcaggugccuguagucccaguuacucgggaggcugaggcaggagaauggcaugaacccaggaggcagagccugcagugagccgagaucacgccacugcacuccagccugggcaauagagcaagacuccaucucaaaaaaaaaaaaaaaaaaaguucacaaaggccaggcgcaguggcucacaccuguaaucucagcacuuugggaggcccaggcaggaggaucaccugaggucaggaauucaagaacagccugaccaacauggugaaaccccaucucuacuaaaaauacaaaaauuagcuaggcuuuguggcauccaccuauaaucccagcuacuagggagacugaggcaggagaaucgcuugaacccgggagguggagguuacagugagcugagauugcgccauuguacuccagccugggcaacaagagugaaacaaccccucaaaaaaaaaaaaaaaaguucacaaauuuggccgggcccaguggcucacgccuauaaucccaacacuuugggaggccaaggcagguggaucaccugaggucacaaguucaagacuaaccuggccaacauggugaaaccccgccucuaccaaaaauacaaaaaugagccgggugugguggcaugugccuguagucccaacuacucaggaggcugaggcacuaaaacaguucgaaccagagaggcggagguugcagagagccaagaucacgccauugcacuccagccugggugaccaagugaaacuccgucucaaaaaaaauaaauaaaaauaaaaauaaaguucagaaauuuccacugcaagcauuaacugccacugauucaguuaguacuaccuauauaucuugaaaugcuucuugcuuuuuagaaauuuaucaccaacucaucuuaaaaaguauuaccuuacacucuacuaaaaauacaaaaaaaaaaguauuacccuacagcagugcuucacaaaacauguuacauggaauaccaguauucuuuaaaaucagugaucucacaggaagggcuuaauaaucaauucaauuuaccucuuuuuaagaaggaauguuguuuacagcagaauucuucaaacccuuuaauacauuaauaugccuaguaaauccccaaaaggaagauacauaguauuucccaaagacaucuagccacucaauuuuuuauuuuuauguuauuuauuauuaucauccucauuauuuauuuaguacaacaccuacuaaaaucugaagcacuagagaaauacuaccacaauuucuguagucuaucugccucuguucaugaacagcaaauuaugaauuuagaaaaacaaugucucacagcaaaaguaacuaucucuuauugugcuaagaaauuaaauacucuacuucauucaauaaucacuacaaccaugcuugguaagaugagauaaccaaagaccuagaaaauagacucaaucaaauaacagaggcaggaccagaucucacaacuccaugacuccaaagugcucucuccaggacauaagccaauuggcucucuucaagauuaaaauuccaaguauucagguaauauuccugacaaaauaucucugacaaaaugccuauaggcauuacaguuagguaaacccuuugucuuacaagucaacuaaaauacagaaauugaagaaccacuuuggaaaagcagaaaauaaacaaggggcuuggaacuaaaaagaauggggucugaauaaugguguuggcacugcccaugaacugcuuuuucugccagcucaguacuaaaacaaaguaaaaacaaagaaaagacccaaagucagcccccuugccuauucugaaaacaaagaucagacugugaggcuuggccuaggucaguuccauaauaaucaacaggucacauugccacugggucccugaaauccuuuccaguaugcuaacuuauucuaucuacuucuuaauaaauauuaccauguuuccuuaaaagucaggucaaaagcacucucuugcccggaugcgauggcucacgccuguaaucccagcaccuugggaggccgaggcuggcggaucacaaggucaagaaugagaccauccuggccaacauggugaaacccugucucuacuaaaaauacaaaaauuagcugggugugguggggcucgccuguagucccagcugcucgagagacugaggcaggagaauaccuugaacccgggaggcagagguugcagagagccaagaucgcaccacuguacuccagccuggugacagagcgagacuccgccccaaaaaaaaaaagauucaaaagcacucucuuaucugauuaucaccauaaugaugauuagaaaucacucuguuaacucagacauauacaaaaagcuguauuuuuuguuaagauuaacaaagaguagcuacagguggaauauccuuuuuccaaaaugcaugagacaagaaguguuucagauuuuguauuuuuuuuggauuuuggaauauuugcacauacaugaaauauauuggggacaugacccaagacuaaacacaaaauucauuuguuucauauauaccuuuauauacagagccugaaaguaauuuuauacaguauuuuuaauaauugugugcaugacugcaaccuaucacaugaggucaagugugaaauuuuauaccuguagcaucauuugacacucaaaaaguuuuagauuuuggagcauuuuggauuucaaacuuucagaauagggaugcuaaccuguacuagaaaacaaaacuacaaaaauuauucaaacuuauaguauuuccuagguuaaaaaaaaagauaaaauaagccccuuuagaaacuaguauugauaagaaguuaaacauaaaauuuaagaagcuacuuuuauaagcaaaguauuguaaucaagucuucugagggcuacuucacuaucacuguucagcugcuaguuaaggguagcagagcuaagaagaaaaagugacaaaauuaauacuaguaauuacacuaagugucaagguacaaauaaucaaacauggaaaacauguccacucuuuucauuuuucaaagauaugaaucucugaaugugggacaggaauaauaugcagaaauggaaggcuacacuauucugaacauuucuccuuguggugauuagguauaccaaguggcacauucaucaauauaaugcaugcauuccugauuuucagauauuuaaaauccauacuuucauguuaacauacugacauauuuaaacuggacuucauacauacaaaaaaaaaaaaacacccaagucuugcaggaaaaguaggucaaagcacccagcucacauaggcaauuguuaccuuaccaacucaaccucccuuucaugaccaccugcaccugaguucuucucucccgcucuucccugcagagccacagguggcacugguuggcaagaauauuugggcugguuaucacccaccagccaggcagucuggacccaagaggcaacaccugcacaaaccauaauuagacauuuuauaauuuuuaguucucuggagugaaagaacucccauauaagauagauaagucaaugggacaaauuuuagacauucaacuuucuaacaaguuuucacgaaagcauuaugucaaaaguacuacagacugaauguuuguguuucuccuaaaauucauauugaauuucauguugaaacucucauccccaaugugauggauguggaugugaggccuuccagagguaaucaggucaugagggugggaacuucaugaugggauuacugcgcuuacaagaaaaagacaaugaucucucucagccaugagaccauacagcaagaaggcagcuguaugcaaaucaggaagcgggcccucaucagguauuaaaucugcuggccucuuggucuuggacuucccagccugcagccuucagaacugugggaaagaaaugucuauuguugaagccaucuagucuauaauaucuuguuauaaaaauccaaacugacaaagacaguaaggaguuguggcuuucuagauuauuaaaaucccaaaaucucagggagaguaaagaagcuaaaacugcaaguuaucucuagauacucaguauauguuugcuaaaguuauuuuucucaccucaaauuuuaccaauuauagcaguauucuaaacuauuuuccaaucaagguucaaggaaaaucaaaauccuuaauguuaaagaaagucugcaguuuaauauaaaaucuuaauaucugagacaaguugucaacaaacaagaugaaaucaggaaugguuuacauuuuuuaaguuccauuuacugaaauuuuugguauauuagaaaguuuucuacuaaacaauauuacaaguuaaaaacaaaggaacaguagaauaaaacuagacucuagaaaacacaagacaccuugagagccauuuuucaaaaauuuuaagcauaaauauauuuuacaacaaacuaauugcccucccuaucccuaugauuauuuuguuuguugaaaauaucuccagauuaagccaaaacuaaguauuuauucaagaaaucuucaagaagcuacugauuuaacaacugaaaucuaacaacucccacugccuuaauaucagacauuuguuaauaauccuaacagguuaaggauuuaaaauuuaguagguucuuucuuuuuuccuuuaaagugacucaaauuauugcuugaaauguguaugacuacauauuacuucaaaauuuaaaagcuaacaaaacuaaaaaguaaaacaugcagcuggacgcggugguucacaccggcaaucccagcacuuugggaggcugaggugggcggaucaccugaggccaggaguuagagaccagccuggccaacauggcaaaaccccgucucaacuaaaaauacaaaaaaaucagccggguguggccaggcgcaguggcucacgccuguaaucccagcacuuugggaggccgaggcaggcagaucacgaggucaauagauggagaccauccuggucaacaugaugaaaccccaucucuauuaaacacauaaaaauuagcugggcacgguggcgggugccuguagucucaccuacucaggaggcugaggcaagagaauugcuugaacccgggaggcagagguugcagugagccaagaucacgccauugcacuccagccugggcaacagagcgagaugcgucucaaaaaaaaaaaauuagccggugugguagcacaugccuguaaucccagcuacucgggaggcugaggcaggagaaucacuugaacccggaaggcggaggcugcagugagcugagaucgcaccacugcauuccagccuggaugacaagugagacucugucucaaaauauauauauauaaauaaauaaaacaugcagccucccauacacaaaaacucuaccgugaaaauuauacuagaggauaaaagacugaaugcuuuccuccuaacaucaagaacaaggcaaggaagucuacucucaccacuccuauucaagacuguggacuacaagucauagccaguguaauaaagcaagaaaaagaaauaaaagacauacauuuuggaaagaauaaauaaaacuaugccuuuuggcagacaacacagauugucuaugcaggaaaaaaccaagaauucuacuaaaaagucuuagaacuaauaagucaguuugaaaggucacaugauacaccaacauggcacauguauacauauguaacuaaccugcacguugugcacauguacccuaaaacuuaaaguauaauuuaaaaaaagucacgugauauaaagacaacacaaaaaugaaccaaauuucuauauauuagcaaagaaaagcugaaaaccaagauuuuuaaaaauacuauugacaauagcuacaaaaauacgaaauaguggggaauaaaucuaacaaaauauacagagaagcaauuugcucaaaaccacaaaaugcugauagaagagaucagagaacacaaauaaacugcaagacauacuguguucauagauuugaagauucaacauagaaaagauguccauuuuucccuaaagugaucuacagauuuaaugcacuccuaaucaaaucccaaaaggauuuuuuguagcuauagauaaacugauucuaaaauauauaugaaaaagcaaaggaacuaggguagucaaaauaauuuugaaaaagaauaaaauuggagaaacaauauugccuaauuuuaagauauaguauaaagcuauaauaaucaagauuguaugguauggaacaaaauaagagaauccagaaacagcuuuacacauauauagucaauugacuuuuggcaaaggaauaaaggcaauucaacgaagaaagguuagucucuugaacaaaugguguuuuguugcaaugggacaaccagaggcaaaaacagaaccuucacccaaaccuuacaccuuauaaaaaaacaaaaaacaaaaaaaaaaaccucaaaauggaucauagagcaaaauauaaaaugcaaagaaauaaguuaucuagaagaaaacauugggaaaaauauuuguaaccugagguuaggcagagauuuuagguaugacacuaaaagcaugguucauaaaauaaagaacugauaaacuggacuucaccaaaauuacaaauugugcuuugcaaaaacacugucugggugcaguggcauaccuguaguccuagcuacuuggaaggcugagguggguaucacuucagccuaggaggucgaggcuguagcacacuaugaucacaccugcgaauaagcacugcauuccagcccuggcaacacagcaagaccccaucucuaaaaaaaaaaaaaaaaaaaaaaaaaaggucaggcgcacgucuguaaucccagcacuuuggaaggccaagacaggcagauugcuugagaccaggaguuugagaccagccuggacaacauggugaaacugggucucuauuuaaaaaauacaaaaauuagcugggcacaguggcacauuccuguagucccagccacucaggaggcugagaggugggagaauugcuugagcucaggaggucaaggcuacagugagccaugaucacgccacugcacuccagccuggacaacagagggagacucugucucaaaggaaaaaaaaaaaaaaaaaaaaaaaagauacuucagagaauuaaaagauaugcucuagaucaggagaaaauauuuacaaaugucauaucaaaccccaaaaaaaagauacccagaacauaaagaacucucaaaacucaggaguaagaaacaaacaacccaaagaaaaaaauaggcaaauuaucagucuaaaaggcuaaauacuauaugauucuauuuauaugacauucucaaaaagacaaaaguauaguaguauagauagaucgcugcuugccaggguauaaggaguagggggaaggguggaguuuuuuuaggaugaugaaacuucuguuucuugauuauggugguagauaaaugaauuuauacucauguuaagauucaaagaauuauacaaaagaauaagucaauuucauuguauguuaauuuaaaaaucaauacuugaaaagcaaagcgcugccuccuuccagccuacccugaaaucccuacuauaguccaagcucugugcuaggcaccaagaauauacaguuaaaaagacagagucagccgggcaugguggcucacgccuguaaucccagcacuuugggaggcugagauggguggaucacuugagcucaggaguucaagaucagccugggcaacauggugaaaccccgucucuuaaaaaaaauacaaaaauuagucaggcaggguggcauguucccguaguuccagcuacuagggaggcugaggugggaggauugcuugagccugcaaagucaaggcuagagugagccgugaucguuccacuacacuccagccugggugacagagugagacucucaaaaaagaauagagucugccaucagaagaggugucaaacaaguacauuaugauaacggaggagauacaagacauauagagagcaacgccuaaaaaaaaaaaaaaaagcuucccggaacacaggguauagcugacaccugagaugagcagagauugccaagacaaaaggaaagaguauuccagacagagaaaauagcaucuaacagagagauauggaagaauguaguguucuaaccuaauuuggaaacuacaaauaauuccauucccaggcacaagcaggcugcuuaagaauauggucaggaaaugaggacagguucccuccaagcaauauaaauagugcuucgauuugaagcuuuggaaaugguaauuuuucagacuuaagugaagcucaguacuucccauuaauucccucacuccccuuuguucacaucaucacaguuacuuauuauucacguauccaucacuuuugccaaacuauaguaaugcccuuguggggacacauagguguccccauaugcacacucacagcaccuaaugaaaaauguuuuauaauacagguauucagcagcauagcauugggauuaaaagcacugugauugggaccagucuaccuggguucaaauguagacucuaccacuugcuggcuauaugacccuggacaaguuacuaaacgucucugugccucaauuuccucauugaaaauguggaaaugauaaugguaccuacucaccgggccccugugacaaauguguuaauuuaauauaaacugcuugacucaguaagcaccauguaaguguuugcuguuauuacucaacaaacacuagcuacguauaauaaaacuaggauuuauacauucuccugguuucaaaauaaacccaaacuacuuuaaauaggugcaaagccaaugagguagcuugugcccacaaucccaggcaauaggcugaggagggaguaacacuugaacccaagaguucaaccugcaguaagcuaugauugcgucacugcacucgagccugggugaugcagugaaacccccaucucugaaaaagaucaauaaauaaaaauaaacaugugcaagacuguauccugagaauuacaaagcacugcucauacugaagagcuaaauaaaugaggagauauauuauguucauggaucagagacaauauuauuaagauaucaauucuucugaaauucaucuacauucucaauauaaucccaaucaaaaucuggacaggcauuuuuguagaaaccagacaagcugauucuaaauuuuauacacaaaugcaaacaaucuagaauagccagaacaauuuugagaaagaaagaguacuuagacuaccugauuucaaaacuuaguauaaagcuacauaaacaaagccaugugguaucaugagaaauaaaaccauauguccauacaaagacuuguauaugaauguucauaauagcuguauucauaauguccaaaaacuggaaacaacccaaauauccaucagauaaaaugcaguauauacagauaaaaugcaguauaaccauacaauggaauaugagucagcaauaaaagggaaugaaacacaugacaacauggauaaaucucaaauaaucauacugaguggaagaagccagaccaaaaaaaaaaagugcauacuauaugauuccuuguauacaaaauucuagaaaauacaacccaaucuauagugacagaaagcaaaccagugguugccuagagauagggaaugagggggagugacugacugcaaaggaacaugagggaacuugugcagugaugaacauggguaguuacacaacuguauacauuugucaaaacucaucaaauuggacacuuacaaugggugaauuuuacuguauauaaauuaugacucaauguaaauuaaauaaguuauaauacagcacugucuuuugagaauaaaaacauaccuuuuauacucauggaaagaauacaggcaagaacugccauucaccuacuguugcugagaaaucuauacuacaauaugagaauuuuguaaacuuagcaugaugaaauaacugaaaacacugcugaugguucucuuacacuugugucuccuucaacuaaagaaucaaagggaacuuaugaaagaauuuuccaauucugaauagagguacuuauucuacauaaaaauuaagaaauaacacugaguuuaacugcagaaucuguuaguaugcuugcaacuggccucaaaaucaucuaaccuugccagauuucagagaacugcaaaaaagcacaaaggagauuuaagaagaugaaaaagcucuuuugcuauccaaaauuuaacauugguacuuccaaugauuaaaacucuacuccuacagaaauaacccugcaaggaucaaaaauauagaaaauuguuccuugaagcuagaaguaaaucaguaguagaaaauauacagaagacauucuuaauuuuuaucucaugaaguucucucaggagagcacuauuuaccugguuaauuauccugaaaaaagguguuuuucuccuuaacucucaagaaauauuuuauaauacuaagcacaguuauuuuaaaaguaugucuccacguugacucucagaccuuacauuuuaaaaacaaaaucuguaacauaagcaauaaaugaagacauaaauauuuacgggaagaaaaaaggcagucugugcaauuuucaaguucaaauaaccagagcaauauguaacaugcauauauauaaaugugguuaguucuaaggcaaugugcuacuuuaucuucuaguuuauauugucaaaacuuagcucaguaaauaggucacagcuucagauauuuaagaucugaauuuggccaaugcgguggcucacgccuguaaucccagcacuuugggaggcugagguggguggaucaccugaggucaggaguucgagaccagacuggacaacaaggcgaaaccucgucucuacaaaaaauagacaaauuagccggguaugguggagggcgccuguaaucccagcuacuugaguggcugagacaggagaaucacuugaacccaggaggcgagguuacuguaagcugagauagcgccacugcacuccagccugggcaagagagcgagacuacgccuuggaaaaaaaaaaaaaaaauucugaauuugguuaaccuuuccuuuuguaaaguaacaauacaaauaauuauacucagugcuuccaauuccaguuccacacacauucauaccuccaggucuuuauggacucuaccccuucaacugucuaccuuuucauacccucuccuuuucuggauucuuccccucuuucaacuaucuugauugguacauauuccccaaucucuugauccagaagcaaucugucuucccacagcccuuuucuguagugucugcuggaacuuccuguguuauaucacacuuaaguauacuaaacucucuucuacuaugaguauccuugaaaggaauaaagaucccugcuuuauucagccuuaugucccucaguauuuagugccuggaucuaaacauuuauugggugugcuccguacaaugaagaggaaaacauucaacaauguuuuucaggcacugugugccaugcacaugcauguucuuuuaucuauuauuugauauaagcagaaacaaaugccaaugauagagaacugcucuaaauccacuaagagacacagacaugcaacuaaauuaauacaauauaacuuuccuguuaaauuaacggauaaguaggaugcugugagagaaacauuacguauguugaaaacuguucugauuccauacacuauguguuaggaaacuaagccuagauuuucaaagggcccaaugacuagaaagguuucaagagugguauaauaagggccccucacucucacaaaauuucuuacacaaccugaaacuaacauuccacccauguaacaaccuuaagugcaagcagggagcaacaaacaucccucuauucuccgaacagcaaucggcaauagcaggucaggucuucucauuaucuuuauacagacauguucaucuaucccuccuucucacauuuaucugaauugugcaccauuuccauacaucacgugccacucccaugccccaaacugaucuauuuaaccuuuaagauucuucucaggcugggugugguggcucaugccuguaaucccagcacuuugggaggccgaggcaggcggaucaacugaggucaggacuucgaaaugagccugagcaacaugcagaaaccccaucucuacuaaaaauacaaaaaauuaucagggcaugguagcacaugccuguaaucccagcuacucgggaggcugagguaggagaaucgcuugaacucaggaggcagagguugcggugagcagagaucaugccauugcacuccagccugggcaacaagagcgaaacuccgucucaaaaaaaaaaaaauuauucugaaggccugcuuuacauccuccaaauguauauugaacuacuguuacuuaaucuguaccucucuucuuuaaaaauugauaaaguuaauuauuaacauuuuauauaacuuggaguuaggcaaaacugguuucagaucccagacagaucugcuacugccuugcaauguaaaguugggcaaguuacuaaacuugcuuuaaucuauuucuuccucauuaaaaugagaauuaaauugggugaugugcauaaaaugccuacuauacacauauauucaugcacacauacgucacauacauauauacuuauuuaauuuugauuuauucuuacuuuccuagaagaugcagacucucuuuaaaacucaaggcaaaagcaaugaaacauaaaguggguacuaaaaauuggaccaguuaguugauguaaaggagccucccaacuuuaaaaugugcccucaugguagcucacacaagccacccucagcagauuuuuuucacgucuccuacugaaaaacaugaaaaacucaaagguuugacaaagcccggauccacaguuccuagguugguggccuaacacugacaucugucccaagaaucugucuuucucacagcaaaccugauaaaggucaagagaaaaaacaacuuauauuacauaagccaaacaauacauaaauuaacacuuuuuaaucugcauuaucuuccuggagcaagcaaaaccacuucugcaaauugcgaacucagaagagaaaguccaaacgggaugggaacugagucaucaauuuaaaaccaucaaccacugacugccccacccccagaaagaggacucuaccacgaccuacuacagugaagcccugggcauaucacacucagccacuacucuaaaaaucccaaccuccgacacccaagucccgccaguaggagcagcacccagucccacccucggcucugagccagagucagguacccucacaucaggguccccaccccagauccucaggucccaauccaagcucuaccccagcccgacaccggcacucacccgggcggugaccuuauauacuguguagccccucgggugucgcuggggcucggugacaguguagaaacgggccaggucggcacuccgcucccgguaagaggucauccucccgccgccucugccgccgccgccacccgcccgggaucaugagggaaacccggcgccgccgcgguccagguuccccaacgcagcggcgaagcggcgagggggcgguggcuccaaggcggcuccacggcggcgccucagcugcacagcucugcuucc

SEQ ID NO: 191176 - RNA, 65645 nt, Homo sapiens
ucccagagugccccgcccacaguuccgacgaaaaauggcggggucuccugaguuggugguccuugacccuccaugggacaaggagcucgcggcuggcacagagagccaggccuuggucuccgccacuccccgagaagacuuucgggugcgcugcaccucgaagcgggcugugaccgaaaugcuacaacugugcggccgcuucgugcaaaagcucggggacgcucugccggaggagauucgggagcccgcucugcgagaugcgcaguggguacgggaccaguuagccaguucuuuacucaucauccucuuacccaacacccaggaucuuaggauucagaaagaucccacgccaggccuuggcagaauuaacggugccccaggcuacuguagaaccaguucgagaaacgcuagaggagaaagaaauagaugcuaaugucagcugggucuuauuaauuacuuagaccagcgcuguccagugaaaauacaaggcaagcuaaucuuuauguaguuuuaaacuaaaaguaagaaauaggugaaguuaauggaaauaagacauuuuguuuaacccaauaaauccaagguauuuuaacauguaauaauaucaaaugaaugagauauuuuacauucuuuuguucguacuaagcuuuucaaaucuggugugcugcauuuacggcacaucuucgaacuaguuacauuuaagcgcucaguaacuacaaaguggcuaguggcucaccuguuggacaaugcagccgcagacaaugaggaauucuccuggaaaggguaauucuggaagucagccauucacccaagcagcauuugaucuuuccuuuugcauguuuuauuuauuuauuuauuuuauuuuauuuuuuuuuuuugagacagagucucgcucugucgcccaggcuggagugcaguggcgcgaucucggcucacugcaagcuccgccuccuggguucacgccauucuccugccucagccuccugaguagcugggacuccaggcgccugccaccacgcccggcuaauuuuuuuguguuuuuaguagagacaggguuucaccguguuagccagcauggucucgaucuccugaccucgugauccgcccgccuugggcucccaaagugcugguauuacaggcgugagccaccucgcccggccuauuaaccuuuauuuuuacuguuugcacuguggucauucauaacucacaaaugugcgguauuaugagcuuuuaaauuuuuuccgcuaauauaaguagauuggugccuguuauaaggaagcacacaaucccuuuauuucuuguguucccaaaaaacuaccaccuucagggcuuugcaaaaauauuuaagaaaggcuugggaaaugugguauagaggcaaauguaugaucuuaguaaaguuuucaaccaacacaauuuuuuuuaaccuauuuuagucuuguaaagaaaauguuuucacucuaaaacaggcaaaaggggucgggcgcgguggcucacgccuguaaucccagcacuuugggaggccgaggcgggcggaucacgaggucaggagaucgagaccauccuggcuaacauggugaaaccccgucucuacuaaaacaauaauaauaauaauacaaaaaauuagccggccaugguggcaggcaccuguagucccagcuacucgggaggcugaggcaggagaauggcgugaacccgggaggcggagcuugcagugagcccagaucucgccacugcacuccagccugggugacagagcgagacuccaucucaaaaaaaaaagguucaguggaagaaugaagaaacacuuccuggguugugacucuguauguaguuuuguauauagugacucuuacgucauucccuccuugcaagcaaggcaagaauagggauauaucucaggacguuuuuaguaguuuuuugggagaagacuuuuguuguauaaucuuagaauuugucugauucuaggaaaugcuaagguauuuaaaacauuuaggugucuuacagaaaaagaggaacuuggcuuaaccuauuauauccuauuuagugggacgauaaagugaauuauaagauaaaguuuacagggcuuagacuaccacaggaauucacuuguguuuuauuuuaaauaaagcagaagcuuuauuuuguaucucuguuuaaaacugcauauuaaguagcagauuuucuuuaaaaacaguauugguagcagucugcaaugaauguuacaaagacaauauguuuucucagcaauucuugaaaguaauucuagaaaauaauuuuaaaacauacauaggccgggcgcgauggcuuacgccuguaaucccagcacuuugggaggcugaggcgggcggaucaccugaggucaggaguuccagaccagccuggccaacacggugaaacccugucuauacuaaaaauacaaaaauuagccgggugugauggcgcuugccuguaaucccagcuauucgggagacugaggcaggagaaucgcuugaaccugggaagcggagguugcagugagccaagauugcgccauugcacuccagccugguugacaagagugaaacuccaucucaaaaaaaacaaaaaacaaacaaacaaaaaauaaaauaaggauuuuacuuuaugaaaucuuugaaauguagaauauguacuuuaacucauaauuaucaguaauuugguuuauguuauuuuuaauuauacaaaggguacaaaauauaugcucauaaaaaaauucaaacaguagcauaaagcaaaauucuuugaguuccccuuccccaucccucuuccuucuaggacauaagguacuauuuuggagaguacuuggggagaguaaacuuucuauacccccuuucuguggcuuuaccucuuucucucuguuuauguuuguuugucuccauuaauaaugucaugcugaugaauuguuauugaccugccuuuuuugaaaccaaacaugucuauuauuuguuaguguuacguagagcuugucuucauccuuuuuagguacugcgugguaugaauauugucuauuuaacucuucuaauuuugacuuuagguuuuuucccacaauuuuaaaaauuucaaacagugcugaaaugaacauuucuagcacauucucuuuaguuuuuaugagaguaguccuuuaggaugcauugcuagaagugaaauuguuggguaauaggaaauguguacugccgaauuccuuuaguccaucauuuaaaaaaaauuuugaugaaguccaauuugucuauuuuuuguuuguuuuuguuuuuuguuuuuugguucuuuaucuuuuaauguauuaugaacauuuucaaccuuacaaaaaauuaguuuaguacaguggacacccauauauccaccaccaaacucaacaguugucaaaauuuuguuacaguugcuucucccucugucucccaggcuggaguacaguggcaaucauagcucacuguauucucaaaccacugggcucaaguaauccucuagccucagccuuucaaguagccgggacuacaggcaugugccacugugccuggcuaauuuuuaaauuuuuuaguagagaagguugucucaguguguugccuaggcuggucuggaacuggccucaagcaauccucuugccuuggcuucccaaagugaugggauuauaggcgugagccacugcaccuggccuacguuugcuauuuuaaagcauaucuuagaucucaugucauuucaucgcuacauaaguguucaucucucaaaaauacagcccuuuauaaaauauaauuuuauuuuuaagcauguauguuuucccucuuguuaacaucaacagucauucagcagcauauauaguacuuauaccccugagauucaacugagccuaaauuuguuagauuuuauuuuuucuuucauucuaggaguacuuuuuuuuguuuguuuauaagaauauuccaaaauuuuaaaucagauuuucucuuggguagcauaauggcuaugagacccaaaauguagguagaaucaaugauugaaguggaaucuucauugaaaagaauagauauacuaauuagcuauucugcuacuuuuauuuccucugucacaaaucuggaaguauuauuuugcuaaaacguuugaauuuaguauuuaaaauuauuuuuagugacuugacuacugugaauuuauugcagacuuuugaaucagcugugcaagagaauaucagcauuaaugggcaagcauggcaggaagcuucagauaauuguuuuauggguaugugacuuuuuccuuccauuauuaauuucuggguuauuuuugcagcuaauuuuguuuugaaugcuguuuuuuaaucuccauauuuagugucauuuauuuucaagaaguuguuuacuaggggaguaauaaagaacugagauuaugacuucaauagucuucuuugucaauaguuuauuggaaaauacuguagagcuaucuccagaugacaaaagaggcccagggaauuucuguaauuauuuacaaagcaaguuguauuuuuguaagugaucucuagagugaauagugaaguacccuuaaaagugugaaguuauuauuaauuauacaaguaccguguaaaggaugagguuacaucuuuguagaagguuccuuaaaaagacaauuuuuuuuuuuuuuuugagaugaagucucacugucacccaagcuggagugcaaugacacagucucaguucacugcaaccucugucucccagguuaaagugauucuugugccucagccucccuaguugcugggauuacaggcauguggccaccacgccuggcuaacuuguauuuuugguagaggacaggguuucaucauguugcccaggcuggucucaaacuccuagccucaaucuccuaaagugcugguauuacauaugugagccacugcuccugaccuuguucucaacucuuggcucauaguaggcaccuaugaaauauguuaaauuaaugaauaauucuuuccuguucaauuuuucuuuucuuucuuuuuagacagaguuucacucuuaccuaggcuggagugcaguggcgcgaucucagcucacugcaaccuccaccuccuagguucaagcaguucucaugccucagccucccaaguagcuggaaucacaggugcuugccaccacgccuggcucauuuuuguauuuuuaacagagaugggguuuuaccauguuggccaggcuggucucgaacucucaaacucaggugaucugccugccuuggccucccaaaguguugggauuacaggccugugccuggcuucuguucaaauuuugugauacauuuuaauuguagcuuuaucacuagguagugcuaagaaagcauguuccucucuacaaaaaagauuuaccugggagacuuuucuuuuuuuuuuuuuuaacuaauugugaaauaguacauuauuuucuucaggcuaauuauuuaacuuuuuuaauggauaaaugaaaauuuagggagggcugcuuauauaaauaauuauucaaaguaagaaauaacuauuauuucuugcccucaaaagaaggguacuuucacaauguauacuacugggugaugagugcacuaaaaucucagacuucaccacuguacuauucauccauguaaccaaauaccacuuguaccccaaaagcuauugaaaaucaaucugugugugucucucucucuaucuaucuaucuaggaaagaaggagggaggaaaggaaagaaaagaaggaaaggaagggagggagaaugaaugggaaggaaagggaaagaaagaaggaaggaaagaaagagaaaaaggaaaaaaagggugcccucaaaagaacuaauuuagugggauucaauuaauauuugugacaugaaugaaagacuauaccugauauacuugauuaucugauauguauauaccgaaacauaucagcaauuucucaaaauguuucaaaaauuauguuucagauguuagauuucuuccuaauaaagcuucugaucaauaaaauaaauagguccauuucuagcuuagacuuugacacaacagagcaauaugaggaccaguuaagcuaagaacuuagcucuuuaguauuuguaacuacuuaguauuuuuacucuuuaaaaugauuuucaaaauaaaguuagauggaucaccuacauuccuuucaucuagggugcuucauuucugggccccaucucagacuuacugaaucaaaauucuguacuccugaaaaccaaacaccgcauguucucacucauaggugggaauugaacaaugggaacacuuggaaacagguuggggaacaucacacacuggagccuguuguggggucgggggaguggggagggauagcauuaggagauauaucuaauguaaaugacgaguuaaugggugcagcacaccgacauggcacauguauacauauguaacacaccugcacauuguguacauguacccuagaacuuaaaguauuaaaaaaaaaaucuguacuccuaacauacucguuaggugauucuucuaacauuugagaaucacuguuuuaaaacaugaaaaagcauaugauaaaguagaguuagcuaaaugaaagaaacucuaaacucacuguaucuuucaguuuuuccuaccaucaauccaguugaguccuauuucagaucuaguuacuccacucacugcuacugucauagcuuugggucaguucauaauaagucaaaacuucuuagcaucccugauauuaaauacccuuuacagccugguucuuauauauuuuaucauccauuucuccuuuacuuuauucuguagccauuuagaacuuuucucaggucuccaaagacuaggaucuugcaaauacuguuuccacugccuaaaaugcuucucccuauuccuuuuuucccguaccacuuuuuauccauuggacuuauacuucuauuucaagcucaaauguuacuucuuuaaagucuuauauuucacagucagucaguuuuccauuguucuguguccugauggcauuuugcucauaccucuauugcacuuaucagguugccuugcaauugucuguuucuuucagcaaacugugaacucuuagagaguaggaaucauguugugcucaucuuuguauuucucuuguuuaggccuggcuucuuauagaugcucaauaauugauuguucaaugcguaaauaaauuaaucaccaaagugggggcauucauuaacuugccauauuuguuuuccuucauuauuuuguguuuucuaaauuuaguuuauagcacauuuccauacagaauguaaacaaugaguuuuagggaacuuuuuauauauacauuuuuuuuucucaaauagauucugacaucaaaguacuugaagaucaguuugaugaaaucauaguagauauagccacaaaacguaagcaguaucccagaaagauccuggaaugugucaucaaaaccauaaaagcaaaacaagaaauucugguaagaugauuugccuuuaaaauguuauaguauauuuuaccacaauaaaaacauuaaaauauaaggcucuacguggagauaagugacauuuuguugucuuuuucuuuccugccucaauuaguauuguuugucucuuguaagacuuuacucuucuaaguuguacuaugacauaguauagucauacuauacuguguuuugaacacacugguucaaaaaugaaaaaaaugaaaguuauagugagugguuaaaauugaaauuggugauggaagacugacaaugacuuuaugauucugagacaaggauggaaaaagaagcuuuucuuuuaacacuuuucuuucuguuuguuguuuuuuuuuggcauauauuuguauguuuguauauuuuggaagaccauuuaguuaaauugaugaugaagauuguuuuaguaccuguucauaacacugaaauuugcuuuaugaauuggguguaauuuguuuugcugcaaaaaucaugaacaucugggugacaagaccaggaauucagcuccuucagcacgagcuuuuuagacaagcagagccguagacuuccuucuuauaauuacuauagauaucaaugaccaaccauaucacacccucaucuuuucagauuuauuaggacuagaauaaauaaaaaauaggaaauccacaagaaaauuggacccaaaucuucccuugguggggaggggagguuugcugggaauagcauugucccuccagugagguacauguuguguuuagauugugcuauacuauugccuuuaguuuuugaaauuaguacauaaauguucacauauaaaucuucuaguugccucaguuucaggauuguuucaggucauuauaugcccggcuuaauauuguaucuaaaacauuuuaguuauucugugaaaaacaguauucaugagcagaauuuuuaauuuucuuuauagcaguucucaaauaccgcauuccaucacuucccccaccccucccacuugaaaguuuuuuucaggaaaaacauugaaaguguauuuuucaguguugcccuuguuacugccccacuaccccuaaacccccaaaacuaguaaucaauauugcagaaaagaaagauggcuggccuaggugagguacugcugugguaguuuaaaaaguaaugcaaaauagauaaggugaggauaccaaagaccuuuucaaaauuuuuuccugcccugcccugcccugcgucuuuccucccuucuucccuccuuguugcucagacuggucucagacuccugagcaaaagacauucuccugccugggccucccaaagugcugcaauuacaagugugagucaccacagcuggcugaagaccuuuuuuucuucuuguuuucuuucuuuuaaccuuuuuggcuucugcuggcuuugggcaagaauaaggaagagcaauuuccucuuucuuuuugccugcauuguagauucugugccaguaauucugcuacuauaauuucagugugucgcaggauauauaggcuuaguguggugguaauguagccucgccaccuuuuagaacugaguuuucauggaaauaugcauuuugaguucuaaacacuuguccugaaugaacuuuugaaacacagucccuucauaauuggagacuacccuguacuuuaaacauaaaauucaguuucuaugcuuuuaauuugcuugauugcuuuuucugauuauacuuuuuuauggugccacuucuuaguauaugcagcagguggcaguacuguaaaagacauaauucagacuuaguuugguuuuaccuucucaccuccucuucccuacagacaguaggauuuaauuuuuuuuccucaaaagaaugguacugacucuauaguauaucucccauauuagcugaaagagauguuuauaugaagcauuaagugauuaaaucuguuuuaauuuauguuauguuuagaagcaguaccacccuguuguacauccacuggaccuaaaauaugacccugauccaggugagucaguauccauuugugguaaaaaugaagcaucugcuuauaauuuuuauggguuucugauauucuucuaaaagggucagcaucaaggauauucucccuuugaugcuuuaacuuccuaccagucauucauguuuagcauuucaucuagaauuaagaggacuagcuuuacacccauugacucagaauuccagggguguuaccccggaaucugagcuuuuauaaaguucuugccugacccagacuauuauaacacauacccaucucuaacuucuaauacccuccuaucucugucauuguacuaucuauucuuugcauuacagccaaagcuauacuauuaaagcauucucucauagugucacaccuggugcaguaaccaucauugguuucucauuauuucuaaaaucaaauaaaaauauauugaauuuaagaagaaauaaguauacucauuaugccuuugaacucaguuuuguuuccauuuauauguaucccauacaacagggagaaauaaacuugacacaaacaaauuuauguaaauccagcagcagaacuagcauugcuaaaaauguggauuauguauauuuucaaaugacuguauucucacauuuaaaaauuuauaacaguuuuucuaagaguccuuuuggaauuuccuuuuggcacuuaaaaugacauuucuaaacuguuaggauaaaacaguuaaaucccggauuuauuuauaugggauauuuauacuuaaagcuuugaguacuuuguugaauucugaacuacucuuuaauauguuccuccaccuuccccaaauauccuaagcuaaugggauaaacugagagggggggaaguauaagcauaaagcuacucugaaguugacuaaaaucacaucacuuauuguguuugacauuaaaaauugaccuaggaccuaacacuccucaguuuucaugguucacuaaaaagggguaguugccaauaugcagugguugacauauacuuguuuugguuuugaauaacaaaaaaacaguaauugaaacuugugguauuaugauauacucaaguauuacuuuuuagauacaguuaauuucccucuaaagaaacuugguuaccguuuuaucguagggaaaacacacuuaguuaaugacccuuugaaaugugauuuuacuuucacuguucugauuauguaguauuaguggaagaaucuucuguaucauaugauucagacuucaaaaguaagcaaaagaauuagaaucugucuuuuggauaaauuuugaguuuuuucauuaugcauuuucauaauguuaacaagcuuagaauagcaucaguuccuuaaggagagcaaaauuagccuacaguuauuagcuuuauaucuuuggccaagucaccugacuucuucaagcaucaguuucauuauuaguaaaaugacgaauucuggauuugccgccugaugcuuuaggcgugaauuccagcucugcacuaaauauuacagaaugucuugccuacuuaucuaggugguaguauaaccaagccacauaaggggcuguauaaacuauauaaccaaaacaauacaugacuaguaguuuauaaggauauauuguauaauaauaacccuauuauaaauugcaucccauuuauaauaguauacauuauaguauuguauaccuuauaaucuaccgaacugguagaaucauaugaaacugauuaaaauggcuuaguaagaaaguggaaagcauaaauuucuaugggccuuaaaagucugaaucagcagcauaggaaaacuuuugugggaaccucuugaaaguuuuuuuuccuuuauuguaauauuaagugauauaaaaugucuuugaaaacugacacuuuuuuuuuuuuccuuuuuuuuuuuuuuuauugaucauucuuggguguuucucacagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucucaacgagcacgcugccuucaagcaucuguuuaacaaagcacaucuugcaccacccuuaauccauuuaacccugaguggacacagcacauguuucagagagcacaggguuggggguaaggucacagaucaacaggaucccaaggccgaagaauuuuucuuaguacagaacaaaaugaaaaguuucccaugucuacuucuuucuacacagacacggcaaccauccgauuucucaaucuuuuccccaccuuuccccccuuucuauuccacaaaaccgccauugucaucauggcccguucucaaugagcuguuggguacaccucccagacgggguggcggccgggcagaggggcuccucacuucccaguaggggcggccgggcagaggcgccccucaccucccggacuggguggcuguucgggcggggggcugacccccccaccucccucccggacggggcggcuggucgggcggggggcugacccccccaccucccucccggacggggcggcuggccgggcggggggcugacccccccaccucccucccggacggggcggcuggcugggcggggggcugacccccccaccucccucccggauggggcggcuggccgggcaguggggcuccucacuucccaguaggggcggccaggcagaggcgccccucaccucccagauggggcagcugaccgggcggggggcugacccccccaccucccucccggacgggguggcuggccggguggggggcugacacccccaccucccucccggacggggcggcuggcugggcggggggcugacccccccaccucccucccggacggggcggcuggccgugcagaggggcuccucacuucccaguaggggcggccgggcagaggcgccccucaccucccggacggggcggcuggccgggcggggggcugacccccccaccucccucugagauggggcggcuggccgggaggggggcugacccccccaccucccucccggacggggcggcuggcugggcggggggcugacccccaccucccuccgagacggggcggcuggccgggaggggggcugaccccaccccccaccucccucccagacggggcggcuggccgggcggagacgcuccucacuucccagacggugugguugccgggcggaggggcuccucauuucucagauggggcgguugccaggcggagggucuccucacuucucagacggggcggccgggcagagacgcuccucacuuccuagauggggucguggccgggcagaggcgcuccccacaucucagacgaugggcggccgggcagagacgcuccucacuuccuagaugggauggcggccgggaagaggcgcuccucacuuccuagaugggauggcggcugggcagagacgcuccucacuuuccagacugggcagccgggcagaggggcuccucacaucccagacgauaggcggccaggcagagacgcuccucacuucccagacgggguggcggccgggcagaggcugcaaucucggcacuuugggaggccaaggcaggcugcugggagguggagguuguagcgagccgagaucacgccacugcacuccagccugggcaccauugagcacugagugaacgagacuccgucugcaaucccggcaccucgggaggccgaggcuggcagaucacucgcgguuaggagcuggagaccagcccggccaacacagugaaaccccgucuccaccaaaaaaauacgaaaaccagucaggcguggcggcgcgcgccugcaaucgcaggcacucagcaggcugaggcaggagaaucaggcagggagguugcagugagccgagauggcagcaguacaguccagcuucggcucggcaucagagggagaccguggggagaggggagagagaggagagaggagagagcgaaaacugacgcuuuuaaagaggguugucuguuuuucaaaacuaggcaguguguauaacauugauucaacuuaguuacauuaugaacuuugggggauacaaagauaaagcagacagauucuccccauaaagagcuuaugucugaguaggagaaauaaaagaugaacauaaaacaggauucuuucaugcccccuaacugguuccuuugccaccuuucccuguuugaguaaguggcaucuaugccuacauguugcuuuagcugaaguuaaccuugauuccuucuucugucaagcuccucauacccaguccaucaauaagucccauaaauuguucuuaauauaaucucacauucguugacuucucuucauuuuguuauugucaucucuauucuagguuaccaucacucuagccaggauuucuacaaaugcucucuuagaaggucuucuuguuucacucuugcucucuuccauuucauucugcauacauagggcagugugauuauuuuauucuucgaaauauuucacauauuugaaagaaauauagaaaauaaagaaugcaacauaaugaacaucucuguucccaccacccauauuuaaguguuaaucacauuuugucauacuuguuucagaccuuuuuaggaacuaaaauguucagauauaguugaaacuuucuuugugucuuccacuauuccauuccacucccucucuuaccucagaaguauaaccaggauccucaagcuguguaaauccuugcuauucauguuuuuauacuuaauuuauagauacauauccauaaacaauguaugggauuuaaguuuuuauauaaauuguaucauacugaucauaucauuuuguaacuuuuuucuccaucaacguuguguacacgcagagcucucuauucauuuagcuauuguauauaguauucuaguuuaugaauauuccacuauccauuccuuuacagggggacuaacuuagauuguuccuuuuuuucuugacaucuuguucuagguuccuuuuuuuuuuugaggcaggcugaagccacccaggcugaacugcagugguaugaucauggcucauugccaccucaaucucuugggcucaagugaucuuccagccucaaccuccugaguagcugggacuucaggcaugugucaccaugccuggcuaguuaaaaaauuuuuuuuuguagcgauggagucccacuauguuacccaggcuggucuggaacuccugggcucaagugcuucuccugccuuggccuccaaaagugcuaggauuacaggcaugagcuacugcaccagccuagguuguuuuuguuuuuguuuuuuuuuuuuuagucuuuucagagagucagcuuuuaguuuuguugccuucucuaauuuuuuuguuuguuuguuuucugguuccuugauuucuaaucuuuauuaugauccuccuguuuuugugagguucccguuauuuuuagcuucuugaauugagcacuuaauucauuuguuugucuuauuuuuuaauaaauucauuuaaggcuacacauuuaucucuaaguccugauuuagcuacauaccacaagcauugacauguagaacuuucauaguucagcucuauuuuuuaguuuccaaauacuauauagaaguuuuuguuguuguugguuuuuuuuguuguuguuguuguuguuuuguuuuguuuuguuuuaccguuuuccuuuuauugccuuccauuguguugagugaauuuucuuuuuccucuuauuuuucucuuucucaguuuggaaacuguauacuguguuucuguuccauuuguguuuccuauaaauuuuauuuaauuuuaauuuuuauuuuauugagacauagucucgcucugucacccaggcuguaguacaguggugcaauuacagccucacugcagucuugaccucccaggcucaagcaguccucccaccucagccucucaaguagcugggacuauaggugcaagccaccaugcccagcuaauuuauuuuauuuauuauuauuauuauuuauuauuuuuuuuugagacggaguuucucucuuguugcccaggcuggagugcaauggcgcgaucuugguucacugcacuguccgccuccuggguucaagcgauucuccugccucagccucccaaguagcugggauuauaggcaugugccaccacacccagcuaauuuuguguuuuaaguagauacagggauucaccauguuggucaggcuggucuugaacuccugaccucaauuuuccuuauuguuaaaaaacacaauuuacgggcugggcgcaguggcucacgccuguaaucccagcacuuugggaggccgaggugggcggaucacgagcucaggagauugagaccauggugaaaccccgucucuacuaaaaauacgaaaaauuagccgggcgcaguggugggcgccuguagucccagcuacuugggaggcugaggcagaagaauggcgugaaccugggaggcggagcugucagugagccgagaucgcgccacugcacuccagccugggcgacagagugagacuccgucucaaaaaaaacaaaaaaaaaccaccaauuuaugguuacuacuuuuuuuguacucaaugauuaauuacauuuaugaaucaaaauucccaaauuuuguaaguuguuucuugaauuuuauaccuuuuuuucuguguucacuuuuauucuugcugaagugccucuguagauacuuuaaaagucuguggguaguaaacucccuuaguuuuucuuucauccuugguauugaguuuuguuuuguuuuuuuuuucugguagagguggggucuuucuauauugccuaggcuggucucuaacuccuggccucaagugauccuccugccuuggccucccaaagugcugacauugcaggcuuuugaaauuuguuuuauuuacucucauucauuauacugaaucuauuacaucauuaucuuugacacucuuuauaaauggcuuuaucaagauauaauucauauaccauacaguucacccacuuaagguguacaacucaguggcuuuaguuuauucacagaguuaugcaacaucaugauaaucaauuuuaaaaaugguuuauuauucugaaaagaaacccaacacuccuuagccauuauuuccagucucucaucuugcuucccugguccuaggcggccacuaauguacuuucuaucucuauagaccugacuauucuggacauuucauauaaauugaaucaugugguauguggucccuugugaucagcuucuuucaauuagcauaaugcuuucaaaguucauuuauguuguaguauguaucaguacuucauuucuuuuuauugcaaaauaauauuccauuguauggacauauacuauguauuuuauauauuuauauauucaugaguauacagacuuuuuaaaaaaacuuuucuucuugucacuuguuaacacuagaauguacagacauuuuacucaaugacauuuuacucauuuuggcuacuacgaaugaugcugcugugaacauucauguacaaguuccuguacggauauguuuccaguucuccagaguauguauacccacaaauggaacugcugagucauguggcaacucuuuauguagcuuuugaggaacugccagacuguuuucuaaagugccugcaccauuuacauuccucccucaguguguagggguuccaguucuuuaugcccucaccaacucuuguuacugucugcucuuuuaucaaccuaguagguauaaagugguaucuuauugugauuuuaaauugaauuucuguaauggcuaacaauguugagcaucguuucaugugcuuauuggccaucuguauaucuucuuuggagaaguaucuauucagauccuuuguuuuuugagggagguauuugucuuuuuauuguugaguuauacugguucuuuauguauucuggacgcuagucccuuaucagauauaugauuugcagauauuuucucucauucucacuuuccuuaaauuuuuuuuaaauugguacauaauauuuguacauauuuaugggguacaugugauauuuugauacauauauacaauguguaaugaucaaaacagguauuuaagauauccauuaccuuaaauauuuauuguuucuuugugcugggaacauuucagaucuucucuucuagcuauuuugaaauauaugacauauuauuuuuaaucauugucaccuuacugugcuaucaagcacugggucuuauucuucuaucuaacuguaugucuuuacccaaauaauucuuuuuuaaaccccugccccacccccaacuaacuucucugcauccucuccauacucccuuccccgcuccgcacauacccuucccagccucugguaacuaucauucuacucucuaccuccaugagaucaauuuuuuuaguucucacaugugagugagaacaugagauuuuuuuuuuuucuuuuugucuuucugucccuggcuuauuucacuuaaccuaaugccaguuccauccuuguugcugcaaaugaccggauuuucuuuuuuaugauggaauaguauuccauuguguauauacaccacuuuucuuuauucauucaucuguugauggacacuuagguugauuccguaucuaggcuauugugaauagugcuguaauaaaaauggggauguggauauugccuagauauacugauuuuguuuccuuuggaugaauacccaguggcaggaaugguggagcauaugguaauucuauuuuuaguuuuuuuuugaggaaccuccauauuguuuuccauuguagcuauacuaauuuacauucugaccaacaaugucuaaaaguucccuuuucuucacauccucaccagcauuuguuauuuuuuaucuuuuugauaguagucauaucuuaacugggguaaguugauaacucauugugauuuugauuugcauuucccugauguuuaguuauguugagcaucuuuucauauaucuuuuggcuauuugcaugucuucuuuugagaaaugucuauucagauccuuuaccuucuuuuuaacaggauuuuuuuuucuuugcuguugaguuauuugagcuucuuguguauauuggauacuagucccccauuggaugaauaguuugcauauaguuucucccauucaacaggugucucauuacucuguugauuguuuccuuugcugugcagaaacuuuuuaguuugauguaaucccauuugucuguuuuuguucccugugcuuuugagguccuagccguaaaaucuuugccuggauguccuagaguguuuuuccuauguuucccuauaguaguuuuauaguuuuggguauuauguuuaagucauuaauccgucuugagcugauuuuucuaugaugaaagauaggagucuaguuuuauucuugugcauauggauauccaauuuucccagcaccauuuauugaagaggguguccuuuccccauuguguguucuuggugcuuuuguugaaaaucaguggcuauaaauaccuagauuuccaugcaucuguucuguuccacugguccaugucuuuuuaaauaccaauaucauguuauuuugguuacuguagcuuuguaguauauuuugaagugagguaguaugauguuuccagcuuuauuauuuugguucaguauugcuuuggcuauucggacucuugugguuuuguacuaauuuuaggguuucuuucuuucuuuuuuucuuuuuuugagacaaugucucacucugucacucaggcuugagugcaguggugcagucucagcucacugcaaccuuggccucccgaguucaagugauucuugugccucagccucccaaguagcugggauuacaggugcacacuaccacacccagcuaauuuuuauuuauuuauuuauuuauuuuuguuuuuugguagaaacaagaguuucaccagguaggcuggucuugaacuccugaccucaaaugauccaccugccucagccucccaaagugcuaggguuacaggugugagccacuguaccuggccuaggauugcuuucucuauuucugugaggaauguuauugguauuuugguaggaauuacauuguauucguagauugcuuuggguauuaugguuauuuuauaauguuaauucuucugauuugugcacaagggaugucuuucuauuuguauccuguacuagucuguuuucaugcugcugacaaagacauaccugacacuggguaauuuauaaaguaagagugguuuaauggacucacaguucaacaugccugaggaggccucacaaucauggcagaagacaaacggcacuucuuaaauggcgguggcaagagagaaucagagagccaaacuaaagggguuuucccuuauaaaaccauuggaucucaugagaauuuauucacuguuacaagagcaguauggaggaaaccgcccccaugauucaauuaucucccaccaggucccuccuguaauaugugggaauuaugggagcuacaauucaagaugagauuuggguggggacacagccaaacuauaucauauucucuucaauugcuuuuaauaguguacuguaguuuuccuuauagaggucuuuugcuuccuugguuaaauuuauuuccagauauuuuauuuuuuuuauagcuauuauaaaugggauugacuucuugauuucuucuuuagcuaguucauuauugguguauagaaacacuacugauuuuuguguuuguuuuguauccugcaacuuuacugaauuugucuauuaguucuaagguuuuuuuuuuuuuuuuuuuuugguggagucuuuagguuuuucucuauguaagaacaugucaucugcaaagauggacaguuugacuuccucauuuccaguuuggaagccuucuguuucucuugccugauugcucuggcuaggacuuccagugcuauguugaauaggaguggugaaagugggcaucuuugucuuguuccaauucuugaaagacuuuuagcuuuuccucauucaguauguuagcugcagguuugucauauguggcuuuuauuauguugagguacauucuuuuguugagagguuuuuuguuuuuuguuuuuugagauggaguuuugcacuuauugcccaggcuggaguccaauggcacaaucucagcucaccgcaaccucugccucccagauucaagugauucuccugccucagucuccugaguagcugggauuacaggcaugcgccaccacgccuggcuaauuuuuguauuuuuaguagagaugggguuucuccauguuggucaggcuggucucguacucccaaucucaggugauccgccugccucagccucccaaagugcugggauuauaggcgugagcugcugcgccuggccuguugagaguuuuuuuuaucaugacagaauguugaauuuuaucaaaugccuuuucugcaucuauugagaugauaguaugauauuugugcuucauucuguugaugugauguaucacacucauugguuugcacauguugagccauucucauaucucugagauaaaucccacuugaucaggguguauuaugaucuagugggacuuuugauguguuguucaauucaguuugcuaguauuuuguuaaggauuuuugugucuguucaucagggauauuggccuguaguuuucuuuuuuguuguguccuugucugguuuuaguauuaggguaauacuguucucacagaaugaguuaggaacaauucuucccucuugagguuuuuggaauaguuugaaaagaauugauguuaauucuucuuuauaaguuugguagaauuuagcaggaaagccaucuggucugcagcuuuucucuuuugggagccuuuuuauuacugauucaaucuuguuauguguuauuggucuauucagauuuucugguuuuuuuguuuguuuguuuguuuguuuuuuuccugguucaaucaacguagguuguauauguccaggaauuuauucauuuccuuuaggcuuuucaguuuguuaguguauaguuguucuguuuuaauagucucugaugaucauuuauauuucugugguaucaguuauaaugccuccuuuuuuuguuuccaaucuugguuagucuagcuagccauuuaucaguuucauuuaucuuuucuguugagagugggcuguugaaguccuugacuacuauuguguuggugucucucucuuuagauugauaauauuugcuuuaaucuggaugcucuaguguuggguacauauauauuuagaauuauuauauccucuuucugaauugaucccuuuaucauuauguaauggccuccuuuguccuuuuuuacuguucuugacuuaaaaucucuuugaucuaaguauagcuacucccccucacuuuugguuuccauuuguguggaguaucuuuuuccauuuuuucacuuuuagucuguauguguuuuuacaagugaagugagguucuuguaggcagcauauaguugggccauacuuuuuuauccauuaagcuauuauuugucuuuuaaguggauaaucuauuuacauucaagguuauuauuauugauauguaagggcuuauuccugucauuuuauuaguugaguucugguuguuuuauauauccuuuguuccuuucucucauuguuuaucauugugguuuagugguuuucuguagugguaacauuugaguuuuuucucucucucucguuuguaugucuguucuaccagugaguuuuauacuuuuauguguuuucacaugaugguagauacugucuuuuugcuuccagauguagaacuuccuuaagcauuuuuuggagggcuggucuagcaguaaugaauuccuucaguuuuuacuugucugagaagacuuuauuucuccuucauuuuugaaggauagcuuuucugggaauaauauucuuggcugacagguuuuuuucuuucagcacuuuaaauauaucauugcauucucuccuggccuguaaugauccugcugagagauacacuguuagucuaaaggaagcuucccuucuauguaacuuuaggccuuucuccuguuuuuagaauuuuaucucuuucuuugccuuuugauaguuugaguauaaugugccuuggugaagaccuuuugggauucaaucuauuugcagaauuuugagcuuccuguaucuguauguguauaucuuuugcaagauuugagaaguuuuuagcuacuauguuguuaaauagauuuucuuuuccuuuacccaucccuucucccucuacaacacccaaaaugcaaauauuuggccaguuuaugcugucccaaagucaguuaggcuuucuucauuuuuuuuuuuuuauuccuccuccauuuuauugucauuguuuguuuugagacagggucucacucugucacccaggcuggagugcaguggagugaucauagcuuacugcagccuccaccuccugggaggcucaagggauccuccugccuuagucucuugaguagcugaaguucugaaauucuuuauucugcuagaucuagucuguauauuuuuuaaauuuuauuucaauaguuuuugggucacaggugguuuuugguuacauggaugagcuauuuaguggugauuucugagguuuuagugcacuccucacccaagcaguguacacuguacccaaaauguagucuuuuauucccucagccccacaaccuuaccccaaagagucccuaaagucuauuauaucauucuuaugccuuugcauccucauagcuuagcucccacuuauaaaugagaacauacaaugcuugguuuucuguuccuagguuacuucacuuagaaugauggacuccaacuccauccagguugcugcgaaugcuauuauuuuguucuuuuuuaugacugaguaggauucacauuuucuuuaugcacuaguugguugaugggcauuugggcugguuccauauuuuugcaguugcuaauugugcuguuauaaacaugugugugcaugucucuuuuucauauaaugauuuauuuuccuugggguagauaucuaguggugggauugcuggaucgaaugguaguccugcuuuuaguuuuuuuuuuuuuuuuuuuuuuuuugagacggagucucgcucugucacccaggcuggagugcaguggugcagucucggcucacugcaagcuccgccucccaggugcacgccauucuccugccucagccuccugaguagcugggacuacaggcgugugccaccaugccuggcuaauuuuuguauuuuuaguagagacaggguuucaccauauuggccaggcugggcucaaacuccugaccucagguaaucuacccuccucgaacucccaaagugcugggauuacaggugugagccgccgugcccggcccugcuuuuaguuuuuuaaggaaucuccauauuguuuucaauagugguuguacuaauuuacauucccaccagcauugugaaaguguucccuucucaacacagccaugccaacaucuauuguuuuuugacuuuuuaauuauggccauucuugcaggaguaaagugguaucucauuaugguuuuaauuugcauuucucugaugauuagugauguuaagcauuuuuuucauauguuuguuggcuguuuguacaucuuauuugagaauugucuauccauguccuuugcccacuuuuugaugggacuauuuguuuuuuucuugcugauuuguuugaguuucuuguagauucuggauauuaguccuuugucagauacauaauuugugaauauuuucucccacucuguggguugucuguuuacucugcugauuauuucuuuugcucuacggaagcuuuuuaguuuaauuaggucccauuuauuuauuuuugucuuuguugcauuugcuuuggggguguuagucaugaauucuuugccuaagccaauguuuagaagaguuugucugauguuaucuucuagaauuuuuaugguuucaggucuuagauuuaagucuuugaucgaucuugagucgauuuuuguauaaggugagagaugaggauccaguuucauucuucuacauguggcuugccaauuaggauguccuuuccccacuuuauguuuuuguuuguuuugucaaagaucaguugacuguaaguauuuggcuuuauuucugaguucucuguucuguuccauugaucugugugccuauuuuuauaccaguaccauguuguuuuggugacuguggccuaacaguauaguuugaagucagauaauguaaagccuccagauuuguucuuuuuccuuagucuugcuuuggcuaugugggcucuuuuuugguuucauaugaauuuuaggauuguuuuuucuaguucugugaagaauuauggugguaucuugaugggaauugcguugaauuuguagauugcgucuggcaguauggucauuuucacaauauugauucuacccauccaugaacaugggauguguuuuccauuuguuugugucaucugugauuucuuucagcaguguuuuguaguuuuccuuguagagggccuucaccuccuugguuaaguauauuccuaaguuuuuguuuguuuguuuguuuuugcagcuguuguaaaagugguugaguuuuuaaauuugauuugauucucagcuuggucauuguugguguguagcagugcuacugauguguguacacugauuuuguacuuugauacuuuaccaaauuuauuuauccaaucuaggagcuuuuuggaugagucuucaggguuuucuuuuuuuuucuuuuuuuuuuuuuuaagauggagucucgcucugucaccccaggcuggagugcaguggcacgaucucggcucacugcaagcuccaccucccagguucacaccauucuccugccucagccucccaaggagcugggacuacaggcgccugccaccaugccuggcuaauuuuuuuuguauauuuaguagagacaggguuucaccauguuagccaggauggagucuucaggguuuucuaagguauacgaucauaucacuggcaaacagugacaguuuggguuccucuuuugcaauauggauuuucuucauuucuuucucuugucugauugcucuggcugaguacuauguugaauagaaguggugaaagugggcaucuuugucuuguuccaguucucaacgggaaugcuuucaacuuuuccccauucaacaugauguuggcuguggauuugucauauaugguuuuuauuacuucgagguaagucucuucuuugccuaguuuguugaggguuuuuuuguuuuuuuuuuuuugagauggagucucgcucugucgcccaggcuggagugcaguggugugaucucggcucacugcaagcuccaccucccagguucacgccauucuccugccucagccuccggaagagcugggucuacaggcacccgccaccacgcccagcuaauuuuuuguauuuucaguagagacaggguuucaccguguuggccaggauggucucaaucuccugaccucgugauccacccaccuuggccucccaaagugcugggauuauaggugugagccacugcgcccagcccgaggguuuuuaaucauaaagagaugcuguuuuuuuuguuuuuuuuuuuaaagacagagccugacucucuuucccagacuggaaugcaguggugcgaucuggcucacugcagccuccacuuuccagguucaagcgauucuccugccucagccuucugaguagcugggauuacaggcaugcuaauuuuuguauuuuuaguagagaugggguuucaccauauugaccaggcuggucucaaauuccugaccucagguggucugccugucucagccucccaaagugcugggauuauaggcauaagccacucugcccagcagagaugcuggauuuuaccauaugcuuuuuccaucucuguugagaugaucauaugguuuuuguuuuuaauucuguuucuguuauguagcauguuuauugacuugcauauguuaaaccaucccugcaucccuaguuugaaacccacuugaucaugauguauuaucuuuuugacaugcuguuggauuugguuagcuaguauuuuauugaggauuuuugcaucuauguucaucaggauauuggucuguaguuuucuuuuuuuguuauguccuuuccuaguuuugguauuaggguaauacuggccucauggaaugauuuagggaggauuuccucuuuuucugucuuuuggaauaauuuuaguaggauugguaauaauucuucuuugaaugucugauagaauucagcugugaauccaccugguccuggacuuuuuuuuguuggcaauuuaaaaaauugcugauucagucucacugcuuguuauuggucuguucaggguuucuauuucuuccugauuuaaucuagaaggguuauauauuuccaggaacuuaucuaccuccucuagauuuuguaguuugugcacauaaagguguucauaguagccuugaaugaccuuuuguauuucugugguaucaguuacaauaucuccaguuucuuuuuuuuuucuuucuuucuuuuuuuuuuuuuuuuuuuuuuuuuuuugagacagucuugcugugucacccaggcuggagugcaguggugugaucuuggcucacugcaaccucugccucccaaguucaagcaauucuccuuccucagccucccaaguggcugggauuacaggcgccugccaccaugccuggcugauuuuuguauuuuuaguagagagaggguuucaccauguuguccaggcuggucacaaacuccugaccucaagugauaugccugccuuggccucccaaaaugcugggauugugggcaugagccaccgugaauugagcuuauuuggaucuucugucuucuugguuaaucucacuaauggucuaucaauuuuguuuaucuuuucaaagaaccagcuuuuuguuucauuuaucuuuuguauuuuuuguuuuuuuguuuguuucaauuucauuuaauucugcucugaucuuuguuacuucuucuccuggguuuggguuuaguuuguucuuguuucucuauuucuuugugaugugacauuaaauugucugugcuauuucaggguuuuugauguagacauuuaacacugugaacuuuccucuuagcacugcuuuugcuguaucccagagguuuugauaaguugugucacuauuauucauuucaaagaauuuuuaaauuuacauauugauuucauuguuaacccaaaaauuauacaagagcagauuauuuaauuuccauguauuuguauaauuuugagaguuccuuuuauaguugauuuccagcuuuauuccacuguggucugagaagauacuugauaggauuuugauuuucuuaaauuuauugagacuuauuuuguggcccaucauaucaccuaucuuggagacuguuccaugugcugaugaggagaauguauauucugcaguuguugggaagaauguuguguaaacaccuguuaaguucauuuguucuaggauauaguuuaaguuuguuguuucuuuguugacuuuuugucuugaucuuucuagugcugucaguggaguauugaagucccacacuauuauuguguuguugccagucucauuucuuagaucuaauaguaauuguuuuauaaaucugggagcuccaguguuaguugcauauaaauuuaggauuauaguauccuuauguugggcuaauccuuuuaucauuguauaacauccuucuuugucuuuuuuacuguuguugcuuuaaagucuguuuugucugauauaagaauaacuacugcucgcuuuugguuuccauuuauauggaaugucuuuuuccaccccuuuaccuuaaauuuuuaugaguccuuauauguuaggugagucucuugaugacagcagauacuuggugguuuuuuauccauucugucauucuguaucuuuuaaguggaacauuuaggccauuuacauucaacguuaauauugaaauguuagguacuguucuauucaucauguuaguuguuacuuagauacuuuguuuuuuuuucauucuguuguuguuuuuuaggcccugugagauuuaugcuuucaggagguucuauauaggugcauuucagagcuuuuguuucaagauucagaacuucuuucagaacuucuuugagaccucaggcuccugggauaauguuccagaggguaguuaacugcaucugcugcauagaagaguucccaaagggaguggagaguagugggcaacaaugagccucacccagcucuuucacaguuggcgacgcuggucucacucccacagugcuucgcuuacuggauuuaguuccaggcagucugcgcacggaacucagaccugcccaaggccauaaccaugccuuucuccauaugcccauaaggccggacgcccagcuccucugcucaugucuguagcacacuuuacacucacccuguggguucuguucaggagagcucaucccuacucaagauuauaucgcaaaauucaucugggagcuucuuucacccuaugaccccucccugaacucauugacugcuucuucgagggccccuaugagaugcagucaggaauggcuugccucuguucaugcuggagacugggaaugccuacaaggcacuucaugcugcugcgucuacuuuuguauuucacauagacuaaauccauuccagcucucgguaggguuaaggcuuucucccauggucuggauuuucagacuugcagguggggaugugugcuccgagacaggcucauuccccugcuuacacucugggaacuuaguuuuucaccugucucaugcaguaggcuccagccugcugcuucuuucagaggguuuguggauuccuuccaucuuccuguggugguucuuggaaaaaagaaaauucacagugugacucucuagccacuauucuuuccuuccaagugggagaggcaugcuaacacugacucuuaucugucaucuuggaaaguaaauaaauaaaagaucuaauucaagcuugucuaaccugugauccaugggccuuaugcagccuaggacaguuugaauguggucuaacacaaauucguaaacuucuuuucuuuuuuuuuuuuuuuuuuuuguuucuuuuaagacagagugagacucuguugcccagacuggagugcaguggagcgaucuuggcgcaccgcaaccucugccucccggguucaagugauucuccugccucagccucccaaguagcugagauuauaggcaugcgcaaccaugccuaguuaauuuuuguacuuuuaguagagacaugguuucaccauguuguccaggcuagucucaaacuccugaccucaggugauccacccaccucagucucccaaagugcugggauuacaggcaugagccaccgcgcccagcuguaaacuuucuuaaaacaugauuuuuuuuuuuuuuuuuuuuuuuagcucaucagcugucauuaguguuacuguauuuuauguguggcccaagacaauucuuccaguguggcuuagggaagccaaaagauuggacaccccgaucuagucuguuucugaagcucucaauuguauuuuuuauuucauucauagaacucuucagaugcaggauuucuguuugauuuuuuaaaaugauaucucuuuguuaaauuucucauucagaucaugaauuguuuuucuuauguccuuguguuugucuguguucucuuggaucucacugagcuucuuuaauaucaguaguuugaauuauuuuucagguauuucauguuuucuuuuauuuuuuauauuuuauuuuuucagacagggucccaggcuggagugcaguggcacagucacagcucacugcagccuuccugagcucaagcaauucuuccaccuccgccucccaaguagcugggacgacaggcaucugccaccaaacccagcuauuuuuguguuuuuuguaaaggcaagguuuugccguguugcuaaggcuggccccaaacuccuggguucaggcgauccuccucccuaauaauuuuuuguaauuuuuguggagaggagguuucgccacguugcccaggcuggucucgaacuccaagguucaggugaugcacacaccuuagccucccaaaaugcuaggauuacaggggugagccacaaugccuguccuauagauuucuuuuucacuggaaucuuuugcuggagaauuaucauaguuguuuuggaagugucauguuuccuugcuuuuucauguuucuuaugucuuuaaguugauaccugcacauuuggugaaacaguuacuucuuucagauuuuuagauuggcuuucauaggaaaagacuuuugccuguaguuguaucuauaauauugauuggguagggugcuuuagcuuugauuccgggugugugcaauaguauagucucugcaugauuucuuuggguguaaucagugucagugauguuugugaguuccuuagugacuuacgcuaugguugguacuagaggguaugauaggucuuuacuugggauggggacuccaggcaggccuguucuugggccccacugguggugauggcaugccaaauacauccauuuuugguucccuuggcaguguacacagauacuaguguuaucagguccaggcagaccaauucuugggccuccagguggcuugcucagguaccagcagugacagcaaugggaugggcaggcaggugguuucaugagucccugggcaguaugcgugguguuggugauggcaguagcaguggcgggucaaccgucaggcccccaggcagcaagcacaggcggcaguggugguggcaauggacugggcuggccaguccccccagagcacauuuagggggguccuggcggugauggugguggugaugauaggcuagucaggcccguccucaagcccuggggaggaguguguggaugccggcaguaguggccaguggggugaaccucaggaccucaaacgguaugcucaggcacccgcaguauguuggcugggccuguuaucaggccccuugauggcugagugugugcaccugcccacagcaacagacagaaugaggcuauuccugggccccuagauggcgcucucagacacuggugugguagaguggugcagagcagggugggccugaucuuagccuccugauggugugccuaaaguuguggugggcagggcagggcuaucccuuugcccuugguuagugugcucagguaccaguggcccacaggcuggaccugcuguuaagcucccuuauggugugugugugugugugccccagaagcagcuggcggggcaggucaauccccaggcccuggacaguaugauugggcacuggcgauggucuguugucuugguggucuguugucuugaugugcucacacacccaccaugacagauagggcagggugauuaucaggaucccaggacagcaucugggugggccugucccuaggcacacuaaaggcacaugccagugcgcaguagccuugcugcuggguggccccagggaaauggcucucaggcucugaggagugugcgcuucagcucccucugucccacgggcagccucccuggugcacugcacugcugguuccuugggguguaggacacuguguaggcuagagugccggggaccugguuuuacuauuggguucagucaguguugugccacugcagcucuccagguggaugcaguggggaugucagcaaggcuccagggauguggagauguaggggcuuuugggcccuagggaaggauacagucugguggggguugaauucucaaaauggugcuaugcugcggugucuugggccuuggggguaugugagguacccagugcuaucucucuggaauuaauguuguauggacuccagacagcucccuauacuagucuuagggccugcaggggccaaggggcucuccugugguuaguacugcaggauucugcaguagaaaugugggaucucucauuuacauuuucccugcuucccuuucuucccaugccucaguuguucccugucacuguucugcugaauuccacuguuuuuucuuggaugcugucuuugacaugugauuaucuacccacuguuuaguccuucuuuguggaggaggcaggugccaggugccccuagucagccaucuugaagcccccuccccaucucacuuucuugaugauguucuuugaagcacagaaauuuuaaauuuggcaaaaucuaauuuaccuauuuuuuuuuccuuugguugcuuugguuuuaguuuuauauuuuagaaacuguugucuaauauaaaaguauaaagauuuaugcuugccuuucuccuaagaguuuuccaccuucauucuuuuguauguauauauccaguuguuuuaagcaccauuuguugaaaaugcuugaaugguguuggaaucugugucagaaaucaguugacuguaauauguagauuucuuucugaacucucaauucuguuucauugaucuuugucuguccuuaggccacuacuacacugucuugauuauuauagcuuuguaagaaauuuugaaaucagaaaguaugagucuuccaaccuuguucuucuuuuucaagguuguuuuggcucuucugaucccuuacauucaaauuccauaugaauuuugggaucagucagucaauuucugucaagaagucagcugggauuuugguaggaauuguguugaaauuguagaucacuuugagaguaaugcuaucuuaauguuaaguuuucugaucccugaauaauggauggcuuuccaucuggaaauugauuuauuucaacaguguuuuccagcuuuuagcacuucuuuugugaaacuuauuccuaaauacuuuauucuuuugaugcccuuguaaauugaauuauuuuuaaauuuuauuuuugguuucuucuuugcuacuguguagagauagaauuaauuuuuguauauuaaucuuguaucuuacaaccauguuaaacucauuuauuaguucuaauaguuguuuaauggauguuuuaaaggauuuuauauauaaaagaucaugucaucugcaaacagauauuuuacuucuuuucuuucuaaucuggaugccugacauucauuguugaugagcagugucuugagaaucugauuaccauuccuuuauagauauuguucuuucucuucugacuuuucggauuuucucuauauucuuaaugcucugaaguuuaccacaguauagcuagauguuuauuuucuaguaugguguuugauauguacauuuucugauuuauuucacacugaaaauaauauuauugcuuuuucuugcuuguaugaacaauacaugcacauuccaaaaauguuagaagcauaagaaacaaguuuaaaucacaugaaaucauaugcccagagauaaacacuauuagcauguuuaugaccaguaaccaguauuaugauauauugcaugaugccuguacauccucaguccaucaguagauccugcugccuuuaccuuggaaacauauuucaaauccugcugcuuaccaaccaaaucugucucuccugcucuuauccaugucaccauauucgcuuaggaccacuauaauagcuuucucacugauuaauaugguuuggauguuuuguuccuucuaaaucucaugguugaaaugggaccuucaauguuguagauggaccuagugcaaggugucugggucuugggggcagaucccucauccguggcuuggugcccuccuugugguaaugagugagcucucccucugaauucaccugagagcugguuguuuuaaagacuguggcaccuccccacauccacauccuugcuccaucucuugccauggauguaccguuccuccuuuggcuuccaucaugauugaaagcucacugaggcccuaccagaagcugagcaaauguuggugcuaugcuuguacagccugccgaacugugagccaauuaaaccucuuuucuuuauaaauuacccagucuuacauauuccuuuauaguaauaaaacagacuaacacccuggucuccuuccauccaguucuacuuuucacacagcauccaaacaauuucuuuuaaagcauaaucagauuaugucacucccuguugaaggcccuccaguggcuccccauuauaauuccuuuggucuaagaggcccucaaugauaugguccccggcugcuucucugaucucaucucugacaguguucacuuaccaucucacccucgcuuacugugcuccacuaacacuaauauucuugcuauuucaggacauaccaagaacacacuggcccuacgacuuucauacucgcaacucccuguauuugaaacugcucuccgaaacuaccugccugacucuugcacuucauucagcucucuguucaaagugucacuucaucugauacaccuuacaaccugugucagauucucuuaugacucccuugaucauacuguaucccuuuaaccugcuuuauuuuucucugccacuuacagauauuauauaauuucuccuuauuuuccucuucccuccccacaguauuguaagcucccugugagcaagaacuuugggaugcccaguuuucccucuuuuuucuuuucuuuucuuuuuuuugagacggagccuugcucugucgcccaggcuggaaugcaguggcacgcucucagcucacugcaaccuccaccucccagguucaagugauucuccugccucagccucuagacuagcugggauuacaggcacccgccaucacaccuggcuaacuuuugcauauuuaauagagacaagguuucaccauauuggccaggcugguuucaaagucuugaacucgggugauccucccaccucggccucccaaaguucugggauuacaggcaugagccacugcgcccagccccugacucuuaagauuauuuucugacaugguacacucaauaaauauuuauauuuuugcaaacaauacauaauuuuauauaaauaggauugaauuacauauuacauugucccuuuuaaaaaccaaagucggccggaugcaguggcucacaccuguaagcccagcacuuugggaagcugaucgcuugagcacaggaguuugagaccagcuagggcaacauggcaaaaccccgucucuacaaaaaauacaaaaauuagccaagcaugguggugcaugccuguaguuccagcuacucgggaagcugcagagggaggaucauuugaacccaggaggucaaggcugcagugagcuaugguccugccacuacacuccagccugagugacagagugagaaccugucucaaaaaaacccaacaaggauagcauuguauuuuuacuuuuuguuuuugguuucuucucucucuuccugucaccccuuuagauauccaacauuaaccugguaugaauucauuuauccuuuuuucugugcuuauauaauuguuacaggaauaaauaugcacuggacauuuugggggcauaauuuacagaaaauuuauucauguguucaaauuaucugcaauuuccuagcuuaaguuuaugguagacauccuccauucgacugccguagcucuaaccuuauuguuuuaaauugugguuaucuuuuaaauuguauuucuugugcuuuuaauaaaugcaagcuuaauguaaaauuuuuaauaauuacauauagauauauaugaaaauauauacauauucauauuuauaugaaauauaccauaacuucgccucccaaucugucacaucccacacaucuucaaauaggcaacuauuaucaguuugcugugucuaauuuuagaucuuuaucaaugcauuuguaugcacauagguagacacagggguuuuuuuaguuguuuauauaaauauuacauaaugcauuuuauucugucauuguuuuucuuuuuucacucaacauguaacauaguucaacuccaugguuuuuauugguaauuuuuuucuugcuuauauacacagagacaauuuuauuuaaauaauauuauauauguauuuuuguuuuuugugagagauuauuugguuuugcuagauuccucuuuucucccaucuuccauuaacaucuccauauauacuuuuaucugaggacuccuauauucuagaaaaucuuuaaccuaauccuucaacuuugcuucuuucucauuucuucuauuuuuguauuuuauguuuuuauuuuauaaccuauuuuucuuuugcaaugucuuaugauuuucuuuagcuauuggagcuguguagcauuuuaaagucauuuuuauauugcucuauuuucauuucaucugcaguaaauuccucucccugacauugguuauacuggcugucuuucaugguuuuaauuucuucauguauuuuagacuuuugauuugcaagugcuucuugacuagaauuuuucaugugcauaucugucuaccacugcuuucacucccucugucuaguagguuugguugccuuccaucuggccccaaacaaucccaggcuggagccauaucuuaacacuggcaacagagggccucugucccagugugacacuggagauugguccaggcccaggcuuggaggcauuaucugcuucccaucauuucugguuuagcuuuaaguaagcuuugcuuccuggcagcgguuaggagcaguuuugucuuuugaguugguuuuuuuuuuuuuuuugagacagaauuuuacucuuguugcccaggcuggaauguaaugguugcucacugcaaccucugccuccuggguucaagugauucuccugccucauccuccugaguagcugggauuacaggugcccaccaccacgcccggauaauuuuuguauuuuuaguagaggcgggguuucaccauguuggccaggcuagucuccaacuccugaccucacgugauccacccaucucagccuccuuaagugcugggauuacaggugugagccaccgcgccgggcugguuaguggcaguuuuuuucagccaccuuuucaggguggguaaacucugucucagcccucgguuucaaacagugaagcugucucuucguuuccuguucuucuggagcacuucgaacaccuuuuaucuugcaggaggccaauuccuggcuacuucugcuuaccgguaggccugcagcuuuagccugacuugcagcuuuuucucuucuccuuuuuuucugguucauugaaauguuuuauuuuguauaugcuuuaggauaugucauuuuaauuuucuauauucacugaugcuuuuggacauaggaagggaguuuuaugcacuacugaaaucaacuugacuaggaagucuuaggauacuuuuaaaaaugcaaaucaguuuucaguccucugcuuaaaauccuaaacucuagacuuuuagcauucccuuaggugaucuggccccuaccuaccucuccagauuuauuucaggcacuuuccuguuugcugccagucuuucaguucuuugaaagugccucacugucacacaugcaugcccccuugcccaaguuugacaucuucccaguucucuuuucucauuuaaauguuaccuccucagagagaucuuaccuaaccacccucauuaaaauacucuccccaguuguuuaucaugacaccuguuuauuuccuuaauaguacuuguuacagcuuauaaguauuuguguuuauuuucuuguuuaugcucucucacaaaacugaaagcuccaugaguuuuuuaauauuauauuuacauuauauauagccagcauauagcagcaugcccaauaaauacaucaugagugacuguuacucauugguccauucaguuguauauauugaauggcuacaguaugacagaacuguucucaauguggcagauguaauauuagugagcagcacaaaguucuuacucuauagaguuuauauuuuagugggagaagaaaaguaauaaauauaaaaauaaauaagugacaucagugcuuuagggugguguguuuaggugauggggaaacacuuuucugagguaguaacaggaaggaauuuaucuggugaugaucaagaaaaagagcugucaagcagagggaagagcuagaauaaaguucuuaaaucaagaaugagcuugaguauucauggaacaaaagaccagagaggcuguagugaagugaguaauagagggaagaagcauugcaagacaaugucaaaaacuuggcugaggccagauaauaacgagcgagggucaggaguuugaaagugugccuuaagagaggugcaacaugguacugaaggagguggugagguguaggugggaaggugugcugcagaggauuucaucuacugagcaaauggguucaacacaucucuauaaauuguagcaaaggguuaucuuucagaaaaucacaaaucacugcuguguuuuugguuucauuuucaccagggaugcugcuuucuaauucuugguucuaauggcuuaauuaccucuuuagaaaccaguagaagccacacaucugaugcugugcgugauugcuuguuuauauucauaaaauacauuggaaauagaaaggaaguacucacuuagugcuuuuuuuuuuuuuugcugaauuucugaauuugggcaggcuuuuggaaguucauguuuccuaguuuagucaguacagugaccugaaagcaaaacuagguugauuacucaaucuuucauuuccacuuuuucauuucccuguguuuuagaaagcaagugacuagggaaggcaguguucucaaggaugccuaacuuccacauuuuuaagagcaaacucuuuuuaaaaauauccuuauagcaaucuacugaugagcuguccaccaauaagauguggucucauuugacauuuacaaccuuuuauaauccuguuguaaugaauaauugcuuccauauugccuuuuuuuaaaaguucuuugaaauuaacugaagaucccuuuuuucccuguccuucgcuaaacauguagcgauggcaaggagcuauuuuaaguuucuguaugguaaacuuaaugauacuuccaguucuuuugcugacccuacaggcagaggacucagaggcaguuccgcuucuuuccuaauaaugcugucuugcuuaagccacugucacaauauuuacagguagccacucacaaauaguuacacuuuaaaaauucauguaagucugaguuuuggaauuugaaauacacuucccacugggaaaaaaauguauaaauaaauaaauaaauauguuucuaggcaacccuuuacaggcuuauuaaaccuuaaucuauaauguagcugaaauacuauacauuuaugaugaaaaaauuaggaaaaucauauuucagaugcauauuaguuccacuauaugacauuuaaguaggauuuuauauggaauaguuuggcuccuuuaacaccauuguugguggugagaaggguaaguaguggugucacgagguucuagagagaagacauugagaaugguccucgagaaagcccaucccaucuccuguguggcauggaccagccaucugcaugugagacagucuuaagucacauacuuguauaucaggaguauuguaugaucuuacuaguugcaaaaugugaaaaaauucauuuagaauaaucuugagugagggagugaaaaguauauauauuuugaaauuuccuaagcagauauuguuggaaaaaugccuuuuucaugcauuuacagauaauauauucauauauuuagugaccauuuuuaguuguguuuuccuucuuuugucuuuaaaaaaaaugguuuuauuaauuauuggugcuacuuaguuuuaaauguaaaggacuuaauucauuuaaaaagaaaaaaagguaccauaaaguuaauaguuuaaacauuuaauucuauaauuguucuagaguuuuaauguuuuaguucuuuaccaggcacaauuauuucaagagauuuucauuauguugaagcuaacuuuuuaccauuaguuaacuuauauucuuaugaggacaguauaauuccugacaaagcaguauuuuggaaaguuauagaauguagaagagugugugcuuuggauucuaggagggagaugugaguucuuauucaagucuagauacauuucucagcuucuguuucuuuaccuacaaaaggaggcugaugaaacccacuugccucccaggguugcuaaaauugcauaagauugauugagaauguaugucagcccauacuacuauaggaaugggcuguccauggaacagguagggaaaguuuucaugccauuguguuuuucuuccuuguacccuucuuccuuuuauaacuaaguuucucaaaugaauaaucuauacucaguagcuucacuuuuaaucuuucauucuuguaaaaaaaaucaauaguauuucauauuuguauuuuuaugacuauguaaguguucuucaaucugagucagguaauuauuauuuuguuccugagucagauaauuauuacuacgaguauauucuuucuugaauagcuuucuaccccuuuuggaacaauaauugcuuuauuauuauuuuuuuucguuugaggcagucuugcucugugacucuggcuggagugcaguggcgcuaucucggcucacugcaaccucugccucucagguucaagccauccucccaccucagccucccuaguagcugggauuacaggcgcccgccaccaugcccggcuaauuuuuuguauuuuuaguagagacaggguuucaccauguuagccaggcuagucucgaacuccugaccucaggugauuuaccugccucugccucccaaagugcugggauuacagguguggcucaccauaccuggccuauuuuucuguuugcuuuguuuucuguugugucuaacagaacuguaaaauucaucucaauauggcaaacacuuaagguuaucucucagauccauuuuuaaacuuuaucuuuuccucggagauacuucucugggaaccuucuguccuccuauuccagucuggacuggcugcugucuaggccuggugcaaaauuuucauccugccuguuccuuucaucaucguccugggaauuucccuuccuucucucauguuuuaaaucguguuuccugguuccuguuuucuacucuuucuugauuuauucucuugucuuugauguaucacauccucuaccacccaccuccucccagcucaccuagccccaaauccucuauuaaggcaacuuucuuacaucaccugugaagauuucccucucccuucgguucccuuguuagauugaucucacccuccuuugugccuccauggcacccucuaucauagccuugguccaucaugacuacugaacaccuacuguacacguuaggcacucuguucaacauuagggauucugagauuaaaagaauguguuuccuguucccaagggaguucuggaagcuaaaugagaaugccaggguucucacugggguuaguacugcccucuaguggacccuuugaaaaagugaaagaaaguuuuugguugccauauuaaugggaaaguguagcuggcacuuuguagucaggggccaggcauacuagaugucucauauguccagcacaacuuuaggauaucucacuagacauucauuuguuaaaauauguuuauaauuauucagccuaggaccuaauuccauuuuacacacaaacccaaacuacucuuagcacuuuuuacauugucauugcuugugcaaccgauagaaaacagcuguuguucagcaaugugaguuuagagacaaauuucuuuuuaagguagcaugagauauuuuaagaauucuuuauauuggucauugauggcgcuuagucucuaagaauccuagugagaggcuucacaaaucagugaauaugguuaucagugcuguuaauuaaaaaauaaaguguaggcugggcauaguggcucacaccuguaaucccaucacuuugggaggcuaaggcaggaagacugcuugaguccaggaguuugaggcugcagugagcuaugaucgugccacugcacuccggccugggugacagagugagaugcuugagcccaggaguuugaggcugcacugagcagugaucacaucacuguacuccagccugggugacagaucgagacccugucucaaaaaaaaaaaaaaaaaaaaaaacacaauaaaacgcaaaaucccuuaagugauggauuauuuuguaaaguuuguaauguaaacaauauaauaacaaugaagaagaauaugauuuuaccuuacccuauucauaaaagauaacuuuucauauuaaauguuaauaaauauuuuguucauuauuguaugugugugugcacauauauugcaguauaacauauaaugcacagcuuuaugaauuuauuuacaugcauacaccuacacacauguaacugccaccaugaucuagaaauagaauaucugcauaguuggaaaauauaggauaaacuuauuuuuaaacaguauauugauuauauuuuuuuaauacugugccuauuauguuuucauguauacaauaaauacaauucagaguguccaaaaaaccuggaagcauaaagaaaacagugcguuuauuguauuuuuaaaaauauucacaauuggggccacugcuuuaaauuuagaaguguuuuacuuggaaaaauauauugagguugaagaaaaagauauugaacauauuauuugaaaauguaacuagcacauauuuauccuguuccccagccuuauggauacccuguauaacauuuccaguaccccaaaauguuucccauaccccuuuuuagucauuauaccauuucuaucagguauaaccacuauucugacuuacaucaucauagauuuuugucuuuucuugaacuucauguaaauggaaucauauaguaugcauucuuguguuaccuucuuuaaauugguguuauuccuaugagauucauccacguuuugaauguagcagaaguucuuuguuauuguuguguaguauuccauugugugucuacagacaauuuaucucuucuguuguuacuugauuuguuuccagauuuuggcuauaugaauaaagcuacuaugaacauucuuauaccacauuuauacucaucucucguagauauauaucuagaaauagaauuuuugggucacauguaggcauauguuuggcuuuuauagcuauuacuaaaaaguuuucugaagugguuauuucaauuuauacuucuaacagcagguaugauaguuacaguuguuccauaucccuaacaacaauucauaguguuacuagauuacauaauauuuauucaaucagugauaaguaaaaaguuaacagauauuaucauaucauuaaauauauuugaaacugcaagaagaugacauaaaucacauuaaagugaaggaauuauaguauuuaucuacaaucauauauuauuugaaaguaaggcuggucacaguggcucauaccuguaaucccagcacuuugggaggccaagguggaaggaucacuugggguugggaguucgagaccagccugaccaacacggugaaaccccaucucuaccaaaaaaugcaaaaauuagccaggccugguggcacaugccuguagucccagcuacucaggaggcugagauaugacaaucacuugaaccaggaggcagagguugcagugagccgagaucacaccacugcacuccagccugggugacagagugagacccugugucaaaaaaagaaaaaagaaaauaaaucucacuaggaauuuuauuucuaccuaagauaagccuaaauuuauuccuuugaaaauauauugcucucauguuguauuaguuaucuauugcugccuaacaaauuaucccaaaguuuagcugcuuaaaacaauaaauguguuaucucuuacuguuucugagggucauuaaucugauagcagcuuagcuggguaguucuagcauagggcucucacaagguuguagucaagaugucauuuggagcugcaguuaucuuucagggcucaccugggacugugggaaauccacuuucaaacucacucacauaguuguuggcaguacagcccuggcugguguguuagagacuuuaguuccuuacaacgugggccucuccauaagcuucuguaacaugucaaccuacuucuugcaggacgaaugaucugaaaggcauagggaaugaaugaauaaaugaauacccaagacagaaguugucuuuuuuauaaccuaaucuuggaagugauuugcuauuacuugagcuguuaguuacuggucaugcaggcugaccuaguacacugugggagaggacugcacaaggaggcaugaauacccugcacaaggcagagaucacugggggccaucuuuuuuuuuuuuuuuugcucugucgcccaggcuggagugcagugcgaucucagcucacugcaaccuccgcuuccuggguuccagugauucuugugcuucagccucccuuguagcugggacuacaggcacacaccuccaugccuggcuaauuuuuguguuuuuaguagagauggaguuuugccauguuggccaggcuggucucgaacuucuggcucaagugauccacccaccucagccucccaaaguguugggauuacaggccugggccaccgcaccuggccacaggggccaucuugaagacuaccacacauauggaugcuuauuuuuuguuguggcaguggcaaaguacacauaaaauuuaccauuuuaaccauuuugaaguguaugauucacuggcagcacauucauaaaguugugcaacucaucuaagcaguuucuuaccuuuggcauggagcaucuuaguuuauuuuuucauuuucaaccuauguuugucuuuggaucuaaagugaguuauagacagaauagaguuggaaucaugucuuucuuauccguuugccaacuuuugucuuuaauuggaaaguuuaauccauuuacacuuacugauaaggaaggacuuuugcuauuuugguauuuguuuucuauacuuuuuuacuuccacaauuccuccauuacugucuucuuuuuuguuuaauugagcuuuuugaagugugccacuuuuauuauuuucuguauaguucuuagggguuuuuuuuagugguuuccuuggggauuacaauuugcaucugaaauuuauaacaauguaguuugaauuaauaccacuuuaguuuuaauacuguauagaacuucuucuauacagcucuguuucucccccuuuauguugucauugucacagauuucaucuuuauacauuguauauccauuaauguagauuuauaauuguuguuugaugcauuugucuuuuaaauuauguagaaaaaaaggagacgucacaaacuaacuuuuauauuuaccuauguaguuaccuuuauugguauucuuuauuuguucguguggcuucaaggugcugucuagcauccuuucauuucagccugaaacacuguuagcaguuucguaguccagguuuacuaauuauuaacuccuucaaguuguuuuguuuuguuuguuuguuuguuuguuuuugagauggggucuuacucugucauucaggcuagagugugguggugccaucauagcucacugcagccucagccucccugggcucaggugauccauccaccucagucuccugaguagcugggacuacaggcaugugccaccaagcccagcugauuuuuuuguauuuuugguaggcaugggguuucgccauguuguccagguuggucucaaacuccugggcucaagugaucugcccacuucagccucccaaagugcugggauuauaggcaugagccacuguguccagacaauucccucaguuuuuaucuggaaaugucuuaauuucaccuucauuuuugaaggauauuuuuggcagauagugaauucuugguggacagauuuuuuuagaagucuuucagcacuuuaaccauauccucccagugcucuauucuucaugguuucugaugagacauuggcuguuaaucugauugaggaugucuuauauguaaugaaucacuucucucuuguugcuuucaggauucugucuuuagcuuucagcaguuugauuaguauguaucuugauguggcuuuccuugaguuuuucugcuuggaguuuguugagcuucuuggauguguaaaugcuuggaguuuguugagcuucuuggauguguaaaugcauguauuaucaaauuugggaaguuauuggccauuaucucuuaagauauuuuuucugccccugucucuucucuuccccuucugagacucuuguuaugcauaugcauaugcauauauauauauauauauauauauauauauauauauauauauaguuuguuuguuuguuuguuuguuuugagauggagucucacucuguuguccaggcuggagugcaguggcacaaucuuggcucacugcaaccucggccucccagguucaagcaauucuccugccucagccuccagaguaggugggacuacagucaugcaccaccacgcccagcuaauuuuuguauuuuuaguagagacgggguuucaccauggccaggcuggucucaaacuccugacuucacgugauccggccgccuuggccuuccagagugcugggauuacaggcgugagcuauggcaccuggccuuguuaugcauauauugaugggcuugaugguacccacagaucucuuagacuucauuuggccuaccuucaaguuccuuaauucuucugccugcccaaaucugcuguugaacacucaccgucuccccucugaguuuuucauuucaguuauuauacuuuuuagcuccagaauuuuuuuuguuccuuuuuauaauuucugucugccauugguauucucuguucggugacacacauuauuuagguuuucuuuaguucuuugagcauauuaagauaauugauggaaagucuuuaucuagucaguccagugucugaaccuccucagugacaguuuguuaauuuccuuuuuuuccugugaauggaccauacuuucuuguauuuucgcaugccucauaauuuuuuguugaaaacuggacauuucaaauauuuuaauaugguaacucuagaaaugagauucuuccaucuucccaggauuuguuguugcugcuuguggugaguuguuuguuuguuuagugacuuuucuaaagcuuuuuuggaaauaccauguuuuuuguuguuuguagucacugaagucuccauuccauuagcuuaguggucagcuagugauuugucagagauuuccuuaaaugccuggagcaaaacaaaacauuaaacucuguagguguaugucgggauaugccuucagcucucagccaggcaguucauaacggccuuugccuucccauccugcuuguuuggagcuuuucagcaagcaguuuguuugccccaacugacuuccugugcugcacgcugcaucugcugcuucguuaccuuucaauguuuuuaacagauaaccuccagguaaccacuuuuccacccugagagaguuccaaaucaggugaaauaaaggcaagccuuuuguguuaguccuucagagagccacucaccaggucaaaacaauacaauucuuugagagcagagucuacucuguuaucuccagcaccaguaacccacucugggaauuacugccaccgagccaggaagaagggaauggggcaaggguaaauuaaaauauaccaaguucuccuaccagauuucacuugcucuugccuugauuaaacauucuguugauuggugaaaacccuugacuguuuuccagauuuuugauaaaguugauugugacagauuuugccagcuuuuuucuguggagggaugggccuuuggaaucuccuaugccaccauuuuugaugaugucacuccuaugcaugcuauuuuuaagauagggugauuauauuuaaagauuguauauacaagguauuuaagaauuugaauauacaugaaguauauuuggaguauacauggaaccuguuaaugaacauguggaggaagggaaaauugagcuaaaaaaaaaaaaacaaauaagccaggcgcugugguucauggcuguaaucccagcacuuugggaggccaaggcgggcggaucacaaggucaagagaucgaggccauucuggcuaacauggugaaacccugucucuacuaaaaaugcaaaaauuagcugggcaugguggugcaugccuguagucccagcuacucaggaggcugagucaggagaaucacuugaaccugggagguagagguugcaaugagcugagaucgcaccacugcacucgcugcuggcgacagagggagacuccaucucaaaaaaaaagaaaaaaaaaccaaaguaaacaaaaaucuuugcagcuagagcuacauuuaauccguaaauguuuuagauucaguugagacuuucauaccuguuuuuuccuaaggaauuacuuagagcauuuccaacaauuuuaauuaaaagggauuuuaauuaaaugcaguauuuaguuauugcaaaagcagcaaagcugauggaaaauauguaacaaaguuugagaguccuuaggacuagaaccaaauguuacugaauuaacagaagcacacaaaauacagggaucucauuuuuuuuuaagcaaaagugguuuagguauauuugcuauugucaaacuaaauauuaaaaauuauauuuuuguaccacaaugauaagaaauuaugugaagauuuaaaauguuuaaaguauucuaauuauaguuuugaauugccuguuuugagugucagucagauuaacuacagaggucagccacauaucaucucuauaguuucuuguauuaauauuuugccuaauccauccucuauuucucaucaccuuucgacaguaugaucuuugaagucuuuuuaaguuaauguauauauugacuauagucuaaauuaugggaauuuugaagcaggagauauguuuucugguagacuuuaaucucgcacuuuuucauguuauaggggauaauuuugacacuacacuuuuaauaaggacauuucauuuguagaaauaauguacuuccuaauuuucaccaguucaacagucaguacuuugucuugguauguuaucucuauuucaguuuuucuuccucuuauauucaaauaaaucuaaucuauuauuucuuauguaacauuaaguuuuauucaaguuccauccauacuucugaucuucugcuuucuguauagaauggcuucaaauguaaauuuucuuaaguccaagcuuacucauuauaaguaggcacaagucugagaguacuucauuaugucuuugguauaguugggucugagcauauuuaaacauauuaaguacauauuuugaugaauauuauuucucccuuuauuucuauuuauauguguagaaauauuaccuaugaauuuugcuuuagaauaguaaugggaucuuuacaaaauauguucugaaguggggggugguguugggucgggucugauaggguugagaaauuuauucuacacaaauuagugcaaugaugucuuccaggcauuguacuagaacugugcaggacccagugggagccuguagcaaggcaggguccauucaggcaggaggugagguauguguuaaccgagaucauggaaacaugagacuacccaggaaaaguuugagcuaauuuugaagaacuuccuguguuucucucuucuaaacugaauguuccuugaugggcagggaccauuuuuacuuauuauaaguaccuacugcucagcuguauuagucucuucucacacugcuguaaagaaauaucugagacugaguaauuuauaaagaaaagagguuuaauuggcucacaguucugcaggcuguacaggaagcaugaugcuggcaucugcucagcuucuugggaggccucaggaaacuuauagucauggcagaaggcaaaggaagagcuagcaccucacauggauggaacaggaagaagcuguuuugggggugaggugccacacacuuucaaacaaccagaucucaugagaacucacucacuaucauaacacaguaccaagggggaaaucgccccgugauccaaucaccucccaccaggccccaccucuaacauugggauuaugauucgacaugagauuggguggggacacagauccaaaccauaucauaagccuagcccauggaagauacaucauaaauguucguugaacagauagcuccuacacaggugugcaagcuugaagagagaguaagugugggccuggcuagaauccauauugccacaggaggaccaaaggaugaauuauuuauuugccauaccacagagaaaauuuaacaauuguuaugccccugaguacuuuuggggaaucuccucaaaucguaaauaauagaaauuaugauguuauuucaaggcaaggauccuuaggacccuccugugaacuuguauaggaaaaaaaauacauuuuuauuuuuacuagccucaaacugaaauuuagcauuuccuuccauuuugaauguagguaauaguggugauguuaucaguaucacuaacuuucuuucuguuacuuaaagcuacagauauuuucauuuucuguuguuguagauaccucacacuguuguuuacacucauuguuuuuauauuaugguaaucacuaugccaucaauuuuguuauuuaaaucaucaauaaagaagcacauauauuaccuaucacaauuuucuacuuacauuuuaaauuuuauuuuaaaacauucugaaauuuuagaauaagcaaaacuaauguauagugauuaaaaucagauaaaugguugcuucuuauggagaaaauugacugggaaaggggcacaagagaacuuucuagggugaugaaaauguccugugucuugguauacacuugucaauugaaugcugaacuuacugucuauacauuucacuauauauaaauuauaccucaauuuaaaaaacaaguacauuaaaaauuuuucugagaagguguucauagguuucaccaaauugccaaagaaauuucugguacaaaaaaaaaacccuuuucugagauuauccuguugccauugucugucuccuucuuugagugcccucuuucaguaagcuguuuuugugguucauuuccauuuuucuaaauguguucucacuuuuuaaagaugaaccuaagacaagucagaaaagaaaaauagcaguuaugaaagaaauauuuugccuggguuauugaccaaucucuucuagccagugaaaauguggcccuccuaacauaguuauguacuugcuuugacucuaagaaauuucuagugagaacuacucuucuaaaaaguaauucauagaugauuucauaauggaacaauuuuuucucauuuucaguuuuguuuagaguuuuaguaagauuuuuaucuuucuguaucauugaauaugcaaagauuggaagaagaaaauauguauuaggaaguaaggaaagagaaaguaguauuacugauaaucuguuccagauuaauuccaucuaggcaugaucucagugcagugugauuguauauucuaagaucgaauauguguuacuuuuauaaaauucagaguaauauaaaaaguauuuauuuaaaaaugugaugauagugcucaaagauguuaaacauagugguagguaauguauagaaugaacauugaacucucuuuuaggggcacacaguguuaugacuacucguaauagaauuuuguguaccaucuuaugcuuauaacuuuuaguuuuacucuauuauuauaauggucucacucugagaaagauuaagcugaggugaaucguccuagcagauuuuuguccagauagcaucuauaugccuuucagauaguaucuauaugccuuuuaugauuugcuauuagauaaaaaccuaaaauacuguuuggcaauguuuuugcagccccucauauggaaaauuugaaaugcagaggggaaacaguagcaaaggagaucagugaagccaugaagguaaaagcuaugugcuaaaaaaauuaucaaaugaacaaaauguauggcuagguauuugcauucaacauucauauguguuuuagucugcucuaacaggaauucucagcgguccuuuaaauaaaucuuuaaugaauuuauuaagcaacaguaacauuuagaauagcugccauuuaucagguaccuacuaugugccagguaauauaccugucuucuuuaaagguugauuauauuuuuguguucuggguguuagcaguucaccgaacaguuuuggauaauaauaccagcuaaaauguauugaauaauugguaugggcaccauccaacugcuuuacauguauugucucauguaauccuuacauccuaugagacagauacuguuauuucuuuuguagaugaggaagcugaggcacagagaggcuaagcagguugcgcacauaaguaaccuacaauccagcauuuaaagccuggaucagcaagggcacaguggcuuacaccuguaauccaagcacuuugggaggccaaggcagucagaucaccugaggucaggaguucaagaccagccuggccaacauggugaaaguccacgucuacuaaaaauacaaaaauuagccaagugugguggugcgcgccuguagucccaacuacucgggaggcugaggcaggugaauugcuugaacccaggagguggagauugcagugagcugagaucacaccacugcccuccagccugggcaacaaagcaagacuucucaagaaaaaaaaaaaaaauuagaguacugcauccaucuuugucuguuuguguuucaaccugagauuaauguugaauauuacuguuuguuuguuugaaguccuugccugcauuaauugaacaaggagagggauuuucccaaguucucaggaugcagccuguuauccaccuccagaggauucaccaagaagucuuuuccaguugucauaggaaaccagaugcuaaaccugagaacuuuauaacacagauagaaaccacaccaacagagacugcuuccaggaaaaccucugacaugguacugaaaagaaagcaaacuaaagacugcccccagagaaaaugguauccauugcggccaaagaaaauuaaucuugauacaugagcucuuucuguuuauuuugggaguugaaaauaggcaccaucaacauuuagauuacagccuaauuaauaccuagauaagacuucauuugaaauaagaaauaacucuuuuacuagugauucauuuauacagauauaguaucucugugcggggauaugauauaauauuguauuuccuuacuguuuuaucuauuguaaauaaaaagcauuuuaaaaaguauugacacaaagcccaucagugggcauuaaaaauauuaaaagugcagacuuuuacuguccuuaagugccaucaacucucagcucccuuguagcuuuugugggauuuaacaaguaacaaauucuguuguguuucccugguauacaucuuucuaggaaaaaaaaaaaaaagagagagagcuguauaaugauuuuucguuuacaugcugaaaaguaauuaucaguucugcacagcagcagaugcaggguuuuuuuuuaaagauguaguuugauuuaucaaauuaaugugcugaugauaauacuggcuuugacuuuguuacuccauguucagcuaauuuagguuugugagauuaacuuuaggauuuuuuguuguguaagacaaugauaacuauuauuugugcaacauuacucuuugaaauaaaaauuggcauguagccaauguuuccugcccacacucacuuuuuucuauagaccauuaacauaauuugacuuggaacuaaugguuucuuuuuaggguuucuuauuuauuucuuuacaaaucauuccaguucaaaauauauaucagauuaauacacuggcaaagugucauuguguuauugaacuauuucacauuugaagauguuuauauaucagguauauaaucacugggagaagucugagaaaacgauauuggcuuuacuucuaacauuuaacuauaguuucuuauagcucuuauugugugucuuacauuauacaguguaggcagggccaucaaacuuaccaacuguuuccccuuuugaugacucugauaccuucauucauuuuucaaaggaauuuacugaucaugagguuggaaaaucuguauuucucuugcuuauuauguauuaauaaucauaaaugucuagauucaccagaagucaccagaaggucugucucagugaagaaaacuuauaaagccacuuuguugcauuuuguguuucaguguuacaguuugagaucuguauauuuguacacagcuauguguuuuucauugaaauaauguacaaagacugaucuugaugcuguguauuuuuaugaguugucuuaggcauuccugagcucagcuucaguuggauggugggucagcacccugcguuucugaacauacuagacuucaguuuaaaacuguuuugaggcuguauaauauguugcuguuuuuacagugcuaauguuuuuauaguauuaaaauucuguaugauuuguuucacuucagagguccccaaacaaaagaguuauuguuaauucuauuagauuauauaagcuacuugcauuuugauuauauaagaacauggucccucccuuuuaagagagguauauugugcuacauagaguuuuuaaaugacaugauagauuugcucugaaguauucagcagagaaacaaggaaucgauuaaggaaaugugacaaaaauccuguuaauguugaaucuguguaaugacuauauucuacuuuguguuggaaauuuuuauaaguuuuuaaaaaaugguuauauuuuaaaguccccaggcagacagcugagauuugaaauccucuugagagcccaaaguuuuacuccauaguuauagcagaguuuaaaauagaaauaccacugggaaagacaguacguauuagcauuauuaacuaagaaaagcaugaccaauagcaguaauaauauugaauaaguauacuguguaagaggagaaguugcauuucugcauaggccaagaacuaguaagcuaaggauuaaaagcaagaaagucuguaguuuuaaggaauuggaaagguugaaggaaaaaauugaaaaucaaaucuugcucuaugauaaaaagagucuggauugaauagggucuuaaaauuaucuuucagaaaagaaauagccaggcgcggugggcucaugccuguaaucccagcacuuugggaggcugaaguggacagauuacuugagcccagccugggcaacauagugaaacuccauuucuacaaaaaauacaaaaauuagcagggugugauggcacacaccuguagucccagccacccaggaggcugaaaugagaggaucacuugagcccuggaggcagaaguugcagugagccaggauggcaccacuguacuccagccugggugacagagugagacccuguuucaaaauaauaauaagaagaacacaagaagguuaagucuagucccaaagaagagagaacacugucaaagcugguuucugaaaacugguaccaaaaucuacauuuguuuauuuaggcuacuauaacagaauaccacaggcuggguggcuuaaacaacagauacuuacuucucacaguucuggaggcuagaaguccaugagaaggugcuggcaaaugcaguuucuggugagggcugucuucccgacuuguagaugaccaccuccuuacuauguccucacauggccuuuccucagugcaugcauguggagagagggacagagugcaagcucucuggugucucuucuuauaaggacaccaauuguaucagaucagagccccacccuuauggccucauuuaaccuuaauuauuuccuuagaggccccaucuccaaauacagcuauaggcacaugggaguuaaggcuucaucauacagauuuuagggggacacaaacauugaguccauaacacaagcccacagaaaaucuuauccuagaccucuuucccuggcccuuuauggcuugggcuccguagaggacaaagugaauaaaaccaaauuuuuuauugcuucaaacaguaugauuucaucuuguaagauguacuuuuucuuuucuaaggcugaauuuguuugauuucuggugaacaccuaucuucucuauccaccuucauucauuuauucaucuguucaacacauacaguuggacaccuacucggaucaaaagucagagaucuuaagagcacagccucuaagccagaucaucugaguucagauuucaguucuaccauuauuaguucaaugauauuggacaaguuacuuaaccugucuaugaucaaaagucagagaucuuaaagagcauagucucugagccagaucaucuggguucagauugcaguucuaccauuauuaguucagugacauugggcaaguuacauaaccugucuaugcugcaguuuucucaugugcaaaauggggauaauaauuaugccuaccucauagcguuauucugagaaguaaaugaguucauaaugugaaggccuuagacuaauaacuggugcauaugaguacucuaugaucacuguuauuacuucuuuugauaaaggaaaugaaaacacucaggacaaguguugccuucaggaaggucauauuccagugaagaggaugagugugcaaacaaugauaaugccaugcagcaaaugguaugauagauguauguguggaacuuaggggaguagucauggaagucuuuguagaagagguggcauuugagcagucuugaauguuuuaggcaaauaaucagggaaggaauacaggaauaaagaacaaauuacuguuauaacaauguggaucaauaucaaagauacuauauugaauaaaagaagcaaagccaggcacaagagaauacauccuguguauggaaucacagaaugggcaaaacuaagccauggugguucccucuggggagaggggagauauuaacugggaauggcacgggaaacauuuuugggugagcaaaauguucuguaucuugaucugaguggugcucacauggcuguauauguauguaaaauuuuguugaacuauacacuuaaaauuucugcacuuuauuuaaguuuuauauuuuaaaaaugcacaaaacugauucaccaaauauuugaggagcgucuccagcaucaaagacagacccaaaaacuguaagucccuuaauggcaggaaucuuuguuccauccaccuggaauaauugcuggcacaugaugggcccucgaugcauagugguuaacugagugaauuaaaacaaaaaccaaagagaauaaaggaccucaaagaaaacagauacauacaaagcaaaaucccagaaugaugacuguacucccagaaagaagagaaaaucauacauuuuuuggaaaaucggaaugcuauuaaauaauguucaguaaauaagaaaaaguuuuugaaaauuaaaaauaugaaaguugaaauaaaaauucagugggagggcugggagauaaaaugaaauuuucccaaaaauaaaacagaaagauuaagaaauggcaaauuagaaaaguaagaauaaagagaauaaguucauaaaguucaaagucuaaucgauacccauuccagagauagcaugcagaaaaagcagcagagucaaaauuaucaaagagauaaugcaguuaccauauggcccagcaauuuuacuccacguucuaaaccuaagagaauugaaaacaugcucacacaauaacuuacacacaaauguuuguagcagcagguugaacuuucaugaacugaugaauggauaaauaaaauguggacuauccacucaauagaauauuauuuggcaauaagaagaaaugagguacugguaaaugccacaguguagaugaaccuuaaaacaugccaagugaaagaagccucucacaaaagacugcugaauuuuguagacuccauguaaaugaacuguccagaacaggcaaaucuacagaaacaaaaaauagaucugucacugccuaaggcuggaaagauggagaggguggaaggaauaggaagugacugcuaauggguaugggauuuuuuuuuuuuuuuuuuugugaaacaaggucuugcuguguugcccaagcuggaguacaguggugcuaucuuggcuuacugcaaccucugcccccgcaacucaagccauccucccaccuuagccucccaaguaggugggacuauaggcaugcaccaucaugcccagcuaauuuuuguauuuuuuguagagacggaguuucgcuauguggcuggucucaaacucgugagcucaagcgauccgcccaccucugccucccaaagugcuggauuacaggcgugagccacugcgccuggccugggaugucuuuugagggugaugaaaacccucuaaauuugauuauggugauucacgacugcuuguugaauauacugaaaaccauugaacaauacaguuuaaaagggugagugagaugguaaaguauaucucaauuuaaaaagagaauaaagaaauagaaauaacacaagaaacauucccagaccugaggaauaccaagaggaauuggaauggcaucagauuacuaaacaacaauccuaaaaucuagaagcaucuggagaaauauucucagcauaaaugauauacaaccuaggcuuuuauacacagucaaacuaauaaucaagugcaugauuagcuaaaagauaucucagauaugcaaagcgucaaaaaaaauuaccuccaaggcaucccguuuggggguucuaccaggggcugugcucuauuccaaaggguaaaccaaaaaagcagcagccaugggaucugggaaacuaaggcucccaaaacacagcacacucgagucuacaggcuacuaacuaaucagcagauuuggagacuaggcagaccagguuggaauaagacuauguaggccgggugcgguggcucacaccuguaaucccagcaccuugggaggccgagacaggcagaucaccugaggcugggaauuggagaccagccugaccaacaacuaaaaauacaaaauuagcugggcgugguggcgcaugccuguaaucccagcuacucaggaggcugaggcuggagaaucgcuugaacccaggaggcagagguugcagugagccaagaucacgccaucgcacuccagccugggcaacaagaacgaaacuucaucucaaaaaaaaaaaaaggacuauguaggacuccaaaagagauauuuucagaaaaaaauaaaagugacaacacgagugauaauguuaacuaugcagaaaauuguauaaaggagauguuuuguaauaugauuaagauguucaaagaaacaaaaaauaaggcaguuauucacuacaguagaggcagaaagcuguacaaaaaaagaaauguaaucaugguuacaaauuaguucuccagugaacaauauuuauauagccauaauaauaaaaacccugaaucugaauucaguaaaaaaaaaaaaaaaaaauugggacaguuacacugggaggcuaaaggaugggaauuagcaauuaguacagcacaggcacugaacaguuagauggacauugguuaaagcaguaaggugggguguggaggcccuuauagcugcuggguccuggggcaggguagggugucccaggacauggagcuggagcagccagaguggcagggauagugaggaggcuucugugccaaccaguacaauccauauguuuguaacagugugacugucugaacaccagcuuugacauggcaguggggagugaaaucuucacccaccacaacuggaagucaguggaugucuaaaaagcugauucaagaucauacaauauggauauaauuuagugcagcagaauaaagagcugacgaagugggaaguauuaacucuguggaugaacuuaggugggggaacugggccagggacugauaauuuuugauagaagccucauagauuugauuuuuaaaauuaaaugcauauaguaauuaagggaaaauaaauuugguuuaagagacaaaucauccccuagaaccuuucucgggguuucaguuuuucaggguuucagaagcuuucucaggguuucaaaacaggcgugugccaccaugcccggcuaguuuauuuguuuuagagauggggucucgccauauugccccggcuggucuugaauuccugggcucaagccauccuccugccucagcuucccaaagugcugggauuacaggaaugagccacugcaccuggccuaucacaguauauuucagauaagacuuacuauucucuguuuuuggcugauaauucuaguuuugguuucuucagguuuuuuuuuuuuucuccccucugaccauuuguuuugcaaauagauuauauuaugaaagucucugaagaaaaaaauaucucucuagagaaccacugaaggggguucuuggggauuuuauaugaaaggauuugagaaaauuaauguuauauucauuugaagcuucagggguaaagaaucccuuguaauucguugcugugucucuacauugcucauacuuugcccaugggcuguaaacuaauauucguugaaugaaugaguucauauugcaaauuucuaacuugucgguuucccuggaucacaaucucacacauuaauggcuuguggcauuuauauucauuauuaauugaacuuagaaggugaguguggggaggggagagguaaaaaacugaggacagaucacugggaaacugaccugaauuaggacuccagagucuccugucuacuagaacuacgucuacuagaacuaagucuaauucccauaucccugcaggacauaagagcagaggauggcauugacaucccucagugacaucacugugcuagcagguauaguugccuucugaucaccuuuuccuuuggucacauccccugacuucuggguggccugggauagcuagagaagaaaauucaacuucucccugcaggucuucugcuccagcugacuccugugccuguguaaaagauugggcauuucuaucaucaccuugacuagccuuacucagagaauggcuccagugccuuugggcucauaccuaguugcagauuuuaagaccucccuuggugcccauucauguagcucuguggcccacaucuucuacaaugaugucauuggaguucuuuuguccauuucugccccugaugccaccuugaugggaaugccacccuccacacaacucuucaccaguccauaaauaccugagacuuggcgcauuucuuuuuuuuuuuuuuuuuuuuuuuuuuuugagacugucacccaggcuggaguguaguggagcgaucucaacucacugcaaccuccaccucccagguucaagagguucucaugccuuagccucccgaguagcugggauuacaggcgcgugcuaccaugcugggcuaauauuugcauuuuuauagagaugagguuuugccauguuggucaggcuggucucgaacuccugaccucaggugauccacucgcccuggccucccaaagugcugugauuacaggagugagccgccacgcccggcccauuucauucuuaaaaaaaaaaauccuuccggagguuuaguuccuccacaaggcagcuucugguuaccugcccccucaggguccuugcugccugggucaccccagcaaccccuucguccacacaucacugcccuuugcagcaccagcugauuacauugcuuuuuccauguucuagcuguucuuuugagccguuuuauagccgagcaucuccaccagaagagcggauaggaaaaaggaaaagagaggaggauuugaccuugguaucuugcuucauuuccuucucugacaaaaauuuggugaaaagguuaaaauaaguguucgaauucucucugacuugucauauucugucuaugcccugugugccugccucugauccugaggaaguguagaaaugaggggaugacacuggcagaauaauaaaaaugggcaaaguuguagggcaccccugcuccaggucccauacaccccagcuccagagccucaggaucuuucccagccaugugccagacaauauuguaaaaugauuuuucguagccacaccuuuuauuacacacauacucgaugaaucuaaauacugugcuaagagcuguguggauguacaccuguaaaccaaggcacagacccugcccacaagcaauuugccgucaguuaggggagccaucaguagcaucuagggauccauuagagggaaaagagggagcugagggagaggcuaggagcccaagcaaaccugcacuucugcuccuagagggaaccugagagugaaacucauggguuuggaaacuucuguggaauuaccugcuugcaagaaaugauuuugucugguuuuagaaacuacgauggaacacuaauauauuccuguaauugacuggcaaguuuuaacacuuacugcaauuuauuuuucuuguaagcccaacccaaguauucuuccuuuaaaaaaaauuucagauugacaaaugacugcuucuuuagaaauccuccuuacuaaaauuacuccucauuucuuuuucuuucauauucaaagggaacaaacguucaaacacacaaauaaacacugcucuuugccagagugguggacucuggccuccccacccccagcacucccagucuugcccuccugcaaacacuagacuuaauuuucucugcgcugagggcccuccucgagucagagugagaggaaaaacagaagggagaagcugcgagauguggcaacaaaggggacggugaucagguuuaucccugauguugucugugaagguguuccauucuccagagaucucaccaaaugguauaagugaugugcagauaagccugugguucccuucacucaucagaucagagccucagaauucucagaaaccauuuuuuuccuaacauaaaacuccuuuucucauuucuaucccucuguaaaucugauuugaaaaaauuguuugaacaaaccaacaaugucagauuuguuccagcuauaugagcucacaauucaucuacucuugguaguucaagauaaaagauuacccaaagaaaaggaagagauugaguaaagccacaacuguaauagugucccagauuggguaaaaggccauuaauaaauagcgugaauuguagaacuguuuaaagcagcauauuuuuaaaacaggcauauaaagaauccacuuuaugccuggaauuguacaaaaauacuuuaaauaaauguuuacauauauaauguuaucaacuuauuugcugaagguaauaucaauauaaugcuaguaguuaccauguauugagugcuuacuacaugccaugaucaugcuaaaagcuucacaugcaccaucucuuuuaauccucaagacaauccaugaauuaagggcuauuaccacgcccauuucaugagaaagagguggagaugagaagggaagugccuggccaccuucccagcggucuauagaccauguagagcagagcgaggccuucugaccacaaacucugcuuccaccuucuccccgugguucacagcaaaggccuuguccagagucucagacgcucucaccgcuacaccacagcgaccucguugguucuucucauuuuuuuucaaugacacauagcaacagagaguaucaacaaacauuuuuaaauuucccagcaguuaacgaauagugaauauuacuauguaauacuagugucuaagaaagugcucaaaguuguuuaaagcaauuuauuaucuuaaugagguuaaauaugaacuuuugcuguuaauuucuugggaaauauaaaucaucauagcuagucauucuuucaucgugggaagcuaacaguccugauuguucaggauuauaauuauaguaaauucugaauuugugacgugugaauuuuagaagguuacaaaacaacuuccagacaacugagucauaaaguuuuugagagaaguauguggcacacgucuaauucauuguccuuucucuccagugguauaguuaugauauuaaccuaaauugcaaaaggaaucguuuuaguugacugcugcuugaaauugugucacuuuuccaaauuuagguaaugucuguuacaaggaguauauuuuggaaacauuaacuugacugauacuuauuucccugguuaagugaccuuccugccaugugcugagugccaggacuuacugccccucaguaauuuggaaggggauccugggcccugccuggaacaaaggguugugaaacagcucugagucucaaggcaagucuugaaagccauauauaguuuucagaaaaagagaucuucuaaauuccauucacccccauuuaacacauuaggagccaagccugguggacuagcucuaggggcaguuuaggagagaaggggaucggggaaccuucaucccuucugccucuggugaacuggcaagaugaagaggaugaagcugggugacccagagcccgcccucccucucucggcagucaucuccaaggccggaguagacuggacuggagggccucugagaggacacagccaggaagcacacucucccugugcucuucacccaccaugaagagacaggacgggaaaguccgugcugugcugguguccaucagagggagggacaccauccagccccugggaccgggcucggcucuguuguugcacagaagucauuuggagauccccacgugccacauggaggauugugggaggaccccaccgagguggcuggcagccucucauggacaccauggagagugacccaaucacucugcauuugaggacugcagaguggcucagcggucuggacauugaagaggagccaaccucagggguaacacagugccgcugggagcugagaugagccagguggucggugggggacacaagccuagaacaaauucaauaaaccagccacagacguuaucaucagaugugcccagagacaagguggacaggggcauuugcuguggagaccagagggccagagagaguacagggaccuggauagauggcuccagcaccucuucuucucccuacacccauaugccaucuugauaaacagcagggaaaucugaaaaauaccaagucuucccauagggacaguguuaccucccaaaaacuguuugaauaauuggcuugaacuggauuuucugaacugaacuaaugcuauuguuuuguggguuuuuuucuuccuacugaguagaguaguuguuuaugggggacaucugauccuuucauuuucuuccagagagcuaaccaccuguucugacaccauuuauugaauaguaccucuuuucccccacugaugugagaggcugcauuuuucaucuaauaaaaucgaauauauauuuagaucua

SEQ ID NO: 191177 - RNA, 19670 nt, Homo sapiens
gggaggggcgcgcuggggagcuucggcgcaugcgcgcugaggccugccugaccgaccuucagcagggcuguggcuaccauguucucucgcgcgggugucgcugggcugucggccuggaccuugcagccgcaaugguauggcagcuugcgggaagaucggcaggaccgcaagggauggaagagcuugggcacggggcagggaggaggagaugggcgcgggggcagauguggggucgcagggccuagcugggccccuggcccgucggaggcgccggguagcgggggcugcaggaagcggcucugaggucgggcaaggugugcgcagggccgggcuccggcggagcaaggucccgcccgguucccugaggucggagggccaccugggaccucgggacugcggccugaguccaaauugacgucugggcggucuugaguucccucagcuaaucagcacuuccugagcuuccacuuccacugcaagccaggcccccagucucagggccugcaaggugacgggagccugagcaauagcccaggggaagguuaagucgugcuuuuuguccuugacgcccuuugaaacccuguagugcuggacagagugacccuuuaagauucgaucgagucagagagcgcggccgucgagcaccucccguguugcagacgcuuugcugggugcugcaacagcaaaggcgaacauccuagaugccucugagggugguuuuggugcagaagggaccguacagaucugucugagggcggggaagggaaggacaccuagcacuaccuugaaaccacuugcugaaaccguaacccugcaaggucaugaaauugcccccagguccugggggaggaguucggugggcuuuuaaguggcauuuguuaacugacaugcaacuaaagggugccacgagccucgagaauuuuaaacauuaguuccggguagggggaccugggcugggggaagugcauauuagaaggcccgggaaugggcagguaaaaguugguuuguggguggugcuguucaguuuugaagcuugacggaaucuggaagaauuccagacacgcugcuaaggggauucuaggcugugucguagcaauucccugcucuuaacaguguggaggauuucuaaggcgcuacagugcuaaacuagauuuucguauccuaauuuauaugaagggaccauaaagcauuaguugaaauaaauagguuuuucauuaagcaaauaacugauaguaauauacgagauuuucagaaugauaucugaugugaauuagccacauaaaauuuuugguggcuuggccuuggaagucagauuuuuuuuucucuaauauggaaaaagaacauucaugggaauuaaaaggucacuguaguugaauucucaguuguauagauugucccacuuguuaaccacucagcagacauuagcugagugcuuccacuccacccggugguacuuggaaagugcccaaaugugauggugagcaaauagauaaggucucagucaguuuccugggacagugccuggcaugcaguggugcucugcgaacaucagcucuccuggccuuaccuucuugccacgcauuaauguuaucugucaguauuuuuacaaccuuaguuucuaaguugaucuuuaaaaaaguggaaauaguuucugaaacaaagacaauauuuuacaaaaaauuuuagaaauaucuuuuuuuaaagcaccuguaagauaauuugaagcucuuuuagugaaggauuguuuuaaauaagagcucucaguucaagacaacuacuguuaggagcuuaaaucggaaccacaaucagcauauaaagguccuaauccugaccuuaaucccuuuggaauauugguuuuauaaaucaucaaucaacaguguuccacuaugaaagcauauucugucuucuucuuuucauguauuccuucacugcuggugcuuaaugucuuuccuuccucuucugccauuucucuuuccaugaauuauaauugccuuuugaauucagaaauuaaaaccacuccacagaauuaauuuggaaggggaagaaaagaccuuugucuuaacgaaccaugaagaggcauauuuccaugcuucugucuugauuacuggaaguuuuuuaaaguacaauuuguuauuuuaguuuuuguuuucagagaggcuaccaugcuaacauaaaaacauuaggcuuacuuaaauucacagugguuauuuuaauaguuguuaggguaucggcaaaauacucuaacguuuugaaaauuaaaccuuuuuuuuaaagcagcauauaagaaaauggaaauuaaaaauuugagagaaagaaucccggauuuuacugucuucaaauuugggaaaaacauuucuauuucuuagaguucaguagucucuaaaauggaacuguuuuuuaauaacgugucaguagucauaaacuacagauaccgauaaggagauggcauuucaggagagaaaagacaaauugucaucugagaccaugagggcagauauuuacuaauaaauguaaaaaaugugaggcagcagaguguaguacuguaugaagagagagacucuguagccagcccugaagggcugcauucagacggcagggauugaauucugauugccacuuagcagcucugugaccuugggcagguuacucagugucugucccaccaguuccucaucugucaaauauaugcaauaaaagugcacaauucaguggguuagugugaggauuagaguauuugcaaagcauguaggacaaugggggaaaugcugauagggauccaaaugcuguauaucaguagagaaaugaagaguuuuuaaguacaguuucuacaucaaauguaauguaagaagauugcuuggacuugcgaaaagaggaaaagaagaugcagucgggcuaggcgcaguggcucacgucuguaaucccagcauuuugagaggccgaggcgggcggaucacaaggucaggagaucaagaccauacuggccaacauggugaaacccugucuguacuaaaaauacaaaaauuacccagacguggugguacgcaccuguagucccagcuacucgggaggcugaggcaggagaauugcuugaacccgggaggcggagguugcagugagcugagaucgugccacugcauuucagccuggcgacacagugagacuccaucucaaaaacaaaaaaaaaaagaugaugcagucauggguguggguuagguaagugugaaggagucaguuuuugcugguggcagguaauggacuuuuacacgcuuaauaucagaauuagagucacuucauaauuuucguugagaauuagccaauauugcuugcuuuuuaaguuuuuauguaucuuaauauacuccuuaaaaaucucucaaacaauaguuucuuggaagggugucauuccugacucccuccuccacugccuucgucagcuguuauaacagcgcuguggaaucaugguagauagugguaauccacgguccauuugauucucccuccacuguguuucuuagucucccgaggaucucaggacgugcaaugauucagagcuuuaucuccucauuugcaaaacuuuuauauuuaauaaaggaagcuaucccuaaagagaguucaauuagcucaucacuguucuuacucaaauuguaccuaacaauuaaaguaguaacauagacgucuucagaauuaaaugaaagcuaaacaugagagugcuuuaaaacacaugaaauuagggcaaaugcguagcauuaucacaaaagaugcuaccucuucauaccucugacuuggaguacuuaaggaaaccaaaacauucuguguuuguccaaauaugguauucaauucaaauuuauaccauaugguauucucugacuagaaacuugugucaguugaagugucugccuaaaacaauaauauccaagagugacuuguuauaaccaauaaauuuuguguucagggagaaaagucauuacuacaccaaaaaaggaagguugaccaaaaacugguauuacuuuucaagugugauuaugaaaagcuguuguaguagaacagucauggcagguaguuugugcucugaaauaacagagcuugucaggauuugccagcuuuuaucuuuuccuuuaguagauucauucuuaaaaccaaaccuaauauuuuucgugcuguagugggagaaucaccugagcccaggaaguugagacugcaggaagccaugaucacaccacugcacuauagccugggugaggggagugagacccugucuucaaaccgcaaaaaacaaagauccacucuuuuuguuauacaguuccacggauuuggacaaaugcauaaugacauguauccaccauuacaauaucaugccaaagagcuucacugcccuaaaaaucccuccucuacucuccccaaaacccugacaaccacuucucucaacuauugcuagauccucggcuuuucuggcaugucacauagccagaaucauacaguauuugcuuuuuuucagauggccuucucucccuuagcaguaugcacuuaagguuucuccaugccuuuuuauaacuuaauagcuccuuugugguuuuggugaauaauaguccauuguauggauguaucagaguuagauuauccauucauguauugaaggacaucuggguugcuuccaacuuuuggcaucaugaaugaagcugcuuuacaugcucuuguguagguuuuauguggacauaacauuucaucucaguuggguaaguuaagacuagguuuagguuuguaaaaagcuaccagaacaucuucccaaguggcuguguacuauuuuacauucugccagccaucaaugagaguuccuuuugcuccacauccucaucaucauuugcuggucaguuucuuggguuuuauccauucuugcagguguguagugauaucuuacuguuuuaacuugcaguucucuaaugacaugauacugagcaucaucuuaugugcuuuuugccaucugguugguuuuuguuuuuguuuuuugagacagagucuugcucugucauccagguggaaugcaauggcacgaucucugcucaccacaaccuccaccuccuggguucaagcgauucuucugccucagccuccugaguagcugggauuacaggugcccaccagcacgccuggcuaauuuuuuguauuuuuaguagagacgggguuucaccauguuggucaggcuggucucggaacuccugaccucgugauccgccugccucggccucccaaagugcugggauuauaggcgugagccaccgcaccuggcccugccaucuguugaucuucuuuggugaaguuuccagaucuuuugcccauuuuuuuuauuuggguuguuuguucucuuauugcauuuuaagaguuguuuguuuuggauacaaguccuuuaucagagaugaguuuuagaaauauuuucucccagccuguggauugacuuuucauucucuucacaguauuuuucacaggacagaaguucuaaauuucaauaaagcccaacucauuuuuuucugucauggaucaugcuuuugguguuguguuuaaaaacucauugccaaacccaaggcaccuggauugucuccugugguaucuuguagaaguuuuaugguuuggcauuuuauauuuaggccugugauucauuuuaaguuaauuuuuauuaaauuuguaaagucauuguacagauuaauauuuuugcauauuaguguccaguuguuccagugccauuuguuuguugaaaagaauauccuuuuuuccuugaauugcuuuugcuuuuuuauuacuguaacuuuagaggaggucuuaacgucagguagugucaguccugacaauauuguuugacuuuucuaggucuuuggccuuccuauauaaccuugaaaaucaguuuauugauauccacaaaauagauaucaacuaaaaucaaacuugcugagauucuaauggauuuuuaaaauuguaaaacacauggaacaugaaguuuaucauuuuaaccauacaauugugugcgggcauuuuuaacuucauacuccaguaguucagggcugcugcagaggaaugcaacuagcuuuuuauauacacuaaccuuauauccugcaaccuugucauaaaugcuuauugguucuaggaggggcuauuuuuauucuuugggauuuucuacauagauaaucaugucaucuaugaacaaaaacaguuuuauuccuucccuucaaauuucuaugccucuuauuuucuugucuuacugcauuagcuaagacuuccaguaugauacugaagaagagugaugaguggggauuuccuugucuuguucgcaaucuuauggggaaagcuccuagccucucccauuaaaucagagauuuuguguguuguuuuuuuuuuuuuuagcagguugaggaaguucucuauuccuaguuugcugagagacuuuuucaugacuggguguuagauuuuguuggaugcuuuuucugcaccuauugauuguaugauuuuuucuuuaaccuguugacguaauagauuauauuauuugauuuuuuaauauugaaccagcuuugcauaccuggaguaaaucccacguagugaugguguauaauuauuuuuaauacauuguuggauuugauuugcuaauacacuguugaggauuuuugccucuaaccuaugcucaugagagauauuagucacuguccaccaaggucauucaauuagagaaaccuuagaucauucuuacugcuuuccuuucuacuacgaauguacaugugaagaaguuaaaugcuugcaaaucuagucuccuauugcuuugccagcaucuucauccagguucuugaggucucuccugaggcuguggcagccuacauccccaugucuucuguguucaucaaaacuccaaccucauuuuacgcuugucacugccaugugagauacuuugcugaaauacuaaacugauuugugggcuuauaaacauucauuucccuauuaaccuacaaauaagauuuaaaccaauuugcuuuuuuugauauuuaaaaauauuaauuauuuaaaguaacaaacccaacucauguguccaguuuccccuucuccauuucucacucuuuccugaucaugaaugcucuuaaaaugacauucuguucccgagaauccccuccucacaucucuacuuugugcacacauuucaucaugcucaguucuccuguguagcuuugccugcaaacacaggcacuuuguauggauuugaaggcagaaagaucaucuaauauuuuuuagcaugucuucccccauuaggccaggaauucucucauauucaucuuucaccaacauuucauuuaagccuaaucauuuugacuucugcacauuagcauuucaauuuuaaagacuugaaaaaaaauacuaaauguuauguaaauguaauuuuuuaugaaccuuguuuacaagguaacaauaugucagagaccaugucguguuuaccagugccuggaauuuagagcaucuugguaaauguuuauugagcuaaauugaaaaaguuaagaaucaguuuauauaaacuacuuuuacacguguagucauguucgacuauaucauugacucuguuacuggaagagguugcugugaacuaaggaaauuuuuagaguggcuggccuugauucgaaguauaguugggcagcuuaacaaggggaggggcuuuucugucauggaaacaagauaagcaaagauauggaggugggacuagagcaugugugagucaauagagcauguugacuucugggaagguggugguacagacaggccaaauaaaaggaggccuucaauacagggauuugcgccacuacuaagggauuuaaauauaugucuauucauauacauucugaguccuguauuugauagauuguuucuuuaugggguauucuuuaaauaaauauauauuaacugaaaguuuuucuuguauaauggaacuauuuuucaaaaaacugaaacauuuuuaaaacuuuuauccucaggauucaaguucgaaauauggcaacuuugaaagauaguaaguauguuguuugucucaauaugugaauugagaaaaacuaaauuuugacaaauacaaauacuuucaaaaauauacugcuuuagcccauuguguauuugaucaaaacugaccaaauggauuuccauuguauguuugggacauuggacuuguucugaaaagaccaguaagaaaggacaccugagacagcuauguucuguuguuuguagaaugaucaugauauaacuagaaaaaauuauaccaguguugguguagguggguguaugugugggaagggguaaaucauguuauauauaaauaauguuauggaauaugugguuaaggcaacuuucaauaccauuuaauguuuuaaauguauauuauugucuuauguugccauuugcuuguccuaaguaguagcuaguuuugccuuccuuuuauuaguacuauuucuauuuuuuuuuuuuggagauggagccucauucuaucacccaggcuggagugcaguggcgccaucucggcucacugcaagcuccgccucccggguucacgccguucuccugccucagccucccgaguagcugggacuacaggcgcccgccaccacgcucggcuaauuuuuuguauuuuuaguggagacgggguuucaccguguuagccaagauggucuugaucuccugaccucgugauccgcccaccucagccucccaaagugcugggauuacaggcgugagccaccgugcccggcuauuaguacuaguucuaauauuaagacugguuuagcaucgugcuguuuauuguuuaucuaagcgcucauuauucugccuugcacuucagaaaaauaugucaauaaauucacaaggaaguuauacuguaauuccuuugucuuaacacaguacuucuauuuuucagucaccaggagacuaaaguccaucaaaaacauccagaaaauuaccaagucuaugaaaaugguagcggcagcaaaauaugcccgagcugagagagagcugaaaccagcucgaauauauggauugggaucuuuagguaagggaagaguguaauucacaaauuaggaagaacuguuucacacaaggaagacuacugaugacuuacauuuagagcuuacagugaugucaagccuaucugagcacuugccauguacuuauuuuucaucuacauccacuugacacguaaugauaacaacccguguagguaguacagguagggacuguuagaaucccugcuuuccagugagaaaaacugaagcacacagaaguuaaguaacuugccuaagaucacauauaaaaggaugaagagccucuguuuggaccuaugugguuuggugucgagucuguguauuuguuagccauuauacgugaccauguuaacuuuuaaaauauucugaaauguucccaguuguuaaguauaccaucagaagaacuuggaaaccgugcguuagauguaagggcuuaauuucauccuaugaccuuguaguguggcauuuuaggacugcagcgggggcgggugaggggcagugcaguggagagcuggccuuguggucauggauaugacucaugaugguguuuugagaauccgaacgauguugaagcaggaaaagcagcugagaaccuccauuuucaagauacuuaaucaccauucuuaucuuuucaaaagcaugaagacauuuuuccuucagaaauuuauguaauccauccuuaauuagucuucuuaauggaaaagagaugagauaugacaguuuaaaaagaauuuauauuguguuuuuagaugcuuuuauacuuguuugauuaugaauucaucuuggaaauaaaguuguaaagagcuggaaaugggaaagaaguuucuauuuuaacuuguaauuacauucuuucucuuaacuuuuuuaugaucaugcugucuuauccugaguugaggcuaucuaaaagaauuuuuaacuuaaggaagauuuaugcauauuugauaguaaagaagaucaugcagugaacccccuauuuaucuaccaaauccucaguaucucaacugacagcuguccuuuguuuuuuuauguguguguguguguuuuguuguuguuuuuuguuuguuuucuuuuuguguuuuuuuuugagauggagucucauucuguugcccaggcuagagugcaauggugcaaucucagcucacuacaaccucccccucccaggcucaagcgauucuccugccucagccuccccaguagcugggauuaacaggcccccaccaucacaccuggcuaauuuuuguauuuuuuuuuucugagucggagucuagcucugucucccgggauggagugcaguggcauaaucucagcuugcugcaagcucugccucccggguucacgccauucuccugccucagccucccaaguagcuggggcuacaggcgcccgccaccacgccuggcuaauuuuuuuguauuuuuuaguagagacgggguuucaccguggucuugauaucgugaccuugugauccgcccgccuuggccucccaaagugcugggauuacagacgugagccaccgugcccagccaauuuuuauauuuuuaauagagacgggauuucacuacguuggccaggccggucucaaacuccugaccucaggugauccgcccaccucggccucccaaagugcugggauuacaggcgugagccacugugcccggccucagcuuacagcuguccuaagaacaccugcuuacacuaggcaguugccagcuaaauuuaaaugcguauuuuggaaauaaccaacugcuuuguaaauuagagauuuauuguauuuaguguauugcauauaaaaaaauuacugcuuuuguuuguuuuuaagcucuguaugaaaaagcugauaucaaggggccugaagacaagaagaaacaccuccuuauugguguguccucagaucgaggacuguguggugcuauucauuccuccauugcuaaacagaugaaaagcgagguugcuacacuaacagcagcugggaaagaaguuaugcuuguuggaauuggugacaaaaucagaggcauacuuuauagguaauuuaaauauauauuguuuauuuucauaaagauguaagcacgaauaaaucuucucucaaaaguuuugacaaacucucaaaaccuucaucaauaacaagguauauucuucagggccuuuuuugguauauucacaaggggguguuuguuuccuuuuucuuuuuuccaggauauauuggaacauuucuguuuuccuuccccuguuuucuaccuuugcuucuucauccggaucauaaguugaaugccaugugaauaucaaaagcuaucagcauuaagccaaaugaggcaucugaggagcuguuacagccuggaaauguuagcaauaguucauuaggauuagaaggagaggaauaaaggggaaaagaauauaaaacagaccucauuuuuaguucuuaguucuuugcaggugcugaaggaaaggaaugaugauaguguguggaacaacucaggaaaucaccaccacccauaccccaaaagaccugauccauggugacaauguuuucuccugccuguccccugugcucuuucagcagaaaucuuauuaaacuagcuaugugagcucuugcuuuucuuauaggacucauucugaccaguuucugguggcauucaaagaagugggaagaaagccccccacuuuuggagaugcgucagucauugcccuugaauuacuaaauucuggauaugaauuugaugaaggcuccaucaucuuuaauaaauucaggcaagacagauuuagaaaucaaagcuuuuuuauguucaugcuuuuguucauauuuugaaauaacaguuuaaaaauuauuuugagauuuacauuuguuuuugucaauucuaggucugucaucuccuauaagacagaagaaaagcccaucuuuucccuuaauaccguugcaagugcugguaaguaguuuuucuaugauacauauuuuuuggcauauagaauggagagauuuguacacuaaggcagacagugucaagauaucuggugguagcuauagcaaaugauuuggggcuguuucuuuuuuagauggaaucuugcugccucccaggcuggagugcaguggcaccaucucggcucacugcaaguuccgccuccuggguucacaccauucuccugccucagccucccuaguaccugggacuacaggcacccgccaccaagccuggcuaauuuuuuguauuuuuaguagagacgggguuucaccauguuagccaggauggucucaaucuccugaccucgugauccacccgccucggccucccaaagugcugggauuacaggcaugagcccagccuuuuauuuuuuuauuuuuuauuuuuugagacggagucucacugugucacccaggcugaagugcaauggcaugaucucggcucacugcaaccuucgccucccggguucacgccguucuccugccucagccucccaaguagcugggauuacaggugcacgccaccacgccuggcuaauuuuuguauuuuuaguagagacagcauuucaccguguucgccaggcuggucuugaacuccugcccucaagugauccaccugccuuggccuuccaaagugcugggauuacaggcaugagccacugcacccggccgaucuggggcuguuucugagaagugccaucucuugacuuccaugauacuuaauucagucauuguuugauaacuccugcucuauucugucauuaauugaaaagucaguaucuauugagguucaucauuagauuuuuuuguccucaaggauugaagagcguagcuagaaacuggcuuugcaaguuauguuugggaccucuaacuacaauaaaacagaagcucuagaauagagaguugaacaguguucacagcuaauuuacauugacugacucaauucucuuguuuuauuguuggaauaaagucaucauugaucauugaagcauccuggaauaauauucuggaacugauuuuaguuuucuaaggcuuuuuucccuuguauauaccaucuauuuucuaauacuucauuuauuuucaaguauguacuuuacacguuaauguuucugaaauugagauggcucuaccagccaauggaacaucauuuauaauugaguacauuuuuuucucucuuaaugagaaauaaaguagguguuacaaccaguaccauuuaaugaaauauaguauuuugauaauauauaguacugugucaccacuugaccccaaugaaugaauuuugaaauguacuucuaaauuucuacaacauuaaaacuacgauucauaccaauuucuaguucucccacucuuucaugugcuuugaaagguuuucccucucucauuuuccagauugauacauucagauuucuucaguaaucaaaugacuaaguuggaauuacugcacagguugaguaucccuugugugaaugcuuaggaccagaaauguuugggauuucagaauauuuucauauuuauaaugcaguaucuuggggacaggaccugagucuguacacccuauacacauagccugaaggcaauuuuaugcaauauuuuaaagaauuuucugcaugaaacaaaguuucaaaugcaccccaucacacaaggucagguguggaauuuuccacuuguggcaucacgucagugcucaaaauguuucagauuuuggagcacuucagauuuuggacuuugggauuagggaugcucaaccuguauuacacuaaauucguuucaauucauuauuauucuuuuuuacuggaaaaagcauugagugcuugcuggcuuuguaacaggcacaugcuaaugcuguccagagggcuucauaaccacgagauauagugcaguuauuucaaauguugaccuaauuuuucuaaaguuacacauguggaguagaauaucaaaugguuuauuuacacauuauauuuugcuaaaaauaugcuaucaucuguaguguggaaauagaugacauuauuagaacagauucauuuaccuuaucuagcauuaauuucugcucuguaauuauaaaggaguuuuacacugaaaagcuguuuuugaugaauuacuauuccuuccauauaacuugaaagaaacucaucacuuguuuuaacagacagcaugaguaucuaugacgauauugaugcugacgugcugcaaaauuaccaagaauacaaucuggccaacaucaucuacuacucucugaaggaguccaccacuagugagcagagugccaggaugacagccauggacaaugccagcaagaaugcuuguaaguacacaguauggacagugccagcaggagugcuugugagcacacagugaaucucagcugagaggaguccguggccgagaguagcaucaacaacauuaacaugauauuccuguaccuguaagaaaguauaucuugauagguaguugauuugcaaguacugugaaaagguauccuauggaagauguaaaaauaucuucauaacauuauuugagaggccaauuuugguauccaaaaauuucuuacuuuuaaauuaagcaacagaaguuaguuaacaaguuauucuacucuaguuucagauuuuuuauguaguguuuuuguuuuguuuguagcugagaugauugacaaauugacauugacauucaaccguacccgccaagcugucaucacaaaagaguugauugaaauuaucucuggugcugcagcucugugaguaauuguagauugucgccuucagagaauuuuuuuuccucuugcugugucugcuuguuuggaugcuuaaaaguuuuucguuuuuuucuuuugaaguugaaacucauugcugaaacuugcauccuaacucuuaggcuauaaagaugugguaaaaaugggaccucuuugcuuuauuuuuauuguuucagcuggaaacacucgggcuuaguuuucgguuuucuaaaggauuaggaaugggauguggauaauucaguaucauuuaugaaaucuuuuuuuggaauuuaaacaauuguaagccaagcuuucugaguuacagggcuaguuucagauuugguuuuacauaaaucuauaaaccauugcauguugggaagguccaggaauuuuuuaaucauuauguuuuuuaaucauuauguuuucuauaucaguaccaaaagauaguauagccaucccucaguaucugcaguggauugguuccaguacucacucucaccucccccaggauaccaaaaucugaagauccucaagucccugaaauaaaauagcacaguacuacauauaaaaaaugcacauccucucguauacuuuuaaucaucucuaguuauaaugcuauguaaauuguuguuguauugguuuuuguuuuuauuauuuuaucauuauuuuugucuuuuuuccaaauauuuuacaucggcuguugguugaauccauggauacugagggccaacuauauacugcuuuccucaagaaaauuucuuaguuguugaaaaacuuuaauguuuaugaaaaaaagguuaagauaaugggaauuuuauucaaaaaguuauuaaguugaauacccacuaugugcacaguacagugcuagacacaguguuaaggaugugauucucucuuuuaaggcacuuauauucuaauaggauaagaaacauacaaguaauugugauuagauaaaacguguaguaaguucuuuuugacucguuccuucuuaccuccugcuaaucaguuaccaugcucuuuaaguuuuaccuucuaacuaucucuugaaucuucccccuucuuuaugcccacuuaaugcagauccuugucauuucucuccuggguucaaaaagguaauuauuugagugccccuuaagugucaggcccugugcuagacacugaggauacagugguaacaguauuugccuucagagagcucagucuucacaguaaaggcagacacuaaauaagaagucacagcagaacagagguugcuaaacuguggccuggagcuaagaauggguucugcauuuuuaaagggauauaagaaaaaggagagugauagcgugugacccacagagugcagaauacuugcuguguggcccuucaccgaaaaaauuugccuauucuugugacaguguuaugaggaaaauaacaaaauccauucucuguuauacacucauucugcagaaacacucgauguaugugauccuauauuuucuggucaccagcacucuucccaguccagucucuuaccauuaccauuucucacguccuugaaccucagccaccuugaucuacuuccagaucuacagauucgucacucuuucucgcggccagggaguggcaugugcugcagccugaaaagccacuauuucuucccuugcucccuugauucuucaucugacugccuccuguguauccuuccuuacucagcugggggaauccuuucuuccagaaaacacuccuuccuucagucugagugaggcagccuucugcagcauccugucuuccauuuagcuuagcucuuacagccuuguaugaggaauuggcuuuuuauuugucugugugcuccucgaggcuaggaugggaccauaucuuauucacuuuuguguccccauugccugguacauaccuccuucgugaauguugaaugaaugaaugaaaugccauauguauucagaacuggaaguucagaagagggacaaauaacauuuuauuggguguaugaaaauguggguccaugguuuuaagagucagggaaaaguucaucacuauuuaaaguguuccuuaaguguuacuuuucaagggcagaaacugggcagaaugccagagagacacaacuagaacuuuuugagccaacagagaccuuuguguaaguuguuaguuggauccaucagccucgcuauccuaagcauucuucucuuauuuuacuuucuaagcacagcuguguuaggacuaacccauucacagccuggucaccaauguucuaucagcaucacagaauacugucucauggugucuagcuugaugaacuugguuaggauacucucucuguuacucagcuuugucaucuguaacauggggacuaauacaaggacuaaaaccuucuauuagccauuauccuucuugccaucuaccccauguuaaagccaggcugauuuguucuuggaucuuaagugugacaaagccugcgggaaggaaccacauucugaagguuugugggcugugugagauccagagaacccaaggggguuuuuuugcucuugacaaacgaauguuagguaugaccuaugaugauacaacuucugcaaaauugaggaccagccuauuucuucauuagaaaugcaggaaaccuggccgggcgcaggggcugacgccuguaaucucagcacuuugggaggcagaggugggcggaucacaaggucaggagauugagaccauccuggcuaacucggugaaaccccgucucuacuaaaaauacaaaaaauuagcugggcgugguggugggcgccuguagucccagcuacuauggaggcugaggcaggagaauggcaugaaccugggaggcggagcuugcagugagccgagauugcgccacugcacuccagccugggcaaaagagcaagacuccuucucaaaaaaaaaaaaaaaaaaaaaaagaaaugcaggaaaccuauuuaaaaguaacagaaacagcugggugcauuggcucaugcuuguaaucccagcauuuugggagaccgaagcgaguggauugcuugagcccaggaguucaagacaagccugagcaacauagcaagaccccaucucuacaaaaaugaaaaaauuagccaggccugguggcaugugccuguuguccuagcuacucaggaaauugaggcaggaggauugcuugagcccaggaguuuuaggcugcggugagcuaugaucgugccacugcacaaaaccaagaauuuagaaaaaggaauccacauaauuggaaauugaguauuaaguuuuugcuuccuaggaagguagucuaaauccuuauacaaaaacuuagcuaugcagugccaagguuggauugcuugugaauggguuugcaugcucuguaaccuaucaguuauucugaaucaagacuugaauauuuaaacauacuuggaaaagaaaaagaucaaaaaacaaaauaaacauauuuggcuauuuaguaauauaauuaagaacaugaguaaaccauaguauucgagguccaaguauuaguugccagccuaaaaacuaaauauggccaggcgcaguggcucaugccuguaaucccagcacuuugggaggccgaggcggguggaucaccugaggucaggaguuccagaccagccuggccaacauggcaaaaccccgucucuacuaaaaaaguacaaaaauuagcugggcgugguggcgggcaccuguaaucccagcuacucgggaggcugaggcaggagaaugacuugaacccaggaggagguugcagugagcugagaucacgccacugcacuccagccugggcaacagaacaagacuccaucuccaaaaaaaaaaaaaaccucuaaauauauuguguuaauuuauagaaaaauuguaauuuaaauuacauauucauagucuugccuacuugcaugagcauguuuuuauugcuucuaaccuggauugaaaucuaugacuuuuuauaacagucauugagucuguuucaaaggaaucuugugguaaguauuuuugcaugauguacucaagguaucaaguuuaacaauugacuuuuuuucauuggaaagcauaugugauuaacuagcauggauugcuucuugaccugcuuguuuuguguuugucuuuuucuucuaauauaauaaccagggauuaaugaaaaucaaguuccauccucagacaagagguaaaguucacacauucuucccaugucuguucagaaaagaaaccuauucagauauaaguuaagcuaauuuaguaauccuagaauuguccucugagagauuuagauggaugggccacuucacaguagcagccaacucacgggagcaccugggcaacgcuaguggacuuuuuuguagugaguguguugaucauagaaaauguagauauaaggaaauaaacuuugaggauagagaauuaacauuauuuugagauauuauauauagguugugaagaguggugguugucacacuuuauggucucuggaccccuuaaugucugauucauguagcagaagccagcuagauuuucaucugucucuauucauuuuguugugaugucauggaucauguggccucuggaaaacucuacuguauacucgagaaugagaauauaacaggcaaaauaacauuaucaugaaaauaguuuugaccucaugaaccccaugaaagguuccccagaccaaaauuuuagaaucacugguauaggguaacacuuuauuguguaaauucaguucucuguaccccacuuaaauauguauuauuaucucuugacauuauuuucccaaaaaaugcuguuugauuucuuacuuguucuguacuuuguuuuucagguaaagaaggaaaauucagccaguugauuuuguuuuuagcuuacugcugccuuuguccgaagaaacuguuccuccauuauuugaauuacugaagacagcaagauauuuguaaauuaucuuaaaauaaacaacuuaaaauaa

SEQ ID NO: 191178 - RNA, 208986 nt, Homo sapiens
auggucucuagcgaccggcccgugucacuggaggacgaggucucccauaguaugaaggagaugauuggaggcuguugcguuugcucagacgagagaggcugggccgagaacccgcugguuuauugcgacgggcacggcugcagcgucgcggugcaucaagguaaacacccaaccgcccgccggggcgcgccggccugcgcccaacggucaccgccgcccccaccugggccgcaaccgccggcgcccccgccccgugccgcggccgcgggagggacgcggaggguccgcggcggggcgcggggggugugggccgcgcaugugggagaaagugcguguggcccggacugucaugugauuccgcucucacucucucaagugucauucggccgccgccugcgccuggggccggggucugcugacucggcggggcggggcggggcagggcggcggccgcgcccucgagaucugggccggggugggggcgggggcgggggcgggggcggugcgcgcccuucccgggguucccggggccacggggguggguuugggagaguggagcgcccucuucuccccuggccugcagccgccugucugccgcaguguuuggagacuuccuguggcguggagacgggcucgggaacgcggcgccaguguggggaggcugggggucgccuugccucuuuagauggggagggaugcggggcccguugcaccccgagccagaaggcucgggcccugccgccgccgcccgguagcugucugcggaggagauggcggaguccguugcugaccaugcgggaguggcggggcugcugcagcgccugugggguggccgcggcaggccaccaccagccuagguggcugaagagguggcggugccaagucacuuuuggggagccucuuaguuuauuucugguuguuaacaauugaugagguuuuuggauauacaagaaggccgaggacacuaguaagauacuuuucuggccuuugaaguggccgacuuuuccccauuucacgugguaaggaauccaggacaaaacagucuauauucuuuuuugguggcuccaugucccuucgcauuucugaaucuggcauuaagcgaugcauauguuuuuaguagucuguuggaaaggacuaccaccaaaagggagacgaaaauuugaacaucugcuaaagugcauuuuguagagaaacgaaugucacacuuggaaagggagacuuuagaagcaguggugaugauucugagguaguguacuuacucugagaaugcuguuuauucccagacuuuuauuuuuuuacuuuuuauuuuguugagacggagucuugcucugucacccaggcuguagugcaguggugccaucucagcuuacugcaaccucugccuccuggguucaagcgauugauucuccugccucagcuucuugaguagcugggauaacaagcacacccuagcacaccggcuaauuuguauuuuuuaguagagacgggguuucgccauguuggccaggcuggucucaaauuccugaccucaggugauccucuugccucggccucccaaagugcugggauuaccggcgucagccacugcgccuggcccuagacuuuuaaagaagagccaaguugcaugucuugcuuuuuuagggagugaauacaaugcgugucaaaccagauacugauuuuaaggucaucccauguucauuggcauuuugaaggccaaugaauuucuuaugaauuggaauuucuuaugaauuggaugauaaacuaucaaaauuugauaauuucuaugucccaauauagaaaauuuuuauucaaaucuuaaauuuuccuuccuagaaguacaccugaauaaaguuuuugggcaaugaugcuguguuuuggacaccuaugcuguguuuuuugacggauagagcauuuauagugagacacauuuuacaaauucuguuuuuuugagacagggucucacuuuguggcucaggcuggcaugcagggugcuauuacagcucacugcagccuugaccuuccaagccaucuucccacuucagccuucccaguagcugggaccacaggccuggacaaccaugucgggcuaauuuuguauuuuugguagaggugggauuucaccagguugcccagguuggucuugacuuuuuuuuuuuugagacagaguuuugcucuuguugcucaggcuggagugcaauggugccaucucggcucaccgcaaccucugcauccagguucaagugauucuccuaccucagccucccgaguagcugggauugcaggcauggaccaccaugcccugcuaauuuuuguauuuuuuuuaguagagaugggguuucuccauguuggucaggcuggucuugaaccccugaccccagggugaucugccugccuuggccuuccaaacugcugggauuacaggugugagucauugcaccuggccuggucucgaacuuuugagcucaagggaucugcccgccuuagccucauaaagugcugggauuacaggcaugagcugccuugccugguccuacaaauguuuaacuggaaguggaaguuuagcuuuuggaguuuuaaaaaguuauacugaauuuauauucugcugugauuguacaguggguaguacucuguuuugugaauuuauauucuuucuuucuuuauauauuuuuuugaggcggagacucccucugucgcccaggcuggaaugcaguggggcaaucucggcucacugcagccucuaccucccggguucaugugauucuccugccucagccuccugaguagcugggacuacaggcacuaccaccacaccuggcuaauuucuuuuuuucuuuuuugagauggaguuuugcucuucuuguccaggcuggagugcaguggcgugaucucggcucagugaaaccuucgccacccaaguucaagugauucuccugccucagccucccaaguagcugggguuacaggcaccugccaccaugcccagcuaauuuuuaaaaaaauuuuuaguagagaugggguuucaccaucuuggccaggcuggucuggaacuccugaccucaggugauccuccugccucggccugccaaagugcugggauuacaggcaugagccaccgcguccgaccugaauuuauauucuuuaaaugcuuuccaauauuuaagauauuuucauauuucugccuagcaagcucaugcagaagucuacuugguuauuaguguuuuuagaguuuuagaaaauuuucaguuuugagcuaauuauuaacuuuaaaaaccaauuuuaaaacaagacugugauuagauaugugauguauaauuaaaucauuuggagcauucacaucauuauguauuuagaaauaaacauaccuuuuuuuuuuugagauagggucucccucuguugcccaggcuggagcacaguggugugauuauggcucacugcagccuugacuucccaggcucaagucagccuccugaguagcugggacuguaggcacaugccaccgugcccagcuaauuuuuuuuuuuuuuuuuuuuuaaauuugagacggaguuucacucuuauugcccaggcuggagugcaauggugcgaucuuaccucacugcaaccucugccucccagguucaagcgauucuccugccgcagccuccugaguaguaggauuacaggcaugugccaccacgccuggcuaauuuuguauuuuuaguagggacaggguuucuucauguuggucaggcuggucuugaacucccaaccucaggugauccgccugucucagccucccaaagugcugggauuauaggugugagccacugcgccuggccuaauuaaaaaaaauuuuuuuuuuuuguggagauggagucucacuguauugccuagacuguucuggaacuccugggcuccagcagcccucccaacucgaccucccaaaaugcugggauuacaggcaugaaccauugcacccagccuugauuuauuuagaugagguaacacaaaagaguugcauuuaaaauuuuuacuuguuaauuaaguaagcuguauaugugauaaauaggaugugaacuguuuuacuucucuguaaagagguaguuuacuugaauagugacagguggauuaauagggcuuugaaaggguauuugauuuuuccauaguucuucgaaucuuaacauuuuaacacauuucauuuuucaacagcuugcuauggcauuguucaaguacccacuggaccgugguuuugcaggaaaugugaaucucaggagagagcagccagagugguaaggacuauuuaucaaaaacauuaaacuuuagugaguagguuaggaaauuaggaacugcacuccuguugugguuugugggguugucagucauuucuucaaauaucauaauguaagagauaauuuaggccaaauauugacuuggaguauuaaacagauuuuguaaaacugaaaaacaaauggaaucaagugaguauauuuuggauacuuugaaaacaaaaauacauagucauauuugggcuuuguuaacuaguuacagaaucaagaaagcuugaagaaguuugaagguuacacuggcuaaucauaguuaaaauauaauggaaauagaaacauaaggaaguuacauugauaauucucuuagguuuuguguaaugggaaaaaaacccaauaauuuuagugacuaucauauuccuuuuacuacaucuuuggguguauaguuuaacuucgaacacucacugauuucaggcauucagucccuuuggcaaaccaacauaaaaaucuuuuuuuuuuuuuuuuuuuuaacuugggugguuaccuuauuucagaacuuuucuaaaccucuuauaagaaugaaggaggugccgggugcagugguucacaccuguaaucccagcacuuugggaggccgaggcgggaguaucucgaggucaaaagauggagaccacccuggccaacauggugaaaccccgucucuacuacaaauacaaaaauuagcuggguguggcaagcaccuguagucccagcuacuuaggaggcugaagcaggagaauuacuugaacccgggagguagagguugcagugagcugagauggugccauugcacuccagcuugggcaauaagagugaaacucugucucaaaaaaaagaaaaacaaauuacaaacauuagcugggcgugguggcacgcccuauaaucccagcuauuugggaggcugaggcaggagaauggcgugaaccugggaggcggagguugcagugagcugagaucaugccauugcacuccaaccugggugacagagcaagacucucaggaaaggaaaaaaaaaaacaaaaaggagguaggccgggugcagugacucacaccuguaaucccaccacuuugggaagccgaggcaggaggauugcuugaguccaggaguuugaaaccagccuggucaacuuagucucuacaaaagaaaaauuuuaaaaauuaguuggggcugggcacaguggcucaugccuauaauuccagcacuuugguaggcugaggugggcggaucacuuggggucaggaguuugagaccagccuggccgacauggugaaaccuaucucugcuaaaaauacaaaaaauuaacuggauguggcagcgcgugccuauagucuagcuacucugggggcuaagacgggagaaucgcuugaaugagggagccagagguugcagugagccaagauugugccacugcacuccagccugcacuccaaacagagugagacuguuucaaaaaaaaaaaaaaauuaguugggcgugguggcuugcaccuguacucccagcuacucuggaagcugagacaggaggauugcuugaaccugggagguugaggcugcagugaaccaugacuccagccugggugacagagugagagacugucucacaaaaaacacagugagggagguauguuuauccuuuguauccacaagcauuuuucccauuuggauuucugaaaauaucagaaauagauuuuauuuucauuaguuaugcaaaccuaccauuuaaaauaugauaguuccuuuuuaaaaucuuauuauauuuauugauuuauuauuuauuccaagacaucuuguuauagcaaauuccuuucccuugguguugauuauggaauuagacugaagguagagaacaaacauuuuagcuucuuuaccuaggcauauagcaaaagcagaagcuuuuguguuugccugggcaauuuuugagcgguagaaauaaugggcugggugcuguggcucgugcuuguaauccuugcacugugggaggccaaaguggguggaugaccugaggucaggaguuugagaccagccugagcaacauggcgaaaccccaccucuacuaaaaauacaaaaauuagcugggugugguggugugcaccuguaaugccagccacuugggagacugaggcaggagaaucgcuuggaccugggaggcagagguuccagugagcugagguugcgccacugcacuccagccugggcgacagagcgagacucgucucacaaaaaaagaaagaaauaaugguugaguaaccuauaaaaauguguugagucucagaacuauuuguauuuuauuauuuugagacagucuugcucuguuccccaggcuggaguggaguggcgcaaucauugcucacugcagccuugaaguccugagcucaagagauccuccugccgcagcuuccugaguagcugggacuuacaggccuguagcacuuaacacccagcuaauuuuuuaauuuuauuuuugagacagucucgcucugucgcccuggccggagugaaguagcgccaucuccgcucacugcaaccucugccuccuggauucaaacgauucuccugccucagucucccauguaucugggacuacagacaugcgccaccacacccagcuaauuuuuguacuuuuaguagagaugggguuucaccauguuggccaggcuggucucgaucuccugaccucaggugaucugccugcuuuggccucccgaaguacugggauuacaggcgugagcuaccacgcccggccugaauuuuacuagaaaugaggucuugcuuuguugaccagccucgucuggaauuccugagcucaagcaguccuccuaccucagccucccaaaguggugggauuacaggugugagcauccgugcccggccagagcaauuuuuuuauaguuccgaugauauguuuugguugugugugagaaugcacuuuaauagaauuacagcuguuauucuagugugauuuagcaaauggaggauaaaaucaaucauagaaaguuugggacuuggugaaaucuuuauagcguuacucuuugacuuuuuuuucuuuguaucauguuacgguuuguggugaauaggucacuacgcaguggaacguaugguuuauuaguaaacacugacaaugagaugaggcuguuccugggggugucacaguagauugaaggcuggaaaagauaggaaaauaagguggguauucagagagagaagauaaugaauagggagugucagaaugccagcaucauuugccucaaaugccacuuguuacgugcuuccacucuuuuauucucucugaggacauggucaaagugucagugugaauaagguaguuaacuuaaaagguguauuagggcugggcaugguggcucaagccuguaaucccagcacuuugggaggcucagguaggcagaucacaugaggucaggaguucgagaccagccuggcuaacaucuuaaaaccccguuucuucuaaaaauacaaaaaauuagccgggcgugguagugagcgccuguaaucccagcuacucgggagacugaagcaggagauccgcccgaacccgggaggcagagguugcagugagcugagaucgugccauugcacuccaucuugggcaaugagugaaacucugucucaaaaaaauauauauauauuagaugcugcugggagcaguggcuugcgccuauaaucccagugcuuugagaggccgaggugagaggaucacgccugaguuggagaucaggccacaaguuggagaucagccuggacaacauagugagaccuuaucucuacaaaaagaaaaaaaaaauuaaccacauguggugguguacuuguccuagcuacgugggaggccgaggcaggaggauccauugagccugugaguuugagguugcaaugagcuauagucacacuacugcacacuaguccaggugacaaagugaaacccucuuuaagaaaaagaaguuuuugcaggggggcauuuuauuuuaacaucauuuggugggaugugggugacauuaagguuuuuuuuuuguuuuuuuuuugagacgaaauuuugcuguguugcccaggcuggagugcaauggcgcgaucucggcucacugcagcauccgccucccggguucaagugauucuccugccucagccuccggaguagcugagauuacagacaccaugcccggcuaguuuuuuguuuuucuuuuuugagauggaguuucguucuuguugccuaggcuagagugcaauggcacaaucuuggcucaccacaaccuccaccuccuggauucaagcgauuuuccugccucagucuccccaguagcugggguuacagacaugcgucaccaugcccggcuaauuuuuguauuuuuaguagagacagggcuucuccauuuuggccaggcuggucucgaacuccugaccucaggugauccacccgccucagccucccaaagugcuggguuuacaggcgugagccauguugccuggccaaggauuuuuaaagaagaggcaaaagcaaaaccuuuuuaaaauuauauuuaaaaauauauauuauguuuuuuuggagacagaguuuaauucuuguugcccaggcuuggagugcaguggcaucaucuuggcucacugcaaccuccgccucccggguucaagcgauucuccugccucagccuccggaguagcugggauuacaggugugugccaccacgcccagcuaaguuuuguauuuuuaguagagaugggguuucuucauguuggucagacugaucucgaacugcugaccuccggugaucugcccaccuuggccucccaaagugcugggauuaccauugugagccacuaugcccggucuguaguguauaauuaugaaaggcaggguccuuuguaagaaacagauaagcaaagaaagggcauuguauuauaaggacacaggagucaagaacccuaacauggaaauguauuucacccagaaagggaauugaauuagucuuaugaaucuuuuuucuacuuuugucugcaugccugcuuccauucuuuucuuucugccgacuuacugugcuacuuguuccaaaaugaguagcuaacuuuuugaguguuuacuaugugcccacauacugugcuaaauguuuuaugccaguuacuucauuuaagcauccugucacaucuaugagguggauauuauucuuacuuuauggguaaggauacuauaguuuuaagagagauagauguuuuaugacagucugggaugugauuaagcucuuaaccacuguguuaccucuuaaccaccauguugccuccuauggugaaagaugacgauaccucagcuccugauauuuuccaucuccugucucaaaagcgaguaaauucagucccaaucucauguuccuuugagaagacaauaaaacaaaagcccaacuuugguuuggcuuggaugagauaccuagcacuggaccguuuugcuauggugagacaauagggucaaguugcucagacacaggaagaacucucuggacuggggauagcuaacuucucagggaagggggauuaugaccuggcaguacccugacagauaccgaacaguaaagauucagaaaaguaaaggagcauuuucagaaaauuuagguacuauauagaaugaacuugaaagggaagguuagagauggacuuaggaugcuauuacuauaaagaugugggaauacaaaaggaguagaaaagaagggagcauuuugaaguaugaaaugacagaaauggauguuagguaaagggaagggaauaaucaaagaugauucuuagauaucaaggugcucacucauuaauggugauaccauuaauaaauauuagagcaguuguaguagaggaaggagagcaagugaagacuaaagaaagaccuguuuugggcauguugguuuugaugcugcuaaaauuuuuguauuggaggccgggcgcugugucuuaugccuguaaucccaggacuucgggaggccgaggcgggcggaucaccugagaucgggaguuugagaccagccugaccaacauggagaaacuccgucuguacuaaaaauacaaaauuagccgggugugguggcacaugccuguaaucccagcuacuagggaggcugaggcaggagaauugcuugaaccugggagauggagguuguggugagccgagaucgcgcuauugcacuccagccuggacaacaagagugaagcuccaucucagaaaaaaaaaagauuuuuguauuggaaauuuaggauacaguuacagagugaagucagaguugaagcugcauagagggaaaacagggaaccacaugccuuuuuuuuuuuugcuagagaagagaaauguucacauuugggagaguaagagaacugauuaucaaggauugauagugaacugucaggaaaagaaccuaaaaaguacagucgccacagagacaacuagguguucaggaaagaaaaguugauagugacaguacugccaggaacgcugaaggacuaagaaaaguuuuugagacagcuaauacagcuuccugguuuggguagaacccugguuguagggcauggaagauagaggauuugauuguuguguggaaaguauaaggaaagagaaaaauuaaaggagaugagguugaggaaaguuugguuuuuaagggaaguucuuuguagauagacauugauuguuuagaaaaagcaccgugucucccaaaacaaaaaaauuaaacacacuuucucaugacuauuuuuguauguauguauuuagagacagggucucgcuuuuugcccacgcuggaaucaguggugcgauuuuaguugacugcaacaucgaacucuggggcucaaggaauccucucacuucagucuccugaguagcuaggacuauaggugcauaccacuauguccggcuaauuuuaaaauuuuugguaaagauaaggucuuguuauguugcccaggcuggucucgaacaccuggcuuuaagagauccucccguguuguccuccuaaaguguugggauuucaggcgugagccaccaugccuggccuauuuuuuauuuagugagcauuuguucugaauuacugcaggcugcagugacuuauuagaaauuuaucuacuuacauaauuuugaugagauacagaagaauuuuuaaaaauuaaauuuaauuaauuuuuuuugagacagucuugcuccaucgcccaggcuggagugcaguggugugaucucggcucacugcaaccucugccuccuggguuccagugauucuuguguuucagccuccugaauagcugggauuacaggcaugugccacgaugcuuggcuaguuuuuguauuuuuaguagaaacuggguuucacaauguugcucaggcuggucuugaacuccugggcucuaguagucccuccugccuuggccucccaaagugcugagauuacaggugugagugaccguaucuggccagagaggacauuuuagauuguaaauauucuacuuuuuuuuuuuugagauggagucucacucuguggcccaggcuggagugcaguggugugaucuccgcuuacugcaaccuccgccucccagguucaagcgauucuccugccucagccucccgaguagcugagacugcaggcacgccccaccacuccuggcuaauuuguuuuuuuuuuuuuugagacagggucucugucgcccaggcuggagugcaguggcgcagucucagcucacugcagccucugccuccuggguucaagugauucuccucccucagccucccgaguagcugggcuugcaggugcccgccacugugccuggcuaauuuuuuuuuuuuugagauagaguuuugcucuuucccaggcuggaguguaauggugcaaucuuggcucaccacaacuuccgcuucccggguucaagcgauuguccugccucagccucccaaguagcugggauuacaggcaugcgccaccacaccuggcugauuuuguauaguagagacgggguuucuccauguuggucaggcuggucucgaacucccgaccucaggugauccacgugccucagcgucccaaaguccugggauuacaggcgugaacucccaugcccggcccuaauccuggcuaauuuuuguauuuuuaguagaaaugggguuuuaccauguuggccaggcuggucucaaacuccugaccucagguaauccuccugccuuggccucccaaagugcugggauuacaggugugagccaccccgccugaccccuucauucuuuuauuuuuuuuaauucucugcugauuuggaggucauaugcucuauuucuuuuauuuuagugauugcacuuaaaguuuuaacaugcauacuuaauguuuuucugagucuuaauaucuguacuccguuugaacaaaacaaagguccuugggacgccuugauuccuuugguucuuuuucccucgcacaaucuauguuauuguugucuuuauuacucugcuguuuucuuuuuuuuuuuuuuuuaagauagggucucacuguguugcccaggcuggucuggaacucuugggcucaugugauccucucaccuuagccuucuaaguagcuggaauuacuccaucuguuuuuuucuuuuuuuuuuuuggugauagagucucacugucacccaggcuggagugcaguagugugaucucggcucacugcaaccuccgccuuucauguucaagugauucucauggguucagcgauucucaugccucagccucuugaguagcugggacuacaggcacaugccaccuuguccggcuaauuuuuguauuuuuaauagagaugggguuucaccauguuggccaggcuguucuugaacuccugaccucagguaauguuccugcuuuggccucccaaagugcugguauuacaggcgugagccacugugcgucuuauuuugaaucuucuaaauaaucguguguuuuaaaaaaauaguuauuuauaauuaggcuuaauauuacucauguuuuuguucaaucuagccuuuuauuuuccuuguuuguggguucauuuuuuuuacuuugaagguuuugguauuuuuuucucagggucugaggcuaguaaguaauaaguaagaaaguuauauuagucuuuuugugucuacgaauuucauuauuuugcucucuuggaagcuaguuugaauccuuugauaauagcuauuuuccuguaacuaaagauuuuauucuaguuugucuucuggugucuguugguugauaaacaaucuuuugaguuuguuuauccuguuugagacuuggucugcuuuuucauucugaggacucaguguccuuccauuuuuuauuuucuacucugucucuucaaauacuguaaccuucucauuaacuuuucuuuuccuagaacuguuagguauauguuugggauuuucauucuguuuuucaugucuuuuaauuugucuuucauauuuucuaucuuaucuuuuuuuuuuuuuuugagacggagccucuguugcccaggcuggagugcaguguugcgaucucggcucacugcaagcuccgccucccggguucacgccauucuccugccucagccuccuaaguagcugggaauacaggugcccgccgcuacgcccggcuaauuuuguguauuuuuagcagagacgggguuuuuccaugugagccgagauggucuugaucuccugacuucaugauccacucaccuuugccucccaaaaugcugggaucacaggugugagccacugugcccggccuuucugucuuaucuuugcauuacugauaauaucuuuaacucugucuucagauuuaugcuuauuuuuaauucagugaauuaauuuuuuucugaguaaauuucuagaauuuuugugugauuuuauuuuucaauuugucucuuuuuucaggguaucuugcuuuauuguuugaagaauuauauucguuuuuuuauuugaacauuuaaaacauacuuauuguaaagauucucagauuuuggaauucuuuguuaacucuggugauagaugucuuuauauauuguguaauuuuugacugcaggcuaaucuucagguggaguugucuuuccugggauuccuguuccucuaccaugaguugugaagaugucacugugggguuuuugccuuugcucucugucuuuuaagaauuguguuuggccgaccagauuauaaugguuucuacaagucaggagcuuauuccuuuuuuuuuuuuuuuuuuuagacuugagucuugcucugucacccuggcuggagugcaguggcgcagucucggcucacugcaaccugcaccucccggauucaagcaguucuccugccucagccuccccaguagcugggauuauaggcaugugccaccacuccuggcgaauuuuuuguauuuuuaguagagaugggguuucacuguguuucgaucuccugaccucgucauccgcccgccuuggccucccaaagugcuaggauuacaggcgugagccacugcacccguccaguuauucuuuuacuuaaaagcaaaaggcauuuugaagcuucgaugacagcucucuuaagucacuagggaguaugcuuuuucuaucuuccuucuguaucagccuuagcacauaguuuucauguucaggguuaucccauagucaaagcauggcagcuggaacugcagucauugugacuacaaaagaagucccaggcagaaagaaggggagaggguaagcuucaagugugguccucuaacugaguuguacucuuuuuuuuuuuuuuuuuuuugagagagugucuugcucuguugcccaggcuggaaugcaguggccgcgauccucuacuucccggguucuccugccuuagcuucccgaguagcugggauuacaggugugugccacuaugccuggcuaauuuuuguauuuuuuguagaaaugggguuucgccaugucggccaggcuggucucaaacuccugaccucaggugaucugcccgccuuggccucccaaagugcugggauuacaggcgugagccaucgcgccuagcucugaguuguacucuuaaacuaauuguccuugaggcuccacucaacaacuuaggcuuaauuuuacuggcucuuaauuguuacugagccugcaaaauguggucauaaaguugggcccauugauaaacugguuaaagugagaguucuguuaguagggaagaaggagaaaauagacuuggauugguagcugcagagucuguuacaguuugccuaaugggguucauugcuccaggccagucucuaaguuuguuucuuggcuuggauuucuacauccuuuagauaauagauuuugggccccauaccuucccucaguauccccuuggauuucuagagugagucaucuacucacaucuggagcaagcaucuaauuucugugcagcuucccuagucuuaguaguccagcacaugguuuucuagagucucuuccuguuaugacauggauccuuaucagcucuuguccuuauauagggaacccaguuagagcuuuucuccauaucuuuagucuauguugcugucauagucaguccuacccucuaagguauuguuucugauagcuucguuaacugccccagcuucaauuuaauacugauuccuuuagcuuuuuguuuguuuuugagacagggucuugcccuguuacccaggcuagagugcagugaugcaaucucagcucacuucaaccuccgccuccuggguuggagcgauucaccuuccuuagccuuaugaguagcugggacuacggaugggugccaccaagcccagcuaauuuuuguauuuuuaguagagacggggguuucacauguugcccaggcuggucucaaacuucugacuucaagugauuugccugacucagccuaccaaagugcugggauuacagacgugagcuauggcguccggccuuauuuagcuuuaaaguucuuuuuuauuucugccaccuggagaguuaccuuuauucacauaauuaaaaauuguuuucagauuucuuuuaucuuuaauuuuuuuuuuuuuuuugaaauggagucuugcucugucacccagugcagugguacgaucuuagcucacugcaaccucugccucccagguucaaguguucaggugauucuccugccuuagccuccugaguagcugggauuacaggcacgcgccaccacgcccggcugauuuuuguguuuuuaguagagacgggguuucaccacguuggucagguuggucucgagcuccugaccucaugauccgccugccucggccucccaaagugcugggauuauaggcgugagccaccgugcccggccaacuuaucuuugauuucuaagugcaagaagccaggcugagugccaaaaaguacucggauuguaccuuuuuuuuuuuuuuuuuuuuuuuuuuuacauaacacaaauaacuuuuuuauuucuguacaggcuuuuuagccuguacacuuuaaauagaaugucuuuaaaguugaacauuuacuaacuuuuuuuuuguuacugcugacucauaaucuaguauuucauuuuaaauucagcauaauaucguaaguuccuauagcuuucaaagaggugguuuucaaaaauuaacacauuuggugcuuaccaucauagaccgauaacauagccaguuuuacuugcuuguuucuugaauuccuuuuccuuuuaaugugagaaaaggcuagcauaagggcaggaaugaagcaggugcuuaauacuuguuuguauucuuuucuaaccucccuacaaaacuaguaagagaauugaaaacauagauguacuuugauaaauugccuagcauaugguaucuguuuauucuguuuuuguguuuagacuuuuuuuuuuuuuuaaauuaagucuaauaguuucugucucucucucuuuuuuuuuuuuuaggcagagucucgcucuguugcccaggcuaaagugcaguggugugaucucagcccacugcaaccucugcuccccggguucaagcgauucuccugccucagccucccaaguaggugggauuacaggcacacaccaccaugccugggcaauuuuuguauuuuuagagacggaguuucaccauguuggccaggcuggucucgagcuucugaccucaggucauccucccaccucaaccucucagguagcuggaacuauagguacacaccgccaugccuguguaauuucuacauuuuuuguacggauggggucucacuauguugcuaggcuggucucgaucuccuggguucaagggauccuccagccuuggccucccaaaguacugggacuacaggcgugagcuacccugccugguuuuugcuaauuuccaagacaaaaauauacagcaguguuauuacuuuuugguguuaauuuuuauuuuuuuccucugugauuaauauuuguucuguauuucagcuuuccuuguguuuuuuuucuucuaagacuauaagacuaaaucuuuguauaucuucuuauugcuuuuuuuuuuuuuuuuuuugagauggaguuuugcuuuugucacccaggccagaguauagugacagugaucucagcucacugcaaccuucaccuccuggguucaagcgauucuccugccucagccuccugaguagcaaggauuacaggcgccugccaccacgccuggcuaguuuuuguauuuuuaauagagacggggcuuuaccguguuggccaggcuggucucgaucuccugaccucaggugauccacccgccucggccucccaaagugcuaggauuacaggcgugagccaccaugcccggccucucucauugcuuucuuaaauaaucugcaugguuaucguauuaggucguuuauagauucacuuuuccuuuccuuccuuuuaucuucuuuucuguuuauuuucuucuuccucuucuuuccgucuccucuuucuccucucuuugauuuuauucuucucuguuccuccuugcgccuuccuccucccucuuucuucucuccccuuuuacuuucccuugucuuuccucccccuuccuuuccuuuuuaaaccagggaccuucuucuggguaccaucugcuugcucccaucuggucuguuugcuccuuaggcuugcuggagcauccuaaggaacaucccuucaccauuaucuuggaguuuucuucuugcuuauauuggauucccuguuuuucuaucccccuacuccccuguuucuuuauauuuaagaaggcacaucuucuggcagcuucauaggaaaaggcgcaugagaaauaaauuaggguuuugcaugguugauaaaaugggauugcuaucuuacuugauuguuugacagaauacauagaauucuugguuggaaaucauuuuccgucagaauuugaagauauuucucuacugccuuuuagcuuucaguguuacuguuagcaaguccaaagcaguucuaauuuuuuuuuuuuuuuuuugagaaggagucucacucugucaccugggcuggagugcaguggugugaucucugcucacuacaaccucugcaucccggguucaagagauuuuccuuccucagccucccgaguagcugagacuacaggcgugugccacuaugcccagcucaguuuuguauuuuuaguagagauggggguuucgccauauuggccaggcuggucucaaacuccuggccucaagugaucuaccugccucagccuccuaaagaguugggauacagacaugagucaccacacccagcugcaauucugauuucuuuuccuuuuccuuuucuuuuuuuuuuuuucagacagggccucucugucgcccaggcugaagugcagugacgugaucuuggcucacugcaaacucugccucccggguucaaguaauucucuugccucagccucccgaguagcugagauuauaggcaugcgccaccaugccuggcuaauuuuuguauuuuuaguagagaugagguuucaccauguuggccaggcugguuucgaacuccugaacacaggugaucugcccgucucagccucccaaaauguugggauuacaggcaugagccgcugcacccagccgauucugauuucuuuuuaaucguuuguaugugguaguucuuucuggauuuaguauuuucucuuuaaccugguuauucugauacucacgauggugugcuugcuuauacucauuguacuagguacacagugguccuuuugauuuguuagcuccuguuuuggaaugugaguuuaggucagggagaaaguuuuugaauuauuucuuugauaauuuccucaguucugcuuuguuugccuuuucuguauuuaaaaaaaauuuuggauguuagacuuucuaaucugauccuauaauuuuuguauuuucuguuucaguucuuuaacucuuuuuacucuauuuucugaggugauuccucacuuucucuuccaacucuucacuuaaaaauuuuuuuguuuguuugagacagcaucuugauauuguagcccacgcugaccuugaaagugauucucucagccuuccauagaguugggauuaugggcgugccacuacuccuggcccuccuucacuuaaauuuuuuuuuuuuuuuuugagauggagucuugcucugaccccaggcuagagugcagugaugugagcucagcucacugcaaccuccgccuuccggguucaagugauuccccugccucagccuaccagguagcugggauuacagacacgcaccaccacgcccggcuaauuuuuuuuuuuuuuguauuuugguagagaugagguuucaccauguuggccaagauggucucgaucuccugaccucgugaucugcccgccucggccucccaaagugcugggacuacaggcucugagccaccgggcccggccccuucacuuuaauuuuucaagaugguuauacuaauuucuuccuuuguuuguuuuucuuucuuucuuucuuuuuuuuuuuuagacagaguuuugccguguuucccaggcuggagugcauuggugcgaucuuggcucacugcaaccccuaccacccggguucaagcaauucucaggccucagccucccgaguaccugggaugacaggcgcacgccaccaugcccagcuaauuuucuauuuuagguagagacgggguuucaccauguuggucaggcuggucucgaacuccugaccucaggugauccacccgccuuggccucccgaagugcugggauuacaggcgugagccacugugcccggccauacuuuuuaauuucuaaggacucuuuaugcucucagcugcuccuuauuuuuguaaucuucuguucaaguuucuuggauacaauuuauuuuaauuuaaauuuaauuuaauuuuauuuuuuugagacagagucuugccugucacccaggcugcggugcaguggugugaucuuggcucacugcaguccccaccuccuggauucaagcaauucucccuucucagccuccucaguagcugggauuacaggcgccugccaccacgccuggcuaauuuuuguauuuuuaguagagacuggguuuugccauguuggccaugcuggucucagacuccugaccucaggugauccacccuccuccaccucccaaagugcugggauuacaggcgugagucacaaugccuggcugauacuuuaauuggagguuuuuguuuuguuucaguuacgaaacuuucuucugcuccuugaacucuucuuuuguacuguuuuggccugucuuucguguuagugacuuuauguaaaaaucuggugauucucagccuugauucaaauguaagacaauuuuuuuuuuuuuuuuuuugagagggaguuucacucuuguugcccaggcuggugugaucuugggucgccacaaccucugccucccggguucaagugguucuucugccucagccuccugaguagcuggguuuauaggcaugcaccacgaugcccagcuaauuuuguauuuuuaguaggaacaggguuucuucauguuggucaggcuggucucgaacucccgaccucaggugauccaccugccuccgucuccaaaagugcugggauuacagcacuuuuucaaguggugugagccacugugcacggcccuuuuuuuuuuuggacacggagucucgcucuguugccuaggccagagugcaauggugcgaucucggcucacugcaaccuucgccucccggguucaggcaauucuccugccuccgccuccugaguagcugggacuacaggcaugcgccaccacaccuggcuaauuuuuguauuuuuaguagagacgggguuucgccauguuggccaggcuggucucagggugguccgcccuccucggccucccaaagugcugggauuacaggugugagccaccgugcccagccucaaauuuaagacaaauucuuaaugaguggauuggaaguuuugugugagcagacauuauugagugauagacuucaucauaagugaucuagcgggguucuuagcuuaguaagagagaaauauaucugaucaugaucaccuguuugggguugacaaaccugguuaccaauauuccuuuagccagauggauguuggaauuugaggauuuagaauuacacuuuuaugauucuuguuuuucuucagcugcuccuggugucucugaguguagauuucuuccauuuacccucucuaggaaauuaagcuuugcaguuuucuagggcaggugagagccaguuacgcguuaguauguagugaauaagggauuguuuugauugcuuuucagaugguaugcaauuccuguugguuagccucaucugaaaacgucacuccuggauacauagaacaucacugcgcaugugcaucuccccacccccgaugccuggugucuaacguuccuccaguuucuggugcucugaugcauugcuuuugggcuugucuuacuacagcagcuuucuucgguccucagucauuuaccacuugucauauguccuuucuaguuuccagggauauucuuuuuuauauuuauggcuuuaugccauuuaucucaguugucauuuggcguuucaagaaggagaggugguaguguuuaaguggaauuaacuacuuguguuucugauguggucuuuuauauuucuuacaggguuuuguuuuaccaaguacuagucuucagucuauccuguuuacuugauuuuuucccacucaacucacaaacauuuuugaaucaucucaugaauucugcuuuccauuuacauuuuugcccuuuugucuuuuccucuucgcuguuaaacuuccugaaaaaauaaaacuaguugauucacuucuucaaaugccuacuguguuguuauuuuuccccuugugcuuaaugauugaguuauaacucaguuauuauaaguaauaguuuaugaaaucuguauuugauauaacacuuucaucauggacacuguccauuuuguucuucagugacucuuaacauaaaagauccacguacaagaaguucuuuuaauaauaaagcaucaggaaaauuaucucccuugcguaucugguauauuuccuccuuuuugauagaucugugaaauacauucuguuugucuuuuuguccugguuaccaggcagccuagaaccaaaucuggucuuuaguuacaucagcuauauuaauaucauuauuaguauauuuguucccucuuucuccuuccgugggguuuaggacuucaccucuuaucucuguuucucugcguguugauuucauucucucauacuacagacucuacuucaugaggcuggaaccaugacugcuggcagcucuuguuuccagccccuuuuaccagaagaaggggcucucuagaagaauccuggaaaggacucugauuggccugucuuggaucaugugcccaucaucucuguggcuggaguggggaggguacugugaauggcaacccucacuagaacuacauaguuggagucagggguaagagcaguuuccauaaugcaggggggugggugcuguuugcaaaacaagggggaugcuuaugaagcagaaaaacaauagaugucuaucauacuggcuuuuauuauuuuucuuuuuuuuuuucuuuuuuuuuuuuuuuuuuggagacagagucucgcucuuuugcccaggcuggaguacaguggugcgaucugggcucacugcaaccccugccucccggguucaagcaauucucuggccucagccucccaaguagcugggauuacaggugccugccaccacguccagcuaauuuuuuguauuuuuaguagagaugggguuuugccauguuggccaggcucgucucgaacuacugaccuccggugauccacccaccucgaccucccaaagugcugggacuacaggcgugagccacugugcuuggccuuauuuuucuuuuuuuaauuguuauaauacuuguccuuuauuguagacugccucaaauccuuuucuaaaaauuuuagguuuaaguauauuaaauauccuaaaauaacauaaacuccuauucauucacucuuuaagggugcagugagcuaugaucaugauccugccacucuacuccagccugggugacagaggagacccuaucucuaagaaaaaagaaaaaaaucaaaauaugaucaugggcuuuggagucagaugaacuaaauauaugacugagcaaguuucuucuucuuuuuuuuuuuuaauuuuuaauuaaagaauagaggugggguuuugcuauguugcccaggcuggucuugaacuccuggccucacgcaguccucccuccuuggccucccaaggugcugggauuacaggcaugagucauugugcccaaccucuuuucaaaaaauuuuuauuuuuuuaaauuuuaaguagagacaucuauuuguuuugacacuauuccucucaguuccacaguggcacuaugucauaaaucagcuguuaauauuuguaugcauuucuuucugaacuuuguguucuuuuuaugugccuuugugcgagaaccacaguuuuaaaauuacuauagcuucauauuaauaauaacucuggauacaagauaccagaaagaauuaguccuucuauauuguguuccuuuuuuguuguuguuuuaaguaucuugccacuucuuagcucuuugcauuugauaaauauuuugaaccauaauguuccacaaaaauguugcuaguguuuuguuugaguuugcauugauuguguauaucaguuuggggagaauggacuucuucuuucuuuuugagacagaaucuugcugugucgcccaggcuggagugcagugguacaaucuuggcucacugcagccuccgacuccuggauucaagugauucuccugccucagccucccaggaagcugggacuacaggcauccgccaccacgccugacuaauuuuuguauuuguaguagagaagggguuucacuauguuggccaggcuggucucgaacuccugaccuugugauccgccuuggccucacaaagugcugggauuacaggcaugagccacugcgcuuggcaagaauggacaucuuuauauauaguuuugaauuuuugaauccaugaacaugguaaucugauuauucagauuuuccauauucauugugguaaaauacacauaauacaaaauauaccauuuuaaccauuuuuauguauacaguuuaguggcauuaaguacauucacaguguuuauaaccgucagcaguauauauuuccagaacuaauuccaaagagaaauucuguaccuuguaagcauaacucucauuucgcccucucuauagccccugguaacuucuguuuucuuucaaguugccuaguuuagcuacucauguaaguggaaucuuauauuuguucuuuuguacguagcuuauuucacuuugaauguuuucaagguucgucuauguuguagcauguaccagaauuugaaucuuguuuauagcugaauacuacauaauccauuguuauguauauaccguguuuuguuuauccauucaucuguugauggaaacuuggguuguuucuaccuuuuugcuauugugaauaaugcugagcugaacacugguauucuagcaucuguuugaaucuuuuuuuuuugggucggguggguguacauuaggaaugaaguugcuggaucacaugguaauuccguuuggcuuuuuuuuuccugagacggaguuucacucuuguugcccacgcuggagugcaauggugugaucuuggcucacugcauccuccgccuuccggguucaagugauucuccugccucagucuccugaguagcugggauuacaggcgugcgccaccacacccggcuaauuuuguauuuuuaguagagacaggguuucuccauguuggucaggcuggucucgaacucucuaccucaggugaucugcccgggcugggccucccaaagugcugggauuugagccaccacgccuggccuguuuggccuuuugaggaacugccaaaauguuuuucacagagacuucagcuuuuuguauuccuaccaacaaugcaugaagguucagucuuuuuccacucaagucuuuuucaguuuucuucaauucuucuuauuuucuguuguucuuacuguuuuugagacagggucuaguucugucauucagcauugaagugcaguggcuuaaacauggcucacuggagcgucaaccuccugggaucaggcaguugucucaccuagacuccuguguagcugggaucacaggcacguacuaccaccaccaccaccaccaccaccuaauuuuauugauuuuuguagagagguagcuucacuauguuguccaggcugguuuugaacuucuggacucaagcaauucuccugccugagccuccccaaaguauuaggauuacaagugugagccaugacaucuggucuauuuucugguuuuugaugauagccuugcuaaugauguaaagugguaucuugucguuuugauuugcauuuucccagucauuagugauacaagcaucuuuucaucugcuucuuggccauuuguguguauucuuuggagaauuuucuguucagguccuuugcucuuuuugugugacuuuuuguuguugaaaugucaguauucuuuaucuacuucuagauccuagacccaguaucuaauuuuagauuccagaccguucuuagauacaugauuugugaauauuuuaucccauucuguguguugucuuuucgcucuguugagagucauguccuuuuaugcacagagauuuuaauuguggugaaguccaauuuaucuuuuuuuaguuuuuguuuuuugugcuuuugguaucauauccaagaaaugauugucaaauuuagugcagugaagauuuuccccuguguuuucuucuaaauguuucuauaguuguugcucuuuuauuuauuuauauauuuauuuauuugagacggagccuugcucuguugcccaggcuggagugcaguggugagaucuuggcucuguucugccuccugggugcaaguucugccuccuggguucaagcgauucuucugccucacccuuccgaguagcugggacuacaggcacaugccaccacacccggcuaauuuuuguauuuuuaguagagacaggguuuuaccauguuagccaggauggucucaaccuccugaccucgugauccgcccaccucggccucccgaagugcugggauuacaggcgugagccacugcacccggcccagugguagcucuuaaguuuagguguuugauccauuuugagccaauuuuugugugcaguguaagauaaguguccaccuacauucuuuugcauguagauaauccaguuuucccagcauuauuuguugaaaagacucucuuucccacugaaugauacuggcacuuuuguugaaaaucacuucaccauauaagcgagaguuuauuucugaacucucuauucucuuucagugcucuguuuuuaugccaguacaacaguuuuuuuuuuugagguggaguuucacucuuguugcccaggcuggaguguaguggcccaaucuuggcucacugcaaccucugccuccuggguucaagcaauucuccugccucagccucccgaauagcugggauuacaggcaugccccaccacgcucagcuaaucuuuguauuuuuaguagagacgggguuucuccauguuggucagacuggucucaaacucccaaucuugguugaucugcccgccucggccuuccaaagugcugggauuacaggcgugagccacugugcuuggcaacacuguuuugauuacuguagcuuuguaguaaguuuugaaaucaggaagugugaugucuucaaauuuauucuuccuuuucaagauuguuuuggcuauuugaggucccuugagauucuacaugaguuuuagaacguauuuuuuuuuuauuucugccaaaaacauucuugggauuuugauagagauuuuauugaauguguagauugcuuuuuuuuauuuuuguuuuuuuauuuauuuauuuauuuuuuuuugagacggcgucucacucuuguugcccaggcuggagugcaguggcacaaucucagcucacugcaaccucugccuccuggguucaagcaauucucaugucucagccucccaagcagcugagauuacaggugcccgccaucacgcccggcuaauuuuuguauuuuuaguagagacaggguuuuaccauguuggcgaggcugguuucaaacuccugaccucaagugacccaccugccucagccucccaaagugcugggauuacaggugugagccaccacaccuggcguggagauugcuuuggaguaguaaaaucuuagcaacauuaagguauuacaauccaagaacgugaaaugucuuuccauuuauuuauauugucuucaguuuauuucaguaaaguuuugugauuuuucuguguacgaaucuugcguuuucuucauugcugacuuacauauacuuuguuuuuuuuguuuuuuuuuuuuuuuuuuuugagacaguuucacucuuguugcccaggcuggagugcaauggcacgaucuuggcucaccacagccuccgccuccuggguucaaggaauucuccugucucagccuucugaguagcugggauuacaggcaugugccaccacaccuggcuaauuuuguauuuuuaguagagacaggguuucuccauguuggucaggcuggucuugaacucccaaccucagguuccuggugcuuccuauugcaccaucuucccagaauccucucccuuccugcugugcuuuuauagccacaccugcuuuccuccugccgccagacuuagucauaaccacuaagguauucuucauuuugguaauuuuguuaccucaaggauguuauauaaaugggaugauagaacuuguaauuuucuggaggcccggcgcguggcucaggccuauaaucccagcacuuugggaggcugaggcgggugggucacuugaggucaggaguuugaaaccagccuagacaacauggugaaaccugucucuacuaaaaauacaaaaauuagccaggugugauggcgggcaccuguaaucucagcugcuugggaggcugagacaugagaauugcuugaaaccaggaggcagagguugcagugagcugagauugugccgcuguacuccacccugggcgacagagugagacucugucuaaaaacagaacaaaacaacauguaacuuucugggauugaguuuuuuacacuugguuuaauuccuuggagauuccuccagguuguugcuuaguauuuguuacaguuaaacugcguuuuguuuaauuacuuauuugcugaaagauaaucucaguuauuuccacuuguagguuauuaagaauaaaacuguuauaaacauuacauggguuuucaugugagcauaagucuucauuuaguaauuuugauaggcggguagugauaucucacuguguguauuauuauuauuauuauuauuauuauuauuauuauuuugagacagagucuugcuuugucgcccaggcuggagugugguggcgcgaucuaggcucacugcgggcuccaccucccagguucacaccauucuccugccucagccucccgaguagcugggacuacaggcuccugccaccacgacuggcuaauuuuuuguauuuuuaguagagacgggguuucaccgucuuagccaggauggucucgaucuccuaaccucgugauccacccgccuuggccucccaaagugccgggauuacaggcaugagccaccgugcccggccuauuauuauuauuuuuuuuugagacagggucuugcucuguuaccuaggguuugaagggcagugucaugaucauggcuuauugccgccuuaacccuccgcguagcugggacuauggguguaugccacuacacccagccauuguuuuuaaaaauguauuuuugaagagauggggucuugcuauguugcucaggcugguuuugaacuucugagcuaaagccaugcucccgacuggucuccuaaagugcugggauuacaggccacuacacacgcgucauuguguuuuuaauacguauuuacuuaguggcuaaugauguugaccaucuuuucaggugcuuauuugguaucuuuuuuuuuuuucuuuuaauauggaacacuuuaagaauuugcgugucauuacuguucagggagcaugcuaaucuucucuguauugauucaauuuugguauaugugcuguugagacaagcacuaguaccuuuauauguccucuguucaucaguuuuggcuauuuucuuuuucuuuuuuugagacagagucuccccaucucuacuaaaaaaauacaaaaguuagccgggcaugguggcacaugccuguaaucccaacuacuugggaggcugaggcaggagaauugcuugaacccaggagguggagguugcagugagccgcgaucgcaccauugcacucuagccugggcaacaagagcgaaacuccaucucaaaaaaaaaaaaaaaagguauuccacucuuggugaguggaauguucuguuguucuguaaaauguucauggauccaguuaguucauagcguugaauuaaauauucuugcuaugaauauauguauaguuuuaacaguuauuacagagaaauauugaagucucuauaguggauuugugcauuucuccacucuguuccaucagcuuuucuuuuacauauuuuguagucuuguuuuuuggugcauacacauuuaggaauguuauguccucuugguggauugaccucucucuccauaaauaauuuccuucuuagucucuaguacuuuuucuuugcucaaaaguauaguguuucugauguuaauauagucacuccagcuuuucuuuaauuaauguuugcaucauauaccuuuuuaauuuuuuuuugcuuucaacgugcuuauuugaaguaaauuucuuguacacaaaauaguguuagguuauguuuucuuuguuuuuuguguuuguuugagauggaaucuugcacuguagccugggcuggagugcaguggugucaucuugguucacugcaaccuccgccuuccggauugaagcgauucuucugccucagccucucgaguagcugggauuacaggcgcccgccaccaugccugguuaauuuuuuauauuuuuaguagagacgggguuucacuguguugaccaagcuggucucgagcuguugaccucgugauuugccuuccucggccucccaaagugcugggauuacaggugugagccacugugccuggccuuuuuuuuuuuuuuuuugagacauggucuugcucugucacccaggcugcauugcaguggcacaaucaugguuuacugcagccuggaccuccugggcucaaacuguucccccaucucagccucccaaguaagugggaccacacgugugcaccaucacaccuggcugauuuuuuuauuauuuguagggaccaagucuuguuauguugcccagccuggucucgaacuccugggcucaagagacccuccugucauggccucccaaacugcuggcauuacaggcaugagccaccaugcuuggcuuuagguuauguuuuuaaaauccagucugucaaucuuuggcuuuuuuuuuuuuuuuuuuuuuuuuugagauggaguaucucucugucacccuggguagagugcagugguaugaucucggcucacugcacccuccaccuaguggguucaaacgauucuccugacucagccuccagaguagcuauuacaggugcccaccaccacgccuggcuaaauuuuuuuuuguauuuuuaguagagauggguuuucacuguguuggucaggcuggucuugaacauugaaccucaggugaucugcucuccuaggccucccaaagugcugggauuacgguugugagccacuguaccuagccaguuuuugucuuuuauuugcuguauuuagguauuugggucauuuacauaguuauagauguugucagacucccccccacccccuuuuuuuuuuuugagacaaagucuuacucuugcccaggcuggagugcaguggcucaaucuuggcccacugcaaccucugccucccggguucaaguaguucuugugccucagucucccgaguagaugggauuacaggcaucuacuguaagcccagcuaauuuuuauauuuuuaguagagaugggguuucaccauguuggccaggcuggucuugaacucccggccuuaggugaugcaccuaccuuggccucccaaagugcuagaauuacaggccugagccaccaugccuuguuuuaguuuuuguuuuuuugacuguuuuucuugcuuucuuuuggguuacuugaacauuuuuggaauuccauuuuucuuauuuuuuucuucuaccccaauucacugugccaaaccauuuuucuuuauuguguuuuguaucuuuuuuuuuaguucauugauaugguuuggauauuuguuccacugaaauuuuuuuucuucuuuuuuugauacgaaguuucgcucuuguugcccaggcugaagugcaauggcaugaucucggcucaccucaaccuccgccuuccggguucaagcgauucuccugccucagccucccaaguagcugggauuacaggcaugcaccaccacaccuggcuaauuuuguauuuuuaguagagacggaguuuguccauguuggucaggcuguucucgaacuuccgacuugaggugauccacccaccucggccucccaaagugaugggauuacaggcgcgagccaccgagcccggccuugguaucuuuuugguaucacaaauaacuuuugauugaaaccugggcauuuuuguauugucaugagacuaugcacuuacuuaaacaacuguuuuaacuaguguucucuuacacuuaucuaacaaggggagaguguuggugccacuuuguuaagccagguaggggaugaaguucagguuaucuaccuugucuguguugacauuugaggcaaacuuccuuuuaguuguuugcagaauugggaguuguggcucucuaccugaucucugugguggauguggccuuguuuguuacuguguguaggugaaaguucucacucucuacuaggucuucucugcuaccacuccaguagggacagggagggaugccuuauuacuggcagauggugguggaaguccagucuucccuacuuuucuccacugacacaguagggaguggaugcucauuaacuagccaauuggaaugaagguuccaauccccugcuuaauuuucucugacacuaccuggugggaaucuuggauuguuuucauuacagucucaugaggguggauaucuagguuccccaugugaucauugcugguauggguggggcuagguuuucuaugguguuaugcuggauuauagcaguuacucuucaaguuuucuuucugguuaacauaccacuuuacugguaaucuggucuggagagagaaggcuuuuguuggggcuucuucuuuuuuuuuuuuuuuugagacagagucucucucugucacccaggcuggagugcaguggugcgaucucugcucacugcaaccuccgccucccgaguucaagcaauucucgugccucagccuccggaguagcugggaucauaggcgccuuccaacacgcccggguaauuuuuauuuuuaguagagaugggguuuugccauguuggccaggcuggucuccaacuccugaccucuggugauccacccgccuuggccucccaaggugcugggauuauaggcaugagccaccgcacccggccuuguuggggguucuuuuauuuggucagugcccaucgguguuccugauguacucacuucuuccauuccaggaguaggauacauuaggcaaaaagaagagaauacccagggaauuuacugcuauauugugccuuguguccugugauccugagcuaauuugccuucucuccaccuuucagagaaaauucguuuuauuuauaauauucacauuuuaaauuuguacuuagugggaggaauagggaaaaguauguccauuccauccuccuagaaguguaaguguaaccuuugauuucauugagugugcccuauuuuucuguuaucuauuucauugacuucugcucugaucuuucuuuugcucuucuaguuucuuaaggaacaaggugaaaucacugauuuguuucuuuucuaauauagucauguaauuguauaaauuucuauuucaauuacugcuuuaacugucuuaaaaauacuugauauuuuugucuuuuuuuuuaccccuugguuauuuuauuuuauuucauuucauuucauuuuauauuuugagacagauucucccucugucuccaggcuggagugccgcagcgagaucuuggcucacugcaaacuccgccucccggguucaagcaguucucugccucagccuccugaguagcugcgguuacaggagccugcuaccaugcccggcuaauguuguauuuuuagcagagacgggguuucaccgucuuggucaggcuggucuugaacuccugaccuugugauacaccugccucgaccucccaaagugcuggaauuaacaggcaugagccacugcuccuggcccccacugguuauuuuagaaguauguuuugauuccaaauauugggauugucuuugauuuuuuuuugucacugauuucuagauuaauaucacaguuguaagaaaaaauucaugguaacaccugaaaccuuuuaaauuuaccaagaguuguuuuuuuggccugaauaugguauaucuuggugaauguuccaaaugcacuugaacagaaugcguauucugguaguuuguguagaguguuguauaguuaguuaggucaguuugguuaaugguguuauucaagcuucuguauccuuacugauuuucugucugcugguccugcuauuaguaucauuccuuuuuuuugaacaugauguugcuuugucaccuaggcuggagugcaguggcaugcacaaucauagcucauuaagccuccaccuccugggcucaaaugauccucccaccucagccuccccaguagcugggucuacaggcaauaugcuaccauacccagccaauuuuuuuuuuuuuuuguaauggaaucucgcucucgcccaggcuggagugcaguggcgugaucucggcucacugcaaacuccaccuccuggguucaagcgauucuccugccucagccucccgaguagcuaggauuacuguugugcgccaucaugcccggcuaauuuuuguauuuuuagcagagacaggguuucaccauguuggcgaggcuggacucgaauuccugaccucaggugaucugcccgccucaggcucccaaagugcugagauuacaggugugagccaccaugcccggcccacccaguuaauuuuuaaaaaaucuuuuuguagagaccgggucuuccuguguugcucuguugccugggcuggagugcaguggcacaaucauggcucacuauggccuugaccuccuccugccuuagccuucccgaguagcuagaaggaccacaggugugugccacuaccuguggcuaauuuuuguguguuuuuuguuuuuauuucuugagacggggugccgcucuuguugcccaggcuagagugcaauggcaugaucucggcucauugcaaucucugccuccuggcuucaagcaauucuccugccucagucuccugaguagcugggauuacaggcaugugucaccaugcccagcuaauuuuguauuuucaguagagaugggguuuguccauguugguuaggcuggucucgaacuccugaccucaggugaccugcccaccucggccucccaaagugcugggauuacaggcgugagccacugugccaggccaauuugugugugugugugugugugugugcgcgcguguguguguguuuagagaugggguucugcaguguugcccacacuggucucgaacuccuggccugaagugauuuucccaccucggccucccaaagugcugggauuacaggcaugagccacugcgcucagccacuuuucuucauguuuccagugacugauaguucauuaaaagagugcccuguuauacaugcuuauaauuuccaucaaauaugugaaaguuguuggccaugauuucuaaagacuuuuuuuuucuauauuaucuccuguuuuguggcuccaguuacaaguauguuuggccucuugaaauuauuucaauuaucacguauuacauuuuuuagugguuuuuuuuuucuguguuucauuuagguuaguaauuuugguuucauggguuguaaaucucaaaguguauuuuucaucuuagacuuuguaauuuucaauuuagaaguucaaauuuuaaaaauauuucauauuuuuacuuaauauauuuguuucuucuagccuucugaucauaugaaauaucaucauaauuguuuuaaaggacuugucugcuaauucucuuuucuguuucauuucaaaauugguuuauuuuuuguuucauuaugggguguaacuuccugcuucuauguaagucuuauaaauuuugauugacuuuuuagccacugugaauuuuaccuuguuuucuaguuucucuaguuuuguuugccuuuuacaaauauuuguggacuuuguucuguggcauuauugaguugcuugaaaacaguuucuuucuguugggucuuucauguuuucuuugacuggaccagggcuguguuuaggguuaauuuuuuccuccuucugaagacuuucuuaguacuccuaugucauaucuacaaugugauauaaauuauaucacaucauuuccuuuuggacuuuuggguauggguacuauucacauccuuaugucaguucuggaugcuauuaccucuaauucuuuuggugauuucucaucuugccauuggauagcuccuuuacauugcaagugcugauuugucauucaaccaaaaguucuagggugagccuuuguagaucucuucauuucucucucucucuccagcucucuacucagugcuggucucccuugugagcucuaggcaccuuggccuccuuggacuuccagcuucauuuccucaacuuggggagacuacaggcucugccuggguuccuccucccuguuccacgaccuggaaacucucucaaggcaguaagcugggcacacgugcggcccauuuguuuuuugucuuccagggaugacuguguuuuguugcuuguccaauaucuucagugcuguuguuucauucauuuuauuagguuuuuauuauuucgugcaaggaggcuauaucugguccccuuuauucacuccaucuugaccagaagugguaucauugugguuuuaauuuacuuuuucaugauaacugaugauauucagcacauuuuagcuuguguguugaccauucguguguucucuugugaugaguuuguucauuuagccuuugcuauucuuuguuuucuuuuuucaucuauuugaguugcagaagguguuuauauguccuaaauacugauccugugucugauaaauguuuuguaaauacuuuccccaagucuauaugguuuaacuauuuauuuuaacuguaccuuuugaugagcagaaauauuuauaucugauaaguuuaauuuaucaguguuuucuuuuguaguuauugcuuacugugagcuaagacaguuuugccuaaccucgaagucaugaagguaauuuccuuuauuuccucuaaaagguuuugcuuuugcuaauuuauauuuaggucugugaugcaucugaaauuauuuuuguagguuugaguauuuugcauauggcuauccaguuguuuuucaccauuuguugaaaacagucucuuuuucucacuggguugcuuugggaacaucacauggcugcauaagugggauaucuuucagaaaucuuuauucugcuccaaaaaucuguuugucuagcccuguuauucugauaauuuuguaacuuuauauugucuugaagucagaauugcaaguccuaaaaccuuuuucuucuuuuucgaaguucugcauauucuccguccuucacauuuccauauaaauucuaauaaucucuuuucugucuucuccaagaaaggcugaugggaucaugauuauaauugucuugagucuguugaucaguuugaggagaacugacaucuuaacaacgauugagucuuaaucauuaguauaguauaucucuccauuuauuuaggucuuuuuugcuuugucugagcagucguuuguugcuuuuagccuuuggucuugcaugucuucuguuuuaaaauuacuuuuuuuuuuuccuguuuuuuugagacagagucuuacucuguugccucgcuggagugcaguggugcaaucuuugcucacuccaucuccuggguucagacaauucuccugccucagccucccaaggagcugggauuacaggcauguaccacuaagcacagcuaauuuuuauguuuuuaguagagauaggguuucaccauuguuggccaggcuggucaacuccugaccucaagugaucugccuguuucggccuuccaaagugcugggauuacaggcaugagucaccacgccuggccuaaaauuauuuuuaaauauuuugucuuuuuuuugaugcuauuuuaaaauauuaaauacauuuuuuagcaauuauaaaguauuauaaaaauuucuaauuuuuuguuggaaauagaauuuuuguauauugaccuguuucuuacaaccuuacuuaagucauauuaauucuacuaguuuuuuagguagauuacuuagauuuuucuaauagaugauugucauaaaacacuguuuuaucucuuuuuucccauuuguaauuccuuuuauucucuucccuuacagaauggacuuaaucuuguuuucauucuuagaggagagcauucaguguuacaccaucaauuauaagucagcuguagggguuuuauugaugaaguuuaucagauugcuuucaaauauagcuuuuauuacuauuuagauauggcaaggccaacagaacccagcaugacugccauugaaaagauaguuuguuauagucacagaccccaagaggaauagucaugccaugccauggagaauacacagcugaguagcuuccugaggguuugugucaugaauggauauugaguuuucucaaaagcuuuuucuguaucuauugagauaaugcuauguuuuuaaagauauuaauguaaauuucauuguuuuauuuucaaauguuacgcuaaaugccauuuggugucaugguguauuauucuuuuuuuuuuuuuagugauggguacaguggcacaaucucugcucaguguaaccuccaccuccuggguucaagugauucuccugccucagacucccaaguagcugagauuacaggcacgugccaccaugcccggcuaauuuuuuuuguggagacaggguuucaccauguuggccaggcaggucuccugaccucaagugauccucccgccuuggccuccgaaagugcugggauuacuuucguaauccaugugagccaccacaacuggccuauucuucuuauauauuguuggacuuaaauugcuaauaguaaauauuuuugcaacuuuguaugggagggauuuuguuguaaucuuguugcuuuuugucaagugcugguauuuuugguauauucauugguauucuucaugcuaaacuuagaaaaugauuugggaagcauugucuucucuguuuucuggaaauacuugugugagauugauuuauaguguuugaaggaacuuaucagugaaaaaaucugagucuagaguuuucuuuuugggaaggauuuugauaaugaauucaacuuaaaaugcuucucagauuuucuguuuuaucaguuuugauaaguuucauuuucaaauaauuuuuucuuuucaucuaagcuguugaauugguuagcauaaagucauuaauaauaaucuuuggccuucuuaauaucuuugggauuguagagguaauucccauuuuauucuugauauugguaauuuguauucuuccuauuuaaaaaaaaauuaauuuagcuugcagauugucaacuuuuuagguuuuuccaaaguguuaccagaaagggggucccaauccagaccccaagagagggguucuuggaucuugugcaagaaaaaauuugaggcggauucauagaguaaagugaaagcaaguaacuuauuaagaaaguaaaggaauaaaagaauggcuacuccauagggagagcagugccauggcugcugguuucccauuuuuaugaguauuucuugauuguaugcuaaacaagggguggauuauucaugaguuuucugggaaaggggugggcaauucccagaacuagugguuccuccccuuuuuagacuauauaggguaacuuccuggcauugcuauggcauuuguaaacugucauggcgcuugugggagugucucuuagcauguuaauguauuauaauuaguguauaaugagcagugaggacgaccagaggucaguuuugucaccaucuuggcuuugguggguuuuggcccccuucuuuauuacaaccuguuuuaucagcaagguuuuuaugucuuguaucuugugccagccuccuaucucauucugugacuuagaaugcauaacuuacugcaguccagcaggacucagccuuaugauuuccccagccccuguucaagauagaggcauucugguucagaggccucugacaaaaggaccaacuuugacuucaaauucucuguuacuuuucuuuucauuucuucugcucucauuuuuacuauuucuuuuuucuacuuacuuuggguuuacuuuacucuuuuauauauagguucuuuagguagaacccuacuuauuuuauuuuauuuuauuuuauuuuauuuuagacagaguuuugugcugccacccaggcuagagugcaguggugcgaucuuggcuuacugcaaccucugcaucccggguucaagcgauucuccugccucagcucagccuccuggguagcuuagauuacagccacccgcugccaugcccagcuaauuuuuguaucuuuaauagagauggaguuucaucauguaggccaggcuggucuugaacuugcgaccucagaugauccaccugccuuggccuuccaaaguguugggauuacaggcgugagccaccauauccggcugcuaggucauuaauuuuauaucuuuuuuucuaaugugguuagggaacauaaucuguaugauuuccauuauuuucauuuuauuguguccugcuuuauggcucaguauguggucuuccaugggguaugcaccaaguuuaccugaaaagaauguuuauagugguuuuaacauugcuuagauuauuauuauuauuuuuauuugguuugguuuugucagucacaaagaggaguguuaaaauaucuuaccacguuuggggcacugaguauucugacuaugccuuaugcuaauuuuugcuucauguauuuugaagccuuguuuuuaggugcauacauuuauaauuauuaugacuucuucauugucugacuuacugugaaaugccccucccucucuuuacuauguagccacucaccaucuuuuuuuucuuguuguuuguuuguuuguuuuuuuuaugagaugagguuuuacucugucacccaggcuggaguacaguggugugaucuuggcucacugcagccuuugccuccuagauucaagcaguucaccuguuucagccacccuaguagcugggacuauaggugugugccaccgugccuggcuaauuuuuguauuuuugguagagauggggcuuugccauguuggccaggcugguuucgaaccccuggccucaagugaucaagugcccgccuuggcaucccaaagugcugggguuacaggcgugagccaccgcacacccagccuauccauuuacuuuuuuuuuuuuuuuuuugagauggagucucgcucugucgcccaggcuggagugcaguggcaugaucuugguucacugcaagcuccgccucccagguucacgccauucuccugccucagccucccgaguagcugggacuacaggcacccgccaccacgcccggcuaauuuuuguauuuuuaguagagcuagguugucaccauguugacaggcuggucucgaucuccuaccuugugauccacccaccucggccucccaaagugcugggauuacaggugugagccaccgugcccggccauuccauuuacuuuugaccuguuugugucuucacuuaaaguguguuucuuacagacaccuuguguuuacuuuucuauccgugcuaauacacaauuuuuuuuuuuuuuuugaguuggaguuuugcucuuguugcccagacuggagugcaauggcacaaucucggcucacugcaaccuccgcuucccggguucaagcgauucuccugccucagccucacgaguagcuaggauuauaggcaugugccaccacaccuggcuaauuuuuguauuuuuaguagaaaugggguuucuucauguugaucaggcugguuuugaacucgcgaccucaggugaaucgcccgccucggccuccuaaagugcugggguuacaggcgugggccacugcgcccggccaauuguuuuguuuugaaacagugucuacaucacuacaaucaauuuuagaacacuuguauccccucaagaagaagcccuuuggcccauuaacagucacucuccauuacccuacuuccccagcuccugacaaucacuaaucuucauuucugucucuaucccuauuugggacauuucauauaaauggaaucauaugauauaugguguauugugaguggcuucuuucuccuagcauaauguacaagcauuuguuuuguagcauuagaacuucauucccuuuuguugucaaauaauauucuguugcauggcuauacuacauuuucuuuacucauucauuaauugauagacauuuagguuguauauacuuuugcaauguuaugaauaacguuauuaugaacauuugucugcaaauccagacauuuguuuugaauucucuugggcguaggauuuuuguuucaugcuguaacucuguuuaaucuugaaaaacugacagaggcuguaacauuuuaaauuaccagcaacaauagaugaagguuuuuuuuuuuuuuuuuuugagacggaagucucccucuguugcccaggcuggagugcaauggugcaauggcgcaaucucagcccaaugcagucuucaccuccuggguucaagugauucuucugccucagccucccgaguagcugggauuacaggcacccaccaucaugccgggcuaauuuuuguauuuuuguagagaugggguuucacuauauuggcuaggcuagucuugaacuccugaccucagguuauccgcccacauuagccucccaaagugcugggauuacaggugugagccaccgcacccagccuauaugaagguuuuaauuucuccaucucuuugccaacauuuuuuauuguuuggcuuuugguuuuagcuauccuacagggcaugagguaguaucugauugugguguugauuuuuauuuauuuuuuucauuauauuauuuuuuuagacagagucucacucuguuguucaggcuggaguacaguggugugauaucuuggcucacggcaaccucugccucccggguucaagcgauucucgugccucagccuccugaguaccugggauuacaggugcccgccaucacgcuuggcuaauuuuguaauuuuagaagaguuggaguuucaccaugauggccaggcuagucucaaacuccugaccucaggugauccacccgccuagaccucccaaaguguugagauuacaggcgugagccacugcaccuggccugguguugauuuuuaauccuuaaugauuaaugacguuaagcaucuuuucaugugcuuauuggucauuuauauauuuucuuuggagaagugucuauuuagauccuuuguucaauuuuuaacugggcuguauagcuuuuuauuuuugaguggaagagcucuguauccuggauacaaacuacuugucagacaugcgacuuguagacuuguaaauauuucuuccauccuuuuacuuuccugaugguuuuguuuguagcaaaaaagucuguagguuugguaaauucuaguuauuuuuucuuuuauugccucugcuuuuaguguuaugucuaaaaacuguuguuuaaccgaguccuaaagacuuaccuccuauguuuuuuucuaaaguuguauaguuuuagcucuuacauuuagaucugcgauucacuuuugaauuaauuuuuaaguauaguaucaggaaggguuucaacuuaauucuuuugcacauuccucuagcaauuuaaguauauuucuuuacucuuuucagucuguuuuuauaguauuaccacuuauggguaauauuguacaagucguaaaguauacaaagcuuguaaguuguucuuuuauaucaccucuguuuguugucaguuaugcuauugucauguguguuggaacuauguauauuauaagccccagaaaacaacaauauaauuuuggcuuucaauaaucauguaauguuaagaacuuaagaguugaaagucuucuaaguuuacccagauauuuaccauuugugguagucuucugaagauuggcauuuucuagcaucauuugucuuaauucugaagaauuucuuuagccuuucuugcagggcauaucuuuuggugauaaauuguguuuucuuucuuuuaucugaaaguaccuauuucaucuuuauuuuugaagggcauugugguuggauuuagaauucuguguugacggugcuuuaucucuuagcaauuuaaguauuuuaguuuacuuucuuuuggcuuccauauuuuaugaugagaaaucugccauuuauccagucacuguucccucugcccucuguguaaugugacauuuucuuuuggugcuucaagauuuuucccucuguguuugcuguuuagcaaggcauuugacuauuugagguuugcugagauucuugaaucugugaaugugucuuuuuucaaauugaagaaauuuucagccaucguuucuucaaaauuuucuuuccugccucauauucuuucucucuucuucuuuuuaaggccuuugguuaugcaugugagaccuuuugguacuguccuguaggucccugaagcccugguuuuuuuuuuuguuuguuuguuuuaccucuauuuccucuuucagauuagauucuuuuuuuuuuuuuugagguggaguuucgcucuuguugcccaaacuggagugcaguggugcgaucucggcucaacacaaccuccgccucuuggguucaagugauucuccugccucagccuccugaguagcugggacuacaggugugugccaccacaccuggcuaauuuuguauuuuuuaguagagacgggguuucuccauguuggucaggcuggucucgaacuccugagcucaggugacccacccaccucggccucccaaagugcugggauuacaggugugagccaccaugccuggccucagauuagauucuaucuauugauguagcuucaaguucacugacucuuuugucaucucagauuuguuguuaugaagcuugccuagugaaauuuuuacuucacauguuguauuuuuaguauuuaaaaaauucuuuguuuuuuuguuuuguuuuuucuuuguuuuuuuuuuuuaauuugagaucaagucuugcucuuuugcccaggcuggagugcaguauugcuauuauauuacugcagccucaaacucccaggcacaagugauccuccugccucagccuucugaguauuugggacugcagacuggugcugccacgcucggcuuauaguuucuuuuuuauuguuguugcugagacauccuguuuuauuuauuauagguuuaucuucagugggcagauuuaauuagcauuuagugacauuuuuccguaaaacuugacaauauaacggaaaugguauaauuuggaauagagaaaagaaaucacucauaaucuuaccauccuuaucacaguccuauuaauauauuuuguguauuuuuuuuuuuuuuuucgagauggagucuugcucugucacccaggcuggagugcaguggcaugaucuuggcucacugcaaccucugucuccuggauucacgccauucuccugccucagcuuccugaguaguggggacuacaggcgcccgccaccacgccuggcuaacuuuuuuuguauuuuuaguagagacgggguuucacuguguuagccaggauggucucgaucuccugaccucgugaucugccugccucggccucccaaggugcugggauuacaggcgugagccuccacacccguccuauuuuguguauuuucuuuucuuuuuuuuugagacagagucuugcacugucgccugggcuggaaugcaauggcgcgaucuugacucacugaaaccucugccuccuggguucauggaauucuccugccccagccucccgaguaguugggauuacaggugcacaccaccacgcccagcucauuuuuuuuuuuuuuuuuuuuuuuuuaguagagacggaguuucacuauguuggcuaggcuggucucgaacuccugaccucaugaucugccugcauuggcuucccaaaguguuagaauuacaggcgugagacacuguguccagccuauuuuguguauuuucuuuuaauguucagugaauuuuuuuuuuuuuuuuuuugagacggagucuugcucuguagcccaggcuagagugcaguggcacgaucucggcucacugcaagcucugcuucccggguucacaccauccuccugccucagccucccuaguagcugggacuacaggcgcccacuaucacaccuggcuuauuuuuuuuguacuuuuaguagagacgggguuucaccguguuagccaggauggucucgaucuccugaccucgugauugccugccucggccucccaaagugcugagauuacaggcgugagccacugcgcccagccauauuuguguuuuuaaacauagaaaagguacagcuaaaauaaugguaugaaagauuuuaaaaaaugcacuuguauagggcuuuaccaugaaugaagcuuacaggacuagaaguugcucugggugagucagugaguaaguggugagugaaugugaaagccugggacauuuuuguacacuacugauaggguuuggcuguguauccccacugaaaucucaucucgaauuguaaucccuauguguugaaggagggaggugacuggauaaugggggcaguuucccccauccuguucucaugauagcgagugaauucucuugcggucugaugguuuugaaaguggcaguuuuuuccuauguacacauucucuuucucuugcuugcugcuauguaagaugugcuugcuuccccuccugugaugauugaaaguuuccugaggccuccucagccauguggaacugugagucaauuaagccucuuuucuuuauaaauugcccagucucagguaguucuuuauagcagugagagaauggacugcuacaacuacuauagacuuuauaaacauuguacacuuaauguacacuaaauuuauuuuaaaaauugcucugucauguuacuauggcuauuacaucauuacgucacuaggcaauaggaauuuuuuaguuccauuuaaucucaugggaccaccacuguauaugugguuguuguuaugcagacugcauuuugagagagaccacauucauauagcuuuucuuauaguacauuguuauuuuuuuuuuuuaauuuuuaaaaauuuuuugagguggagucucuuucucuguugcccaggcuggagugcaguggaacgaucuuggcucacugcagucuccuagguucaaucgauuuuugugccuuagccuccugcuuagcugggacugcaggcacgugccaccacaugcagcuaauuuuuuuguguuuuuaguagagauaggguuucaccauguuggccaggcuggucucgaacuccugaccucaggugaucugcccgccucagccucccaaaauccugggauuauaggugugagccacuacacccagccuguucuauuuuauuguuguuguuaaucuguuacugugccuaauuuauaaauuaaacuuuuuauagguauguauguauagcaaaaaacagaaucaagugcucaguaccauuuguuguuucagacauccacugggguucuuagaauguuucucccauggauaacugggggacuacugcauuuaggaggugacugaagugguccugaugaaaggugaugcuugcuuuaaguaggguaauaguggagauggagagagagaggcagaucucaccaguauuuaggaagaggaagggcacaauacaguuauggauuaaaagugagauuagggagugaggcaugaaguggucaaagaugacguauacuaggugucuugcgugagcaaugugucauugaaaauaucauuaccaguauaugaaaagagcaggaagagcagauuuugucauaaauuguggagcguuucaagugucuauguaggcugggugagguggcucacuguaauccuagcacuuuaggaggcugaggugaguggaucacuugaggccaggaguuugagaccaaccugggcaacaugacgaaacccuauuucuacuaaaaauagaaaaaguuagcuggacgugguggcacacaccuguaauugcagcuccuugggaggcugaggcaggagaauugcuugaacucuggagcuggagguugcagugagccgagauugagccacugcacuccagccugggcaacagagugagacuccaucucaaaauaaaauaaaauaaaguguuuauguagcauauagaguuuuauaccugaaccugaggacagauacaaauagauaaaauuugggagucacuguuacauuuuuauaauuuaguugguaauggaaauuuggacaaugaguaagauugccuaguguuucaugugaaauaagaugacaucuuaggccagagcccugaggaauuucaccauuuaaagguuugauagggugaucagaaaggugcugccaaagagguaauaggaaaaucaggagagugaaauacugaaaggcaagaaguauagugguauuagccuguuucagguuaaaggaauaccugaaacuggguagauuauuaauauaaagaaaagagguuuauuugguucacaguucuguaggcuguacaaguauaccaccaacaucuuugggcugaggaaacuuuuacucauggggcagugggaauggggaccaggagugucacauggugagagaagggagcaagguggcaggcucuuuuuaccaaucagaucucacaugagcuaacaacagcaagaaacucacucauuaccacagggaaaacaccaagacauucaugagggaucugcccccauuacccaaacaccuuuugcuaguuuccaccuucaacauugggauuacauuuuuacaugagauuuggaggcacaaauauccaaacuuuaucaauaggcucaauuuuuuuuuuuuuuugagacggagucucgcucugucacccaggcuggagugcagugacgcgaucucggcucacugcaagcuccgccuccuggguucacgccauucuucugcuucagccucccaaguagcugggacuacaggcgccugccaccacgcccggcuaauuuuuuguauuuuuaauagagacgggguuucaccguguuagccagauggucucgaucuccugaccccgugauccacccgccucagccucccaaagugcugggaauacaggcgucagccaccgcgcccagccuuuuuuuuuuuuugagauggaguuuugcucuuguugcccaggcuggagugcaguggcaugaucucugcucgcugcaaccuccgccuuccgguuucaagugauucuccugccucagccucccaaguagcugggacuacaggcacgcaccaccacaucccgcuaauuuuuuguauuuuuaguagagaugggguuucaccagguuggccaggaugguauugaucucuugaccucgugauccacccgccuuggccucccaaagugcugggauuauaggcgugagccaccgcgcccagccaauaggcucuauuuuuuuuuaaauuauuuuuuguagagaugaggucucacuuuguugcuuaggcuggucucgaacuccugaccucaagugguccuucuguuuuggccucccaaagugcugcgauuauaugugugaggcacugcacccggccucauuaggcuuuuauggcuuaugcuuucuguacuuuuaauacuauuucaacuuaauuuucuacuccaauuuuuuguuguaauuuauauauguauguaaguguauauauauuuauauguaggguguguauauauaguguguguauauauauauaaaguauguguguauguguguauauauauauaauguguguguuuauauacacauacauauguauguauacauacacacauauauauacguauguguguauguacguguguguguguguguuuauauauauguauauguauauauacauuuuuuuuuauuuuuguuuuuuuugagauaggguucacucuguaacccaggcuggagugcaguggcgcaaucguggcucacugcagccuugaccuucugggcucaauugaucugcccgccucagccugcugaguagcugguacuacaggugugccaccaccacacccagcuaauuuuuuguuuuuguuuuuuguagaggugggauuuugccgugucgcccaggcuggucuugaaccccugggcucaagcgaucuaccuaccucagccucccaaagugcugggauuacaggugugauccacugugcccggccuauauuacuauauaguaugcugcaaaaccucuuuuggaaacaaagugggauauaaauaauacucaagugagacuuucaggaacauauucuucuugguaagacagugccacugaaacuuacuguguuucauaagaagugguaguacuggcucuacuuuuauuuuugguuuuaaauucugagcaugagaaggagagggauccacaauaaauuuugaguacuauuguauuugaauaauaauaacugauuauccuaauuccuuucagaagggaaaucagcaugcaugagaucauuucuugccacuuaaauuaaaauucuaaauucuagaguuaggcucuuuaagagaaaccagaccuacuugacggcagucguccuagcugaccauaagacaggaaguaaacagguaacaggcauauguuaaaagccuugccccauuccuguguugagaggaccuuuuuguuuuuucucccgcuccccagguaaauaaucccagcaucuuuguguuuuuauuaauguaagauuuaaaaaauuguggcaggaguuuuguuuuguuucuuuuaguuggaguuucguuuuuguugcccagacuggagugcaauggcgcgaucuuggcucaccgcaaccuguaccucccggauucaagcaauucuccugccucagccuccccaguagcugggauuacaggcaugcgcugccaagccuggcuaauuuuuuauuuuuaguagagacgggguuucugcauguuggucaggcuggucucgaacucccgaccucagcuaauccgccugccucagccucccaaaguucuaagauuuacaggccugagccaccgcgccuggcccauggcaggaauuuaaaaguuaaaauguacuuuaaaaaaauuacuuguccucugaagaagaucacaugucaucaagaacaacuguuugugaagaauguucugaaauauucuuggggggcaacuaggacaaaugcugcucucacauuuucaguaguuuugacguugcagggaagauacuacauuuuugauaaucugaaauauucauuaccuguuucuuuuuuuuuuuuuauagagaugugaacuuuguccccauaaggauggagcuuuaaaaagaacagauaauggggguaagugcagagauuucuugaaaaaaauuuuauugaaaacugggacaguggaguauuuucaaauauuugguaguuuauuuuauuuuaucaaauuaaacagcguuuucuacucauuuuuaacagugguggcuauaauuuauaaauccuuauuguauugacccacaauuuuucuacuuuguggacaaacuuaagcauuggguauuuuaugcaguaugaucuauuaaauacauacuucuaauuuaaauucuuauguuuuuggcugggcgagguggcucacaccuguaaucccagcacuuugggaggccaagggagguggaucaccugaggucaggagucgagaccagccuggccaacauagugaaaccugguuucuacuaaaaauagaaaaauuagccaggugugguggugccugccuguagucccagcuacuugggaggcugaggcaggagaaucgcuugaacuugggaggcggagguugcagugagcugagauuauaccauugcccauuagccugcgugacagaaggagacugucuccaaaaaaaaaaaguauuuuuuuuaaauggauauaguuucuuauguuaggaauuuuuuuuuuuugaaaaaugagccacauuuuuuuguuguuguuguuagaccuaaaaucuguuguuuuagauucuuuuuuucuguuuuguguaucucuagacagaugauguuucuagugaauguuaauuuuauuuaacucugaagaucuuuguugcuugaauauaaagaaauguugacuuuuaggcugggugugcugccugacaccuguaaucccagcucuuugagaggccaagguaggaggcucacuggagcauaggagucugagaccauccugggcaacauagggagaccuuggucucugcaaaaguaaauauaaaaaauaaaaauaaaaagacugaguuacacaugguggcacgugccugcaguuccagcuacuugggaagcugagcaggaggauggcuugagucugggaggucgaggcugcaaugagccauggccacaucacuguacuucagucccugggaugggugagagugagacccugccucaaaaaaaaaaaaaaaaaaaaaaaagcugacuucuguaucacauuuugguaugcuuuccuaugaacccuuguauauuacucauuuucuucuccacuuucaguuaucuuugucagagaaaucauauuuuucuacagcucaguacuauucugaaauguguagacaugaguuuauuagaccauggcauauaugaugaggcagcuaaaaaaagguuaagcugcuauuacuacuauacucuucuccauuuuggguagccacuucuaaaguaguuuuggcauaggcuagaguaauggugugaguaaauaaaagggaaaaauagaaugauuuuggcuagauauauauauuuuacaguuuaaucuucagacuauguuauacagucagauuguacagaauuuaaaaauauguugaaaacucuuccuguuauuccucuuccccaucugcccaguuuaucaauaguuuuccugcuacuauguaauaauuacuuucuugcauaucuuucuagguuucuuuugcauauucaaaugugaauaaagacuuauuuacucccuccaucuuuauacaaauggguuaauauuauauacucuucugccucuuaauuuauuucacugaacaauuuaucuguuuuuuuugagacuuugcuuuucuuuuuucuucgauuuucuuuuuuuugaagcuucgcucauuugcccaggcuggagugcaguggugcagucucagcucacugcaaccuccaccuuccgggcucaagcgauucuccugccucagccucccaaguuccugggauuacagguaugugccaccacgcccggcuaauuuuuauauuuuuaguagagaugggguuucacgauguuggccaggcugguguugaacuccugaccucaaaugauccuacugccucggccuuccaaagugcugagauuacaggugugagucacugcacccggcaugaacaguuuaucuuguuucaguauagagcuuuuuuuucuuuuuaaccauguuaucuaauaucuaaucaaucaguucuugaugcacuuucugaucuucuacuuugaugacuaacucuuguauguaugucauuuugcuuguauacaaguauaucuauaggauuauuaauuuccauagguggaaacauugagucaaaggaguuuugccguuaauuuugauagauagucccaaauuauuugcccuguaguuuuaccaauauauguucccaguuuuaccaauauaugaauaaaaaagcuguucuacauaccuuugguaaucuaacagguaaaaguuuguauauccaagcaguaguuuugcauuucucuuaauauuagugagguucacaucuuuuuauaguuugaagagcaguuuguuuuuucucuucuguggucuguuuuuugacuugguuguugaucuuuuucuuuuuuuuuuuuuuugagacagggucucccucugucacauaggcuggagugcaguggcuugaucuuggcucaccgcagccucugccucccccuuucaagggacucuccugccucacucacccgaauagcugggauuauaggcacacaccaccgcgcccagcugauuuuuuuauuuuuaguagagaugggauccacccaccuuggccucccaaagugaugggacuacaggugugagccaccaugcccagccacaauuguugaucuuuuuacuuugauuuauuggaguguucauaaggagccccucauauauuauuaugcuguuuugauaugaguuggacuaauuuuugcccaucuggucagucuuuguuuauauugugcuuuaaaaaaauuuuuuuuuaccgugcaugaguuucugauuuuaauuuuguucaauuuauuaaucuuucaugaugucuguauuuugaguuauuaguuagaaaggccuucacuauuccaaaguuuuuuuuuuuuuuuuuuaagugacagguuuucauucuguuguucaggcugaauuacaaguagcaggauccuagcucacuguagcuuuguaguccugggcucaagugaucuuccugccucagcuuugagaguguuggaauuacaggaaugagccacugcaccugguguaaaccuuccaucuuauuaaauauuuccuauucugguuuguuucacuuguuccauucuacccuauuagcuuaaaaaaguuaacauuacuaugugcuuuuuuccucuuucugaauccucugaaacuuuuaggauacuguaaauucacuuguccaucuccagacauauauuuuauuuuugucauguacuuucauucucuguuucuuuaagaauuauagugguuuugucagguguuuguugaggauuaugcuagucacuuaaaaugaaacaguuuguguaaauuugguguuauuuuucuuugaauucuauauagaacuucgugagaaacugaaacuuuucugggaaaauuuuugauaaauucguuuuuuggcaaaauuauagggacauuccuuuucccccuuuccuuucccuuucccuuccccuuccccuuccccuuugucugucucucucucucuuucuuuuuuaacaguguaucacuuuguugcccaggcuagagugcagugaugcagucauagcucacugcagauucaaacuccuggauucaagugauccuucugccucagccuccugaauaggugggaccacaggcacaccaugccuggcuaauauuuuuuucuuuuuguauuuuuuguagagacacgucgucucacuuuguugccgagggucgucucgaacaucugggaucaagcuauccuccugccucauccuuccaaaguguugggguuacaggcuugagcccuugggccugaccuauuuuuauaaacuuaagucaauuuuggugcgcucuauuuuuccaagaaauuuaacuacuuuguauaaguugcugaaauuguuggacuaacauugccaauaguauuuuuuuuuuuuugagauggagucuugcucugucacucaagcuggaaugcaguggcgugaugucggcucacugcagacuucaccucccagguucaagugauucucugccucagccucccaaguagcugggauuacaggcaggcacuaccaugcccagcuaauuuuuguauuuuuaguagagacgggaucucaccauguuggccagucuggucuugaacuccugaccucaggugauccacccgccuuggccucccagagugcuaggauuacaggcgggagccaccacacccggccgccaguaguauuuuauuauuauuuuguuaauuuugcuagcaaugguaguaauuaccccguuguuauuccugauguuggugacuuguguucugguuuuuucuuuguuuuuauuuuuauuuuuuugaccaguccaaauagaauuguucaguuuuauugaccuuuuuaaagaaaguuuuggguuuuguuaauuuuuuuugccaucucccuguuuucuauuuuguuaaacuucugcucuuuauuauuuccuuccuaguacuuacuauguguuacauuuuccucuuguuuucuaacuuauaaagguggaaccuuaggucuuuuauuuuagauauucuuuucuaaugaaaauguauaugcuguaaguuccucucuauugcuuuuauugaaucccacaaguuguguuuuuuuguuuuuguuuuuguuuuugcuguuguuguuuugagacagggucucaguuugucacccaggcuggagggcaguggugugaucuuggcucagugaagccuccaccuccuggguucaagcgauccuccuaccuuagccccugaguggcugggacuacacgugcacgccaccuuauccggcuaauguuuuuguauuuguuguagagacgggguuucaccauguugcccaggcuggucucaaacugcugagcuccagcgauuaacaggcaugaaccacuguccccagccuaugucucaaguuuugauaaauuucauauuuguugccauuccguucaagacauuuuccaguuucccuugugacuuucucuugacuaucuuagucuaucuuggacagaaguagaagucuucugcuguuuguucguaacauugauuuucccucuuauuucuuauuucucuucuguucuuuuugugauuauuuuuuagugcuguauuuuaaucaguuuaacaaugcaacuaguuaguauugcauuuaaauuuaauuauauuaaauugccuuaaauugccuuuuuggccauaucucuuccuauauauauauacacaaguauuuauauuuaucuauauagugguugcuguagggauuauaauuuucuuaucaguaaauucagucucuacugaguguacaacuuuuuuuuuuuccuuuuugaaauggagucucgguguguugcccaggcuggacugcaguggcacuaucucggcucacugcaaccucuaccucccagguucaagcaguccugccucagccuccugaguagcugggacuacaggcacacaccacaacacucagcuaauuuuuguauuuuuaguagagacauaguuucacuauauuggccaggcuggucugaaacuccugaccucaagugaucugccugccuuggcuaucuaaaguguugggauuacaggcgugagccacugcaccuggccugugugugccacuuaacacgaaauguagaaugaaaccauauagacuucuuuuaccuguuuuuuuuccagucuuuguuauaguuuuauaggaaagcuacauacauucacaaacccuaccaguguuuuaauauuuaauguaaguggucauuuguauuguaaaugagugugaaggcauuauuguuuuguauguucguuacauauuaaauguaccuacauguuuaucacucuuuauauuuuucuucaguucugagcuuccuucuggaaucauuuuccuauuacucaaggaaaauuguuugguguucccuuuaauggaaaacuuuuaaaaaauguuuucuggcuuuauuuaguuaucuaguuuuucuuuugauaacuugccuuuugucuuuaagauuuucauuucuuucccuuaguuuucuguaguuuuuuuuuuuuuguuuguuuuuguuuuuuuuugagacggagucucacucugucgcccaggcuggagcguaguggcgcgaucucgacucacugcaggcuccaccccccgggguucacgccauucuccugccucagccucccgcguagcugggacuacaggcgccugccaccuugcccggcuaauuuuuuguauuuuuaguagagacgguguuucaccguguuagccaggauggucuugaucuccugaccgccugaucucuucauccgcccgccuuggccuuccaaagugcugggauuacaggcgugagccaccgcgcccggccaguuuucuguaguuuuauugucucuugguguaugucuuuauuuacucugauuuauagugguucuucagucaguggcuuugggucuucuguucuggaaaauuuuuagguauuaucaauucagauaaugcuuucaugccauuuucuuucucauauuuucucugagacucugauuacauguguguuagaucugccugccuauuacauuuuucaugugucuuauuccauuuuuuguauuucuuacuuuugugcuaacauucuggauuucuucugaccuguuuuguuccuacuaauucucuuuucauccaugucuaaaccguuguuaaucccacccauugauuuuuuuuuuuugucuugagauagggucucuaucacccaggcuggauugcaguggcacaauuacaguucacagcaaccuucaacucuugggcuuaagcacuccucccaccucaaccuccugaguagcugggacuauaggugcaugcugccgcaccugacucauuauuuuuuuuuguagagaugggguuucacuuuguugccuaggguggucuugaacuccugaucucaagugauccgccucagccuuccaaagugcugggcuuacgggugugagccccugugccuggcugauuucuaaauuuccucuuuacuucuggaauuuuaauuuauuauuauaguuuucaguuauuugcaucaauuuagaauuuugucuuguguguacuugaucauaguaagcauacuuauuuuaaaaccuuuaucugauaacuccaaaauggugaucuguuuugauuuucuuauuucuccuuauuuucauucauauugucuugucugucauguguuugguacuuauugugcuggaaauuauauguaaugaagaaauuuuaggcugggugugguagcucaugucuguauucccaccacuuugggaggcugagacugguggaucacuugaggucaggaggucgagaccagccuggucaacauagugaaacauggucucuacuaaaaauacaaaaauuagccccgugugguggugggcaccuguaaucccagcuacuugggaggcugaggcaggagaauugguugaacuggaaggaggaaguuguagugagccgaaaucaugccagugcaguccagccugggcgacagaccaaggcuuugucuuuaaaaaaaaaaaaaaaaaaaaaaaaaaaaaaaagguggaaauuauuuguagccaagaugauacuguuuucuuuuagagaggauagauguauauuugcaucugcuuggugccuuggggguuguaauuuaggauuaccuucgucaaauuucaguuugagauggucagaggccugguguagucucuuugagggucuauguacuuuuuguguauucuuagcucuaguuugcccuucaguguugcaucugaaacgagagggguuuacuuguucccuuuuucuguugguuguuucugaauguacaucccuguacuguuaggccucugaguuugucaaaaguacccuucaggcugagcguggugcucaugccuguaaucccaucacuuggggaggcugaggugggcggaucaccugaggucgggaguucaagaccagccugaccuacauggagaagccccaccccuacuaaaaauacaaaauuagccgggugugguggugcaugccuguaaucccagcuacugggucauuuguauuguaaaagagaauugcuugaacccaggaggcggaggucgcggugagacgagaucgcgccacugcucuccagccugggcaacaagagcgaaacucugucucaaaaaaaaaaaaaaaaaaaaaaaggacccuucauccucaccaccgcuuucucugaaauaggcaaauguucccugggcaaaaguggccaaaaacuguaccuaggacuuucauucuuuuccgguuuuagcccagaaacuccucacuaucauaucagcucuuuaauaccuucagucgggaggcugaggcaggagaauugcuugaaccugggaggcggagguugcggugagccgagaucgcgccauugcacuccagccugggcaacaagagugaaacuccaucucaaaaaaaaaaaaaauuuaauaugaaauuuaacacauuucaaauuaaaauagugaaaugauuauuacuaauauuaaaaauauugacacuaagauaaaaauaauuucauguugacauuuaaaaugauuaagauaauuaaauuuugucguaaguauuaaacuuuuaaaaacuccuuuuauagugguucucagagguagcguugaucugaauauuuagucugccuguauaagaaguguuagugccaacaucugaauuuauaaauguuucccuuuauuuauguaacuguacaucauaacuggggaaaugauuaagaaugcuuuuuuuugguagugguuugaguauucucaagcaauggaaguaagacagcaaugagaauuuguuaauguccuuguugugcauuuauuucaauagacauuuaagggaucuguuaaggaaguuaacgguguuaauuugcuuucgauaaaacugaaaagaugacauuuauuuauuuauuuuuagguugggcccaugugguuugugcccuguauauuccagagguacaauuugccaauguuuccacaauggaaccaauuguuuuacagucuguuccgcaugaucguuauaauaagguacaguggauauuauuuuauuacuguuugaauaucacuacugggaaguagaaaggaaguuuuuguguuuuuaaaaucacaggucuccaucaaauccagggagauuuggaaaaaaaauuacuacuccaaacugcaguuauuaaaauguuauuaauauguuacuaaggucacaggaguacaaagcaagcaaaacuguguuaccuuuuauaguaaccuagguauuuaguauucuacgauauacaggauauuuuaauccuuacagauuggugcuuuaugaauuacugaccucuuuugcgcuuucaaguaucaagagccuguuaaauuugaauuaauuauuauuuugcauaauauucauuacaauguaucauacauucuuuuuugaagaacaguccuauauuagaauguuacuugucuccuccucccaaaguuauuuguaccccaagauaugguuuuuauuguuggccuuaaaaaaaaaguuugcuuuuuuccuguauauuuuucuucauuuaguacauauauauuauuguuuuauucuccugugcauuuuagguuuuaccauuacccaaugugccuuuaaauauaguuuuauuauuuaauugaagguacacauuccauccguggaagaaauugcagccagcuuuaagauuuuaaauguuuuuguguaaaaaaccuuuuuauuuuguaauuaauauuuauuuuaaaaacuugaaaauacagacaaguaaauaaauauaagacaaaaaucauucauaaucuuauucagguucauccagguuuuuuucuguguauuuuugcuuauaguauaugcuuacaaaaaaguugaaucguuuucgcuuauauuuuuucuuugcuuuuggaacuuacacagcaucuuuugcgagucaauaaauuguguuucugcuguauuuuuaauagauacuuagucuguaauacaaaacaugagauucaacaaacuguaaauuuaauuaagcaacccuuugugguugaagggccuaguuuggugucuggcauuuaguauacacugcuagcaucuguguaaaagugugugaacauuuuggaagcuucaauaaauacauugugugaaauuguccucuggaaguuacacuguauuagcuauaugugagauugcucauaacccuauauuauguuagguacacuguguuacccuuaaaaaacuuugcuauucuuucuaguaaaaaaaaaaaaaaauauuaaaauguuugaaagaguuugaguacugguaagguuaauuauuuuaaaguuuguuuuuugaagauuauucauguauguuaauugaccuuccauaucuguuuauuuuaauauuauaauuuuuuuuacaaaguguuuuauguuagagaucauauuauuuugucuuguauauuugcuguguguguuuuuucccauaauuuaacauuugguuuuuaauuuuguuacgucuucauagcuuuuguuguugggauucuagcagguuaauuuuuuguaaugcagaaguuuacauuuucgagguaauuuacacaaaugcucuuuauuguuucugccuuugaugcugugcaaagaaaaucuuuauauuaaugcacuuuuuuuuuuuagugcuuuggaaguucguuuuuaaaaaccuuguuuuucuuuuuaauuuuaaaagcauuaaaacuuacaaacagguugcaggaauaguacaaaagaacucuuccuucccuaaaccauuugagaguaacuuaccaauauaauaugcugucaccccugaauacuucagaguuucccauaaagaaggauacucucuugggaauauacaauaugccgucaaaauaaggaaauuaacagcgauacauuauuacucucugaucuuuggaacccauucauguuuuuguaggcauauucuuuauagcaaaagaaucacaaacugcauuuugacucuuuggucuuuuuauuuauuuuuauuuuuauuuuuguacagagucucacucugucacccaggcuggaguguaguagcgcagucucggcucacugcagccuccaccuccuggguucaagugauucuugugccucagcgucccgaguagcugggauuacagguguacaccaccacauccagcuaauuuuuuugugcuuuuaguaaagacaggcucuugccauguuggccaggcugcucucgaacuccuggccucaagugaucugccucccucagccucugaaaguguugggauuacaggcgugagccaccccacccgggucucuuuggucuuuuuaaaucucaaaugguaacucagucuuuccccgaguuucagaaauuugaugcuuuugaauauuacaggccaguuauuuuguagagugacccccuauuuggauuugccugauguuucaucaugauuaaauacaguuauguuuuuagcaggaguaucacauaugugauucuguguucuuuuuuuugcauccuaucaguugguacauaauuucaguuuuuccuugaucacuugguuaaggugugucugucaguuuucuccacagugagguuaaucuuuuuucuuuuuauagucaguauggauuuugugggggaaguacuucauauauaaacaucuuguuccuuuugccuuuuccucacuaauuuuagcauucauugauguuucuugaccuaauuuaugacuaggauugauggcaaguagugguuuucuaauuucacccuuucuuuuacauucaucaguugacauuccacuguaaggugaagcuuucuuuacuugcugauuauuuguauuaguauggacuuaugcuauuuuauuuuaaugggucauauuccacuaaugucauuuauuuugauguucauacugucucagguuugccuggugggaccucuuuaagcuggcuucugugucuuuugaccuaucauuucagagaagcauuucucuacuucugacacaacaguauaaucuaggcucaucuuguguuauuccugcuguaguucugaaaucaccauuucucugaguaaccuugauuucuuuuuggugagaauaauauuuagaagccaaagugggugcuagguguggguuauugcuacucucagucagcauggcuaggaaauguguguuuguguguguguguauuccuacggagauacauauuucuauaaauucacaucuauuguuucuauaucuauguagaaaacugugggccaggcgcgauggcuuaugccuguaauccuagcauuuugggaggccgaagccagcgggaugacuugagguccagaguucgaaaccagccuagcuaaugaaacccugucucuacuaaaaauacaaaaauuagcugggcaugguggugcacgccuguaaucccagcugcuugggaggcugaggcaugacgagaaucacuugaguccuggaggcagagagggugcagugagccaagaucacaccacuucacuccagccugaauaacggagugagauucugucucaaaaaaaaaaauuggcugggccugcugacucacgccuguaaucccagcacuuugggagacccaggcggguagaucacgaggucaggaguucaagaccagccugaccaagauggcgaaaccccgucucuacuaaaaaauacaaaaauuagccggguguaguagcaggcgccuguaaucccacuacucaggaggcugaggcaggagaauugcuugaaccuggaaagcggagguugcagugagccgagaucgcaccacugcaccucagccugggugacagagugagacuccaucucaaaaaaaaaaaaaaauuagcugggcaugguaguggacgccuguaaucccagcuacucgggaggcugagacaggagaauugcuugaaccugggaagcagagguugcagugagccaagauugugccacugcacuccagccugggcgacagaaugagacuccaucucaaaaaacaaaaagaacaagcugugaggucacaauacuuugauucauuaugugaauauacauacacacacuaaucucuauuacuguauccaucucuauauauugaacuccauaugcucaugguaacuucuccaaaucuagcccaacaaaacaggguucauuuuaauuuuuucccccauauuuaugauucucagacagaaaccugacucuuaauauuuuuaauaguuuacuuauuugaucaaagugacccugucucacuuugucacccaggcuggagugcaguggugcaguuuuggcucacugcagccucgaccucuugggcucaagcaguccuuccacuucagcccucuaaguaugugggacuacaggcacacccaucacacccggcuaaguuuuuuguauuuuuuuuguagaguugagguuucauaaugaugcccaggcugaucuugaacuccugagcucaagugaucugccugcucuggccucccaaggugcuaagauuacaggcaugagccacuauaugggcccagccccaucuuguggcuuuaagacuaaaauaguucaaguagaaaaggagcaaagguagaccaaagaaggaauuauuuagauauaaacauuucauuagccuagaauaauuuuagaauaugguaagauaugugcccaacuuucccuucccaccugguuagucaacuuuuucaacacuauugcugaauaaucuauguuuuccauagugauuugaaauauuauuugaaucauuacuaaauuauugaauacuugaguuuguuucuggacuuuuuauguguuccuuuggugugucuauuuuuauccuggcaccacacacacuauuuuaaauuauuguggcuuuauaugcauuuuaguacaugguaagacaaauauuaucauguauuuauuuuucuagaugaacauuaggacuaauaaaagcacaauuuagacuguauuagaguuacagugaaauacuguuuuagggaugaauauauuuuuacaauauugaaucuuuccugagauagaacacacacacacacacacacacacacacacacacaguuaauugaaacauuucuuagaaugaagagauagacacuaaguuuuaaauuccugacuuauguucaugaaacauauuacucuguuuguaaaacaagucuugugucuacaaauuguucacuggcauguauuaacgagaugauaauaaggccccugauauucauauuuguaugaaagcauugaauauauuugcauuugucuauaucuaauaaauguuuauuuuugcuugacacuuuauacuaguuacuuaggugagugcuuaaauugauuuuucuuuucuggaaaauugaaucauuuugaaaagcaaaaucuugcaguucuggcuguaaaaaaauucuuuugcucuuuuugauacaucagcugauucucauuuugaaauuuucuauuugacuucucucugcugucuuuguguguucucucucuccagccccccucuccccaacccuaguuacacauucucuuacacuugguauucucuuuuucucaggaauaguaaacuauuauucauuauauuuguuucuuguggucucuccuccccugccacuccccucuucuuuuuuuuccaacauggucuugcuguugcccagccuggagugcaguggugcaauuacagcucacuguagcuucuacuucccagccucaagcaauccucccaucucagucuccugaguagcugugacuacaggcaugcaccaucaugucuggcuacuuuuguuuuauuuuuuauagagauaggaucucacuauguugccuaggcuggucuugaacucuuggauucaaacaaccccccugccuuggccucccaaaguguuggaauuacaagcgugagccaccaugccuggccucuuugugucuuuugugcuugucaacuugauauauuauuugcuuucuuacucucaacaguuccaagacucaaaggccuauuuauuugauaaggacuguggaagaaugacacuauaauaucccucauuguuauuucuuuucucuuagcuaccaaaggcagcaagcauuccaaucuaaacuuuuggaaauggcaguguauaguagcagcuuaaaauuguucaugagauuaaaaucuguaaucucacucaccaacauugccuaucucagugcuuuucuuuuuguaauauuuauuuauuuagagauagagucuuacuccaucaccccaggguggagugcaguggacaguuaugucucacgauagccucaaacugcuggccucaagcaaucaguccucccaccucagucuccugaguaacuaggaguacaggugccaccaccacaccuaguuuuuuuaaaaauauugguagaauugguagagagacagcaucuugcuauauauagcccaggcugguugugaacuccuggccucaaguuauucuucgaccucagccucccaaaaugcugggauuacugucagccacuaugccuggcccuaucucaguuuuuuguuuuuguuuuuguuuuuaauauuuauuuggcuucuggaguacucuagaugauagguauuuaauauaaucugauaagaaauugauugggagauuuuacaaaaacugauacuucagggaagguuacauugcugggcaacaugguauuaaaauaagacaggucaaauuugagaaaucugugauucuacagguuacccuacagguaacugacucaaugucucaguccuaaauuuccaggagaacaauucugguauaagcaccuggauuuagaagcuauuuucaccuagacaaacaugaguaccuaggcaccauuccauuauuagaaauugagcauagaugcuaauuucuagaaaagagagauggguuguccaggugggcaacaaguugcaguuuugaucaggcugcugcugcuggugguuuauccagcuacaaaauuccaggauacacaguuugccucuuucuccccuacccccagcuggcucccccguuauaggucaaauuuauuuauuuuuuuuugaaaguugguagcauugacauauccuggaauugugaccauuuaaauucucagauaacacaccaugugauaaucuuuuuauaggguuaugucaagaaucuuuuguauauaccaccucuuccccacagugaugaagaaacaaaggaaugcauguuaguugcaaaaagucugagugagauagacuccuagauuaacuuaucuuaugugacacuaggggcauauagaucauuuuuaagggaauauaaguaacugugaugauuaauguuuucaaauugguuuuaguuuuuugaaacuguuguugugccauguaauccauuaugguuuucuucacauaaacauuuaaauggaguuuuuuccuuuaucuaaacucuuuuuuuuuuuuugagacagugucuugcucugucgcccaggcuggagugcaguggcgcaaucucggcucacugcaagcuccaccucccaggguucacaccauucuccugccucagccucccgaguagcugggacuacaggugcccuccaccacgcccggcuaauuuuuuuuuguauuuuuaguagagacgggguuucaccauguuagccaggauggucuagaucuccugaccuggugauccaccugccucggccucccaaagugcugggauuacaggcgugagccacugcgcccggccuaucuuaacucuuaaucaaaaaauuuuuuucuuuuuuuuuugagauggaaucucacuguuucccaggcugaaaugcaguggugcgaucuuggcucacugcaaccuccuccucccgaguucaagccauucuccugucucagccucccgaguagcugggauuauagguguccaccaccgugcucggcuaauuuuuuuuuuuuuuuuuuuguauuuuuaguagaggcgggguuucaccauguuggccaggcuggucucaaauuccugauaucaggugauuugcccaccuuagccucugaaagugcugggauuacagaugugagccacugugcuggccuugaucaauuucuuuuaugccugauauaaagaagagcuuuggggcuuauuuccaauuuuauucaaauguuuccuaauuugucugcuucugcuuuuaaagcuuuaauacuuaaucuacuuauuauaacauucguuuauuaagaauuucugaaauugucaaauauauaaaacaguaagcaauaauauaacaaacaaccuguguagauucaucacccaauucuaacacaugaccagcucauagccaauuuuucauacacccccuguaguagggcugcuguaacaaaauaucacaaacugggugacuugaagcagcagaaauuucuucuuacaauuaaagaggcuacaagucugaaaucaagauaucagcuggguggauccuuuugagaacucuuaagggaaaucuguuccaugcuuccuagcuucuagugauggaugucagugguugacaguuuuuguuuuuuuguuuuuuuuuuuuuaaucacccuaaucucugcugcuaucuucacauuccauucuuccuuugucucugucuccauauggcuaucuucuuauuaggagaccagucauauuggauuaggguccugcccuacuccaucaugugaccucauccuaauuacauuugcaaugauccuuuuuccaaauaagguuacuguguaagauacuggguguuaaggacuucacauacauuucuuggggaccacaguucaacccauagcagucugccuucuggaccccccaaaauuuauguucuuuccacauacaaaauaggugugcuguaucccaguaguccccaaaacuguuaauccauuuugauguaaacucuguaaguaagucucacaucuuaccugaauauaauaaacucagaaagucccaaaucucaucuucugaaucauuggaauuggcgauggauuaagacuuugguuaauccugaagcaaaauuucuaucucugcugggcaucucugguggcucaggccuguaaucucagcacuuugggcaggcagaugaccugaggucaggaguucaagaccagccuggcuaacacagugaaacccugucucuacuaaaaaugcaaaaauuagcgagguguaguggcacacaccuguagucccagcuacucggguggcggaggaggagagucgcuugaagcugggaggcagagguugcagugagccgagacugugccauugcacuccagccuggguggcaagagugagacuguuuaaaaaaaauaauaauaacuucuauuucuaaagcugugauacauagaaaacaaguuaucuguuucugagaugcaauggugggacaggugaagaagcauucccauuccaaaagagauaaauuggaaggagaaaagggguuuaaagcagguuuguaagucugcaggacaaauuccauucaguucugagacuugaaaauaguucucuguggcuugauauuccguucucuaggugcauugacacggccuuaccccuugguccuggauuggcagccugcccauuuuuuuuuuuucuuaugacugcuuaguuccuauuuuuuguuuuuuuuauuucuaccuuuuuaaucuuaaguacagaugcuucuugaguuaugaugagcuuacauucugauaaggcaggaguauuauuugaguccaggaguuugaggcuuuagagugugauuauugcaccugugaacagccacuucacugcagccuaggcaacauagugagaccccaucucuuuaaaaaaaaaaaaaaaagaaagaaauauaccuuauuuauuuaacaucuuggcuuagccuagucuaccuuaaacaugcuuagaacacuuacauagccuacaguugggaaaaaucaucugucuacacaguucacuggacaagcaagcauugguuguuuagucucaugauggcguggcugacugggaguuguggcuugcugccgcugcccagcaucacaagagaauauuguacugauguguaucagguuugcaucauggugguaaaguugaaaaacuguaaguagaaugauuuuaaguuggauaccaucuauagauacuuucuaguaugccauuuucauuucuuuuauuuuucauuguuauuuuauuuuauauauuuuuuugagauagggucuugcucugucacccuguuuggauugcaguggcacugucacggucacugcaacaucaaccucccggguucaagugauccuccccgcucagccucgcaagcagcagggacuacagccauaugccaucaugccuaaguuuuuuauuguuuauagugacuggguauguugcccaggcuggugucaaacuccugggcucaagcuauccuccugcuuuagucucccaaagugcugggaacuacagguguuuggcucacuggccuggccuuuaugauuuuuaaaacuauuuuucuuggguuauuuucuuagugguaguuguagggcuuacuaucuuuaucuuaacuugcuagacuguacuuaauuuuaguaagauguauaagcauaucuuuuuuuucuuaagcauaucucauuuuauugggcuucuuuuuauuguacuucacaggaaauugcauguuuuuuuucuuuuuuaccgaauugaaguuuugcggcaacccuggaguaagcaagucuaucgguuucauuuuuccaacagcaugugcucacuuagugacucuuugucccuuuuuguuaauucucauauuauuucacacauuuucauuauuauaucuguuaugguuauguaugauccgugaccuuugacguuacugugaggugaaguuaauaaauguuguauguguucugacugcuguaccagcuggcuguucccucaucucucucuacucuccuuaggccuccuuguucccuaagacacaacaauauugaauguaggccaauuaguaacccuuugacaagguacauagucaccuaagagcucuguugaagauguacaagaaaauguucuuuucauaccugcuaacaacauccauccugcagucuguggauccaggagucaauuugacauagaagucugauuuaagaaacaccuuucgaaaggcuauggcugcuauacagaggaugauuccucugauggaucugggcaaaguacauugaaaacuuucuggagagaauucaccauucuggguaccauuaagaacauuuguguuuugugggaggaggucaaaauaucaacaugaaccggaguuugaaagaaguugauucuguccugcauggaugacugagagauucaagacuuugauggagguugcagaugugguggccaauagcaagagagcuaaaauuagaaguggagccugaagaugugacugaauugcugcaaucucauggucaaacuugaauguauaucuucucauagaugaacaaagaaagugcuuucuugagauagaaucuauuuccucugaagaugguguaaacauuguugaaaugacaacaaaggauguagaauaugcccuaugcuuaguugauaaaguggcagcaagguuugagagaauaggccccaauuuugaagaaaguuuuacuguagguaaaaugcugucaaacagcagcacauacuacagagcaauguuuuaugaaaggaagagucaauugauauagccaacuuuauuguuauaaauggcugggugugguaguucacaccuuuaaucccagcccuuuuggagacaguaggauugcuugaagccaggaguuugagaccacccagggcaauauagcaagaccuugucucuacuugaaagguagugaaagugccacaaccaccaccucagugagucagaagccaucaacacugaggcaggacuuuuuaccagcaaaaagauaaagacuugcagagaacaguuuucuccuguaaagcuccauugcccucuuccacauuuugcuauuauuauaauaaacauuauaaauguuaaaaacucaacaauauguuguuaaacuuauuguuuuauguacucuaugcuuuuuuuuuuuuuuuuuuugagauggaguuuugcucuuguugcccaggcuggaguggaauggcacgaucucgucucaccacaaccuccaccuccuggguucaagcaauucucacacuucagccuccugaguagcugggauuacaggcaugcgucaccacgcucagcuaauuuuguauuuuuaguagauacacgguuucuccauguuagucaggcuggucucggaacuccugaccccaggugauccgcccaccuuguccucccaaaaugcugggauuacaggcgugagccaccccuggcuagguguuaauucuucauuauagcuuuguccuaauccuguuucauuguauuauugucacauuuguauauguuacagucuuggcaauacaauuuguagacauuguuuaauucagcuauuuaaauuaaauagauaagagaagaaugaagaagaaauaccuaaucacacugucuuacuuccuacaugguccuuaucagagcuguuuguuuuucauguagauugcaauugcuguuuggugucacuugauuuuagcuaaaauaauuuccuuuaguauuucuuuuuugucacaucuggagcaagaaaaucucuaaauuuuuauuuuaaaauguuuauauuuugccuuuauuuuugacagacaguuuugcuaguuauaggauucuugauuuacagguguuuuuuuuuuucuucuuuuuuuuugguauuuugaauauguuauuccauugccuuccggccuccauaguuccugauuggaucucagguguuaauuuuauuguauuuaucuuacauguggcaggucauuuuucuuguucuguuuuaaguguuuucucuuuauuuuuggcuuuuuuuuuuuugagacagggucuugcucaguugcccaugcuggagugcaguggcacgauaaaggcucagugcaguuauugaucuccugggcucaagccauccucucaccucagcuuccugaguagcugggacuacaggcuugcaccaucacgccuggauaauuuuuuucuuuuuuuuuuaaaguagaggugagguuuugcuauguuuuccaggcugguguugaacuccugggcucaagcaguccuccugcuucagccucucaaaguguugggauuacagaugugaguuaccacuccuagccacuuucauuauuuuuaaugugaaucucuuuguuuucaucuuauuuugaguuuguugagauuuuuguauguauaauuuuuuuaaaaucaaauuuuggaaguuuucagcacuagauuuucaaauguaguuucuaucucccuuucucuucuucugguuauugauacauauguaaauuuaauggugucccacauuuuuuucaggcuguucuuuagguuguauaaucuaaggaaaaaaccguccguuagguuauguaaucucuauugaucucuucuuaaguuugcuaauuuuuuucuucucccaauuaaaucagcuuuugagucuuuuaaauaaaauucaaacuccagauuuuccauuuguuugaggucuuugucuccuaaguccaacaucuggguacucucaaagacaguuuuucuuacugcuccuuuuuccuguguguguucuuuauuuuuuaauuuuuuuguugaauaccuauuuuagguaauauagccccucuggauaaugauucuuucuucucccugugugucuuacuguuguuuguuuggucauuuauuuguuuaaucacuuugccagacugauuuucugaagucuauuuuuccaauaguauacaaccucagauggcccugcucuaacaaauguaggacccaccuucccuccaccaguuccccauuuuuuuuagcuugaccuccuaggauugccacaccuuggggccacauaaaccacuuauuguccuuaaccucuuagccaguuacauuuucacucuuuccuuuuggagguguuuguuguuuagacacuauuuuccaaggauaucagagguuauuuuccaaucauuucuuagaggguguacaauugagcuuaugcacagucuuuugaccguuagguaugaaugugauuuuacuuugaaguuugacuuuugaggaauugccccgggucagaguaacuaacuuuucagccaguuuuugaucagagguuguacuguagcccccugagcuuuauugauugaugcauuuguauuuggcuuagggaaugcuuuuagguucgucacaaauccugauacaauuucuccccauugggugcagccuaguucaugugcacaacauucuagaaccccagggauaagugugaucccaggagggcccuucuugcugucuuucucuaguucacucuguuaaucuucuggcuguucaguuguuguacuuguuucuccuuguaacuaucguucuuguccuaauugcuaacaaguguccauuguuuuguuuuuucccucugacuuuacuuaaauuguagugaguacacuggaaaauagaauucagguacucuuuauuaguuuucuuuuuuuucuuacuuguuuuuguuugacaaaucauaauuguguauguuugcagaguacagugugauguuuucucucucacacacacacacacgcacauacacagauugugaauucuccauuauuuuugacaaaaaccuuaagcaugaacucuaagccuguuaaaaaacaaagucuguccucaggcagagcugcugaauucuuugguucuuacaguccccuuaaguguacacccucugcccuacugcucuggaacuggggaugggacgaguagccuucuucugaagagacacucuugcucuauaagaggguauugagagaagggaaggguaugauagcuucuuguuuuuccaguuuguuucucauaauuaauauggaacuuuccacucuacuaaaagcuggggcagggaugauaggacccuagcauucuuggcuuuuugugaggauggggaucugugaaugggagcuaccaggucugaguugaaucagagacacuggcagccuggccgucauaggguaaaacuauaguccuagacuagaagcugaguuggagggagcccucaucuucuuggccacaccauccagaguggaccaucugucauagggagcuguugggguggggaugcugggagcaaguugugacuuaaaugcuauagacucuuagugucauuauugagauuuaguagauuuacuuggguaaauuuuuuucuguaugucgguaggacaauuccagagacuacuugacuguuuuucaccugugaaaugguuacuucucuggggaggagaucucccauucuggauguuucaccccccuucuuuuuuuuuuuuuauaaauaaaaauuaucauauuuuuaaguuuuaugggaugguuaaguaaugauuucuauucacugucagcucuuuggaaguuacugagguauuugaggccucuuuugcauauuuuccccaaauuuugccauauagaguguuacuguuucaaugugcucuauuuuuaaauuuuuuugaucauuuguaggcaaaaaugcaugcuaaauucuuccauuguaacuaguacuuaggaauacuuuuauucagugugucuagauagguuuuguuguuauuugggauuuuacuuuuuagagguauaaaaugauguuuguaauucaguugagucugaauccuaguuuuucuuucuuuuuucucuuuuuuuuuuuuuuuuuuuuccuuuuuuugagauggaguuucucucuuguugcccagccuggagugcaauggcaugaucuuggcucacuguaacuuccaccucccugguucaagcgacucuccugccucagccuccugaguagcugggauuacaggcaucugccaccaugcccggcuauuuuuuuuuuuuuuuuuuguaauuuuaguacagacaggguuucaccauguuggccaggcuggucucgaacuccugaccucaggugauccacccaucucggccucccaaagugcugggauuacaggugugagccaccacgcccagagaauccuagguuuucaauagaggaguugaaaucauguaccuaguuagauaauuaguuuuuuuuuuuuucuguguccuuguaaauauuguugcaugguguuauuuggcaccacagugcaaagugaaugaaaccauuugguuguguugaaguugggcuagguuaugcuuuauuacuauuuagaaauuaguuucuuuuucaacauguaucaccugauuauauguaguuagacauaacuuuuuguauccucaacuuggagucugcugauuuuauucauuauacaccgauacuuacagauuguuguuuuugcaguucagucuucugucacaugaccagccaugauuuugagcugugaaaaguuaauauugcguauuaguuacuugcacauggaaaauggaagaugucagucaaaguuucucgggguguucauuggcuuuguaucucuugggcauuucugaccuacuuagcuaaaguaucuucuucuguagcccacauaugucagcuugguggggcugaaugacagccuacccguauaggauuccucacagacaguggaaaugaaugaccuaaacguugcuaauucguguagggcuguuauuugucucuuaggucccaauacccuguuucaaacccucuuagauaugauuauuuccugcagaggggaaagauaaacauuguuuuuacacccuuguuacaggaaucagucuugaugacaagguguugggaagaagaggugugguagauuguguccuggcccgccagccucagugccugggaagagucuuccugucuugcaaaguuugugagacugaugaagauaaugccuuugugaauuuuuuuaauaggacuauuuguaugucuuuguuuauauuuuucuguuuguauuguaugcaaaaauuagauuauuguccaaaaugaauucauauuuugaguuaagauagguuacuuaguauaccugaucuucauuucugaagauaauuguaaaauucugauucauguuaagaacauguaugauuuuugucuuuuuuuuuuuuaaccccaagacuugcuacauuugugaugaacaaggaagagaaagcaaagcagccacuggugcuugcaugacauguaauaaacauggaugucgacaggcuuuccauguaacaugguaaggauguuuccauuguugcacagaacugaacuugguaaauaccuuguguaacaaucauaaguuaaagacuuagauacucaaacauuaauuaugguaaacuuuauugguauaguuucuauguucacauuuacuuauuuguaauaaagauaauuuuaauaacugaauguauuuaccagagugauuuugcaauaaguggacucugguucugauguuuuauucucuguaagcuucaguuucgucuuguuuaaaauuuugguauugauuaccuauccuucgauuuguuauuaugauuaaaugagcuaaucuagguaagcuuagugcagugucugaauacaaggauucggugaaugauaguacuuccuuaccuucugugucucaagugagaaguaguguaaccacugucauucucaauauuacaauggcgacuucacaaaaacuuauuuaagauacucuuucaugccgggugcaguggcccacaccuguaaucccagcacuuugggaggccgagguggguggaucaccugaggucaggagguccagaccagccuggccaacauggcaaaaccgugucucuacuaaaaacacaaaaauuagccaggugugguggcacaugccugcaauccuagcuacuuggaaagcugaggcaagagaaucgcuuaaaccugggagguggaguuugcagugaaccgagauugcgccauugaacuccagccuggcgacaaaccaagacucugucucaaaaaaaaaaaaaaaaaaaaaaaaaagauauucuuucagcaacaaaauuucaagggcaaaaauuauuuacaacaauauauuuuacauaauagguaacaguuccaaauaaaaaguuugggaauaaucugugcacuaauuuuaagaaucagucuaugcuucacugccaguguaaguacaugcucauuuccugaguuuuuaguguguaguuauaugaaaucuguuuuauacuacuauugugaaauggaaaacgguuuuugacuuuuauaaauucucguaaugacuguaccaaauuucucaaagaugaaaguaguuuuugggguaugagaucuguauacuaauauaauuuuggaauguuaaaagugugaaaggucaaauugaaaagauggugauuagaaacuucagcguuuuguguuuuuaaaaaugaauaugcuaggcacuguggcuuacgccuguaauccccagcacuuugagagacagaggugggcagauugccugagcucaggaguucagagccacccugggcaaggugguaaaaccccaucucuacuacaaauaugaagaaauuagccgggcauggugaagcaugccuguaaucccagcuacucgggaggcugagaugggagcauugcuugagccccagaaggccgagguugcagugagcugagaucaugccacuguacucuggccugggugacagaaugaggcuccaucuaaaaaaaaaaacaaaaaacaaacaaaacgaauauuagcugggugcaguggcuaugccuguaaucccagcacuuuaggaggccaaggugggaggaucgcuugaguuaaagagcagucugggcaacauagcaagacaccucaucucuacuaaaaauaaaaacaaaauuagccaggugugaugguguacuccuguagucccagcuauuugggaggcugaggugggaggauugccugagcccaggagguuaaggcugcagugagcuuucauugcaccacugcacuccagccugggugacagaacgaaacccuguuuuuuuuuuucaaaaaaaaaaaaaaaaaaagaauauuguaacauuagguuucauuuucauuucuuccauugcuuuuuacugaaaagcacaauuuauguuuaucucgcuuauugugcugugacuuaaagcacuuagaguugcaaauuuagucuugagugaaugcauguuuuccuuguaagguuauguaaucugcauccaugggcuaaauaccaucacuucggcccuuuagaggcauggccuuuccauuuguaccugugacagauugaaaaaguaaaaugaaguguuaacugauggggugggauugagggggaagagaauguaucuuaaacuuaauaucuauuuggagacauaaaacauguguacaucuucauccuaauaugagaugugugaagaguuuguuuuaagccauaaacauaacuuuaaaaaaagaucaguugcagguuggggugaaauacacuuggucacagcuagaauaaagcuuuuuauuuucucauuuuuuucuuaggagauguuauuuucucagagcaugaaugauuggaaguaaauuuuauuugcuuauauauacagguacugugauuuuaguauaucaauaaauauacuuggcuuuuauuuucagcgcucaguuugccggacugcuuugugaagaagaagguaauggugccgauaauguccaauacuguggcuacuguaaauaccauuuuaguaagcugguaagaauuucucuuggauuuaaugaaaugauuaugauuaguuuugacaauagaaugacacuguuuuauuaaaaaaagcauauaacaguuccuuuuuccuugaguuuuuggcuggagauuguguuuagcauguucuuuauuggaaguaaauagaucuguuaauaguaauuuuaaaagauuuugcuugcuucgguguauuuguaaaggugaauauucuaaaguacucucauuuagaauauauauuaauauuaggccggguguuguggcucacaccuguaaucccagcacuuugggaggccgaggcggguggaucaccugagguugggaauuggagaccagccugaccagcauggggaaaccucgucucuauuaaaaauacaaaauuagcggggugugcuggugcaugccuguaaucccagcugcuugggacgcugaggcaggagaauugcuugaacccaggagguggagguugcagugagccgagauccugccauuacacuccagccugggaaacaagagugagacuccgucucaaaaaaaaaaaaaaaaagaaaaaaaaaaagaaaauauauaaauauugauagugaauguugguauacauuuagugaaaaaauuaaucuguaggaaacuuuauauuuuuaaggucuuuaguuaauuggauuuuuggugccaauuuuacauuuugugauuaucacuuuguuucucauuuucugcuuaauuacuauuacccauuuauuuauuuucauuuuuauuuacugggaaauaguaaaacugaaguaaggcuguuuuguaacuugcuuaaaaaccuucagaaaaauauauuuaaauacaacuuugggaauucuuuagauuuggucacuauuugcugucacacaggaucauggugauugaguuaguaacauuugauuggguguuacauauuuguauccauguuccuuugaagggucaguaugccugaagucccgaguaucuacuucucauucuuuuuaaugguagauauuaauacacugaagguuuaaggcuucuuuauuuuucuuuugguuucuaauuuuuaaauuauuauauuucccuugugaauggggcuauuucuuuugaaaauaaauacuacaaggggccccuguuuuaugaaaugagcaguuuaggccucuaauauuuugguucuuguauacgaauuacuuaagaguguguaucuguguauccuuugaugcugaaugcuuuauuuuaaugacuuaacaaaaauuuugagauuauaaaauugaaaauuuuucuuccuagguguaauaagcauauugaaauacucauuuucuaaaugagagaugauauaaauaaaaaaauggauuuugaaguuugugcaaauagaauuuucuuauugcuaauuauagacaugauguuaucccauuugauaguugggaaaaauaucuguuuaauaauuuaauaagauuguauaaucuuuacauuugcauggaauuugaacuucuuuauagucauuuuuaucuaguuuacaccaauucgaugugguaccaacuuuuaaacaccucaaauaacucucaccuucauacuuaauuaugcaaugguacaaguguuuuaaacagaaaugugugaugcuuuuuaguaaugcuuugaaaagugcaugagucuaauacugacauuuccuuuaauuuuuuaauuuuuuucuuuauuugcucuaucaaauaaaaugugcaggaauuauuuauugaacugcagagauaaauuuuuagaaaacuguauaccuuaauacugaugguauaagauuaaaagucuuuuugcuuuuccuaguggcauaaaguaacacuucaaauauuuaccuuucuauucuucuagucuuggcacccuuuuuuaauacggcauuuucucuuuguauugaaacuuuuuauuuuuaagcugauguugaaaauauauaguagcuuauuugaaaauagaugaucuguuuucacacauuuuaauuaauuuacaaaaauauggcauuaauguuuagauuuucuuuuauaaugcaauggaugauauaugaauggugucuaaacuggauuauauagauugaaauagacuuaaaaauuucaguagacauuaaaaauacuuuauaguugaauugguuuaagccuaacaaaaagauuuguuuaaaaaguuuuauauacauauacauauauguauauauauuuucuuuuuuagaaaaagagcaaacggggaucuaauaggucauaugaucaaaguuuaagugauucuuccucucacucucaggauaaacaucaugagaaagagaaaaaaguaaguggauuuguuguugcuaaauuuguagcacaucuacuuaauagaauuuuuuuuugccuuuuuagauaaaauuacauucuugauaguuaaauggagacauugaaauauagaaacauuuuggcuaauaaagaguauuuaaugaaaugauagguuuaaugccauauuugugaauaugguuuuacccauugcaacugaacauuuagauuacaacuuuacugaaagcaugagggaaauuucuugcauguguuacuguggucaucuugcgaaaucuuuaggugacuucagcaauaauaguucguugcuauauauuauuaacugauuucuucgccuguaaguaauuaucagcuuuuuuccuuuauaauagaacaauuuugaaguucuauauauucuuggcuauuuuuucuuuuucaguggugcuacugguuuauuaauuuuuucuaguggcuacaugucaugucuuuuguuugagaauauuuugucuuuuaauuaaaacacuaaaagcuugccuaaauacuaaucugucuuuuucugacuugccuguuuuucccgcuuacauuuuuacuugcuuuauaggaaauacuuuuuaauaaacuaaaaaauaauacuggaaaaucauuuguacuuaauuuguucuuuaauauguucuuuaagaacauauugccauuagcugagcaugguggugggcgccuguagucccaacuacccaggaggcugaggcgagaggaucguuugaguggaggcuguagugugcugggauugugccagugcacaccagcuugggagacagagugagaccccugucucuuaaaaaugaaucuauuaugaauuguguuuaaggaagugaagauaaaaaggacauugucaaauggaaaagaauauuuuucuuacaaaguugguauaugcuaguuuuggaaauguuucugcagacuguauuuaaaauuuagaucucuuaucauuuucacauuuguaaauaugauuugguaaaugccaacaaauaauuguuuaaaaacauuuugggcugggcgugguggcucaagcuuguaagcccagcacuuugggaggcugagggagguggaggaguuugagaccagccuggccaacauggugaaacugugucucuacuaaaaauacgaaaaaaaaaaauuauucgggccugguggugguuguuuguaaucccagcuacucaggagguuaaggcaggagaaucacgcuugaacccaggaggcagagauugcagugagccgagaucaugccacugcacuccagccugggcgacggagcgauacucuugucucaaaagaaaaaaaaaauuuuugguuugaguuagugcuuuuucaagguaaacauuguagaaacuuaaguaguuuugagaguaaauucucuaucaugagugaaauaauuauaacuuagggcuguuguuuggcauuuauuuauuuauuuagagacagagucccacucuguugcccaggcuggagugcaguggugugaucucagucuaccgcaaccucugccugcuggguucaaacgauucucgugucucagccucccuaguaacucugucgcccaggcuagagugcaguggcgugaucucguguuauugcaaccucugcuucccggguucaagugauugucgugccucagccuaccuaguagcuaggauuacaggcacaugccaccaugccugucuaauuuauuuguauuuuuaguagagacaggguuucacuauguuguccaggcuggucuccaacuccuggucucaugcgauucggccucccaaagugcugugauuacaggcgugagccaccgugccuggugacauacacacacacacacacacacacacacacacacacacacacuuuuuuuagaucucaggcagcaaguaaacauguauaucuugauuucuuuuugaggugguuuuguuauaaagugacgguaguaggagccugucuuguuuauuguugauuagauugcugauaaaaaauagcagaguuaguuuaauuagcaguuuuaguaauaagcaccaugaaaguuuauuuaagcuuuuuaagucaucaacuaaggauucuuaggcagggcucauuauaaauugugaagagggaagccucacuauuaauggucuucuguucugccauuucaugcauauuaucuuguauaaaaagcgcuuacuauaugaucguauuuauuuuaagauaugcccuaucauguuauuugaaggacaguuauuaaauauguuaugguguugaaugaauauagugcugaugacuacacguauagaucuuuuauugcucugggaaugaaugaaauuuuguauuuuaagaauuuuuuguggugguugaguggaugcuagauuaaaaaacacguuuagucaaacuuguuuagcuuuaauauuuagaaguauguaaauacuauuuggauuuuacuuuucgcauauauaaguuuaauauaacuugaguuuuugcugucaagcuugaaucuguuuuuacauuuuguuuuuaauaacugagauuuacuggucaucuacaaaguaagcacacuaaaugaaggaaacauacuguaaguuuauuauuagacaugcuugcuuggcuugggaauauuugggaaaggacuuuaaaaauaugggaugauuauaagugauacuauaguuaaaagauugaguguuauagacuaucuuuuucuccuucccuccuuaccucuuuuaaguuuuuuuuucuuuuucuuuucuuuuuuuuuuuuuugucgcuuaggcuggagugucgcccaggcuggagugcaguggcgcagucucagcucacugcaaccucugccucccggguucaagcgauucuccugccucagccucuugaguagcugggauuacaggugcacaccaccacgcccagcuaauuuuuguauuuuuaguagagacgggguuucaccauguuggucaggcuggucucgaacuccugaccucgugauccaccugccucggccucccaaagugcugggauuacaggcgugagccaucaugccuggccccucuuuuaaaauuuuuauguucaguagaguugucuugaaaauaugccuagcauguuuuuaguguugcauugaaagguaacgcucauaaucaagucagacauuaguauuuuuaaaacagacaguucccaauuugaaaugguuugaauuacgauuuuuagacuguacacugguaugaaaacuaugcauuuauugugcuucuagauuuaccauggaguuaugucaggauaaacuuuucguaaguugaaaauauuguaaguugaaagcacauuuuuaacaggauauuuucagcuuaugaugggguuauuguaaggugaggagcaucuguauuguauauuaugagcuaaauuuuggugauacuguucauaagauauacauugaaccacuuucuuucugaauucuuuuaucugccuucauucuggcacauauuuuucuuuuuuuuuaaauuuacaauuuuaaaauuguuuguucguuuguuuacugaggcggagucuugcuguugucgcccaggcuggagugcaguggcucgaucuuggcucccugcaaccuccgucucccagguucaagcgauucuucugccucacccucccgaauagcugggauuacaggcaccugccaccacgccuggcuaauuuucuguauuuuuaguagggacuagcuuuggccaggcuggucucgaacuccugaccucaggugauccacccgccuuggccuccuaaagugcugggauuucaggcgugagccaccauacccugccaagaauuuuuuuuuuuuccugagacggagucuugcucuguugccuaggcuggagugcaguggcgcaaucucgguuuacugcaagcuccgccuccggguucacgccauucuccugucucagccuuccgaguaguugggacugcaggcgcccgccaccacgcccggcuaauuuuuuguauuuuuuuuuuuuuuuuaguagagaugggguuucacuguguuagccaggauggucucgaucuccugaccucgugauccgccccccgcuccccuuuuuuuuuuuugagacggagucucgcucuguugccuaggcuggagugcaguggcgcgaucugggcuuacugcaagcuccgccuuccagguucacgccauuuuccugccucagccucccgaguagcuaggauuauaggcgcccgccaacacgcccggcuaauuuuuuuguauuuuuaguagagacgggguuucaccguguuagccaggauggucuggaucuccugaccucaugauccgccccucucggccucccaaagugcugggauuacaggcgugagcuaccgcgcccagccaagaauuuaauuuuuuaaaaguaggugagcgaggugugccuguuguguugaaccgaccuccgccccccccaccccgcccccgcccccaaucccacuggcgccacgagggagauggcaggggcagggaggucuacugggauuccacaccccugccucccaugcacugcccaugggcguaaaggagagacgaggggcccguggggugaaagagaagaccaguuucauuucccaugaaugugggucccucuucugucgugacucaggccugguccaccgcauugauccuggcaucuguuucucuuuguguauuuaaaaauacuauuuaucgaaguauaaauaagugauauuguuauuuuauauuuaauauuaaauacugugguauccaaauuauuuaaaaaugaaauaacuuaauuuacaacuucauaugguuuuaggaaaaauuuaaaaauauauagccuuugcuuuucagagaagcucugugugauucaagcuguauuagcacugguuagguacuaacuguagugcgagcaaggagagaagaaaaguuaauggugaaauauggcuucgaauaagggauaguuuguuuuuucuuguuucuuuuguuuuuccuuuuuuuuuuuuuuuuuuuuuugagaugaaguaucgcucuguuacgcaggcuggggugcaguggcaccaccauagcucacugcagccuugaucuccguggcucaagggauccuccucccucagccuccugaguagcugggacuaccagcguaugccacuaugccggccaauuuuuuuuuuuuuuuuuuuaaauuuguagagacgaggucucccuauguugccuaggcuggucucuaacaccugcguagaagcaauucugccuuggccucccaaagugcugggauuacaggcguuagccaccacccaggcugauuaaaggauguuucugcaaaaauugaaaauuugguauauauuuuaaaaggaaccagagcauauauuuaaaaucaauuaaagcugugccuaucaggauuaaauucagucacuaagaguucaaauugugaauuauuauuuuuguagaaugccuucuaauauuuguuaugccuguuaauguuaguuaauguugauuaguaaaaggaaagcaugcugcuguucuauaaguucacuuuuggcaacaaacguguggguuauuuucuacgccaauuaaucacccaauucucuguggacaccaaguggguauccuacaauucaguucugauauuacccagaguuagugcagaucccauagauacugggucccacgagacugcccccacuucagaggccaguugcaagucccagauugucaccuguacuuuucaccaacugguuauaaauuggggguuccacacaaccuucuccuuagauuagguaauuugcuagaauagcucacagaacuccagaacacuauuuuuuauuacuuauguauugugaaggauacagcucaggaacagcuggauggaagagacacauaggacaaguuauggggagguagguagagcuuccaugcccucuccaggugcuccacccacacagcaucgguuguguucacugaucaggaagcucuuagaacuucauuguuaagauuuuuucuggagguuucccauuauguaggcacaauuuauuaaaucguuggucauuggugauugaauucaaccuccagcccuucaccccucaacagagguaccgggguaggacuuaagguuccaaaucucugaucacaugguugguuccucuggugaucagcgucuauccuccaagauuuaccuuauuaguguaaacucaaguaugguugaaaggggcuuauuaugagcacuaggggaauucaaagaguuuuacaagcucugugccaggaaucugagaauaagaccaaauauuauaacaaaaaaugcucuuaucaccccaucacucaggacaucaaaggauuuuuagaaguucugugccagaaacugggggcagagaucaaauauacacacaaagacacacacacuuauuauauaugucacaacuguaaaauagaguuuuauuuuccuucaguaacacaagugauacauagaaugaacaguugauuugacuagucaaaaucacuaggaauaaucuuuaauaaggaagucauugcugucaaaggacucuauuuguuuuuuucuaacucuuuuuauacuuguuagaaaguuuuaaaagcaccaaccucacuucuaucccacucaaucugaaaacuuuuaaaaagcccucuaagaauugugaagcuguguuuucacagagaguuuaaaugacuuguucgaaggucagugauuugcaguaacugauagugguuagaagaaaauggaguuauguugacuuuuaaucuaugguucuuuuuuuuuaauagauuuuuuuaguuuuauugaaaucuuacaugaacaggaaauuggaaauacaaucacaucaaagaacaaauugucauggcuuuugacguuuaagccaaacaaauuuuguagggcagauuucaaaauggugugaaguuauaacaauuuaaaaacacaguuaaccuacuucuaaaaaugcaaaacauacgaucauagguuauuuucaguauaagaaaacuuaaauguguuugcuuuaauuucuuaaaacuacuaagacauagcacuagcuuguauuuuuauuuacagcauacuccauacuccuauguaaucuauccuagauccaaaaaaaugaaauucuucaaaaccacagguucugcaaaaucaugacuuaacaguguguucagcuuguuuugaagcuaaaaugaagcccgaaaugauaaaaacauaacucccagaauaagggaacucuguaagcccaauaauguccaagagcauuuaugaaaagaggaaaaauaaaaaggccugaguauauacacaauagugauuucuucagcccaauacaaauggcagcaaauugcuacuuaaagaugaaacaguuaaacaaaauuuuuuuugaagaauguagaucuagagccagucguaucuugccauuaucauuuucaagcccuuacuugucugcuuccacuguugcccauaaguauccugauaaaauuccugguugucauuauuguaaccauaguuaccagaauagucaccaccuugcugaagcggcugcugagcgauggguugagagacccaguucuguuguuuguuggucugacgaugcuuggaaucagguugguuguaagcaucugccuucucuugcguccuacauuguccccugauugcccugagauccacgggaaccacggccacggccucucugcuguugugcaggacccccucugccaccccuacagccucgugguggucccaaaggugcccccuuuugugaauagccagcucuaccucuuggagguggugcuccccucccccuuggugguggugaagcacccugcccuccccuuccuccucuuccucuuacugcauagccaccaucauagccauaguagggaaucuucguaaccuccuugauagaugugguaaucauaacuguaguaaucuucaugccauaguaaucuggagguuagccauauccaccucucccccaaccucuaaucggaagcggcaugcgaggaggaggguguagugauaaucuucauaugcagugcuucuggaggccugucuagcagcuuggcgcucuuuccuuuucuugucuggugccuuggcuaagacuauuucaaguucuuccccuucuguuucuuugccauucauuucauccauagccauaacagcugcucgucugucuucagaaugaacaaaugcauaaucuuucaacuuauuuacucuuuggaguucuccaaauucagaaaaugacuuuuccaauauuucgucugugcccaaguuucucacaaagaauacuuuuaccuuagccaugacuucuggauaugguucuucacagggucagcccauucaacuguaacuacauuuccccauacuuuuacuuuuccagcaucuggcuuguacugcugacuugugauccucacauuuaaggaagcagaacccccauuucuucuuuuugucaucagguugaucauagagaaugacguccaccaaacccucugugacuuuacugaauucuuccagaguguuuucuuuagucuuauucuucagaauggauccaacaaaagucuguuguuugccacagaaaugcgcacuccauguuguuuaccagggcgaauuucauagcugucacaguuucacagcuuccugugcagcuuccuuuccacagaaagugguaaaugccuacccucuauucugaccagacaguggaucuaugauaagacguagaucccaaaugggacuggccuucucaaaaaggggcaccaacucauccucauauacaucucuugguauuuuaccuacaaacaccucuguuccaauucuagguugcacaccagaguacacacuguuugguggaggcccaccauacuuccucuguccugugguuacauucagaguauaaucauuucucucaagcaaggccuugaucuucacuucaucaggucccuuuguggacucuugcaccuagcuccccuguuucucucucugccuguaggucuucauaacuccacauaaaaaugcacuuuuguucugaacaugugauaagucacuuuccuugaacugcuguaguacagacagagcuccuucuuuauuaaauucccugagagcaucaauugcucuuucaucaagaucgauacaagcuaucaauccagggcagagcaggggcugguggcugggcccgugagaaccagugcaaggcauuuugaaaaugacuagaaaucucgcacgcgugccaccccccaagucuaugauucuuauguuuacauggcaaagaagcugaaggggaagcagguacgugugcagaacgggagaccaaacaugagaggcagccuucuaaucuauuccugcaagaaucaacccagccucaugaaagcugcauuaauacauucaugaggguaguagucccguaacccaaacgccuuuuaauggccccaucagcucucaauagugucacauuggcaaauuucaacaugaguuuuggcaggaacacaccacacuuaaaccauagaauaggauuacucaccucuuugaagagagcuagacuacuuucuucuguggcccucaaaggaauaaaacucucagucauaucauuggaaugacuucucuuugucuuuguaaaaguuuucuagcauugagaguuaccugguaccugcccuuuuuguguacuuuccuuuuggaauuuugugcucaaguugaaccuuucagcaucuguauaugugaagaguuaagagaggacaggucuuuucaggaacaucaguuuagaaugugaggguguguugggugagacugaagaguaugguaacaugagacuagcuaagaagaggcuaguuuaugaagaauuuauaagcaguuagaguuuuagacuucguccuugggcauugagccaggcagccaguaggauuaauuuuuuuuuuuaaacuuuugguuuuuucaauaguuucaaacuuaaaguugcaaaaauacuacaaauaauaaugcuguacuacucacucauuccaaaaauguuaacauuuuaccauauuaauguuaccauguccuucgcucuacccuccuuugcuaucucucucacucucuuucuccucuacucucuguagaaucuuucugaaccauugcaggguaaauuacaaauaacaaugccucuuuagcccaaguacuaaaguguauaguuuuaauuaaaaggggaauuuccuaaacaauuacaguacagugaucaaaaucaauaaauuaauauuguuacagauuauuaucuaaucuacagaucauauucaaauugcagccacugaugucaucuacaccaaagggggaaacauuuuucucuuccauguccaggauccaauccaagaucacaaguugcauuuagcugucaugucuauucaguauuucccaguuuggaauauguccuuauucauugucuuuugugaccuugacaucucuuaaaguccuauuucagguuaucugagguauugccuucugucuuucuuaggucuuaaaaaagggguuuguagccauacucuuuuuuaaaucuucauacagcuguuuucuaacaguggccuagauuuuaucuuucucugggagccauucuuugauuugagcauuguuugcuaucugcagagacuggaaauuuuuaaaaccagcaagucuuggcucuuuuuuuuuggucaacagucuuuucauuaacuuauuucuguacuccugcuuuuuacuauaaacaguaagaaauaauuagacugcaucuuccaccgaauaccuagaaaucuccuuguuaaauuaugcaacucauuaaauacauuuucuauuuuucauguuaccacaggcaagguugugccuaaacuuucaguuacuaauuaugaaguauucagcuucuuccaauuuucaguuaccuuuuucucacuuugguuuaagccuuuaguagcagccugcuaagggccaugagguuucuagugacaaucucuucauugcucaucaagcuuuugcugauauucuccugcaaguccugucagcuucugccuacuaccugauuccaagcagcgccugcauuuucagguuuuauuguaugggaacauccgucuccugguaacagauaaccaggaguaaucuguaaaucuguguuaguuaacuauuguaguauagcaauuuacccugaaauauauuggcuuaaaacugcaauaaacauuuauagucucacagcuucagugggucaggaauuuggauuuagugucuauuaucagauugccuucauguugucuuugauuauagucauuuaaaggccagacuaaagcugaaggaugcucucucuuuuuuuuuuuuuuuuuuuuuugagacggagucuagcucugucacccaggcuggaguacaggugugcaaucuuggcucagacucacuacaaucuccaccucccagguucaagcaguucucccgccucagccucccgaguagcugggauuacgggcuuuugccacgacgcccagcuaauuuuuguauuuuuaguagagaugggguuuugccaugucggucaggcugguuucaacuccugaccucaggugaucugccugccuuggccucccaaagugcugggauuacaggcaugaaccacugugcccugccuuuuuuuuuuuuuuuuuuuuuuuugacacagagucucgcucugucucccaggcuggagugcggugacaugaucuuggcucacuguaaccucugcucccaaguucacaaguucaagcgauugccucagccuccgcauuagcugggacuacaggugugugccaccaugcccggcuaaguuuuguauuuuuaguggagacgggguuucaccauguuggccaggcuggucuugaacuugugaccucaggugauugcccaccuuggccucccaaagugcugggauuacaggagcugccacacccagccgcuggaggauauucucuaagaugacuuacucacaugguugacaguuugguggcugccuuuuuuuuuuugcugcaugaauuuuuucuuagggccuuuugagugccaugugacauggcaccuagcuuuucccauacggacugcucuaagagcaacccaaaagcugccauguuuuuuauagccuggccucggaagucacacgguaucauuuucuuuuucugacuaaaugucuuauuuauuuuuuuaauuuauuugucuuuuuauuuguuuuauuuguuuuuaagguuuuuuugagguaagaauagauaacauaacauuugccauuuuaaccacuuugauggcauauuguuauuuuuacucucuauuggaugcauagguaagccuguucaguacggguaggcacugcacagguacaaagaucauugggggcauggaggcuuucuaccacaccuugagauuuaggcacauauccuguuucuuauuaaauuuucacccacaaguuuuagcauucacugaugagucuagccugaaauaaauaauaguugacaaaagguaauuuucuaauuguaucauugucaauaguggggaaggguggagucuacagaggaaauaaaagaguagguugaguaguagaaggauaaauguuauguucuuuggauuuagcaccaaggaagucauugaagaggaguuucaauguagaguuucaauauauuuauugguagauaaagugggugugaggaaguacagguagugagaguacuuaacucuuaagaaucucagauuugcugggcuugcguguauagucccagcugcuggagcgcugaugugggaguaucucuugagaucaggaguuaaaggcugcagugagcuaugaucaugccauugcauucuagccuugacaacagaaugagaccucaucucuuaaaacaaaaaauuaaaaaagaaucucagauuugaagacaaaagggaggaggcaggaaaaaugauacuaugucuucuucuguuuugguggggaagaaagaagagaagcauguaggugaauaacuaggucaccuggguaguagagcaaagaaacuagauguggguugaacccuaucagagauauugcuaggcagauuggguauacaaauaaggaggccaagugcguuauuuucaaaaguguuuaaaauaauggaucaugagauugaggugggauaauagauguaguggaacuagggaagggcuggaacauagaguuacaggagauauuggagcaugggccuagagggcucaguaagguucaagaauaaguauaguaagagugugaauuaacugcaagguuaugaagaaagaguagaucauugugguuuaauauuucauugggauauguugggugauggcagcuuccagguguuggaagacaguucuccaugguucucacauuuauacacaucuugugaguggcagcccugacugccuuuguucuuuucaagguuguuuauguuguuuauauagcaagcaaacagccuuggaaaacagaggcacuaucauucaaauuucuccuguaauucaguccacuguguguauaaaugucaucuugccccaggucacccugucagaauggggaacuuaggcaaaugcuaacagucuggcuuuugcuauugccacgaguauuaaaguccucuguguccaaugcaggagucuugugucaucuucuaccagcaucuaugaaacuguggugaacuaacuugucacuuuacaaguacaguaagaucuuagacucuuuguaguuuuugacaccaagaugugguuuuaggcauacugaaggagagucugaaugaaagccauugaaauugagaauauuugaggacugugcgaguuguucauacaguuggccuuaacucgcuagcacacccacccacucuugugguccagggauguugggauacugugguucaaggucuuaccaagaucacauguagcaggaaagaguugccuaaagaaaaguacgucgggcgcgguggcucaagccuguaaucccagcacuuggggaggccgaggugggcggaucacaaggucaggagaucgagaccauccuggcuaacauggugaaacccugucucuacuaaaaaauacaaaaaaaaauuagucgggcaugguggcgggcgccuguagucccagcuacucggaaggcugaggcaggagaauggcgucaaccugggaggcggagcuuguagugagccgagauggugccacugcacuccagccugggcaacagagcaagacuccgucucaaaaaaaaaaaaaaaaaaaaaagaaaaguaaugggcagacgaagagauaaagagacaccuauuaauaaaugauagagcuggaauuuaagaugaacuaugucugacuacgaagucccuggaauuuuuuuuuuuuuuaaauacaucuuucugccuuuacuggaggcuguauuaguccauucucacacugcuauaaaugagaaugaguaauuuaguaggaagaaaagagauuuaguugacccacaguucugcaggcuguacaggaagcauggcugggaggccucaggaaacuuacaaucaugucagaaggcgacgaggaaauaaacacaucuuuaccaugguggagcaggagagagaaaaugaagagggaaaguuugaaacugcuacauacuuucaaacaaccagaucuggugagaacucuuaucaggagaacagcaagggggaagucugcccccaugauucagucaccccaccaucagguuccccccccaacacuugcagauuacaguucaacaugagauuuaggugaggacacagagccaaacgauaucagagguaagaaucauauccccuuugaaaguuagauaaaucuguauuacaacuugaagaguuuuuuuuuugguuuuuuuuuuuuuuugguuuuaguacaaauggugaaguuuucacauguucucaaaagaaugcuaauacagaauaugccuuaucaauccucuguucuguuccaggaagcuauuauuuaacugaguaguauuugggagaauaaauuuugaagaccugcuugcuuaaauaaauaacuuguuaaaagaagauaaaaagugaaaguagaugugaauagucuuuuugaaauuuagcuugaauucagauguugaagacaaacaguaauauagugugcaucaauuaauuggcauguccaugaaauagaauguuauggcuaacugaauuggcugaggauuaacuuuauuuaauagaguuauuuuuugcaacuuguaagguugagauugcauguaaugcaaagacucauguuuaauucauguagguguuuagaauuuuauuccagcuaucuaauuauagcaucauggagaugaaguaaugauagccuauuguuuuccauuaauaauauaaauauuuauuaauguauuuaucaccuguggcaaaugaccuaguuuucauuuccauuuuuauagaugaagaauuagggacaugaagguuuaauuagauuugauaaauguuuacaaagcgucuacucaauucgagacaccaugcucaauccuugggaaaacagaauuuaaaaaucuggagagucacaaucaauauugaacaguuuguuuaaaguuuuguauuugggggcauaacaccaguagaauccgguuuauuuuuuaaaacuuuucugcuccuuucuauggccucucuuuuguauuuuuucagaaauguagcuauaagcagugagaguguuauaguagauagaucugacuuaucugagaagccauuuaacugugguauauaaucuaaucuccuacugauuguaggaugcaccuucauuuuaugugccacuaagaaaaaaucaugccaaguaaacuaugacacagcaguauuauaauacauaaccugauuuuagagauuuauuuaaauaaauaaaucucuuaggaucuauuaaacauggcaugucaaagaacuuagaguuccuuuuaacucuuucagguguugcauauacaguuaaaagauguguauaugauuguucaucacuaugguagcucauauuuagaaaccauguaaauugcccguaacagaugaauaaauuauggcacaucuguaaaaauggggcauuauguugugucucaguuucuucaucugcaucaaguugauuuuagugcuuaccucauagaguuuuuaaaacuaaauuaguuaguacauguaaaauguccuggcacauauuaacugaaaaccugguuguuuagacagaaaacacaggagcaucuuaguuauuaaccaacauuauuauuguaacacuuaugauuuagaaucaugauuuagaagacuaaugaagugcaaagauguuuuuaauauaagugaaagauacauaguguauucccaguuuugguuaggagauuuuuaggccaggcauaguggcuuaugcauguaaucccagcucuuugggaggccaaggcgggucuaagaguuggagaccagccugggcaacauggcaagaagccaucucuacaaaaaauauaaaaauaagcugggcauggugguaugcacuucuaguagucccagcuacuuaggaggcugaggugggaggauugcuugagcccaggaagucgaggccacaaaagcugagauugugccaccgcacuccugccuggaugacagagacccugucucaaaaaaauuauuauggauucauuugagaauuaguuuuucacauugugaugcuuccucucuacacaguuaggaauguaucaccuaagaaguugauucuauauagccacaauguaauuagcuuaggaaauuuaacauuaauauaauacuauuaaaaaacauauaauccauaaccaagcaucucguuguucgagcaauguccuaauugauagccaguuuaagaagaaauugauguagaagucaaguaucaaacguugcauuuaguuguugucucuuuagucuccuuuaaucuaaaauagucccagcacuuugggaagccaagguggguggaucacuugaggucaggaguucgagaccagccuggccaauauggugaaauccaaucacuacuaaaaauacaaaaacuagccgagugacguggcucgugccuguaaucccagcuacuugggagguucaggcaggagaaucacuugaacccaggaggcagggguuucagggagccgagaucacacccagccugggugacacagcgagacucagucucaaaaaauaaaacaguuaccaggauuuucuaccuuucaugacauugacauuuucuugaguucagacuaguuguuuugcaguguugcucagcugggauuugucugauuuguuuccuccugaaaagauucauguuaagcauauuugauggaaauaccacguagaugaugucuuguucucagugcauuguaucaagggacauaugauauuaguuuaucccaucauccgugauacuaaauuugaucccuugguuaaggugucgucuaccagaucuacugugaagcuuucauuucccugugagauauuacuugaggcuuugaaauuucuguuccccaauagucuuucaugcaguguguuuaauauauccauugaugaucuuugccugaaucuguuguaacuuuggugguaauaaugugaugauuuucuguuucuaucaaugcuuccauauuuauuucuuggcaugcuuugguuaugaagaacuucaucuguccauccaaacauccauccauucacuaaucucuccaguaucgaguagacucaaguuuauuuuuuuaaguucacuguguuacguaauuccuguuauuauucaucuuaaugcucagauugucccacauuuggccaaugggaguccuucaacuuggcacuugugcccuuuugaaauuuuucaacaguuuauaaaaauuuccuuaauuucuaguaaaacagaugcuguaggcuuaucuugucuucuuuucugccccagaccuugaaucagcucauuuucuaacacugguuucuuuuaguggagguagcauaucuacuuggagugugucucuguccuagaauggacccuucagcaguuugagagaucauaccaguccuucuuacuguguaccccaugcgcuuaccuguuacuggccagugcagaacucuuccugguuucagcugcguuucucaaauuggcucucagugcuuuccaguaaguacuguugacuaaauauuuagugcuuuucuugucacuuccuucuuccucaugaaugcuguuaccaugugggccuuguaacucuuuuccuuaccuccuuguauuuugggguugauggugaugcuuuuacacuugguuuuguuguguuauuccaugaguuuuuaguuuuauuaucuauuugcuuugcuuguuuguuuuuuugagacagaguuucacuuuauugcccaggcuggagugcaguggcaugauguuggcucgcugcagccucugccuccuggguucaagcaauucucuuagccuccccaguagcugggauuacaggugcaugccaugucaccuggcuaauuuuuguaguuuuaguagagacuguguuucaucauguuggccaggcuggucucaaacuccugaccucaagugaucugcucaccuuggccucccaaagugcugggauuacaggcucuuugcuuuguuuuuauauuugggauucagaaaggaugagaaacuauguugcugccaccauuuucucuugcuguuuuuuguuguuguuuuuuuuuuugagauguaguuucacucuugucucccagucuagagugcaauggugcaaucucagcucacugccaccuccgccucccggguucaagagauucaccagccucagccucccgaguagcugggugaucugccugccuuggcuccccaaaguacugggauuacaagcgugagccgcugcaccuggccuuuuuuuuuuuuuuuuuuuuuuacauugcucuguuuacuccucuucugucaaaucauagcucucuucguuuuacucuuuucuugcuccucuuguacccaaauucagcacuuaaccuagccuugccuuucuggugaagcuagacuuccuuugacuuauaagacucauacuguaucucugucuuuugcauggguuuuguuguuguuguuguuuuugagauagagucucacucugucaccuaaacugcagugcaguggcaugaucauggcucacugcagccucaaccuccugcauucaagcaauacucccaccucagccucuggaguagcugguacuauaggcaugcaccaccgcugccuggcuaaguuuuuauauuuuuuguagagauggagucucccuauguugcuuaggcuggucuugagcuccugggcucaagcuauccuucucccaccuuggccuuggccuaccaguguuacgauuacaggguugagccacugcgaccggcccaugauuuuuuuauauuuucauuucacuuuuauauugucuuuauauauguauaugucuuauugucagacuguaucaugucucaaagcugaucuauauuuuuuauguuuuaauguucuuuuauagugccuaauaugauuucuuuucuuuucuuuuuuuuuuuugagacggaguuucacucuuguugcccaagcuggagugcaguggugcgaucuuagcucacugcaaccucugccuccagggugcaagccauucuccugccucagcuucccaaguagcugagacuacaggcgugugccaccacguuggcuaauuuuuguauuuuuaguagcuuuuuuuuuuaaacccugagugucaggugugagguaguagaagaaagguaguguuguugacagcuugugaguacuuaacuaauucuuguugcauucacuauaauaugguaguuguguauacauuuauaggcaauuaggaauagggaacagaaucagcagauacuaacggaguuagagauguuugcugaagucauggaaagccaucauuacuuuuuucuuccuuccucauaaggccuuaguggguguggcguucaguuucaguaagaacucuguagcaagcuaauagcuccuuuucaaaaaggaugcacuuaauagccaugucauuggggcaucaaguccaaaucuccagugggugccuguggguggaggcuuuuuugccagaggauucaguuggcaaaaucauaauucauagaaacauguagcuuaaaagcauaaugaggccugugggguuccaaagguagacaaugugcuucagcuuccuaccuagcuuccaacacaguguguggguuuugggcuacucucauaggaugcauauuuacaggauagcugacauuuaaaggaaaagcagaacguugaagugagugucauagagccccuguuauuuaaagaguucaguaagguguucagccuguuuuucgauggugggauucugaagagaccccaccauccuugacugccagaggaaucuggcguugugaaucuguuccuauacuuuccagaaacuuguugagcaggucuuugaaauuuauuggaguuuccaccaacugugcugacagaggagauaacauuacagagcuauugagacugaggcuucuaauuuaccagcuaauagugagagcuuugaaaaucacaggguagagguacugaguccugacauaccuauuuguggcaaguggcaagggaguuuaggucaccccucugggaaagcacuucagacauauuggagggcuuugacacauggauguaaacugaucuugauccuuagguaugaguguuauggcaaagaggcauuagaaauguccagaacaaccuaccaaguaccaucaguguguaguggauuuagucuguaacagcuggggcuauaagagcaauaacuaaacucacuuggcgcuaauucacuguuagcuuccugcucuuacuagccuuuuuucacuggccuugcagggcuuuuguguugagauauugcaucucuuccuaccccugguaccuuugaguccuuuaucgaagcuguggcuucccuuuguccuucuggaauccuaugcuguuucuguuggaccacccaggaaagagacaugguuuggagagugauuuacaugucucauuagcauuucuacgugcugcucuucuugguggggagaauaccuuuugcacuuauggauggguaaagauaagcauauaauacaggggauggcaaacuuuuccucuaaaggaccagauaguaaauauuuugggcuuuguggaccgcauuuagucucuaucauauauucuucuuuuugguggggggaggggggcgggggcacuaaggaauauuuuaaagaugcaacauuacucuuagcuuagguaucauaauuugcugacuucugauauaacauaucauuuccucuuauaccuucagauguccaggcaguagugaacauacaguuuaauuccccaaagaccccaccuacaaagucauguuagcuuccuuacccccugagaauccugcccacugaauccugggaucuuuuccuuucauggguccaggugggauagugaucugggugccuguauccaacagagucuuaaaaacuuguguuuucuggcugagcacgguggcuuaugccuguaaucccaacauuuugagaggcugaggugggaggacugcuugagcccaggagcgugagaccccaucacuauuuaaaaaaauaaaucgugucuuuuccucuccucaaauuccauagcauacuuggaugacuacauguggccauugaggccucuuggggauagggagugcacauccccaucucuaauuauuuuucuucuuaaagcacugaggucaccuaauuguuacagugggguagaaaugaagcugacugccagauuggugaggaaguccucuccaccuaaccagaguaggcuagcugccagcacagcauccuugggcagcucuguuuaaacauaguuucuggugcuuagccuacagccaccucuucaguuucuccucauuauucaggcaauaaaaugaagacccauuaacugccuaguugaccguacaauuuuucauuuuucgacuuuccucagaucccauuaauuggccugugaggccuuuaauuuuccucuucuaaauagccauaccccuaacagcauuauauucucucaucaccaaacugucaagaacuaugaaagagguggaauagaaaaaacaaacaguuucuccugcuguaaucucacaauacagaaugcuucugugacccauaaauguauggggauuucuccccaccaagcaagcugucaguuuugcagcagacaucaucugcguuuggacacuauccaccuggagauggcaucagauuacacagguugggaacucagucccacaggacugagccucacuuuugaugcugauucuaagccccaggugcuucuguucaacugacugugacuugggguucccacagcccccuccuuggguuggauuaguuugcuagaguggcucacagaacugagggaaacccuuacuuauguuuauugguuuauuaugaaggauauuacgaaguauacagaugaagagaugaauagugugaaguaugucacuggguagggaggcagagcuuccccauccucuugggccuuuguuauaccgaguucacuggacaggcaugacugaagcauggacaccuguguagaaaugugauuggacaaagguaugaucgaacacuaauagacugaguagggaaacccaagcaggccuguauguucacacgcuucuuggccucucugugcagcauuauuuucuucuggguauuggggcagaaccccuucugaaauggggguuuuaugacccacaaucagacaagguaggucagagaauuucuuuauguccagcuccaugauagaaaaguaggggaaguuuagagcauauuuuuaguuuucauggccugucuuggggagaaaaaggagggcaggaaagguccgaaagagagagauucuguuuucugaggccuaaagcaccccauuauaacaaaggacugucauuucaccuuuguuacucugccgcuguucugaagcugcaucaggaaccaaggacaaaaggccaaauacuuuaacaaaagauacgccuguuuuuuuaguuacuuaaaaaauggcaaggacuuugggaguuuugacccagggacuguggacaaaaccaauauauguauacauauauauuauauauaauaucaaauauuauuauauaauauuuauauauuauauuauauuauauauuauauauuauguaauauaaauauuuauauuacauaauauauauuauauuguauuauauauaauauauauuauauaauauauauguauacauauauugguguauauauuacauaaaauauauauacacacacauauauguguguguguauauauauguauauaucauaauaucacagaagucuaucauuugaucuuacuuguaaaguagcuaauuaagagaugcaacuucugggucaagagauagacaacuuauuacuuagagcaauagcuguaaccagaguaucaguaauuuuuggucauuucccaagcccaguucccauagggcacugcaaagaaggccagauaaaaucuguuugugcuguguguugcauuacaggagaggagcccugagcuuagggcaccugaaucuucuguaauagacaguaagcauagcugaccuuugcuuucugucuucugaggcuauucacuauaugagcaaccuugaaaagauaauccagaauaauggguugccauugccuaacucaaaagacaugcagaaauaagagagacuuguguagcaugguuuccugacacaugaauaauucucaaauuaugauugacuuuacacaauguuuuugauucacagcuaaguccaaaagagguguccuugauugacaaacaaauucuuccaaguugugaaucaggggcuuagguuucuuccaucuugugacugccuucuuuaaaaugcugccucuauggcuuuaaugcuuauuuuuguuauccauguaaaaggaaucaguguggauacuagaaauuuggggcuauuaaggaccaggccuagaggugacacacaucauuuucauucagacuacguugauuggaacccagugcacuggcugcauguaacugcaaaggaugcugggaaaugucuaguuaccugccaaauaaaaagaaaugaguuuggcgaauaggcugucucuaccucauuuuagcccauucuuguuaauuuguauguaauuacagagaaugacagaagacagagcauuuaaaaaaugaaaguuaaaaaacaaaaucccacuccauaucucccauugagaaauagccaucacuuacuacuaaguaaauaucacagauuuuuucuaugcauagagacauagauacauacauaaaaaggauaauuagagaaaaauuauuaaauugagugaaaccuacugauguuuuaaacaccaaaggcagauuuauuuggcuguauagauggaaaagaaagagacccugucuguauagaagaacaacagcaacaaaacauagcugaauguguggugcgugccuauagucacagcuacuccggaggcugaggugggaggaugccuugagccuggaguuugaggcugcagugagcuaugaucauaccacugcacuccagccuggguggcagaaugagaccaaaaaaacuuuuuuccccccuuaccacaagaaauauuauuuccucaaagauaccuuuaaguuuaauaauagaaauuacaaaagcaaacaagacguugaagagguaagacugucuuucuaguuggggugcuuuuagcucuaagugauggaauacucaaaucagaguggcugaagcaauuggaaauuuauuacuucauguaagaucagaugcuaggcuuuucuaagauugguuaauuuaacaguagccaauucagcuguggcagagcauuguugacuuucaugugauuuuuuuggcuuuugcagucaugguugccaggacacugcaguuguucugaggaucauggucuaacacuugagcaucuaaaggcaggaagggaauaccucuuaagaaugaggagaacagcuagaaaauuucaauuucuggccuggugcaguggcucacgccuguaaucccagcacuuugggaggccgaggcgggcagaucacuugaggccaggaguucgagaccagccuagccaacacggugaaacccagucucuaugaaaaauaacaaaaaauuagccagacgugguggcggacgccuguaaucccagcuacacuggaggcugaggcagaagaauggcuugaacccggaggcagagguugcagugagcugaaaucgugccauugcacuccagccugggcaacaagagcgaaacuccguuuaaaaaacaaaaauacgaagaaguagccgggcgcgguggcucaugccucuaaucccagcacuuugggaggcugaggcgggcagauuaccuguggucaggaguuuaagaccagccuggccaacauggugaaaccccgucucuacuaaaaauacaaaaauuagcugggugugguggcacaugccgguaaucccagguacucgggaggaugaggcaggagaauugcuugagccggggagacggagguugcagugagccaagauugagccacugcacuccagccuggccaacagagcaagacucugucucaaaaaaaaaaaaaaaagaaaagaaaaauuuaacuucuauuuuauuauccugauugaaaccuauuccaggccuaaagcagucaguggcuaaagagaaucaauuucucuuaauuaccuuggacucauccauguucaccucugggcuggggaauagauacacuuuuaugaggacaugagaaggugaucaugaauuuucuuaagaaaucaggacuuugucagcaagaaagauguuuaugucuagucacuauuuggcagacuuauguuuuguuuuaauuacaugugucagauuuuauauugagcuccuacagugaaggcugcuaguaucccuauagucauuuugcuuuuccugcuauccagguuguuuuuauuuuuauguauuuauuuuuuauuuuuuugagacagagucucacucugucacccaggcuggagugcaguggugcaaucucggcucacugcaaccucugccucuccaguucaagcgauucuccugccucagccucucauguagcugggacuacuggcacaugccaccaugcccagcuaauuucaguauuuuuaguagagaugggauuuuaccauguuggccaggcuggucucgaacuccugaccucaaguaaucugcccaccucggccuuccaaaguacugggguuacaggugugagccaccgcgcccugacaggguuguuuguuuuugaagacauuucuauuuuuucagguagugacauucucuuauguaaacauaauccucauaguuguguaggcauuuguuuuguauuuaaauucguuagcugcucacuauuagucuuuuuaccacagcuauuccaguaaguucauuguuccucuuaaauuggcugaauuuuauucacuuuuuucaauaauaaguucuuaggacuuguguucucugauuucuuucauaauggagaacauuuccuuuugccuuaauuuuugaacuguaucuuggcuguauauaauauuguugggucacacuuuauuucuucuaaaaacuuaaugguccuggaauauugcuguggagaugacuaacgacaccucccucucccuguauucugcuaaguuuaacuacaguaagucuuggugcuacacagucuguaacagaauuguucagaauuuuuuuuuuccauuuucauuuuguggaauuuuauguuugaauauaccuucuguuccccauucauugaauucucugcuucagggauacacguuaucuuauguuugauuaucucuguuuuuuauaccugucagauguggucugccugcuuuaguaucuuuuuuaaaauuugcauuacugugauuauuucaagccuuucuuuuaacacuuuaacaauucuuggcaauguguauuuuccuugcuguuucuauuuuguuuacuaauucuguaaugauaccguuuuagucuuaaccuuauuacuuugguuaucucccuucuuaccuuuuccuauuuuaucaucucauucuugagcuuuguuugaacucauguuauauuuuuuauuuggcauggggacaguuuugagaaauauuuucauacucaguuauguaugcuucuagguugugauauuuggcuaucucaugcacauuagacucuguauuauuuuuugccuguaguuucuuugccauacaguuuuuaaaauguuguuuaugcuugggaggcucacuuuugacacuuauuccauuauaauuuacguaauuuuuugaauauuuucucguuuuugagacgaugguuuaagggcuauguauuuugcauuuuucugaagccugugggaaugaggggugcaguauagaagcuugggaggaggggcgcaguauaagagcuuggcuuagggcaguaugcacuuuuugguagaacuccaggcugggcucuccuuuuuaacacagugcauuauuaaaugucuugcaccagguucuauauaucucaaguguuuggguguauuuuagucuuauggggaauacccuaggauucuauuuuauuuuuuauuuuaauuguaauuuuuugagacacggucucacucugucccccaagcuggagugcaguggcaugaucauggcucacugcagccuccaccucuuggguccuccgccucaaccucccaguagcuaagacuacaaauuugcaccaccacacccaacucauuuuuuugcuuuuuguggagauggguugucauuguguugcccaggcugauguccaacuccuggccucaagugauucucucaccuaggccucccaaagcacuagaauuacaggggagagccacugcaccgggcccccuaggauuuuauguaguuaguucuuagccuugauucuuuacuuccaguuagcaccucuucacuuuucuuccucucgccuucaguuuuuccuguuucuucccugaagcuaguacuacucuuuaggcagaaaaaguaguuuaguagguaggaacauauaaaaucaccucucuucagauuugggacuuucgguuauauucucagaauuuuugggaauuaagggguaggauuaagagcugaauccuguagcucagucuagggcaauuucuacuauagaaucuaguuuacuccuugacaguuuuuguuuaaugcaugaauaucugccccugcuucccauuuugguugcuuuuggggaucauuugguugguuguuuuuuaacugguuucuguucauuuguuuucuacauugggaaaaucugugaugugauuucagcuuucucuuaagcauuuuaagauccauguuuacuuaaaauuuguuugcuuuauauuuguaaugauauuuuguguuauuugaauauaggcacucuuacuagaaauuuguucuauuucaguguaaagaauugagucauauuaaaauaacucacauguucuuuuucuuucuuauguuaugccuaaauauuaauuucuaguauugggcuuucugaugaacuugucuugaugauuagugauaaugaaauucuuucuuauauguuagcaaaucuuuuuaauaauuuacucuagaguuuuccugagagguaacuucaagcucaguauugcauucuuuguaaaauucacuuucugauuugucccagacauuucugucuaugguucacagauuacauacguacucuucaaaacucugaauuccucuuggccuuaagauaugaacuuacaaguauuaucuucacugcuccuuuaaauaguccuauaccuguucuaguuugaaaacugaaacauuggaccugucucuugguuguuugucuugcacuaaacuuaaguuaaaaacuccugcauaggcugggugugguggcucacaccuguaaucccagcacuuugggaggccgaggcaggcagaucacuugaggcccggaguucgagaccagccuggccaacaugaugaaaucccgucucuacuaaaaauacaaaaguuagccagacauggugguacacaccuguaaucccagcuacguggauggcuguaggcaugauaauugcuugaaccugggaggcggagguugcagggaguugagaucacaccaccgcacuacagccuggcaacagagugagacuguaucccaaaaaagaaaacaaaaacaaaaaaaccccucuccuguauaacugucuuuagcuucuuuacggggaaagcaguucauucuggaacuaaacccaguuuaacauuuagguucauuacagagagcaaaugaugcugcauugauuuccuugaaacuauuugguaauguuauuauuauaaacguuucucucccuuuuguuucuguccuuucuuucuuuuuuuccccuugcucuugauuuucaucaugggugccuuaccuacuuucuuuaaauuuugaaaacuuuuuuuuuuuagguuuugguuauguuuuuuuggggggguagauaagagucuaccuugugcuuguuuaagccauaccuuucuguaaaaaaaauaaacagaauuuuucucacacggcuauuuuaaggauugagauaucauguguauucauaaaauauaaacuuuuacaguucugauuuuguauugcuaauuauacauacugauucaacugagagugacguuggcugucuugaccuaacaagcagugaagauaauacuuguaaguucauaucuucaggccaaggggaauucacaguucugaagaguacauauguaaucugugaacuacacacaaagcucaucuguuaacaguuuuccgaaaucucugacuauucccuuuuuuuuuuuuuuuuuucugagacggagucucgcucugucgcccaggcuggagugcaguggcgugaucugggcucacugcaagcuccgccucucgaguugaugccauucuuuugccucagccuccugaguagcugggacuacaggcgcccgccaccacgcccgacuaaucuuuuguauuuuuaguagagaacgggguuucaccgucuuagccaggauggucucgaucucccgaccucgugauccgcccaccucggccucccaaagugcugggauuacaggcaugagccgcugcaccuggccaucugugacuuauuuuaauggccauuauaugcuugcauaaugauuuuuuuucaagcacaccucuguuguugaacaaguuguuuacauuuuucuccccauugcaaauagaaguaugauaaacuguauuuaaaucuuuguacaccuuguuagaugugaaauuacuaggucacaugguaugaguauuuuuauaguuucuaacucuuguuuuaaaaauugucagcuuggcucaguagugugugccaauagucccagauauuugggaggcuaaggcagaaggauccuuugagcccaggacuucaaggccagccuggggaaaauagcaagacccagucucuuuaagaacaaaaauaaguguucuuuauauguuuacauuuucucuaguaauguaugcaagugcucauuucccuaggcaguuauuagaucuugucauuaaaaacaaaacccaacaacuuuggucacuauauaggagaaaaauacuaccuuuaguuguuuuaauacuuggguugcauguuucuguugcuguuuacuggcucuuuuuuuuugcggggggcggggggauugcccagucauguccaauggcauauguauuuucuuauuuauuaaaaaauuuaaacagaauuaaaauacagaauuuuuaauuuuaccgucuucccaguuugguuuuuguuuuuuaaugauuuguuuuuuaauuugcauagcuaagucuguguuuucccuuucuguuuuuuuuauuuuuugggggggagguuagaaaagucuuuccuuccuuaaagucagauacuuuaaaaauacuuucuagcugacuuugauguuauuuuaauuuuuacuuaacccuuuaacccaucuggauuuuguuuuauuuugucuaagauauuuuccccuaaauuauuaaccaguucuaguaccauuauuaaguaauuuuagucuuugccuucugauuuggaaccuccucuuuaucauauacuaaauuuucauauauaauugacucuuuuccuggguuuucccuuucuuaaucuguuuaaaucaacauauguuuuuagugacagucauuagacuucuuugauucacauuugauaggcuguucauauggauauaagccaugcacaguguguuccagugaacacuuguaaugcucauugcaggauacauuucuugauguaucacagaggaccagaguucuuuauuguuccaugauuugcuuuguaugauuuuuuuacaucucuauauuguauguuuucacacauguacauguguauuuuuugccuuuuacucucauuuguuuugcaaguuguuaggguuuguuuguuuacuuuuuuguuauucaggaucauucaccauuaaauuaucucagcucuuauaaccuugaagaacaaagcccagaaugggaaguagaauauauagaguaaaggaggauagaaaggcuucuuaauuaucuuuguagggagaaaaacauugauauaacacuuaaagaccaggaucauuucaacuucauagacuagaguguauaaauuuguuauuuugguguguguaguugcccauuuucauacugcuaugaagaaauacacgagacuggguaauuuuauagaaaaagagguuuaauggucucacaguugcacauggcuggggaggccucacaauuauggcagaaggcgaaggaggaguaaaggcaagucuuacguggcggcaggcaggagacaaugugcaggggaacugcccuuuauaaaaccaucagcucucaugagauuuauucacuaucaugagaacagcacaggaaaaacccaccccuaugauucaauuaccuccuaccaggucccucccaugacacguggggauugugggauccacaauucaagaugagauuugggugaagacacagccaaaccauaucaauguauuaacuuacaaaaauccuaauauuguuauuuuaguuuuuuuaaauaaaugaggucucacucugucacccagguuggagugcagugguaugaucacaguucacugcagccucaaccuuccaggcucaagcaauccucccgccuuggcccucuuaguagcugggaccacagguuuacaccaccacacuuggcuaauuuuuuauuuuuuuuguagagauggggucucccuauguuucacaggcuggccuugaacuccuuggcuuaagugauccuccugccuuggcuucccaaagugccgggauuacaggugugagccagugugccuggccuguauuguuauuuuguuugugcuuucuuuagcucccaugacccaaucguguauucuagucugguuucaguuacacuguugcuuuaaaccacuccacgacuuuuaguggcuuauuaagcggugggcucagcagggaugauuuaucuuucuuccaugugguaucugucggguuuacucaugaggauucauuaagcugguggcuagcuggguguucaguguuggucuuauucacaugucuggcgccaggcgcugcuggcuauaggcuagaguaccucaguucacccugugaugucauucuccauuuggccucucuaugaguagaguguggaaugauucuuuacaugguggcugauaacugagguggcagagguggaagccaugaagacuucuuaaaccuccagguucuugagcuuauacaccaucacuucugccacauccuguugaguaacacaagucauaagguuaacccagguucaagggaguggagaagaggaugucuuaggaugagaagagcagugauaacccguugcagagaauauggcaugauucuuuggggagucauuaucugccacaaucaaaauaacuuuaggauaaaaauguuuccuaaaaagucugaauuagaagcaucauugggugggaagauagccgagaacacucugggcaacauagugagaccccugucucuacaaaaaguaaaauaaaaaauuagccuguagccaggccugguggcacaugccuguagucccagcuacucgggaggcugaggcugcagugagccaaaaucacaccacugcacucucaaaaauaaaaaaaauacauauaaaaaaaagccuugugugguggcaugugccuauaguccugacuacuugggaggcugaggugagaggauugcuggagccuaggagguugaggcuguagugagcugugaucguaccacugcacuccagccugagugacacagcgaggcccuguuucaaaaagaaaagaaaagaguauuauuauauuaauuuacauuuacuguugcugaaguacugacagugcagccugaaaauaucuuacguacuuagaucaggaauuaaaagcagaaaaaauggcaguauuuuggggguauuaaaguaaaacaucugucuuuaauuuguaugcauuguguucugcuuguauguaaaccuuuuuaggaugacagagauaccaaucuuucauggcuugaaaagauuaagggcccucaauggucugauuuaagcuucaugagaaauaaacaaauucgaugaacucuuuaaauaguaaauuucacacccaauacuguuucauaauguagugauucaaacaacagaacauuuugguuaaaauuaucugacauuaaguuggacuuccaauauguaauuaauuuuuuauuuuauugaauuccuuuuuauauuuagcucaucaguuuuagcacuuuauagcacacccuaacuuuaucuaaauuuuuuuguuagagauaacuaauucaucuauuuuuuugaguaaacccaggaaauaauuuuuugcuggaguuucugugccucuaguuucuggagaaauucucaugcaugguagaggaaaaucugguacuguucagaugugaagugcuauguaaacuuuaaaguacuauuuuaaaauguucacaaaaguauuuggugguuguguuguuuuguuuuguuuuguuuuguuuuguuuuguuuuguuuuguuuuguugagacggagucucacacuguugcccaggcucgggugcaguggaacgaucuuggcucaccacaaccuccgccuccuggguucaagcgauucuccugccucagcauccugaguagcugggauuacaggugcacaccaccaugcccggcuaauuuuuguauuuuuaguagagaugggguuucaccguguuggucaggcugauccuaaacuccuggccucgugauccgcccgcuucagcuucccaaagugcugggauuacaggugugagccaccaugccuggccguauuugguguuuuuaaggagaaaaaguguauauuuugcugaauguaaauguagcaaauaauuacagacuucaguuguuuauuaguauuauuuuaggcuuaucaagaauaaaaaagcugaacuuaccuaaaaagaaacucacacuaguauuacuuguuuauaaaacaacacaaugaucagaggaagugauuuuugacagaaguauuuguuaauguuuuaaauuacuaguuauaaaaaaaucucuguugcauauaugggguuauaguuaaauuaaaauuggauuuuacuuauauucguuuuuagaaauauaaagagaaggacaaacacaaacagaaacacaagaagcagccagaaccaucaccugcauugguuccauccuugacuguuacuacagaaaaaguaaguuuuaaguaucauauuuuguuuuauguaauaaguaguuauugugcugauuuucaccucuaaaaacuguuuucauucccuaacuuuucccagcuuuucaaccacauaucaggcacuuagaauucucauuucuuuuuuuuuuuuuuuuuuuuuuuuuuugagauggagucucgcucugucacccaggcuggagugcuguggcacaaucucagcucacugcaaccuccacuuaccugguucaagugauucuucugccucagacucccgaguagcugggacuacaggcgcgugccacugugccuggccaauuuuuuguaucuuuaguagagacgggguuucacuguguuagccaggauggucucgaucuccugaccuugugauccgcccaccucagccucccaaagugcugggauuacaggcaagagccaccacuccuggccugaauucucauuucuuaccuuauucuaccuucuguuuauucugugcuugucuccaaagccuguuguuaaguaaggauaacaagugggaaccaucauugagacagagaauuuuggcuguggguggacuucauucaucugagauuuugaauucuggccuugccacuuacugauugaguguuuagguuaauuaaccuugguuaacucaauuauaucauuuguaaagugggggaaauuauuaaugaaauggaaugacagaauauguguaaagcaauuagaacaguauuugguucauagugagaauuaguaaauauuaaguaguauuaggauuauuaucuugugguuaauaugaaaacagagggagacugggacagaauaaauaaguugggaagugcaguaggagaugagucuagggugagggacccauuaugcaaagcuguauaaaccaguguaaggacuuuguguuuaguuugaucgaaaagugagcuacuggagguuucugaauugagauguaacguggucugacuuagguuuugaaaggaccucuggcugcuuuguuuuggacaggcuguggaaagucagaauggaagcagggaggccauuagcaagguaugcaaucguccagagagagauggugguaaaaacagagguagugauaggugaucagauucugaauacauacaaagcccaccugacuuucuuacagauaaguuagaggcauaugagaaagagaggauccauggaugauuccaaagauuuugggucagaucacuagaagguauagagucacuguuaacaaagaggggaaagacugugggcauagcagguugaggggaaagaaaggaauucaguuugggaugugguuuuaguuuucuauugcaguugaaauuacuacaguauaccaguuuaaaacaacauaaacuuacuagucguucuguaggccagaagucuggguggacucagcuguuuccucuaauuagggucucucaaggccaaaaucaagguguuggauggucuggguucuuaucugaaagaaucuguuucuaccguucgucagguuauuggcagaaugaaucugcuuauaugcuuggucagguuauuggcaaaauuugguuccuugugauugguuguaggacugaggugcccacuucuuugcugccugucagguggggaucagcccuuggcuucuagagccucuuuuuguuuccuugugccauugucagaugauccccuccaucucauagguagcaauggcauguugaauuccucuuacacuuggaauuuuuuuuugcaucucuuuugcuuuuaguuggagaaaguucucucuuuaagcucaugugauuagauugggucuaccuggaaaguccaagauaacgucccuauuuuaaaauccuuaaguuuaauuacaucugcaaagccccuuuugccauguaauauaacauauucacagguuucagggauuagaauguggacaucuugguugaggggugcuauccugccuaccacagauacguuggcguugagauguaucuauuaauauuagacaucugaguagauaugcugacuagccaguuggauaacuagucugguauucagaaaagaggucucaacuuuggauauuaaaugugggaauuauaugcauauggaguuauuuaaagccacaagacugaaugauaccacuaagggagaagugagugcagguagagaaauaggccuuaggaggcucaggaccuccugugucgaaagaucuggaagaggagguacaaccgacaaaggagacugagaagaggcuagaguuuggaagaaaacuaacaggaugugguaugcuggaagccaaguuaaagaaagguggggauaagugaacugugucauauauuaaggacuagcccuuuuagucauuuggaggucauuacugaccuugaacaguuuuaaaguacugauugaggcaaaagccugauuggagugcuuuauagagagaaugggggagaaaagucagacaguguguguaaaugaggagcuuugcuaugaagaggagcagaagaauagguuagggaaguggagauaaugaaggguauuuuaaaaauaagauaaauuauaggauguuagguacacuaauaggaaugauucaguagagaggaggaauaaugaaaugauagaaaagacagaaauauugcuacagugauguccccuagaauaugagaagggaugggauuuuggggaaaauaucuugugauaaauccagacguuuuuugguaaaguaagaagcaaugcuuuuaguugugacgauuugaggaguauuagagauuugagugaagaaaaaaaggcaugagaugguuaacuauaauaaugcaaaagaaaauuuccacaauguuuacuaugauuucuggguagucacaguguuccaccugaagguucaugggcaagacuuaaaggugaggcagauuuacacagcuuuuuguuuuucucuauucuuguccaucucuauggacgugggcacagaguaggguuuggucagguuguuauuuuaccaucugaauacagcgaaugagugaggguaaaugccagggggguuauaaugauggaucauuauauuuaaacccaguggguagggaaaugaggacaauagaugagggauaguauauacugguucaugguuucuggugaaauuaagggauuguugaaggcugcgcaugguggcucaugccuguaguuucaguacuuugggaggcugaggcaggaggauugcuugagcccaggaguuugagaccagccugggcaacucaguaagaccucaaagauuguuggaguaguaaagagugaauuagaaauaugaagugguauuuaagaguaggauauaugaaauggagauuauugaggguuugagauuauuuaaucauaucagaaucuaggaugugaucagggcaugaggggcugcuguagggcagaagacaagaucauuggaagagaggcugucaaggaacagagagacuggagguuauaaaagauugucuagauguauacugaauucucuaagaaguaaaauaacaguaguguugaagacugacaguaauguagguacuaagguagugguuggcaagcuuuuucugucaggggcugaauacuaaguauuuuagguuuuguaggccauacuggcucuuuuuaauacucagaccuuuguugcuguagaacagaguagccauagacaauuuguaaacaagcggauguggcaguguuccagcaaaacuuuauuuauggacacuggaacuuaaauuucauagaauaguuuucacguguuaugaaauagucuucuuuugauuuuuuuuuaaaaagccauuuaaacguauuaaaaucauucuuagcuguugagcuauacaaaaacagguggaugacuagagggccuguaguuugcuguauccuacccuaaugaugagaccuaaugguugcuaaugucugguaacuugagauuuuuuugcugaaagguuuuagagaguuguagaauuaacauugaggaaugaggaaaccuaccucaucuccauacccagugauacaagagcugugggagcaaaguaacguugagauagcuacagaguaaacaguggguuucagggucgaucuaaguuuuuguuggaacaagaaucagaggagauguucagagaaaaggaugggguacauugcaccuuguucucggagcacaguggaaggcuuucagcuguugaaggagggguggcagguguggacauaauaggggagguucacaaccguguagggaugaggcaggugaggauggaccaggagucuuuugaugacugacauaaaaacagggagaaagucauuauccgauugacccugguagacuucaggcaaauaagaugaggccuugaguguuugaagagguuggguagagagguaguaugggcuucuucuugauccugauggcugguagaagccuucagucauagguuccuuuuuggggaacggugucauuuuacauugguucaccacacucuuaucuucucuugauggaaagauagggauaggucagggaaagaaaggcuguuuuacccagaacuuuaggguuccuucuagacuauauggguuuuuaaaaauuauugauauaucguaguuguacauauuuuggagguacauguaauauuuugauacauguacacaauguguagacuccaugguugaugaugguagagcacacuuaaauugaaagucaagggaacuuuaauucacuacuguaauuuuuaaaugucuguaucauguaguguuugcacaguuuuaaccuuaguuuaccaucucuuacuccuuaguaaaaaauuccguuucauuuauuucuuuauuaacuuagauuauacugccuuauauuuuuuagugcacuuuuucugugacuaaccuuuaacccuuuugcauauaaauguuuuaaaacuagaaauuagcaacaaguaucuacuucaauauuauguuauuaaugugguaucacuaucaccuuuuaaauauugcaacuauaauuuacuaguguaauauuuucacacaaaucuuugguaacgaugguaguggaccaccggugauacauaagcauuguucacuaagauuguuaucagagggaguaaaaguguaagugucuuuuccagaagccauagcucuuuguuucuaugauugggggauuuugguucuuagguaaaagaugauuagauggaacacauaggauucugugucugcaagaacuugauguacggaguccuuuaauaugacaaaacaaguagagacagcuuauguuuuuaggaaagugugguuacuccccugauuuccccaauuuauagucuuucugagcacuucaaacuaguuuccuucuucccaugguagaagaggauauugccaaggaaaaaaaggggagaugccaggugggguagcucacaccuauaauuccagcacuuugggaggccaagguggguggaucauuugaggccaggaguuugagaccagccuggccaacauggugaaacccugucucuacuaaaaauacaaaaaauuagcugggcaugguggcaugugccuauaaucccagcuacacgagaggcugaggcaggagaauugcuugaaccccagaggccgagguugcagugagccaagaugguagcacugcacuccagacugggcgacagagcgagacucugucucaaaaaaaaaaaaaaaaaaaaaaaaggugagaaagucuucguuuugaccugauagagauuugcuugcugucaauguuauuuugguaaagaaauucguagaugcuuauaagccacaguucucuuuuuaaauugacaaauugaaccucacagcuuguuaaaagcaaucuuuaacacauuaccuuucauuauuauuagaagacuuaguuguuucucagcgucauuauaaauagcucacaauuuuuaguuguuugaauuuugagguaauuuagcuuuuaaaguacagcuuuuguuuguuuuaaggaagguuuucgugcaccagagauacgugaucagguuuuugucucuuucucuuugcagcauuuuuuaaaagaggauaaaggagaaccuaauuuuaaguaaauccuuucaauuagcuguuaaauuuuguacugauuuuuaagacuuucaggagaaaauuuuugguaaaauaaguuaauuuuuauguguaauuuaaaaauuuuaauguuucuuuaaggaucaucuuuuaaagaaaucuuuagaacuuugaaguuauaaugaaauccaaguggagauuuaaucuuuuuuauugucacuuuaucucucuguucuuuccuuguauuuuuacaacacaauacaauuauauuuaaaaguuaagcuuuuuuaaaaaguaaauuuaauuuugaaggaaauacacacaaucuuaggaucauaagguauucagaagucuaauauaucauaaauauauuauacacgauacauugcacauauuuaaaauagaaacauugauaacauuuugacauauguacacauuagugaaacuaccaccacaaucacaggcaacaguuuccuugugacuucuuuuaaucuccuucucccugaguucacauccuuccccaagcaacuacugaucugcuuuuugucaguuuaaauuaguuugaauuuucuguaauguuaaaaaauggaaacauauaguauguaugcuuuuucugucuggcaucuuucagcauaauuauuuuaagauuuuuucuuguuguauguuuuaauaguucauuuuuuggcuaaccacaauuguguguauggauauacuauaauuagcuuauccauucaacaauugauggacauucagguuguuuuuaguuuugggcuguuacaaauaaagcuacuauaaauauuguauaaaucuuauaagauauauguuuuuauuucucuugcaugaauaccaaggaguggaaugguugggccacaugguagguguggcucaccaugguagguauaugcuuuuuuuguaugugugacggagucucgcucugucgcccaggcuggagugcaguggugcaaucuuggcucacugcagccucugccucuuggguuaaugcauucuccugccucagccucccgaguaacugggacuacaggcgccuaccaccaugcccggcuaauuuuuuuguauuuuuuuaguagagaugggguuucgccguguuagcuaggauggucucaaucucuggaccucgugauccgcccuccuaggccucccaaagugcugggauuacaggcaugagccaccgugcuuagcugguaucuuuuuaugugcauauuuguuauuuguuauuuuuggugaaguguuuauuaagcucuccccaccaccugcuuuuuuuuuauuggcuuguuuuguuguuauug[450 bp omitted]uuuuuuugagacggauucucgcuuuguuggcaggguuggagugcaguggugugaucucggcucacugcagucuuugccuccuggguucaagggauucucaugccucacccucccgaguagcuggaauuauaggugcccaccaccacgccuggcugauucuuguauuuuuaguagagauaagguuuaaccauguuggccaggcuggucucaaacuccugagcucaggugauccacccgccuuggccucccaaagugcugggauuacaggugagccacaaugccuggccuuagucuugcucuuuuuguuccucuucuucaguccauccauguuagaccucaauagguuugaacaaaccaucuauucguuucuuuggagcuuaccacagugaugauuguuccuugcuaguguauaaaaauccuguugaaauuucuguguuuauuuuguauccugccaccuugcuuaaacuuuuuuuugagacagucuugcucuguugcccgggcuggagugcaguggcucauugcagccuugaccucccaggcucaagcauacucccaccucagccuccugaucagcugagacuagagguacacaccaccaugcccaucuaauuuuuucuuauaauuuuuuguagagauaaguuucgcauguugccuaggcuggucuugaacuccugggcuuaagccauuugcccccccuuaacccaccaaagugcugggauuacaggcgugagccaccaugccuggccacuuuaauuuuuguuugcuuacauugggcuuaauuggcucuucuuuuucuacuauuuugaagauuaaggccaggcacgguggcucacgccuguaucccagcacuuuaggaggcugaggcagguggaucacuugaggucagggguuccagaccagccuggccaacauggagaaacucuuucuguacuaaaaauacaaaaauuagccgggcaucguggugcaggcccauagucccagcuacucgggaggcugaggcaggagaagcacuugaaccugagaggcggagguugcagugacccgagaucucaccacugcacuccagcgcgggugacagagcaagacuccaucucaaaaaaaaaaaaaaaaaaaaagccaggugugguggauccccugaggucaggaguucaagaucagccuggccaacauggcgaagccccguaucuacuaaaaauacaaaaauuagcuggguauggugccggacgccuguaaucccagcuacucaggaggcugaggcagggaaucacuugaacccaggagguggagguugcagugagccaagauagcgucauugcgcucuagccugggugacaaucaaaacucugucucaaaaaaaaaaaaaaaaaaaaaagauuauuguucuucuaucuucuuuucuaauauauucauucagugcgauaaauuccucuuuaaaugcugcuuucccagcaucugacaaauuuuuauguuuuauuuucauuuaguuccauauauuuuaaaauuucucuuuauauuucuucuuuuacuuauauguuguuuagaagugucuuguuuaaucuccauguguuuuuggauuuauggccaccuuucugguauugauuucugguuuaauuucacuguggucugagagagcaaggcacacuguaugauuucuauucuuuaaaauuuguuaagguguguuuuauggucuagaaugugguccaucuugguuaauguuccauguaagcuggagaauagaagaaugugucaucugcuguuguuggacgaaguagucuacagaugucaauuauauacaguugauugauaguacuguugagcucaacuguguccuuaacugauuuucucacuaguguaucuguuaauuucuggcugcaguaucaauuucuaucaguuuuugcuucauauauuuugacuucuuuuguuagucacauacacauuaaggauuguuaugucuuuuugaaguauuaacaccuuuaucuuauuuuauuacucucuuuaguccugauaacuuucuuugcucugagucuguucuguucauaauauaguauuucugcuuuuugaaaauuagcauuagcacaguauaccuuucuccauuuccuuuuuauuuauuuacuuuuauauggaacgcuucacgaauuugcaugucacucuugcacagggguccuacuaaucuucucuguaucauucuaauuuuuguaugugugcugccaaagugagcacgauuuccuuuaaacucuacaugucuuuauauuuaaaguagguuuccuguagacaacauguaguugcugcuugguuuuggaucugugacaaucuuuauuuuuuaauugggguauuuagaccauugccauuuaaggugauuauugauauaauuggguuaauaucuaccauauuuauuauuauuuuucauuuuuaaauuuuuguuacuguuuuugucauucacagcuuuugugguuuuuauugaguauuuuauaugauugcauuuucuugucuuuuuuuucacccucucaucacacuuuaaguguuuuauuucacugucugcuugauugcauguuuucugaggcaaauucagauaucauucuuacacuuagugccuguguggguaagguguuuucuucuggcuuccuucguggauuuuaaucuuugagcauggagguguacuucccuuacccccuccuuuuuuugcauuuaucuuguuuggcauccucuaaguuucuuugauagcugguuuggcuacugccauuuauucgaggggaaguuuuuggacguuaugauuucaaauauugcuucuucucuuuucuucucuucccuguauucccauuuuaacuaugucauguguuuuguauaugucccagcauucauggauauuuuguuugcuuuuguuuuccagucuuuuuucucuuuccuuuucaauuuuggaaguuuuuauugucauauccucaagcuuaagagauuuuuuucuugaguugugucccacucugcugaugauuccaucaaagacauucuucauuucuguuuguuuuugaucucucuggcauuucugauuugcuuucauuaugcauauguucuugcauguugucuaccuuuuccauuaaauuccuuaucauauuaauuauagauuucaaaaauuauuggucucauaauuccaacauuccugccaugucugacuugguuucugaugguuuuucacuuuauuuaaacuguauuuuuugccuuuuguguuguuguuucaaguugaacauuauauccuggcaaagggaacugcacuauaaauaggccuuuaguuaacgugcuagugaauuguggggaacaggagaucuuauauuucuauaauuagguuucagucuuuaggugaaccucuaccccuggaaugugaacugcauaggggcuucuuaguuauuuuuuucucccucaagugggacaggaugaugguuagagucgccugagguuguacauuucccuucccuagguuaguuaggcucugacaaaaaccuccacagguuaggaucugguuaaauaguuaaauagcaggccuuguuaggaaaaagaaagcucugguuauuucaaaaugguuccuuuucccccuuuauuggagggaucucugggggacucugucuccgguauucacucugugggccugcuagagguccuagagguaaaauucacaaaagugugagggucccccaagaccaggucccccuggagguuuucuuuuucgggcuuguucacacugugccuccagcaguaucaacuaaaauaguucagguuuucuuucccugguacugguuccugcagagguuucagcugcuggauuugcuuaaguaaguuguaagucucucugugcacugauuugucuuuccuuuuuuuuuuuuuuugagacggaguuucacuccuguugcccaggcuggagugcaauggugugaucucggcucacugcaacuucugcuucccggguucaaguaauucuccugccucagccucccaaguagcugggauuacaggcaugugccaccaugcccagcuaauuuuuguuuuuguucguuuguuuguuuuguuuuuguuuuuugagagagucuugcucugucacccaggcuggagugcaauggugugaucucagcucacugcaagcuccaucucccagguucacaccauuuuccugccucagccucccgaauagcugggacuacagacgccugccaccccaccuggguaauuuuuaaauauuuuuuaguagagacgggguuucaccuuguuagccaggauggucuugaucuccugaccuugugauccgccugccuccaccucccaaagugcuggaauuacagguaugacccccaauuuuuuguuuagcaguuugcccugugaccucucaauucacugauauaagaguuggugauuuucaguuuguugaguuuuguguuuguuuuagggcagagcaaagacuucucucugcuccuuauaugcucaacgagaaaccagaauuccuaguauaggcauuuaaugauauaaacuucccucuuaaguagggcuuuaugaauuuugauauguuguguuuucauuuuuauuuaguuaaaaaaugcuuuguaugguuuuccuuuucuucuuugaccuaugaguuacuuaaaaguguguuauuuaguuuagaaauauuuggauauucacuuuguuacugauuucuaauuuaauauuuuuguguuaucauuccuuuuaaguuuauugauacuuuuuugaugcagaacauggauuaucuuguuaaacauucuauguauguguuuuuuuuuuguuugcuuuuuguuuguuuguuuuuuuuuuuugagggggagauagagucucccucuguccuggagugcaguggcacgaucucagcucacugcagccucugccucccagguucaagcgauucuccugucucagccucccaaguagcugggacuuacccagcuaauuuuuguauuuuuaguagggacaggguuucaccauguuggucaggauggucgcgaucucuugaccucgugaccugcccccucagccucccaaaguugcugggauuacaggcgugcccggcucuauguguuuuuuauaacaaugaauguguauucauuuguaguuguguggaguuuuucuguaaauguccauuaggucaaguugauuuauauuaaguuuucuauauccuuacucguuuuuugcuuguuuguucugucaguuauugugagcgguggguauuaggugcagaaacaauuaggauuuuuguaucuugaugaguaagccacuguauuuuguuaauauucuuuguugugaaaucuacuggcugauauuaauauagugaauuuagcuuucuauugauuagcuuuagcuugauguuucuuuucacaugcuuauacuuucuuugugccuuuauauuuaaaauaggcuucuuuuuucuuuucuuuuuuuuuuuuuuuuuuugagauagagucucgcucugucaccccggcuggagugcaguagcaugaucucagcucacugcaaccucugccuccuggguucaagugauucuccugccucagacuuccaaguagcugggauugcaggugugcaucaccaugccuggcuaauuuuuguauucuuaguagagacgggguuucaccauguuggccaggcugguccugaacucuuggccucaagugauccaccugugucggccucuuaaaguguugggauuacaggcgcgagccacugcgccuggccugaaguuaauuuaacuuaaaauaggcuucuuuuuuguuuguuuguuuguuuuuuuuggggggggggggguuucacucuuguugcccaggcuggagugcaauggcacgauuuuggcuuaccgcaaccuccgccuccugguuuuaagcgauucuccugccucagccuccugaauagcugggauuacagguaugugccaccacgcccagcuaauuuugcauuuuuaguagcuacaggguuucuccguguuggucaggcugaucuccagcuccuuaccucaggugauccacccuucuccgccucccaaacagcugggauuacaggugugagccacugcgcccagccaaaauagguuuuuuuaaggcagcguauagucauguuaugaguuuauucauucauuguugcaaucuuugcuuuuuaauugggguguuuagagaauuuacagauaauaugauucucugagugguuguauuuuauuauaauacuguuauuauuauuauuauuggaacagggucuugcucugucucccaggcuggagugcaguggcuugaucucggcucacggcaaccucugccuccuggguucaagcgaucucccaccucagucuccugauuagcugagacuacaggugcagcuaaucuacagguagagacaggguuuuaccauguuggccaggcuggucucgaacuccugaccuuagucgaucugccugacuccaaaaguucuggaauuacagugugagccacugcaccuggccucuguguaguugcauuuuaaucuaacauuugcuaauccuuuucuuuuugcccaucauuucucuucccuucucuuucucugucugcuguauguuugauugaacuuuuuuuaugauucaguuuugccugauuugcaauaauuuuuuguuauauuguauuguuugauuuagagaguacgguauagcgucguuagccuaucagaguuuaccuucaagcaauauuauacuaguuuacauaaaguauaagaaccuuguagcuguauacuucuccccuuuugguuuugugcuauuuuuaucacuuauuguuuuuuuacauauauuauaaaacacaauuuauuguuacuacuuuugcucuauaucaucugucuuguaaagaguuuaaaauaggccaggcgcgguggcucauggcuguacucccaaacacuuugggaggccgaagcggguggaucacgaggucaagagaucaagaccauccugcccaacauggugaaaccgcucucuacuaaaaacacaaaaauuagcugggcaugguggcaggugucuguagucccagcuacugggaaggcugaggcaggagaaucguuggaacccgggagguggagguugcagugagcucagaucgcacuacugcacuccagccuggcgacagagcaagacucugucucaaaaaaaaaaaauaaauaaaaaaguaaaauaauggaacaagucuuuauuguuuaccauuuuuacuguauuugucuguuacuccuuccuuaucucuuuucacaguuucaguuaucuucagucaacugcggucugaaaaauauugaauagaaaauuccagaaauaaauacauuauaauuugcacacuguuuugaguggugugaugagaaauuucacaucaucaucaucucucuguacuauauuuacuauuagcaaugaacauuucuaaugcucuuccuucuuuuugguauauucacauuucauuuauuauuugucugaaauaguucuuuuagcauuuauuguaguguuggucugcuagugauuaguucuuucugcuuuuauauccaaaaaagccuuuauuuuguauuuguuuuagaaagauauuuuauaauagcugccuguggaauucuaaguugacaguuuuuucuuuuaguacucuccuguuuucuagaucgaauguuuucagggaagauuuugcuuucauucuuaaucuuuguuuuuggaguguaagacauccuuaaaaagaaaaaagaaaagccugguuucuuguaacauuuccucuuuaucauugguuuuuaaagauaagcaauuugauaaugaacugaguucauuuacuuuucuucauauuuauuuuucuugggguuacuugagguucuuaaacuguggggguuuuuuuuuuuucaucaauuuuauaauuuuuccuacuauuauuucuucaguuuuguggggauuuuuuguucguuuguuuugauccucccauucuuuuugaguauucuaguagcauguaaauuaggcuacuuaagguuguucuacagcucacuguuuuuuuuuuaauguacucauucuuuuggugauuuauguuggguaguuuacauguuguagucucaagguuggcuugguacaaaguuugugguuuuuaugggacacuugaauaguacauuauuuuauuuuaauauuuuaaccagcacauuauguuuucuaaugguugaaggcauagcacuugccaucaccaaugcagaugacagagccuuguagacuaaucugaggcaaccauaccuuuuguaaauaaucauagcugcuguuucuuugguuacuuguuauagagucauuguuuaauuuuggaucuaguuuuaaauuuuuguuugaaguaaauaauuuuuguuuccacuuaaugcuauuguauagguauauugguguugcagcuuaucuuaggacuaauaguuggccaugaaauaaaaaugacguguauucugaauuagccuuuuaaaagauuaaguugcccguaaaucacaauguagaacaaaguaugcaguacuucagagacucucaguacagccaaauaucuaguuuuaucuccaguagaaaacaacaacaacaaaaaaagaacuuacauuuuucaguagagcaccaaaugaaguaguuggcauuuugugguccaauuuacauuaaaaauaaguauuauuauauacaagaauuacacucagagcagugagauguucauacuaugauagacauuuagaauacaaaagugaggaaacaagauuuugugaauuuagucuugggcuuacucauagugugucuuucagccaucucccaccuccuucuggucuccuuuuaccugucuucgauuuugaguugaucauuguauguuuauaauggaauucccuagugccauauugucccaacagcacauuauggaacaaguacuuuuaaaaucauuuuuaaaccuggaauuaaaauagauguuucucuuugaaugaacccugcauugccuuaguuagugucauuauguguaauuuaaaaauuguuaacaucuaaagcuaaaauucauuuuuuucacauuaagucugauuauguucugaaacguagguuuggacauuuaaaaaauguucaguuacaguuuuaauaugauuuuuugucacugaaguuugauuguuuuauucauugcucucuuuguaauacuguuucuuccaaaugucauguuuucauggguuuuuauggacagauuuauacuugaggguuugaucaaggguguucuguuaaauaagugggaaaaaugaccaucucuaauguagauugucauguggaagugaauagcguauuuccauuuguaguacucuacccaauuuucucuccauucuuuauuugauacaugagcaaaaauacaugagugaagaacaccacuguguuuucuuagaugacuuuuaaacuucacuaggucaugcaaggaucagaugugagaggaauggagaaccucaggaucaacucaaguaauuggaaaaaguauuugaaaaaugagguggggugguuuccaaauugaccugcccagcauggaaaagguucauauuucuaaaguaagccaugaaguuucaucagcuuaaauguaauugguuuguaaaaugggauuuuuuuuuuccuuuuaaacuuacuuugaaacguuuguucuuguuuguggauuguaguuuguuagaauaguggaguacuuuguuuuuaugaaauauuucuucuauuuaaugaugaauaucuguuauuggcacugagaugaugggggcuggggauggcaacagggugacagaaaagcagcaagauuugguuuuccaaacacuuaauuucuucucuuauuccucuuuuugaaauuguuuuugcuaaaaaugccagccauuuugaaacuuuauuuuauugucauguucucguuuuucauauucaucugauuguuuguguugagugguggcuguaugugggaaaauucacuuuugcauauuuucagauuuuuuucauuuuuauagcagagauuuuagauagauacaauaaaaaaguauuaacuuauccaacaaaaauuuagugccgauuauguagcaagcacuuagugaacuuuaugcugugcaugccucagauacuuuagugaacuuaauggcaacaucaaaaucuuugcccuuauggacuuuauaaaccuuugauuucaaaacauggugauuaaugugcaucugguauaauacacuuucauguagucauuuuauucaccauuauuuggguauaccuuguauuaaaaaugacugcuaaaacuggaaacuauacaagucuucaucuuuuuaccuuaacaaaugcagaucaagggaaugauugagaaccauuuuuagggauaguuauaaaaucuuaccuuugcgauauauaacuuuuuccucaacauaacaauuggaaaaaugauuucuguuucaaaucuuucuguuuuuuuuugcaaaggggcccucaccugguuuccuucaaaaguuuugcucuguccuccgcuagccuuauaaacucauggauaugguccucuaauggauuuguagcaccuuaguucccuuauugucaccuuccuguguugaauacuaaagcuuauuuuaauuucaugucuaggaaguguagacauuguuaaaaaaaaaugauguugcuugacaaaugaguaucuucaguauuacugugucacuucauaaauauaacuaauacauacuuuuacuaguuguugcaauuugauccugaaacagccaucuuuaaauuauguaggcuuuuucuuuucuuuucuuuuuuuaaaaguaauuauaauagacuuaaauuguuuuuggaugauuuucuuaggugaacugacuuauuuuuagaacagaaacuuuguguuuauucugcaaguucuucuuauuaauguggcacccauuguuuucuguaacuaaaauguaaucaacucuuuuuccuucccuuuuugaaucaaaauguuagacuuauacaagcacuagcaacaacucuauaucuggaucauugaagcgcuuggaagauacuacugcacgauuuacaaaugcaaauuuccaggaagucucugcacacaccucuaguggaaaagauguuucagagacuagagggucagagggcaaagggaagaaaucuucagcucacagcucaggucaaaggggaagaaagccuggugguggaagaaauccaggaacaacugugucagcagcuagcccuuuuccucaagguauuagugauguuuuaguuaaaauacuuguguuuaagaugguuaauaauaguuaugcuuuguaaaauaauugguuuguuuuugaacuuauaacuaauggauguucuagauuauuauaugauuaguugcuuuaguaagauuacuuuaaagauaguguuuccuauuaaauuuuuuuaauagggacuuuuucuuuccuuuuauaauaugauuugugcuuccagaguugaauuguaauuuuaauguuuaacuagauauggaauaaugcuuaaaauuggggagaaaaauaauaaaagcuggagcuuugcuuugaguucuguagaacaguccuucuuuuuguuugagacggaaucucgcucuguugccugggcuggagugcaguggccggcucacugcaaccuccgccucucagguucaagugauucuugugccucagccucuugaguagcugggauuacaggugcaugccaccaugccuggccaguuuuuguauuuuaguagagaugggauuucacauguuggccaggcuggucucgaacugcugaucucaggugauccucccgccuuggccucccaaagugcuaggauuacaggugugagauacuguuccuggugucuuuuccauaaauguuuuuuauuuauauuuccuaaacauuaaaaacaauuaagguuggccgggcgugguggcucacaucuauaauccuagcaguuugggaugcugaggugggcagaacucuugaggccagcuugggcaaugugguaagaccucaucucuacaaaaaauuuaaaaauuagcugggugugaacugggcacaguggcucaugccuguaaucccaguauuaugaggcucagucagguggaucaucugaguuuaggaguuggagaccagccuaggcaacauggcaaaacccugucucucuaaaaaauacaaaauuagccaggcaugguggcacaugccuauagucccagcuacuucagaggccgaggugggaggauugcuugagcccaggagguugaggcugcagugagcugagauugcacuacugcacuucagccugggugacagagugagacccugucuccuuggacaggcaaacaaaauuagccaggcuuggugaugucugccuguggccccagcuccucaggaggcuacagugcgaggauugcuugacccagggagguugaagcuacagugagccgugauugugccacugcacuccagccuaggcgacagaacaagacccugccucaaaaaacaaacaaacaaaaaaccaaaaacaaacaauaaaacccacuaaauaaauaaauacaaucaagguuuacauuuuuuaguagauaaacaaauacuagacaauuuuuaggggauuuacauaggucucaguaaauaaguuguugauuaauaaugcauuuguuauaaaguuugaaguuuaacagguuaacacacuaaccuguuuuccagguuuucaguguguguguguguguguguguguguguguguguguguguguauuuugagacagggccuugcuuuguugcccaggcuggagggcagucaugugaucacggcucacugcaagguugaccuccugggcucaagcauucuuccugcuucagacccucaauuagcuuuugccuccaccuuugucucccaaguagaugggaccacaagcaugcgucaccaugcccagcucauuuuuaaauuuuuuguagagacggguucagccuccugaguagcugggauuagaggcacacgucaccacccccggcuaauuuuuauauuuucaguagagucggggguuucaccauguuggucaggcuggucuugaacuccugaccucaugauccucccgcuucggccucccaaagugcugggauuacaggcaugagccacugcacccagccuaaguuucuuauaucuuagaaugguauggugggguacucauguucuuuaaagaaagaauaagcagugauggcugauuucuuuaugaaguuccaugaaaauuggauugggagaaugugagauauagauuagauuccauaugaucauuauuuugucaaauccauuuucuauuaugguagauucagcugaacaauaacaaucacuaguaugucuuaaaguuaaaacuuagaacucauaaccuaggaaacuucuuaaguucuuauuguauauugggaacauuuucaaucauaccuucaauauucaaaaaagaaguuccccuagacauuuagagucagauuauagucuuguuaggucuucuugcaugacuguggaaaggagacuacuguucuguaguccuuccucaggcauacaugagguguuugggggagaauugcggaauguugcuguggcaaaagguaggugaaauaaagcgcaucuuauaucuuaauaauuauuuaaguaauagcuugcaauuccacaguaaacauuuaauaccaucuauaaaaugacacauguuuuuaaagguaauuuuggggauaaauuugacaagucuuaauauacgaauguccuaaguguuguaguuaauuuuuuuaaacucuucucuuuaaugauuauaucaugucugcugcuuaugggaacuuuagcauccaauuuuucugucccccccaccccccaacuuuuuuuuuuuuuuuuuuuuuuaaacuacaggcaguuuuucaggaacuccaggcaguguaaagucaucuucuggaaguucagugcagucuccccaggauuuccugagcuuuacagacucagaucugcguaaugacaguuacucucacucccaacagucaucagcaaccaaagauguacauaaaggagagucuggaagccaggaaggggggguaaauaguuuuaguaccuuaauuggccucccuucaaccucagcuguuacuucacagccuaaaagcuuugaaaauucaccuggagauuuggguaauuccagccuuccuacagcaggauauaagcgggcucaaacuucuggcauagaagaagaaacuguaaaggaaaagaaaaggaaaggaaauaaacaaaguaagcaugggccuggcagacccaaaggaaacaaaaaucaagagaauguuucucaucucucaguuucuucugcuucaccaacaucaucuguagcaucagcugcaggaagcauaacaagcucuagucugcagaaaucuccuacauugcucaggaauggaaguuuacagagccucaguguuggcucaucuccaguugguucagguagggguuugccuauuauuauuuuucuccuucacucccaccaccucccuucuucugucccaaaacguuuucaacuguuguuacgauaauacuugaaauuaauaaaugacauuuaauuaaagugaaauuucucaguuuuuaaauuuucuaauggaaaauacaaaaauaucuuaaagucuuagaugauuugguguuugggaaagauguucggcacuaauuugauuuuacuuaauuaaauguaggcuaaacaaucuauuggucauucauuacuuacaaaacacuuagaauuuauuuccuauuuuuguuucaccugcacaguauuuuuuuuuuaaugcagaauuuauauuuagggugugagaguuuuuacccuuugguuuuuguuuuguuuugagcucccuuucucuaaacuucaauuuuaguaaucauuuucuaaacgacuccucacacagauacuacuugaauuacccuauccugagacauuuuuauaucagugauaaaugauuuuaauuuauggaauccagcagucacauuuuauuucaggagauaucugaaaugauuuaauuguguuuucaaauauacuucaugauuuuaccauucuuuuuauuauaagacaagugaguugauauacauuguuauucacacuauugggauguuucuguaacuugcaauuuguauuaugaauguuauuuucaguuuuuaaaaauuucuucaaaaugcaaugcauguuuuuagacagacccuuaacaguugauguuaacugaaaugucagcauuuaucuuuuaaauuucaucuugaauuuaagauaaaugguuuucaauaaauguugaaaccuuucuucuaguuuuagauuucugauuguugaaauaacaagaauuuagguaagauaaauuauuauggauuguauuuguucuauuaguugguggcaaggguagguaggaaaugguauggaaaaaugauacaauuuaaugaagaauguucauguuuauuuuauaaauacaaaauuuuagauuguuuuaauaguugugaauacacaguaguaacuucaauaaacaaacaaauaaauaaacaaauaagaaagaccaguccaagagagagaauaucauauguaaaggucagaugugagaaauaguaacaauaacugugauuuguuaugugccaguucuguuaauauuuauuuucucauuuaacaacaguuaugagauguccucauuuuacagcugguaacacugaggcuuugaaaggugaaauaagauacccaagaucacauagccaggaguuucuuuguauucagaaaugaguggaaucucuagaugcauuaaggaugguucuagagcaggauuuaucaaucuuagcguuauugacaauuuggaugggacaagucuucauguguuacccuguguauugcaggauauuuaccagaauccccagucccugcccccuacaggccaagagcaucaucacacucucccuuccuacagugggaauaaaaaaugucuccaaacauuguuuaauguguuaaauguguccagaggacuaaaacuaccucugguugaggcucacuauuuuagagggggaaaauacauguaaauuguagugagaaagaaguucauagaaaagguuuaaauacauugcauauuugaauguaugcuuuuauuuauauguuuccuuugaaacuagaagggcuuagcaguaagcccccuugucacaaaaaguaccuuuagacaaauuuagucaaaaaauugaauuucucuucauuuuuagcaagaggcguaguaaucaaucacaugaguaccuuacugagaaaauaaagccuagauuugcuuuuguggggagaccucuuuacugauuuucuguaguuuugaagcauagucugggaauuccugaauuucagaaauuacauuggaaugcuuauuugaaacacaucuucaaauuaauaaaauuaagauauugauuuacaucccugaaaauauuuuccuaucuguuacagauuuggggagauguuaggugugaggaauaguguuccucauaggaugguugcuuucagagggcaguguuugugguacuccuguggcagaaaaaaagaauucguuucucuuaccuuaccauuagguaaacauaguaauuuagggggaaauucuuguaaguauuaguucacaaaaauaaaugaccuaagaaauuuaucugccaauaaauuuuuaaaacguuguguuuaaaaauuacucuggggcggccgcacacaguggcucaugcuuguaaucccagcacuuugggaggcugagguggguggaucacgaggucaggagauggagaccacggugaaacccugucucuacuaaaaauacaaaaaaguagcccggcaugguggcgggugccuguaguccuagcuacucggagaggcugaggcaggagaauggcgugaaccugagaggcagagcucgcagugagcagagaucacaccacugcacuccagccugggcgacagagcgagacuccgucucaaaaaaaaaaaauuacucuggggcugggcauggugacuuacgccuguaaucccaguacuuugggaggccgaggugggcaggucaccugaggucaagagaucuagaccguccuggccaacauggugaaacccggucucuacuaaaaauagaaaaauuagcuagacgugguggcacgcaccuguagucccagcuacuagggaggcugaggcaggagaaucgcuuaaacccgggaggcagagguugcagugagccgagaucgggccacugcacuccagccugggagacagagcgagacuccaucucaaaaaaaaaaaaaaaaaaaaaaaaaaaaaaaaaaaauuacucugaagauauuuuaugucuuguuaaagcuauaaucauggaauaagauuauugaaaacucuuugagauauauucuuuaguuuuauguauguuaauaaacauuuuaggacuuagugcagaacauuuauugacaauaguaaaaagcguauccuuaucuagaagaggcuuggcuucaugugcugcuuuaaucauaguaaguuaagaauugcuaacugcugaugaacacuuaguaugugccacacacuguguuaagcaguuaauaagcauuaaguguuauuacucauuauauaggacaagaaacugagacagaauucucuuagguuuuaagugauggagauaugcauuuucccuggguccagagccauuuaauuagacagcucaacagauguuugcugaugagggucuaacaccacacuaguguaaugucagucauacuuuaagcaaagagaucccugaacaaauuugaaccaauaauuuaacuuucagcaauaguguuucuuauugguaugaaaaguuaauuuuuccuuuggacuaauuugaaauugagaaaucauuuaguaauugugacaacaagaagcuuccccccauauaauaaauaaguaggaaggagaaaauguauacagucauccuuuggcauccauggggacuugguuccaggaccuccugcaaauaaauacccaaguccaagaugcucaaguuccuguuauaaaacgucauaguauuuucauauaaccuaugcacaucuuccuguguacuuaaaucauucuuuucuagauuucuuauaauaccuaguaucauguaaaugcuaugcaaauaguuguuauacuauauugcuuagggaaucaugacaggaaaaaaagucuguacacauucaguacagacucaauuuuuuccuccaaauauuuucuauacaaggguguugaauccccagauguggaaucccacagacacagaagacaacuguauuauguauuacaucaucacaaguuguuuuucaugaugcuguuuuuaaaagauugacuuucuugaaugacaggucgauaauuuaguaaugucgaagaugaccuuuguaagcaccuguuguuuaaacuauaacauucacuauaauacuaacuccugaggcuaggggcuguuucugacauacaccacuguauccccacugccagcacagugcuuuggacauaguaaacguuaaacauuauuuuaagaaaugaaugaauaccauuaguugucucgugaguguaugucaugugguuagaaguaugcuguaugauuuuguacuuccccucugaguguuuauagcuaagcuguaagacauauuacuuuauuuguaaagcuuuucuuuucuuuucuuuucuuuuuugagcuggagucuugcucuauugaccaggcuagaguguaguggccugaucucagcucacugccaccucugccucccgaguuaaagcaguuccccugccucagccucccuaguagcugggacuacaggugcgcgccaccacacucagcuaauuuuuguauuuuuaauagagacaggguuucaccauguuggccaggacagucuccaucucuugaccucaugauccaccugccucagccucgcaaaaugcugggauuacaggugugagccacugggcccagcuauuuuuaaagcuuuucauguaguauuuauuuugccaguuuaugaugaaaaguauuauuaaguuggaaaagaucauggagagguugaauuguacuuugaaguaggcagaagacgaaggccaauauuaccugaaaagaaaguaaaggucuguuugagggaaaagccuaauaagaacaggaagcuuguauuuguggcacugugaaggugauguuuauaggguaggauggguucauugagagauuaaugccagacugaagaaaucaaacugauaggcuaaugaucuuuuucuuaaaauaacuauucuggcuaguuaccauuaugaaagaauuucauuaauggaaaagaaaaaaaaugcuaucucauucagcuuggcaaugcuaauauaaucucuuauuugaguacguuuaaguuucuuaggaacucuuuaguuacucucucauuugauccuuggaacagccuugugaaauaggacagcuccucuugauguuguuauuucuccuuuacaacuaggauguaaagcaggaguagagucagguucuaaugugauucccucuugaaauuauuggcuaaaagcaucaguuuuaauaguaaucaaaauucucucaugacauguucaaauuguagcagaguacauuuuuucugggaacuguagaucaaauuagaguagaagccuagaaaacaccuauaaaauguuugauucagaguucagauucuaaaauuuguauuauggauugaaguguguccugauaaauggccuguuuuauagugacuuguacaaaauggaaaauuaguguguuucuaaaagugauuucuaagaguuuuaaguuuggggcuuauagguuuuguugguuuuuugacugaacucuuuccuacguacauuuuuuuggguucugaacaguuaggcacgaggucuuuugaaacaucaaaaacaguuuuggaagaguugacaaucuguccuuuccucuucgcuauuuaucuucaccacauuacaaaaauuugauuuacuaaagugaaaguugagaacaucuuuuucuucacuaaaaccaucuuguuauuuucucugagaaaagucugauauucauuaacccauuuaugcuggagguugcgcuuuuuugugugugaaaaaucagaccuuggugaugaccuugagcaguaggauauaaauaacucccacaagcuuagguuccaguaauggaacacgaggcauaaagaacucaaauugcaagggguugaugguuuagcauucacuuccuuucuuggggcauacuguguccuuucaaaguacagguugaguaaccuuuauuaaaaauucuugagaccauaguauuuggaauuucagauuuuugggagauuuuggaauacuugcauuauauauacuuaccaggugagcaucacuaaucugaaaaucugaaauccaaaaugcaccaaugagcaugagagucaugggcgcacucaaaaaguuuuggauuuuggggcuauguuuuugguuaaauaauauccaaggaauucccaguuaucccuccuuuaaaaaaauuuuugccaacaguguuagccauaagggaauaucaguuguuuccaggauuagcaaacccagguccuuugagucacagccuugguccuaguuuuaucaauuauuuuucccucagaaagccauauagaaauuaauuucucauauucugagcagauuuugcuuuuauuaguguuuuauuccuuguucucugcacccucugcuuguucuucucguuuggguggaauaaaagaguaaggguaauaaugucuuauucauuuguuaucuuucucuuuucuuuuuuucuuuucuuuuuuuuugagaccaagucuugcucugucgcccaggcuguagugcgauggugcaaucucggcucacugaaaccacuguuuguucaagcgauucuugugccucagccucccaaguagcucggauuacaggcacgugccaccaugcccggcuaauuuuuguauuuuuaguagagacgggguuucgccuuauugggcaggcuggucucaaacuccugaccucaagugcccgccuuggccucucaaagugcugggauuacaggcaugagccaccacacccagccaucuuucucaaaaaugaaugguucaagauagugagcugaauauaacuuaaugaguuuuaugcugcuauauaagucauaauauauuuauggucauauaucaacuaaauuaucauacuuaaauugugauuuccaugugaaaauaguauucaaauguuuuugguaagcucuucccaucuaaugaaugaccuagaccuagcgugguggcucacgucgguaaucccagcacuuugggaggucaaggcaggcagaucacuugaggucaggaguuccagaccaaccuggccaacauggugaaacccugucucuacuaaagauacaaaaauuagccaggcaugguggcaugcaccuguagucccagcuauuugggaggcugaggugggaggaucacuugaacccagugagccgagcuugcgccacugcacuccauccugggcaacagagugagacuuugucucaaaaaaaaaaaaaagaucuaaagcacauuaauguaucauguugcgaaucauacuuucucccauuaaugaagccuuuuauucucagacacuuguuauacagauucauuuguaagcccuuaugucuuuuccucacucuuuguaauaacacagauacauuccacacacucccauuaagauuugugagaauucuauucuguuugguucucccccucaugucccaauuauuagcuuauaauuuuuguuuuugaaguucuagguggccuacuuaacuacacuuuuaggugaauuucccuccauuuuucuggccuaucucuuuuuuuacccuugagucacuggcaauuucuucacugauuuccuuuuuccuuccucucaacagaaauuuccaugcaguaucggcaugauggagcuugcccaacaacuaguaaguugucaaacuggguugauaacccgggccuuuugucuccucuagugcucuuucuaguauguuaugccaccucggaaccucuaaauuuuaauauuccaaaaugcaaguuuuucuuaauugaacagauacuuuucuccugcaaagauaauguacugcuuugucuuguuauagauccauauuacagucaaguuguguacaaauuuuaauuauuguuggucuuuuaauauggugcuuuuguugcagaauugugacuucaccuccuucuugaaauaauguguuuauuuuuuuaacauuuuguuuucuauucuuaauauaauuuuucaauauuuguauauuugcacuaggugguuuuuuucauuaagucuucuacauguguugaggcuuucuuauacugaagucuaggaaaugagaauauuugauaggguuagaugauauaaugagguuuuucuuuauaauaaauauuguuaagugugcccuaaggcagauuuaccuauauagauuugcauccuacagugacucacuuuuagcaagacauuacguugacauaaaugucuuuuaaaaagugauuugaaauacauauuuauuacuaaggaaauuauugucguuaugacaauauaccuuaacauaucucaauuuaguugguaauauguuggcaaguggaauacaauauuuaaaaauuuauaccauguaaaaauggagccaagcuugcaguuuuaaugauucaaacaaugauauaugauagacuuacugaaauuuuauuauacuaauucaguguauggcuauguauuucuuuuguguguuugagaaugaucuuaaccugaaguccuuuuuuccuuacuuaaaagcguucucagaguugcugaaugcaauacacaacgguaaguuuuauuagaaucuucucuagugguucguuuaucacaaagguugccuuuuguagagaaucucgauugaaagcuagcauguucuauugauuagaugaaauccagugcugcagugagucaauuguucagcaccuuagugaaaaauuuuuguagauugccaauaagaggcugauaggucaauaugguucaucaguuuggcuuuuauuguuucuuuuuaaggcaaaaugauaauaguguuuuaaguuucugaaagucuuuuuauuuuuacaaaugguuuuucuaguucuuuugagaucucucuugccagugcagguaauuauugguaccuaggggaagaauuugcuuggaaugugaauuuuauuuuuuaggguuuggguuuauuaauauauagaauacuuuaauuauuuuaccccuguauuccacauagugaauaaauggaagauagucuuuuaaauuacaucugguuugggaccagguuuuuuacaguggaguuguaucuuuugcugcauuggguucugaaaucagcauaucaggcaaauacuaucuuuguaauguaauuauagugaagauuauucuugcaaaaaauguuugaagguuucuucaguuuccccaaagaacauuccuuaauccuuugauguucaaaaauucucguuuugaggcuagugucaacuuuguugauuuucuuuuucaguuauuaacagaucucauuuguucgagacuguuuauguucgacucauuuguucaagacugcuugauuccaagcaguuuuucaauacauuuucauuaacuucaugaaaucuugcauauuuugcuaauguauuuuaauuugcagucgauuuguguugcguuuggguuuuauugucagauguuuacaguaucgacagccaacaagagacuaauggcauaaugagcaggcauagacacucuuguugccuuaaggguaggggucguuagggugggagucuuaucuuauaaguuauuuuuuauuaauuaguagauugauucauaauucuugucucccuaugcaaccugugccugcggaagcuuagauaaugaauacucuugauaacaaggagucccucaacacuagguaucuacagggaaaagggauuggcagcauccuugaaaauaaaauaaacuuguuacuguuauuugguagagaaguguaaaagcugaggauguuuaacaucaucuucaguuugcauaaguaaauuuagaauuguucuuuaauucuuuaauccugaacaucuuuagaaaauaaacuugggauuaaaagaaaguagacaucaugggagcaauguaauggauuuauauuuuucauugcaaguacaaguguaagauugacaccuagugaaugauguuuacccugugggugauugagggagagucucuuaggcuucgcuggaaaaauuuguacaguauuuucucucccccacugccccauccccaacaguuagcuuuucuuucgaaauuuuuuguguuugggguuuuguuuuuuuuuuugagacggaguuuugcucuuguugcccagguuggagugcaguggcgugauauuggcucacugcaaccuccgccuccuggguucucccagguggacuccuaaaguguugggauuacaggcgugagccacgaugcccagccauacucuuuuuacuuaccuaagauggaugguuggauuauugauuggaaucuuuuaucuuuaugaacauagucguuuacagcuauauaauuuuauuuuuuuuucuaacuuuuuauuuuuuuuuagaagcaagaucuugcuuucuuacccaggcuggugugcaguggcaugaucgaucauaggucauugcaaccuucaacuccuggucucaagugauccuuccaccucaguccccugaguagauaggacugcaggcgugcgccaccaugccuggcuaauacauuauuuucugagauuauaucagucuuuuaugauuucuuugauuaguccuugauuguuuuuucucacacuauuuucuccuugacucucuuauguacucacuuggaaaaucugcauaccuacagcuucaaguaucaccuaucaccugugcuucuuagcuucccaaaucgaugccuccaauuuagacuuuucuccugaguugcagacuuauauuucgaaaaaccuaauaagcuucauuuccguaugauacucagccaccucaaccagacuuaggcuaggaaguuaacuucaacucuacccucucauuuuccuagucaucauuuuuuuaaaaagcuuuuuucuauuauugaucaguuuaacuucuuuuucuuuuguauuuccacugccccauuugguuauguccuacauugucaucugaacuguuucagcaaacuccuaaccuucauuccauuauccagucccuuuucuagaugcuacuagaauugauggucaaucuaaagugcaaaucagaccaugucaaacugucuuacuuagagaauuuucugggacuuaugggauaacauuuauacuccuucacauggcauguggaguuuuucuucaucucguuguaaucugauucuccagucucaucccuucuucuccccgacuuuacguugcaucaauagaagcuacuuguaguuuccugauguuauacuacuaugugcaacaucucugacguagaccuuguuuguaucuguugguguggacuuccaacuuuaucuaguaaaaguagucauuaaaacuaaguguaguugcauuuacuuccugcaaaguuuuuuuuucagacucuuugauagaauuaacccuuucucucuuuuuuaauacuucuggguucucauaugugauguucuaauacuuccuccaauugauuucuacucuuucucuggacacuuuuuuuuguuuuugugaaauauaucuuagucauauuuaucucacauuugugaaacuucaaaaaaaagcuuucauuagacaguugaaacuauggauuauuuucaucauuuauucuagcaacugaugcauuucaaaauguuuugaauaggacuuuauaaaacuaaaauuuauuacuucacaaaacuuauucuggaaaaauuaauacaagugaaaugaccaaggaaagaugauuauuauuauuuuugagauggagucucacucuguugcacaggcuggaaugcaauggugccaucucagcucauugcaaccucugccuccugaauucaagcgauucuccugccucagccucccgaguagcugggauuacaggcgcccaccaccaugccuggcuaauuuuuguauuuuuaguagagacaggguuucaccauguuggccaggcuggucucaaacuccuagacucaagugauccgcaagugguccaccucggccuccuaaagugcugggauuacaggcgugagccaccgugcccagccucuuuggcuacuuuaaaccagcauuucaaaauaauauuaaaagugagaaaggccaaaacaaauguaugaaacaacucuauuacuuuagcaaagaaccaaguuacuauacugaaagaaacaagacaguccaauacaaaguuuaauucccaaagaaaauuaacauauucccaagaauauauauggaacuuauucuaggaaaauguagcaauuaacaauuuucauucauucaacaauuauggcaagccuauuagaugaugagcuaaauacugacaaaauaagaugaauaaaagccaacuucuaaaauaaauuauuaaagaaccuagaaaauacuagagcaaaaccaucccugagacauaaagaugaaaacuaggaggaggauaugcuaguuuucaacuggacuauaaaacugaacuauaaucuuuuaauacauacuacuuguuucaucauuuuuacaagcauuuaaaauacuucuauuaagugaaauagcgaaauuaaacuuacaauuuauuaagaucaugaaaucucuuaggcugcuucauuccagggcaccaccacaaaaccaaacaugaaauacaaggcacuuucuuuuauaggcaucgauuuaaaguuaauucuccauauaguauucuuuaagauauuuaaaugacuacuuucccuuuccaaacugccucaaaaguuucugaaauuuccugagacuuuuacguaauauaucuuuccuuacuuuucuguuuccuuuuuccuuuguugggacaauaauuuuaauauuauuucuucaauuuuuaaauuucuuaaauuucucugaucauaugcaguuuauccugguggaccuaaauugguguuugaaauugguuagguguuuuccuaaaguacuuugcuuuguaucaauauuauucuuaauuccuuaccugaaaacaccaauuucaaaaguuuaugaaguuauuucacauacccaaaagaaccgccuucauuaaguccuaagauccucucugagaaagaacaaaugaagacauaugcuuuaaacucaauaucuaugacuguaaauauauaauauuuccuuggggccgugcaugguggcucaugccugcaaucccagcacuuugggaggccgagguggcagaucacuugagcuuaggaguuugagaccagccugcucaacaugacgaaaccccuugucuacuaaaaauacaaaaauuagccagacgugauggugcgugucuguaaucccugcuacuugggaggcugaggcagggagaauugcuugaacccaggaggcgaagguugcagugaggugagaucgcgccacugcauuccagccuaggugacagaacaagacucugcuucauaaauaaauaaauaaauaaaguaccaaagagcuuacuuagaucaguuuucacagcaguauauugcuaauugaguuccaagucccacuuauugcacuuuuaaauucccuuuaauuaugaugcuucugguuugagacaacugcgcucacuaaacaaauaggguuuguuggaggagguaauguuaaccaguuauucauauaggugcuguaggaugaguauacguauaaaugccaguugauuuuagaggugaacauucucccucaagaacaggguucuacuuaggcuugucagacuaguuuauaagaaacugaauuuuuguccuucauaugugucccuuuuuuauuucagggaagcauuaaguggauaggauuccaugaagugggaugaguaauacucaggcucauauaauuguuccaaagccaguaucauuugagauucacuguguguaaugagauauuacugaugggggaugaguugucacugugagcaguauggagauugagaaucuagcucauucuaaauuuaauuuccuuuuaaucacaacagacauuuuuucuucuuaugaguuaguguguucuuuaugcuuauacaguaaacugucacauccuaggauacaacaagugcuacgaaguuuguuucaaugcacacaaacugugaaucacuugguaagggauaauuagguuaaaaaaaggggaagggaacuaggccuugggcguaguaaagagcugcaaagcacauugguuuaggggguugaaaugaaauucuagagaaaggcaccugaccguuaguaaaccuagaccuuagaauugcugucuugaaucagagaaaugguaaggagcuaugaugaguuugugggagacagaacacaugaugaaauaguaugaaaucuuaugggcaggguugugauuaugccuguguaggaaagaauuugacuaauuuaacacagccuuuauaauaagguaguauaagacauguacuuauagguaagacuuuuuccauuucaaaguauccaggcuauuuuguugcucuugguuccuugaagauaggcuucaaagacucuuaagggauaaacacauuuggcuggugagucccccacuggggagaaaaaguaguuuucacauuuggcuggugaguccaccacuggggagaaaaaguaguuuccaguauccauguuaacuuuuauaauggaaaaugaaucuacacucuuucauugaaacugcaagagggguggaagcugaaaaguuccaacugagugagggaagcaguacaaaugggaaugaguuguguaauaauuacuuuuaaauuaacugguaaugccauuacuacucucuuuauuuagagcacugcaauuuuuuaaauuuacauagguuucauggggauuuuaacccugaugauccacccccacacugcaccccaucauaauaucuucaguuuuucaacuugucugucauggugguuuuuaggaaguggugauuaaaaaucugaaauuaaagugugucuuuucuuuagacagaggugacaguucuacacuaacaaagcaagaacuuaaauucauagguauguaccaaacuccagcaugguucuaaacauaauaguguuaaauuaauccuauuguagcuuggaaaccuucccauacaaaccaguguuagcaguauguacucauaaaaaaaaaaugaugccugaaaggaauuaucuauaaccuugggugguaggugggaugaacuauauguucuuauuguuguaguuauuuggauuugucauauugcuucagacuugguagguagaucuuagaauuccugaaacuguuuacuuguaagggccuaggcuccuaggucugauuuugugaagaccacuuuguacaccugugucccuucucacacugagaucaggaagaauaugagaacauauuucauguuuuauaaucaugauaacucucugauucuuuuaacauauaucucaaauacucuggaucaguucagagagaacauguguauucugaacuacagagugaaauccacuacuguuaaccacuugaaguaugcauccacucauuucccuccccuacaaaccucauuuuuaacaugcugauaaagcuaauuuuauaggcugugaguaucuucaauauggcacuuuccuucuugagacugucuuagcuuuuuaucauuugacaagaauauauuagguucuuucuuuaugucuauauguaagguccugguuaguugcuuuggggaaauaaguauacugcaaaagauaaaugaugcggcacaugaguccucccuuugagaacauacacucuaaaaggaagagaaauacauauauguaauaauuucaagggauguacuuacaacuucuuuaauggucaguaggaguucaaggccagggaaaauugcuuucagcugaaggaaugagcuauucagauaauguaacguuugaccugauacuuaaagaauauguaaaauuuuguuauuuggagauacagggaucagagcuagauucuuagucugagguauguacaguuagcaugagcaauggcauagaaugagaauacacaggcuguguaaaguaauauauauauauauauauguauauauauauauauauauauauagcguguguguuuuauauauauauauauauacacacacacacacacacacauuuauauauauauauauauauauuuuuuuuuucuuggcauguuuuaccuccaagauacugauauuugauaugaaaaauaacaacauuagcuauuaguccaaggaguugaaagcaguugguguugaguuggaaaaaagauaaucaaaccuguacuuuaggaaguuucaacugguggguagcauguaaaaagauggaaaagagcuaaugcugaaacagaguaacccaauaguuuuuuguuacaaucuaaccaaauuuauugauggccugaaugaggauccuggaagucaaacugaugagauguguauuacccaagaagaacugguaaugacaguagcuggaaaggauggguauucauuuacuaacacaauauuuagguagagauguuuagcacagaauuaaauagagcuugggcaccaaagagaauugaaacuaggccacuuaggggguaguaacugaaacucugagacuaguauaggcugaaaaauguggguagagaagacagaaagagguugaaucagguuuauuuuaaaauagugaagucuuaauagguagaaaggagauuaaggauuaagauucaaggagugauauuucauagaucaagaaucuggagcagaugggaagagaucaagugaacauguagaaaaauuaaguuugaaggaagacagagaaucacuguggaaacauucacugucagaaaaccccccaccaaaccaaauuaguuuucuaaaaccuucauaauuugaauuaaugaauuuuuaaauuauuagaaauuuuaaaaauagauuuccccccaaaagaacugauucuuucagguauguguaguaacuugaauguguuuacaaaagcguuuucuuuuuaguguacuucagaauagggcuuuaaugauuaaauaagaguauuaaauaauacuuaaauaugcaacgguuaugcaucugagcgaguuauuuuauuuuaaauucucagugucgccugagaagugaucucuuuccucuccucuuguauuuuuuuguccgaaauaccucuguccuggaguuacuguuugugccugccugucugucauuuucucugccuauuccuuaacuauuacauaaaucaccaagugcugccuucugaacauuuuuucuaauuuacuaauuugaggcuuucuagacaugacuuuuguauuuaauuuuucuuuaucguuuucaaaacucuucuuuuguguugauucagguccuuaucaucucuugcacagauuauucuaauauccucuuuuuuacuuuugucaguauaccuagaguucaucaaaugggcuuacucaagccagaaucucagaaaugaagguagggaagaaugucauuuaaucaucuaugauuuaaaaauaauaacugccaagaaugccaaauguugcuuaucuuauucuuccuuacgguaaucuucuugggaaaacaaauuauaauuggaaagugcuugcuuagugaaucggacaucagaauaaaggcaguucgaucauguuuaaauauuaucaucaucuugauaauacuuuuuuuucucucuguguaauguauuucacuacuuugcagcuuccuuucacauuaacuucugguccugcauuugcagaaacuaugucccaaucaccuucauuaaaccuggaguuguagaccauguccuuggugggcuguuucuauagaugacugauauacuuguuucacacucagagggucauuuuauuucaggaucucuugauauauacauauggauauauaucucuggauauauguaugugcccauuccuaacagaauaguauauuuauguaauaacagcuagguauuuggaauuuugcuucucauacuuuuuuccaucaugcaugcauuaggagcaacuaauauuuuuauuucaaagguguaucugaaagcuuauagcuuuggcuuaggaagccaaaaacuuuauuucauguugccaauaguagaaaaucugauuuuccacccagauuaggucuuuuauggaacuguagagagaaaacaaaucagcauaauaaacauaagacaugagggaagauaguaguaauuugaaacaaaauuuaaaaagaaagaaauuuuauauauucagcuauauuuuauaauagucaaagcaaggaacacaguaaagggguaauaacgcaaugguuacagccaaggaaaagaauaauaaauggguaaaucagaugaagaaaacuuccuagaaagaaggaaaguaccaauacuguggugccagggacuuaauagacugggcacgguggcucacgccuauaaucccagcacuuugggaggcugaggcaggcagaucacuugaggucaggaguucaagaccauccuggccaucauggugaaaccucauaucuacaaaaaaaaaaaaaaaaaaaaaaagagccagguggggugguggcacgucuguaaucccagguacuugugaggcugaggcaugggaaucgcuugaacuugggaggcagaggcugcagugaccugagaucacgcuacugcacuccagccugggugacagaugagacccugucuuagaaaaauaaaaaauaaaaggacuuaauaauagaagugacuuccauucuaaggaaauguacaaaauaugaaaagacuagacauacagagauauuuaucauagcaaaaaguugcaaguacuggggauugacaaaauuaucacaaugguuauauuauuauuauuauuauuauuauuauuuaaucaaucagugucuugcuuuguugcccagacugguuucaaaucccuggccucacgugauccucccgccucagcuucccaaauugcugggauuacaggcaugaaccaccgcgccuggccuauuguucugccacaucuuucuuuuauuuuugagagagagucuugcuuaguccaggcuggaguagaguugugccgucauagcucacugcagucucaauuucuugggcucaagcaauccuccugccucagccucuugaguagcugggaauacaggcacacaccauuacacccaguaauuuuuuuuuuuuucuuuuucaguagagaugagaucuuacuaaugucgcccaggcuggucuccagcuacugagcucaagugauccuccugccuuggccucccgaagugcugggauuacaggcaugagccgccacaccuggccauaaugguuauauuaaaaucacugguucaagaguauuguguuuucuugucucuguuuucuaaaaaugaauguggccauucuuuuauguuuuuauuuaaaacaaaaauauucaugaagaaaggcaaauuauguugauaaccaccauaucugauaagauuauguucuucauuuuaguugauacuuuuucccccacuaaaucuuucuuuuaaucuuuuuaaagaaacagaaaaaaaaaaucacuguguaguauguauguuucaugaugcuucucguuuaggcuuaugauuguacucauuuaggugugccucaucucuuagcugaaguacucuccuucauuaaccugaugacucauauuuuuauacuuuauuugagcuuaguguuuauagagaaaaaaucaccccauguaaaaauucauaucauucauugauucauaacaauugcagcugacauuuaaauugcuuugcaauguuaauauacuucucuaggaaacuuacuuuuugcuaugcauguuuaauauguauacauuuaacuccucauacucuuccuuugcuuucccuguacucaagauauuagaugucuuucccagggggaaaaaaaaaaccuuauuuuaguuuccugaccgucuuuuugucaccaucucuuauguuuucaucaaucgugcucuuaguaucuuuccucuugaaaacaaccccuccacagagaaaaaaaaaccccaauuuacuuauuccuauuugugcgccuaccccugaaacuguucuacaagcacacacucguuuaagaucauuuguuuauuuuugugauaugucuauguaugacuuaagucuuccuuggacuuaacugugcuuccugauugagagaauucaugcguuucaccgauucccuacacagucuuagccauuauauuucaaaauacagcaucuuaccauucucuccauucuuucuucuggaaguuuuguuaggcauauuuggauuugaauacugcccuuaauguucuuuaaguuuuuguaauuuccauuuuuuaaaucucucuuuuauaucugaguaauuuguuuagauguuuguuuuuguucacuaaucaucucuuuagcuguguuuaauuuauuguuuuauuagacuauugagugaagaauuuuagugaacauguuguuuucaaguuugaauucuuugaagucucuuuuaaaaugaauguaguuugguuuucuguuuuucuuuuuaaaaaaagagcugcguaguucuuuucccacauccgaaaauauuuuuauuuugaagcaaucucaaacucauggaaaaauugcaaguauaguagagagaacuuuguuuuucugagccauuugagaguaaguugcgcaccguaucccaucagcacugaauacuuauguauuucuuacaaacaaggacauucuccuacaauaucacaguauagcuauuaagaacagaaaauuaacacugcuauauuacuaccaucuaguuuucaaaugccauucaaguuuuggcaguugucaauguuuuuggagaucacagcguaguuguuuuggauuuuauuuuucauuacuaaauucagauuauguuuuggggggcaggaauuuuauagaaauuaucuuugcagugcauauuaucaauaacacauaaucaggcuuucccaauguaaagguuuucuuucccccuuuacaauuaguaauuauuuuguggaauaaauugugacacuauauguaauauuccauuccccaucagauuuucaguuuauaucaguauguguuuaaggauuccugugggcuauaauuuauuauucaugauuuauugugaugcugaaaauuguucagguuagccagugggagccccuuugagcuggcucucuguucuguugacauaucccuguuauucuuugaaugcuuccuuacuuucuggcacuguaaguacauuaguuuuccauugcugacauaacaaauuaucagaaaguuagcagcuuaaaaccacacacauucauuagcuuucauuuaucauauuuuaccaguagaaguuuggguuggcuggguucucugcuuagugucuugcaaggcugaaauccaggugcuggccagcugggcucuuaccaggaggcuuccaaagaaacccuuagcucuuagaggcuuuuauaaagaccuugcacaugccccugcgucuucaagccagcaaugaugaguugaauccuucucacacuuagaaucugucugacuucgccuucugccgcaucucucacuuucucuucugccgcaucuuucacugacuuucuaccuucuuuuuuuuuuuuuuuuuuuuguuuggagacagagucuuccucugucguccaaggcuggagugcaguggucugaucuuggcucacugcaaccucugccuugcggguucaagcgauucucgugcuucagccucccaaguagcugggauuacaggcgugugucaucacaggcguuucgcccuguuggccaggcuggucucgaacuccugaccucaagugagccacugcacucagccccucuucugcuuucaaaggcucaugugauuacauuggauccuucuagauaaccccagauaauuuguuuccaagucagcuaaccaauagccuuaauucggucugcauagcaguaccuagauuagcguuucauugaauaaccaggggauagcaaacaccaaccugucuuuagaauucugccuaccacuacaagauacucuguguucuucuuuuuuauauagaguguucuuuucucacauuuaaaaaaugcauccucuuagguucuuaaucauuuaaaauauuuaucuuauaauauuuauuugccauuucuauuuucgaagugucuuggagggcagucuaaauguuuguaucuguugauuugucaucguggggauugguuccuuccauguuuccuuauuuuggauugugaacuuaaguuuuaucguggguuaaggauauaucccuucagaaaaguuuguguuugcuucaccacccugucccuucuuauguuaauuuaauguugggauuuaucaaaccaaagucuauuugaacacaagacuauguggcuauaaauucauauggcagacuuuuuaccuccuauccagagcauagaccaaauuggacaaguauuauuauuuucucccuaugaugugguuuuugggugauuuuuguguguggguuuuuuuuuuuuuuuuuuuaaguggucugcccuuccacugaaaguguagcuuuuugacagucucagccauauaaacaggaucucaguuucauccuuccauccauccauuagaggcacaaggucucaucucuuuuccuuuugggcauuaaaaccaaaguucauacauuauugagacaggccgacucugcuaaggcagccuguuuggccuuuaaguuuuauugcuuauuuuuugaguauguauuuauuuuuuugauuauuauuauuuuuuuuuugagcuuuaagccuucaaguuuccuuuuuauucuugaccccuagacauuuccuuugcuuguggacucggguauuuguuuuuagguaauauuuuuuuucccuaugacacagcccucaggagauccugagaacaugugcccucauuuuuagguaauuuuaauuaggaaggguuuuagguugucugaucugccuuguugcuagaaacagaaauucuccuauugauugauuuuucaaaccacuucuuaguggccucuacaacuacuccagucaggucaagaauggcucucacauugccaagucaguggguauuuuuagucuucaucuuagaugaccuuuaugcacauuugucuuugucuaggaacuucuguuggaaacaucuucuauuuuaauguuauuuuaaauuuuuuugcuuuuguaacauuaugcuuagcauguguguccaacucuuugacaauuucuuuuuaguuuucugguggcuucccuuuauccaaauuuaguauugaaauuccucgagccgcugcuuuucucacuccauaauucuggccagaauuugguacuuaaaauauuuugucuaaaauauuacaauagcuacuuaagucaucucccugacuccacucuguugucuuucagggcgucguccacacuguagccaaagugaucuuauaaaaacauaauucuaaucauggcacucuucugcuuaaaaauguuuuaauggcuuuccguuagguuaaaauuuaaaaguccuuuguagccugugagacucuacaugaguugacucccuagcuucaucuuugagcaucuuauuucuuuacuuauuauaccaucaguuagaguugauuguuauauaauccacagaagugaauucugucugauuuaagcaaaaaaaaaaaaaaaaaaaaaaagagggagaauuuauuagguguguauaguuacaguuaauuuagggaauuaaaagacagaaauaggccgggcaugguggcucaugccuguaaucccaggacuuugagaggcugaggcgggcacaucaccuaaggucaggaguucaagaccagccuggccaaaauggugaaaccugucucuacuaaaaauacaaaaauuagccaggcaugguggaaggcgccuguaaucccaacuacucaggaggccgaggcaggagaaucgcuugaaccugggagguggugguugcagugagcugagauugugccauugcacuccagccugggcaacaagagcaagacuccaucugaaaacaaaaaccaaaaaaaguuuguugaugauuuuuuccuacuuucgcauguauuucaaauuuuaaaaaugauuguguucaauuguauagaucaugucaaaagaagcaauacauaaugaguaaaaauguucaucuuuaauaaagcaaaaauagagcaacccaccaaauaguuaacacuugccuggagagauuuaggaacaccaguauuccacugagauugcugagagucucaggaaagaaaggucuaacuuaaauuguauuuuaccauuucugaguaaugaauggauuaauucuauggagauauauucuacagucuagaaagggaaagccaaagauaaagacuguuguauuuauucauuaguugccaaagggaaagggaagaccgauuaacaacagaaguguuucuguuauuguguauauuauccuguuuauuuuaaagaugcuugcuuauuuacauuuucuuuuaucgcuacauaauaauuuaccuauuuaugggggacguuugaguguuuguuacaugcauagaauguauacugagcaagucaggguaugugggguauccaucaccucgaauguuuaucauuucuguguguuggcaacauuucaagucuucucuucuaccuucauugaaauauucaauguauuguugcuaaugauagucacccuagccuucugucgaacauuaaaacuuacuuauucuaucuaacuguauguuuguacccauucaacaaccuuucuucauuucucccuccuacccucacacucuugccagccucugguauuuguuauucuauucucugucuccaugacaucaaguuuuucaggucuuacauaugaguugagcacaugugguauuugucuuucugugccuggcuuauuucacuuaacauaaugaucuccaguuccauccauguuguuggaaaugacaugauuucauucuuucuuauggccaaauaguauuccacuguguguauauacuacacuuucuuuauccauuuguccauugaaaaacacugagguugauuccauaucuuugcuuuugugaagaaaugcuaugauaaauaugugagugcagguaacccuuugauaugcucauuucuuuuacuuugguuuaaauaccugauauugggauugcuagaucauguggaaguuguauuuuuaguuuuuuagauaaauauacauacuauuuuauauagugguuguacuaauuuuacauuccuaccaauaguguauaagaguuuauuuuucuccacauccucagcaacaucugucauuuuugucuuucuaaucauagccauucuaacuggaguaauaggauaucucauugugguuucgauuuacauuccccugaugauuagugauguugagcauuuuuucauguauauauuguccauuucuauguuuuuguuuuguuugguuugguuuugagacggagucuugcucuuuugcccaggcuggagugcaguggcacaaucuuggcucacugcaaccucugcuucccagguucaagcaauccuccugccucagcccccguaguagcugggauuacaggcacgugccaucaugcccagcuaauuuuuguacuuuuaguagauacaggguuuugccauguuggccaggcuggucucaaacuccugaccucaggugauccacccgccucggccucccaaagugcugggauuacaggugugagccaccgugcccagcauuuguauguuaucuuuugagaaauaucuauucauguccuuugcccacuuguuaaugguaucuuuuuuuuuuuuuuuuaauuguuguuugaguuccuuguguauucuggauguuagucuguugucaggugaauacuuugcagauauuuucuccuauucaacaguuugucucccuccucuguugauuaugucuuuugcugugcaggagguuuuuaguuuaauguagucccauuuugucuauuugugauuuugauguuuuagccauaaaaucuuugccuagaccaauguccugaaguguuuuccuuguguuuucuuugaguauuuuuauacuuucaggucuuauguuuaagucuguaauccaucuuggguugacuuuuguguaugguuagaaaugggguacaguucuauucuuuugcauacagauauccaauuuucccagcaccauuuuuugaagaggauauccuuuccucgguguacguacuuggugccuuugucaaaaaucaguuggcuguaaaaaaaaaaaaaaguggguuuauugcuggguucucuauucuguuucauugguaucuguuuuuauaccaauaccaugcuuuuuugauuacuguagcuuuguaauauauuuugaagugacguagcaugaugacuccagcuuuguucuuuugcucaggauuacuucagcuauucugauucuuucuuggcuccauacaaauguuagaauuguuuuuucuauuucuaugaaaaaugauguuauuuugauaaggacugcauugcaucuguagauugcuuuuggcaguguggucauuuuaaugauacuaauucuuccaauucaugagcaugggaugucuuuaaauuuguuuguguccuuuucaauuucuuucaucaguguuuuguaauuuuucuuguagagaucuuucaccuacucgguuaaauguauucuuuuuuuuuuuuuuuuaaacacuauaguaaacaggacugcugccuugauuucuuuuuuugcuauuucauuauugauauauagaaacaguacugguuuuuguauguugauuuuguauccuccaaauuuacugaauuuaucaguucuuauagucuuuugguggaguauuuaaguuuuucugcauauaagaucauguaaucugcaaaguaaugaauuuuacuuccguauggaagucaacuuggaugccuguuauuucuguugccagauugcucugguuagaauugucaauauuauguugaauaagaguugugaagguggguguucuuguuuuguuuuaggucuuagaggaaaaauuuuagcuuuuuccuguugaguauaauguuagcugugaguuuguccuauauggccuuuauuauuuugcagaaugguccuucugugcuuaguuugagaguuuuuaauaugaagcgauguugaauuuuaucaaaugcuuuuucugcaucugagaugaucauauggguuuuguccuuuauucuauugaugugauaccuauuauguuaaaccauccuugcauuccaagugugagucccacuugaucaugguguauuaccuuuugauguuuuguugaauucgguuugcuagcauuuuguuggggauuuuugcauugauguuucuuggggauauugaccuguaguuuccuuuuuugauguuguuguauccuugacuggucagggccuuguagaaugaguuaaggagaauucccuucucuuggauuuuuggaauaguuugaagaggauugguauuaguuccuuuguauacauuugguagaauucagcauugaaucuauccaguccuaggcuuuucuuugguugggagacauuuuauuacugauucagucucauuacucauuguuggucuguucaggguuucuguuucuuccugauucagucuggguagguuguauguuuuuuggaauucaucaauuuucucuagauuuuccaauuuguuagcauucauacuauucucugcugucuuucauauuucugugguaucaguuguaaugucuccuuuuucaauuuugauuuugcugauuugguucuuaccucuuuuuuuugccuugucuagcuagcaguucaucaauuuuguuuaccuuuugaagaaccaauuuuucauuucauugauuuuuuuuuuuuuuuuugagagggagagggggucucugucuaaucuucauuauaucuuuucuucugcugauuuuggguuugauuuguucuugcuuuucuaguuccuugaggugcaucauuagauuguuuauuugcagucuuucuacuuuuuugauguagauguuuacugcuauaaacuuuuuaguguuguuuuugcuguaucacauagguuuuggcauguugcguuuccauuuucauuugaagaaauuuuuuuauauccaucuuaauuucuucauuggcacagugguggauuguguuauuaaaaauauauauauauuuugaagauggagucuugcucugucacccaggcuggagugcaguaaugcgaucucuucucgcugcaaccucugccuccugggguccagcaauucuccugccucagccuccugaguagcugggacuauaggcauguaccaccacgccugguuaauuuuuuuuauauuuuuagaagagauggguuucaccauguuagccaggcuggucucaaacuccugaccucaggcaguccaccagccucagccucccaaagugcugggguuacaggcgugagccaccgcaccugguuauguuauuucucuucucuucucuucucgucucgucucgucucgucucucuuuuuuuugagacagauacucacuguauugccagguuguagugcaguggcuugaucucagcucauggcaaccuccacuucccagguucaagugauucuccugccucagccucccgaguagcuaggacuacaggcgcccaccaccaugcccagcuaauuuuuguauuuuuaguagagacgggauuucaccauguuggccaggaugaucucaaucucuugaccuugugauccgcccaccucagcugcccaaagugcugggauuacaggcgugagccacugugccuggcuauguuauuuaauuuuuauguauuuguauaguuuccuaaguuccucuuuguguugauuuuuaauuuuauuccauuguaaauugagaagauucuugauaugauuuugauuuuuaaagauuuguuuuguguccugacauacggucuguccuggagaauguuccauaugcugaugagagcaguuguuggauaaaauguuuuguaaaugucuguuagguccauuuggucuaaagucuaguuggaguccaguguucguuuuuugauuuucugugccagugaucuaucuaauguugagaguggguuguugaagucucucacuauuauuguauuggaguuuaucccucucuuuagguuuaguaauauuugcuuucugaaucugaauuuuccaguuuggugcauauauauuuagaauuguuauauccucuugcugguuaucccuuugucguuauauaaugaccuaaucuuuuuuacaguuuuuuuuuucuuaaagucucuuuuaucugauguaaguauagcuacuccugcuuacuuccugugguuucccuuugcauaaaauaucuuuuuucauaccuuuacuuuccaucuguaugcauccuuacaggugaaguguguuuuuugugggcaauaaguaguuggaccuuguuuuuuaauucauucaccuaguugauaucuuguaaguggagaauuuaauccauuacauuuaagguuauuauugauaugugagguuuuguuuuuguccuauuguuuucuaguuguuuuguauauucuuucuuuuccuuucuuuuugucguugugguuuugugguuuucuguaggggugguuugaguccuuucucuuucuucuuacuuuguguauuugcuuuacuccagugaguuuuguacuuuuguauguuuucaugguggcaaaugucauccuuuugcuuccagguuuagaauucccuugagcauuucguguaggguggucuaauggugaugaauuuccucagcuuuugcuugucuggagaagacuuuauuucuccuucauuuaugaaggauaauuuugcuguauguaauauccuuggcugaaaguuuuuuuuuuuuccuuucagcacuuuugaauauaucauccccuucuauguugacuguaagauuucugcugagaaaucuguuagucugaugggggggucuuuuauaggugacuggauaccuuucucuuguuuuuagaauucuuugucuuugucuuuagacaaccugaguaaaaugugccguagagaagaccuuuuugcauuguuuuuagggaucuuagagccuccucuaucuggaugucuguaucucuugcuagaccugggaaguucuuuuuuuuugagacagagucucgcuuugucacccaggcuggagugcaguggcgcgaucuccgcucacugcaaccucagccugccaggcucaagcaauucuucugccucagccuuccgaguagcugggauuacaggugugcaccacuaccacccggcuaauuuuuguguuuuuaguagagacaggguuucaccauguugaucaggcuggucucgaacuucugacuuugugauccgcccgccucagccucccaaagugcugggauuacaggugugagccaucgcacccggcccagaccugggaaguuuuaaucuaguauuuuguugaguugauuuuccauauuauuggucacuguguuuugacuggguuauuucaaaagacuggcuucaaguugugaauuucuucugcuugaucuagucuauuguugaaacuucugaauacauuuuggauuucgauuguuuuuuguuuuuuuuuuuuuuuuuuuuuuugauggaguguugcucuguugcccaggcuaaagugaccccaguuuacugcagccucugcccccuagguucaagugauucuccugcuucagccuccuaaguagcugugauuacaggcagguaccaccacaccuggcugacuuuuguauuuuuguagagaugagguuuugccguguuggccaggcugauguugcaguccuguacucaagugaucugccagccuuggccucccaaagugcugggauuacaggcaugagccacugugcccagccucuguuuuguucuuuuuaaauucucucucucucucucucucucucucucuauauauauauauauauauauauauaauuauuacugaauuacagaauaaaaauaaauaauuaauuuauuauucauauuauucauguccugaauaaccauucugauuucuuuguauuuucagaauuauuuuguaucgcacauagcuucuuuaguauuaaaauuuugaauuauuuuuccaauauuuuuaaaaacuuuuuaaugguauguguuccuacggaauuauugugugcccuuuggaggugucucucucucgcuuuuuuuuuuuuuuuggcuuuuuaauguuuccuguauauguugauaucugugcaucugaugugauaauagcuucucccaauuuuuuugaauuugcuuucauaggggagaacauuuuauugaagauauaucuaugguguugcuuggguaggcaccguaguugugauucuggaugugugcagucauguaaucucuggaugauuuauuuggcuuaaacaguaucagcaguggcuaugauuuuucucagugguuuagggugcaauuauuaguggaggcaguggugaaguuuugcuggggacuaggaugccaaguagaccagccuuugcaccucagucguggaccaagcaugccucaccuugggcccaggguggcauaugcugguacugguguuaguggguccagguaggcugauucuugugccucgagguggaggcccauacuuccucagaugccaguagugguagcaguuggcucuguagguuggacgguucucgggucugcagccagccaguguggugugcgaagacgguggcaguggugggucaacccucuggaucccaggaagagugcacuuguauuggugguggcuacaguggacugggcaggccagucuccagaccuacagaugguacaugcagauaggugccagcuguggcaguagcagcaggguggguaggccuaaccucagauccccaggacaaguguucaggugcuaaugauguuggauugcgcugggcaguccccuguacuccagacuugugugcucuggcaugggcugaggguggggcaaagcuggguuggugggcuuguccucaggcccccugaugguauuugcagguaccagucaugguaggcaggggcagggugaucccuaagucaccagcagaauguucagguagccggggcagcauuggucacaccguugcccugucacuggagagcccagggccauguuaguggaggcaaguguaggccagcagauggggaacacucaugcaucagcccuagcagugguuccccacaucucagcccugugugcaguagcccacacuuugcucauucacgccuccacccugggagcaguagcugguguaucucuuggccuuaguccuagcgcugcugggcccuaggacaguguguagccuguuggguacaagacucuuaagauggugcuuugcuguugcugcuuaggucuuagaacauguaugggauacagcauaagcauccucccuguggcugugcugucaacacaaucuccucgcaguuccuuauguuuauuucagagccugaaaggaucuaggagcucucccauggcuaggauugcagaaguccaugugggaauguugacagcugagggucucuaaccuguucuuucccugcauuagggagccucucuuggcuccuggccaagcaggcugccuugcuucccuuuccuuccuuguuuuagguauugguuguuaguuuuuuguugaauuccaguguuuucucuuggacgaucuauacaaauugugguuaccuucuaacuauuuugguucuuaguggaagagacaaauacaaaaugccucuagucacccaucuugaaaccccucucucaauccuauuuaauucauaauaaugaauucauaauaaugaugggcacuguuugucagauguuuacuaugugguagacagcauacugucuaccaugacuggugccugcacauaccauuagggguccugaggacaauauuaguauaugcuucgcauauguaaguuaauccuugccccagcccugugaaauuguugguaccacccucacuuuauagaugagguauaugagguugugugagguuaaguuauuugcacgagggagcaggauuuggacuuuuaacuauuuucacaccauauuaaccucuaggaaagaauaagucauucagucucucgggauguggguuagggauaacuuacaggcuuaauuacuuacuuaguuaaauauuucugaagacuauuccauucacagucuuuuuccugaauaagccacuggauggguacuuacuugaccuccuaggcaguuugaaagugggaaauaggaacucagguugaugagcauuauuauuucugucauuagacagguauacuucugucuuauuuaccaaucuuguguaauugcauuggcuuacuaauaaaaacuuaagucuaaacaauguucuucuggcgucuacucauacuguauucuucuccugagaucacuguuugucuccaucuuuucacaucuagugggcugaaaaugcagcauuugagaagucacugccaucucuuucgucaggcucucuuucuuugcuucagugacaccacagucaugguuuucuucuuaucuuacuggugucaauuuucuguaugaacuccucuucuaggacccauccuugaaauguuggagagccucaacauguggucccaggcuggcguuuaagaaaacuuccauuccuccuguuccaguuuuuaccaucucaguaagggcacuuuuaaucacuagccagaaacccaugacucauucaucuucuacccugcuaccaaaucuaauuugucaucaaguuuagaugauuuuuuuuuuuuuuuuuuuuugagacggaguuucgcucuguugcccaggcuggagugcaguggcgcgaucucgacucacugcaagcuccgccucccggguucacgccauucuccugccucagccucccguguagcugggacuacaggcacgcgccaccaugcccggcuaauuuuuguauuuuuaguagagacgggguuucaccguguuagccaggauggucucgaucuccugaccucgugauccgcccgucucggccucccaaagugcugggauuacaggcgugagccacugcgcccggccaaguuuagaugauucuaauuucuagaugcacugcaaguccuuguccguguucaguacuacuaccgucuuugucuggagggacauaauuuuuaauccagauugugaaauagccuccuaaaaaaaaaucuuuguuuccacucauccccgucagucccuuugcuacauaagagucagagggaugaucuuuuuaaaaagugagucauacuauuugccuuuggugucuuccuacugaucuuagcaaaaauucagaacaccuguacauggcuuacaaggccuuaugaucuguuccuuccccucucuccaacuuugucuuuuaccagccucuccacaaggcuuuagcuguauuaccuguuuuuucuucuuucaauauuucugggucuuuuggacaaguuuuucugucuuacucuuugucuaguuaacaccuaccuaaccuuuaagccuugucuuaaauauuuuuuuagacaggucuuucuugcuuccuaguauuucacucuugugguaccuuuuucucuuccauuauaguauguguuggaauuuauauucauguauuuguuuuaauguuugccuugcuccuuaaauuguaaauucccagagagcuaaaaucuugucugucuugcuugcuacauuaucccagcuccuagccucauuccucauaccuacugaguauuuguuugaugaaaggaaggaaggaaggaagggaagaaaaggaaaggaaggaaucaguaugucauugccacccucuguaccguucugcagcuuuguuucuccucccuauccugaacagaugaauuucaguguauuuuccuagagcucaugcauuguaacauuuagcucuguuuaauucaaugaaugucaccuugauuuuaguuaaaaacagcauaugacuuaagaugaaaauagagugaaguuaaauagaaagcagauacagaagaauuuaagguggauguuguaccaguccuaccugaggagcaaggaaguugaagggaauacauuauuuucauuuucaaagaaagauuuagaauuuuaagcuuuccugccuugauaggaaaggaacauuuugcucuguuuuuuuuguguguguguuuuuuuuuuaccaguaaacugaguaccagauauuguuucaaagugugauuacuggauugcacauuuagcugcguaauuucguauguaaguauacguugauguaauauaaaaacaauuuaaguuuugagauugaagguccuuaaucaccacgauuuugcuucucaauauuauucuuccaagauguuuuacugcauguugugaugguaauugcaacuuucaaaguguaguagagacauuagaggaccugguaguuacaacaguguacuuuccugacuuacagauacauuuuuaaugaaagcauuaacaccaaaauggccguagcuaccauuuauuaaaacuuacucugugguaggcauugcuagagcuuuuuuauauggauauucucaaaaucucacaaaaagucuuuaagguagccauuaucuuuguuuuauagauaagaauaauauggagguucagaaggguuaaguaguuugauuaagggucauguaggugacagauccagcauuugaacccaguuuugucuaagucaaaagccucugcuguuucaauuucagcaugcugccuccagcuaacuuuuguuuucuaauuuuagaaauuggagacucccuguguaguacacuuuucacccccaaaauaacuaaucagcauuuuaucugcuuuuuuuuuuuuuuuuccuuuuuuugagauggagucuugcucugucgcccaggcuggagugcaguggugugaucuuggcuuauugcaaccuccgccucucaagugauucuccugccucagccucucgaguaacugggacuacaggcaugcgccgccaugccuggcuaaguuuuguauuuuuaguagagauggguuucgccauguuggccaggcuggucucaaacuccugaccucaggugauccaccugccucggccuuccgaagugcugggauuacagaugugagccaccgcaucuggcugcaguauuuuauuuucuaagauacucugaaaacacugaauucaguagaaacucaauauuuguugaauuaucuauggaguagcaaccuuuaaaaaugcauaucuuuuucucugcuauguauuauuuggaauauaaaguuuauaaauaaucacugcauuaacaugcugucucuuuucuggcccucuuagccaaacuuguuucuuuuucuuccuuuccuuucuuuuucuuuuuuggagacggucuuguucugucacugaggcuggagugcaguggcacaaucucggcucaaucucaaccucccaggcucaagcaguucucccaccucagccucccaaguagcugggacuacaggcacacaccaccaugcuugacaccacacccagcuaauuuugcauuuuugguagagauaggauuucaccauguugcccaggcugguccugggcucaaagagaucugcccaccuuggccucccaaagugcugggauuacaagcaugagccacuugcaccaggccauuccuuugaaauucuuagagcaguuuauaagauucucuaucuuaguuuucuaaguuugcccuuugugaucuauuuuuguuuguuuacccuuuaaaugguaauguuauuuaggguucugucuuugguucucuucucuugaucaugcugagaacuuucccugggugauuccauuuuuguuccuuggccuugaccauuguguucauaucaagaguuguaaguaaaauacuuauggggccacauagguaacauaaaugagugacaugguaagggaugauggagaugcugauggauuaaagucucuaugcccuguucagagcucuggucagauuguugcucuuuuauaauauaguauccaguguuggcaaaucuucaguuuuucaagagauauuaggcaucuagaguucuuaaugggaaauuucuuauuucuauaauaauuaugagcaacugguuaaaauuucaaccauagugcagaccaauaguaaguauuuuuaguuugcagguuuacuuacuguaacuuaccaugcuucucacuccuagauuuaugucuucagaucugaauuuccugcuggguuuuaggcuuaucccauuguguucuauauguaggaguucugugucccacaggcaucucaaagaccaugacccugaaccucuuaauuuguauuaggaagugauuucauuuauaggauaccugugaguuugaaucauuauuucaccaccuacuagcucaccaaaaaaguuacuuuauuucuuuaaaguucuguuugcucauaugugaaaugggaguaauauuuaccucauugaguucuuauacuagcacaguuacuuccguacaguaaccaaacacugcuuucaguugcuguuccuguuucagugaaugguaucacuacauguacuuacuuaugcuuaagagucauuggugacucuacccuuguuuuuauuuuucaggucuaauuagucaccagguucuauuggucuaauagaauuuucaggucuaauuagucaccaaguccuuagaauuuauccugcucuacugcauguuucuuccucaaaccguccuucaccucuguacugcagccccuuuagaaauuagcuugagaggccagaugugguggcucaaaccuguaaucccagcacuuugggaggccgagacgggcagaucaccugaggucaggaguuugagaccagccuggccgacauggugaaaccccaucucuaguaaaaauacaaaaauuagcugagugugauggcacgugccuguaaucccagcuacuagggaggcugaggcaggagaaucacuugaacccgcggguagagguuacagcgagccgagauugcaccacugcacuccagccugggcaacagagcaagacuucaccucaaaaaagaaacuagcuugaggcugggcaugguggcucaugcgugugaugccagcacuuugggagguugaggugggaggaccacuugagcucaggaguuugaaaucagccugucagcauagugagaccccaucucuuaacccaccgaccccacaaccaacgcaaaaaaaaaaaaaaaaagccaggugugguggcauucgccuguggucccagcuacuugggaggcugaggcaggagggucgcuuggcccaggaggucaaggcugcagugagcuaugauugcaccacggcacuccagcauaggugagagagacucugucucagaaaacaaacaaacaaaagauagaaaagaaauuagcuugaaaagcaacaacaucucuuccaguaaguuuuuuggcucaccacuuuucucacuccaggucugaauuagauaccucuuuuucugugcuccuagccuccugaggaugucucugucauagugcucuccacaacuguuuguaaugccuuuuuucuacgcaacuucuugaaggcaaagacuaccuaucuugaauggcuuuuuaucuccagggcuuagaauaaugccuggcaaauaaugaguucagugauguuugcagaaugaaugcauuggcuaaauauaucauuuuucuggagaaauuguagauauaaaaaagaucccgacgccuuaauuauagcuguaaggcuuuuuaaaaugucccaguuguuuuguuuucccuguuugaauaagauucuaggugcuuuaauuuauuauauaagucaauaacuucauuuauuuauuuauuuauuuuuaaagacagagucuugcuuuauugccaaggcuggagugcagugauacaaucacggcaugguucacuacaaccuugaacuuccaggcucaagugauccucacaccucaguccccaagguagcugggacuacaggcaugugccaccaugccuggcuaauuuuuauuuuuuguagagacaauaucucccuuuguuguccaggcuauguugauguuuuuuuggaacaaaguaaauuguauguugauacaaauuacugauuauuguuguccucuagggcuacaguugcuaauuuauuuauuuauuucuuuuuucugcagcccacuuagguucauucuuuccuccuguuucuguaccuugguuucaggcucuuuuuccccucuugcccucccaagagcucugguuuauagcaaguuuucucggccuccacacuauuaacacuaugggccaguuauuucuucuggaggcuguccugugcauuguaagaugucuaguagcaucccuggccuauacccauuggaugccaguagcacccuccaggcuugauaacuaaaaaugucuccagguauugugaaaugucccuuguggggcaaaaucaccccugguugagaacggcugguuuauagauauucccauuucuuuauccugaaagccucuccuucucuaugcugagcaugauuuucuuuuuuuaaaaaauaagcacuuuuaaaaaauuaacuuguuuccuguuaacuuaugcucauccucccacccucuuuucuagaaugaauagcuuccaccauuucccaccuuauuucuggcuuuuauccccauggugccucucaaaguguuuucaucaagucucccaugauuuucaccuccuguguucucuggaguaaauggagcugccaacucauagcccaguucaucaugucuuaaucguuccuccucuccuaccccugcagcugccccauacagucagucacaaaguccugucuguguuaucgcuggaaugucucuagaaucuaccaacauucuuuauucccacaccugucucccaccaaugucaucagcuccucuuuuggucucggaauuucaaguugggccuguuccauuuuaauuucuaccuugucggcuuucuagaacaaggucucuuccuacuucagacuuccucagugaugauuucuggggcuuuagcauuugccuuuuggaaggcccauuaggugauuuuuauggaacucuaauugcuucauuccucuauuuaagaaacguuuucuugcucuuagaaacuccuaaaauccaugacauauuuuuuacaaagcucuuucugcuauccccugcuuuuaacaaaagccuuuuugcuaaauaaaaaugguguagguucuuuuagacaacugcuucaugagaagucaguguuuauuuguuuaguuacuagcacaauauuuuuuaaacagcaacaauaagauuuauaauuggaggagggauccaggaggaaaugcaaguuuacugauuaugugugucugugacaaauuugacugcuaaguuauauuuaaauaacauuuguuuuuuugcagguauuuauaacagcaaugauguagcaguaucguuuccaaauguaguaucuggcucgggaucuaguacuccugucuccagcucucacuuaccucagcagucuucugggcauuugcaacaaguaggagcgcucucucccucagcugugucaucugcagccccugcuguugcuacaacucagguaaguuguuacacuaucaugugacagguaauagguggguuucucauuuuuaaagugaguuuuguuggaggagaaacaaaugacauagggccuucuauaggaauuuaugaaauaccucaauuuguauuaauguauuagugaaaaugauagguauuuuuacaugguauucaugagagaggauggaugaguguaugggcaccaacuaauucuuuuuaauuucuggguuuuaaauuuugucugaaugauauaaaauauacuuucaggggagcuuuuauucuuucuuuaaaaaaguaggacccacaaaauaugagcaaguuuuggacucuugugauuuuuaaaauuccuuuuauaauuuuuaaaauuacacaaaaaauauaugaaaucuuuuuaaaguuuuaaaaaaaaccguguaggagaauguagguuaaaagaccgaaugaccgcuucaagcacuacacauuuuuccuccuagugggagagaacaguguuuguaaauaaugaugaauauauagguuuuuccauuuguguaccccuuuuaucugacuucagauuuguaguuugauaggugaccuagucuauaggauuuuuuuguuuuuguuugagacggagucucacuuugucacccaggcuggagugcaguggugugaucucagcucacugcaccucugccuccuggguucaagcaauucuccugccucagccucccgacuagcugagauuacaggcacacgccaccaugccuagguaauuuuuguauuuugaguagaggcaagguuuugccguguuggccaggcuggucuucaaccccugaccucagguaaucugccugccuuggccucccaaaguguuaggauuacaggcgugagccaccaagcacagccaagauguuuuaaaagagucauauaagagaaauuguaauccuguuuuauaaagaggacagugcagggggaaagcuguacccaaucccccuguauuacaccccccuuccccaaagauaaucauuuaagauuuccaaaguauuuuuuuuauuuauuugaaauuauguaugauuuuauuuucauuucuccaaagcucuaguagucuuuuaauggucaagaaaauggucacagggacaaaugucuaauaaugaacaacuaguuaaaauaguuguuuauaaguuccugucaacuugagcuuuauggaugcgugcauaauuuccauugcguguguuguuaggauauauauacgcuuuuccggcaagcacaauguuagguuauuuugaugcauuugugugaauggcacagugagagcaguugcuauuaaaauuacguauuagaaucaaccccagauaguucagcacagaaaagcaauggcaugauuaguaguaucgucuuugaagaugaaagugaacuauuuggugaaccucccaacuugauauagaggaguuugacuacuuuagcagaguuuuucuguaguucaugucacuaaaagugagguagccauaacagggguuugggguuagagagggugaaaggauaaaugaaagaauagcuccuauaaaugguuuuaucucuuuuuaauuaagugcaaccauaugcuguugauaguuuuauauccuuggacaaagucucacaugaacauuuucaaugugcauuucucuuuucugucuuuauaaaagucuguuuaauuacccucugguuacuucccggcugaauuaaguaaaaauccccauuucuucucauucauuaugucugugagccaggggguuggcauuagggaagugguagagaagagaaguuuauagcuagagggaaaauuccacuugacaugugacucaacugaagaacaaagaaaucauaguuguaaguaacccaggauucaguucaauuaaaaucuuuacuauuuauccccucuccauguuucagaaagaugggucucuuacaaaugugaucauccaguuagauuuacaugcuguguacugagauaccuacaucuauguuucuguucagcaguaaaugcuuucugucuucaagcugaagcuuauuuagccuggcuuaucuggugcugcuguagcaaccaucagucuccaggcaacugaggcacguugaccucucaguugaacugagugcugaacuacuucaauuuagcugccugagacaauaguaaugguguugaaugugaaaaaugugaaauuuucuaggcaaugugcaaaggaaaggauacagaaauauuuagauagaauugauaggacucuuaaaauuggggaugcacuuagcaauugaaucauuuuuuacaaaacgacaaaguuuauuccuguuucacucucauauagacccuguuuguuuucaagucuuacauuaguuguguuuagauagucacaucuaguguuuuauuuaggguugcucuaaguaguugauuuuagagcaaugcaguaagauaaaugggugaauaaaaauuaucaauauuuaaaacguaauucuaggcugggcgugguggcucaugccuguaaucccagcacuuugggaggccacgguggguggaucaccugaggucaggaguucaagaccagccuggccaacauggcgaaacccugucucuacuaaaaaauucaaaaauuagcuggguauggugguucaagccuguaguuccagcuacucgggaggcugaggcaggagaauugcuugaacaugggaaguggaggcuguagugagccgagaucaugccacugcacuccagcuugggccaacagagccagacucugucuccccaaaaaaaaaaaaaaguaauucuagaagucuuaccacaacuguuaagaaaaccaucauacuugcaagcaaaaacuuuaauaauagugauagaugauggaaauauuaaacuugaauaacauuuugugcccccacacccuuaacgaaaguaggaguuuuuauugauuggauuggugucagcaggauaaaauccagaggucauuuuugcuuuuugugauauacauuuuaaguaaauagaccucuacauugccuuauuugguaucuuaagaacuguucccugggccgggcgcaguggcucacaccuguaaucccagcacuuugggaggccgaggcggguggaucaccugagguuaggaguucgagaccagccucaacauggagaaaccccaucucuacuaaaaauacaaaauuagccgggcgcgguggugcaugccuguaaucccagcuacucgggaggcugaggcaggagaauugcuugaaccugggaggcagagguugcggugagccaagaucacgccauugcgcuccagccugggcaacaagagcgaaacuccgucucaaaaaaaaaaaaaaaaaaaaaaaauuguucccuggaaaguggucaaggagauaagauugggaagggcuaguagaaguuaaaaacuuagaauaacuugaaacuugauuugugcugggaaaaggagauacuuguaaaauuggcgggugggggguggggaggggagucugauagcagcauacauuuuggggaaaaaaccuuuaaaaaacuguuugauuuuauauucuuauauuccuccuccuccuccuccuccuccuccuccuccaccaccuccuccuccuccuccuccucccuucuucuuucuucuucuuucuuccucuuccucuucuuucuuccucuuccucuucuuucuuccucuucuuccuccucuuccuccuccuccuccuccuuuuccuccuccucuuccuccuccucuuccuccuccucuuccuccuccuccuccuccuccucuuccuccuccuccucuuccuccuccuccuccuccucuuccuccuccucuuccuccuccuccuccuccgcugcugcugcugcuucuucuucuucuucuucuccuucuucuucuccuucuucuccuccuucuccuccuccuucuccuccuccuucuccuccuccuucuccuccuccuucuccuccuccuucuccuccuccuccuccuccuccuucuccuucuccuucuucuucuccuucuuuucuucuuucuucuucuuucuucuucuuucuucuuuuugagacuacaggugcccgccaccacgccuggcuaauuuuuguauuuuugauagagauggaguuucaccauguuggucaggcuggucucgaacuccagacuucaggugaucugcccaccuuggccucccaaagugcugggauuacaggugugggccacugcgcccggccucuauuuuauauucuuaaguguuaaacccuuuuuuuuuucccccuuucaacagacuaguuuuuagaguaauggcucuuucacaaauaauugauaggaagccugcuuuacuacauacuaguauauuaguaauagaguaguuucuuaacauugcgggaagagcggacuccuguccaugugacuguuaaucauggaucaggguagagguauaaauuaguuucuguaggagugucauuaauuuuucauuuugccuuucaaauccugcuguuuccuaguucugcagucauucuguacugucuuugggagaaugcaggugcuuuuuuuuugguuugaaggaugauuucuuuaguagaagaacuuaagacugaaugcaaugaaacauaauugcauuccguuacauccuacuuucugaguuuugcguuugaaauacaaucuucaugugauaaucauggcuucuugucuaucccauguuacuguuaaacaaaaugauguagacuuaacauuuaaaguaaaauaaacuuccaagguuuauuuaugugauauuuaggaaaugcagauauuucguguuuuuguuguuguuuguuuguuuguuuuuuugagacggagucucacucuguugccgaggcuagagugcaauggcacgaucucggcucacugcaaacucugccccugccagguucaagugauucuccugccucagccuccugaguaccugggacuacacacgugcaccaccacgccuggcuaauuuuuguguuuuugguagagaugggguuucaccauguuggccaggcuggucucgaacuccugaccucaugauccacccaccuuggccucccaaagugcugggauugcaggcgugagccaccucgccugggcauauuucuguauuuuaaacauacaauuuagugacuagaguuuugcagauuucugugacacuuucaucucaauuagcuucgaauauuuuguuuuccaauaugauuauguauguguguguuuauguaggggaaguugucuaagauguagucuccgauuucuuuucagaugaugucuaauaaggacacuuuaauucugcuugagaaaaugguuucguuucucaggcagauuuaacugacuucuggggugauauuuauguuuauacuuaauuagucagaauguaaauuucuucugauuucaauaauauaaugacuuauaauuuuaagggaauuaccuuucugaggaaaaucaguuuucauaaccuugguaacaucucuuguuaccagaugaugaaaagguucagucacagucacauaucuguaagucuggaauuaagacaugauuccuuagccugcucucuuauuacuaauuguuacuguuaaaaugaauuucccaauuauguacuucuuaugcuaagagguaucuccuuggaaaacguuguuaguaauuuuacuguguucauuugugugaugcaaugcagaagagagaaauuugagucagcaaaaguccuggguuccaggaguuuugcuacucacuuguauaaccuugggcaggucuuuuaauuuuugugagccucaauguuuccauauguaaaaugggaauacuuuaaguaccuguucuaccugcuauacagauacuuuaugagguucaaaugcagaccauaaaauacuuuagaauucaugguuauugacuucaacuguuacucuucagccuaauuaccagugagaaauuguacaggaacacuuccuguauuggaaauaguauuaacaauuucuguuaaaacucauauaauucaugcuaacauagauaaaugaauuuuagccaguauauauauucagcuguggauuaaggucuuucccaguuccaaaauuauuucaauagcugccuuuguccuacaguaauuuuuucccagaaagguaagagcuauauugauaagauauuaaccaguuaagaaaccuacuuagaauuuguugguuaaucuauacaguccuguuguccgaucaugaguguucagugaugguuuaacuacacuucauucccuccugcuacuuuauggaaacucaauuguggggcauuuuggcauuagccuaaacaaugguuuugaauacguuaagcuccuaacaauuagggagcaguuuggagcauugaauaauguggaaugaugcaauugaaccugacagcuucaacagucagccuacucaugggaccugaaaguuguucacacuugguuucaccucucaucacaugcugaguauugaagccuuacuggcgguagcugacacagaaaugggucugcuaucagaauauguucuuaguaaauauaaaguuugaauugaucuggagaauaugugaaccuuucaauuguucccuaauccaugucuaauguucauucauguuuuugcuggaaacuuuucuaaucaaauauauuguguucccaaauucaaacaauaauauaaauuggaucuagaaacauucaaguccuuacauucuaugugcagcauugcuauauuaucaaauacauaguuuaaaacauuacugcauaaugaggcauuuaugcuauuuaaguuuucuuagggaaauagguuuuaaucuuugaaauauagccacaguucagaauauaauugguaaguuguauuuucuaauaauuuuaauggaaaaauagaaaccacaauagcuugugaaaauaauuuuuaaaguuaagcuaaaauaugagcgcuuaccaugugucaagcauuuuuuaagcccuuugcauauauuaacucaauucucacaguguuccuaugagguagauacuguuguuauccucauuuuccagauggaaauugaggacagagagguuuaauaauuuacccaaagugagauagcuuggcuuaugauauauauggugauaauaaaauguuuuuccuccugaaaguauauacgaauuaggaauuuaaaaaguaaauacugaauuuagugagccugaauauuuuuggaagauugcauuuuuaaucaugugucagggcugaaaagcuugaagcagcuaguuuagagcuuuuuugaaucacuugacuuuaauguuuauugacagguuaauugugcauuaaaaaaaaugcuugcuauauauaaccuguuccuguaugauugaaguaugaaguuucagaucuaucucuagaugauacauugcuguuaauacagugcuuuccaaaggugaaauauuuucaucgguauuagucuuucgaaccuaauuuuucuuauuauucugcgcuuauuaacauuaggcaggaaaaaaaucuaccaaaacaguguccacuuuuaaguuucacauucaguuaauugaggacacuugaaccuuuucccccacgcagucgacuccuuuagcaugagccaaguuccuaggaauuugacaguuacuacuuuauaaacaagcucuuuuaaaacaucucuguggucauaggcagauauuugaaaauauaagagguaaacucuuaauaacaggagaaauuauaagcugaaauauauuuuuaucuuaauauuuuaauaugguaugccagucuacuuaggaaauacuaaguuucuuuuauuuguuuugaguuugaauacugccuugguagagacuugcagacguuuaauauauuaaguuauucuaaauuugcuaaggauauucuuuaacucagacaccugaacauauauuguuuaaaagugacuuaagcuuaguucaauaauuauucaauuuauucuuaaucuacuggucuuucagucuaucuuguaaaauaauuacacuucucuuaaugagguuuuuacuagaguguuacaauaaauguuagauaacaucuugagcagaagugauuuuuaucaguuauuggucuugggaaaggggaaggauuccucuuuaagauauuauaugaaggauguauacauccauauauguauauauaauccuauauauucuuauauauauuauccuuacauaaagaggaaucuuucaaauauauauauaaacuuaaguuuguuauggcaguuuucuuaauuugaaauaauuuucgauauauagaaaaguuacaaggacaguacagagaguuagauauaucauggauauccuucacucagccuccccuaguguuaacuuauauucuuacaguaccagcagauccaaggagagugucuauucacaauagccguucuccuuaccugggcagguuaagauugaaaugucauauaauagguacuucuuuuccaaaaagaauuucuagucuuuguaccagaucuucugaaacagucuucugguauauuaguaauuugcuuucaaugcacuuuucaaaauccguuuccaaaguaugcuguagagaaguauguguauguuaauguuuccuuuauuucuuauuccaguuuuuuuuaauacaaaagcuuucaugcccuugaugcuucauaacccuuauuucuuuggguuaacauggacuuucuuccuuuccccugaaucuuaaugcuuuugcuuauuaauggcagcaaagguuuuugagucuaugaaacgccagacacugugugugcucucuucaguaagccgucuuccucuucugcaucuucagugcuaauaagcugugggaucuuuccacuaaaagguggggguuucuuggcuuggagguacccagucuuuccgaaagacucaucaagggucccaguauuaacuguuccaaacaucaguuaagaaauguaggcuaagcagugacagucauuuguguagucuuugguaucucaucuuaccaaccuuaaaaugaugacguucaugauuucaguuucccagcagaaauuaauauggaauguaguagauguuuuuauacaccaaaaugacucuaucugguaaaauuaauaacuuuuaauuucucuuuugaaagucucuuguuuagauaaaugccuuuacuagaaaaacaacuaccacauuaauuuuagcuaacccguuugggaaauuggucauuuccaauaauacuuucauuuauuguaucaacuuuugccagccaucuuuuaaaaauagauacuuuccuucuuuagcauacgcuaaagauacuuuaucuuuuuuugaugaucaucauuaugcaaauuaguuguugugccauacuccuuucuauuuugaucuuuaguauauauagaucuaauagauagggaaacuaagauaauucagagacuagaucaagaaaaugccaccccucugaaauuugaagcuaauaaggauaaauauuaauauaaagcccuuggcagaaggaacccuuccuaaaaaagaguauauuucuaguucuagugagaguuggaucuuuggauucuuaucuaaggcaagugaugagacugauaauugaaagcaaaaagguauuccaagugauauauugauaugucacauagaugacugcaugaacgagagucaaaaggcugggaguguuuccuugcuuuggaagugcuaaggcaucuagaaguacacuuuauaaaguuaauaauaaacuaaaaugagaaugcuauccucagugucuucuuggaggaccaccguauccgcauucuguacuguguuuucucuguugguccuauuuuucucugcccuguccuguggucagcuguuacuucuuggugucaacagacugucucgagauaagacuguuucuuccuccuucuaauuaauuuuccauuucuaaucuauuaaauguguaguggaucuuuuuuagaauuguaucuacaguaagaguaaauuggcucuacaaaagcuauuuuuaaguauuaggaucugagacgucaacagaugggacugguaauaucuguuuuuucuguugaauuguuuguauuuuucuuauucuauauuguuuuauuaauagcuaagauucccaaagaauugacuucuggagagagaaaaaaaucuuaacuguaucucuguuuaugaauuguguguuuuaugugcccucuacuacuaaauacaugguaagugaacagcacgaucuucauguugaaguuauaacuuaccuuuucccgagggacaguugauuguuaaacaggacugaagaguaccaacuuacugacuuugucugcauauuuuuaauaagaggaaaaacaaaacccagaaauugacagauuuaauuuacacauuaaagugugaacuauaaaauacacgcuuugagauaauagaaagcaaggaugguacaucccagaaacuguuuccgugaaccauaaacgcacauuuucaugcuuuguaagugggcugaaggccaagaugcaaugucaugaugugagucuguccagaaauacagcuucuucucuguguuauuuugcuuacaacuacuguguugucuuagucucuugugugcaguuauacauauccaaaugucccccaucuuuuguucuuguuauucagcuucuuuacgauagaagugcuuuaguucuuugccgauauuuucaagaguuuuguucugaaauaacugcaaugauuuuaguuuauaaaagcuucaguuugauuucauucaugaaaaagaagaacaauucuacuuuaacauuugugguucuguuaaaucugagaauuauuucaggccacugagagucuucugugaguaacagcauuuuguauacaagagauuugccuccaaaaugucaaauuuuaaggucauaauauucuuggaaagugggagagagcaugcacaucaaagaaagcauuuuuauuacaguggauuacgcaauacuuuggccagccuccuuagcuucaucuguuuaaggguucauuuucgcuuguuuggcacaggucccagugaggccuucagaauugugguuagcaacaugaaugaauuacaaacuuuggacgagcucuucaguuaguagagcuggcuugcugccaaaaagacagugccuuauauggggucagggcaaagcugugauucguugaguccugcauuguauagaaaacauacuugggaugccuguuugcuuucuuuuaaaauaaaaacaaaacaaaacagaaaaagcagcaggcuuccaagucuaucaaaauaggaaguaacaaaauagugugcagguuuuacuaaugacagaguuaagcaauggaaauacagcucccuguagcuaaaauacuagaaguaaaaguuggacuuuugaccuccuuagccagcuugugauaugagagauugaagcauuugguuagauaccuguugucuuccugcuuuuauguuucagauggcuuaauaagauuaauuagucucauguccacaugguugcugugccacugggguuugguaucagcuagauauguugaaaauuaaaagcaggaauaguuaccuuccaacgugccaguucuucuuuuuuaaaaauuuguaguuauggccaggcgcgguggcucacgccuauaaucccagcucuuugggaggccgaggcggguggaucaccugaggucaggaguuugagacuaaccuggccaacauggugaaacuccgucuguacuaaaaauacaaaaaauuuagcugggcgugguggcgggcgccuccuguaaucccagccacugggaagucugaggcagaauugcuugaacccuagaggcggagguugcagugagccgagaacgcgccauugcacuccagccuggguaagagugaaacucuuucucaaaaaaaaaaaaaaaaaaauuguaguuacguaacuuuuuuuuuuuuuuuugagacggagucucgcucugucgcccaggcuggagugcaguggcgugaucuccucucacugcaagcuccaccuccuggguucacgccauucuccugccucagccucccgaguagcugggacuacaggcgcccgccaccaugcacggcuaauuuuuuguauuuuuaguagagacggggguuucaccauguuacccaggauggucucgaucuccugaucucgugaucugcccacgucagccucccaaagugcugggauuacaggcgugagccaccgcgcccggccuaguuauguaacuuuuaaaaaauugacauguugaaugguaaaacaaguaagaacgaaauuugcuuuucagaaggucacaaauuuugcuuauauucuuagguuggagaauauaauuacuagaucuauuagaagggaaaacuuuuaauauauuuucacauauaauucauuuaucauuguaauuuuuuccauuuaggcaaauacucuaucuggaucuucucucagucaggcaccaucucauauguauggcaauagaucaaauucaucaauggcagcucuuauagcucagucugaaaacaaucaaacagguaaguuuucaagaauuacuaacucuaaaacccuacucucaccuacuuuaauuuuuuuccccuuuugguucauuuuauuugaaaacaugcagggaugugguuaguagaggauuuguacuuuaaaaaaauauucacaguuggaaaauguuaaauauuucaggugcugguuauguuaacuagcuugauuuuauuauuccacauuacauucauauaucauaacaucaauuuguacuccaaauuuauauaauuacaaacugucaauuuacaauaaaaaagaaucacaguuggaaguaaauaguaugcugugcugcaaaauagcaauguccuuuuuuuuuuuuuuuuuuuuuuuuuauugucugaaauggaaauguuucaacagagccaucagcaagcaggaaugcagcagugucuccugugacuuuugugauugauguguucaguucucaguucuaugcaaugaaaguaacauaacacugggcuuuucugugaauagccuaaaccuuuauuugcauaauucaugaaauuguauuacacaaacuugguuaaaaaaauccuguuagagaauuucugcaguguuuaguaauccugugaauguucaccaguugacguuuugucgcauuugucucuuguacugucuuaaugagccacuggauuugcuuuguuucauugcauccuuaaggauugguugacauguccaaguagucaugccuguuugggggaagggaauggauuuagcaguucaccaagaauggaucagucugucuuuaccguuuaagggucagagguuaccugacucagaauaaggggaggacaaccuugaaagaggccagauaaggugauuuuuauaaggaacuaacugcaggggaaauacaaguuacuuuccaagcagagauauaugauauuaccuaaggaauauuuugaaaaguuaauuuuuuucuuuaaaauucaggauucuguauuccuacuuguuuuugucaauuuggaaauuuaguguuuuauguaauuuuauucuugguguaaggcucuagugucuaacaccauaauuuuagucuuggugugcagcucuauguaaauguguuuuauggcuugucuugggaugcaaaguguuaaaaaauacaaagcauacggauuugcugugauaagcauacagauuagcuguccacagcugugauucauuacuuuaaccguagaaauuaaaaguggcugaggggaggguacagcaaaugcaaaccacgcuucugugcuguaaaauugaaaggaaugaaagaacagaacauaauccauggccuucuacacccacaaaaacguguagggacaacgccuuacaugccacaguucagcaauucugaacuagcaacaugcuagaucuucuauuuucgugggaacugcaaagauagugguaaagguuuaauguauguuuuaggaaaaaucagggcaagaguuuaaaaccucuuaucuagugagagucacuuuaucagcucugaaauauuuacacuacagaucaagaucuuggagacaauagccgcaaccuaguuggcagaggaagcucaccccgaggaagucucucgccacgguaagcgcuauuuacacugcaaaguauaggcaaaggaaacguuugagauuuggaaacuuucuuaucucauaucaguagaguguacauuugugaggcuauaaaagcauucuacagauaagaagcaugucuagacaagaaaaaugauucuaaauuaauuuaaauauuaauuuaaacaccauuagauuucuaaguaaaacaaaucccuuuccuuugguuuccaaucaguucgaacucucuuguauuuauuaccuguauacugauuugaguaauucuuuuugaucauaaaauaguuuuaagaucucuuaaaguuguagacccaagacuuucaaguuuggguuccaguuuuagcucuguucuguguagcacuuaaucccuuagucucuaguuccuaauucaguaaagucgugugguagaucacuaaacuccuacuaguucuuaaauuguuugaaucaguuauagcaaauguauuacaaguuuuuugaaaucauuuuaugacaguauucagguaccauuuauuaaaaucuaauuaauauauuugggguuaucaaacugcauauuccuucuguucuaaauggggagaaugugguaugagauacugugucugcuuguaggggagaauggaacuuuggugauagcuaucuccuuauuaauuuuauuucccuucugugcguucucuuuguuuucuccauguucucuaauuuaggaacccucccucaagcaugguguuagacugggugacaauggagaguaagagaaaagcccauucuagggucuuucuuccaagaaugggagaaacgugauuaaaaaugaaaacuuuggucaggcgugguggcucaugucuauaaucccagcgcuuugggaggccaaguuuggaggauugcuugaggccuggaguucaagaccagccugggcaacaugccaagacuccaugucuacaauuuuuuuuuuuuuuuuuuccaaaaugaacuuuuucaugugaugacagaucaugaauaacaguauugcugauauauuuggggaaugucuguuaaggaacaucuucuuuauccuaaagauuaguucaguaaccacuaauuucauuuucuaaugguacaucuagugaugccuuuuuuucuguauaauuccugggugaacuaaaaguaguauuguuuucccugauugaacucugcagaaaaucaaauauccauucuuuggaaaccaggaaucugaagaacaaugauaacaugaucugacuagucugugauuuuaugcugugauuaauucuauguuguuuuucuuuucaaagaagaaaguuaauguuugcucaguguuuaguggaagaagcauuucucuguugcccuuuuaaacuuaaaauauuacaagcuaccgagaauuauuaagaaagugcuauuuugcuuaauauaguuuuuccuuuucauuaguuaaaugggacuuaacaaaugguacuaaauuauuuuuagcauauuauuuccaacuuuauauuacucuuuagaaaucagccugagauguaacagccuaaauuauccugguauaguguacuauuugcagagggauggccaacuguauguggcccauaauguuuacauauggaauaaaaaccccauuuguuuaacaucuuacgaaaauuuugcagagacgcauauuaaggcagugucaagaacacuaguggguuguuagaagaccugaguuguauagcccagcucuugucaccucaccagcagugugucuuuggacaagucacuaaaacuccguccuguuuccucauuugaaaauggagccaauaaaccagguuuugacuucucacuagguuguuguggagaucauaugagauauauacaaacgcauuggaaauucuaaagcucuuuaaauguauuauguuagaaugauagcuggagaccggaaauggccacacuuauuuaaaccaaaaaguguagagaacauuacauguucaucuuaauacaagugcuguuuguuuuagaaggguuaucauuugaaguauagaucuaagacauuuuagaaauauucauguaaaaggaucaaaaauugcuuugggggcugggcacgguggcucaugccuauaaucccagcaguuagauagagaggccugggcgggaggaacacuucagcccaggaguuggagacuaagcugggcaacauggugaaacuccgucuccccugcccaaccucccccaccgccgccuccccgcccaaaaaaaagcugugcgugguagugugugcucuuguggucccagcugcucaggaggcuugaggugggaggauugcuugaacccaggacccaggaagucaagacuguagugagccaucauugcaccacagcacucuagcauggcugacgaagugagacccuaucuccaaaaaugaaaaaaaaaaaaaaaaaaaauugcuuugaucuuauuucuuaauugugaaaauacuugaaaaugaguaauuuuuaauuuauaacaaaaggcugcuuuaagauucuuaaaaauuucuuuuuagugacauuugagauuuuaguugguuguaaauucaaauaccuuuuacaguauuauacuuuuucagguuauuaugauggcaaauauaucaaagcagaauggugaaacccuuuucugggaaauuauuuuuaagucuaauuuugucuuucccucuuuugucuuauaaugccauaccaaguuauuuuacagccuauuucagagauuguuggugguguguuuauauuuucuagugguuuuuaauuaucuaugauggcuagcuauuuccuugauucuauaauauugggaggaagaaugauaauuacucaauuuuaggguagauuaugguuuucuaaauccaggaaccugauacuucuggcauaggcagccugguguuauaaaacucauacaggagaaaaggggucagcuuaagguaagaaacuguacucucuuaaaagcauuccccuucuuuuuaacuugagaauuguuuucaacagauccccuguaagcagcuuacagauucgcuaugaucaaccaggcaacagcaguuuggaaaaucugccuccaguagcagccagcauagaacagcuuuuggagaggcaguggagugaaggacagcaauuuuuacuagaacaggguacuccuagugacaguaaguauucauuuucuuauaugugaaucaagacagaugggcagauggacaaacaggcagauggaugcagaagucacuuuucauccagaguaguaaugggauuaugauauacauuuuauauaauacagugagagaaaguauaaggugaagugguuuaauagaagagauucuauaguguuacugcuuggacuugaauccugucuuuaccuguuauuaauaguaugaucuugggcauguuuuuuaaaguucuuuaaucuccuauuuuuacaauugggaguaauaaugcacccauaucagaggguuauugugaggauuaaaugacaugaaaaauguaaggaccacugccuggcucauacauagcauugucucggugcuuaccaugauuauacauauugguacuuugugucuccacuguacuuuguucuuaucaaucaguuuacuaaaauacaugagcacugucuucucuuaccccaauuguuagaagaaaacuugcucaccucuggaaaacuuacuuuaaaaaauacaaauagucaaguauggccggcuagcuucuucauuuuauaauuuggaggaagaauaauaauuauugaauuaaaucuauaauuaguauauauuaugcuuaucaucuauuggauuauagagcauguacuauauaucuguguuucaguaucuucaccauuucaaguauuagggccguggguguaaaaugcagaguuaaaauagguggugguuagcuggagauguggccuugucuuaauuuuagggaaaaauaggugguuuucaucauuuucgaguauaaacuuuugcugccucauuuuauugaaacauuuugcuuauuguuggcuagcuaagugccauaaauugguauuuuaugaaugguacccugacaaaaaaugcuaauuaauugugaggaaauucaugccaggcuaauccuuuaaacacgauagcuggaggauagguuuagcugagucuuauugcaucucauuugggcccacuaagguuucuuugugggaucuuggaggggagggauaaaaguuaaauccaugggaaacggccagaugugucuguaccagaggaguuguaucuucuaaaggcccugaggucauguuaaacaaauacaacuuuuuaguaugugacggacacuucaaaaaucuuaacggcaacacucuguguuguuagcugggagguccaaguuguggaaggaauugaaguacuugaggugauggggccagacugaaagucagccuguuuacaggggaugcgccuuucuccaggacuggagagguggcugggcgcacacauagcgcucccugcugggugaccugcagagcaacaugcugagcagcugggauuaggggcuuccugccaggcgucugauggcagcacuucguuuaaaccggacaacaaacaaaaacaugugcucauuauuuugguagaggguauuggugcgauccuuaaccauucuguauaugacuucaaugcaaaauagugacaggcacuugaauuuuuaauaggcuuuuauuuugaugaaaauaaaaugucauuacuuuucauugagaauggaaaauuaccugaagcugguguguguuuuuugguauguggcaacaaaguuuccagaagguacauccaggaacacuuugccuuugugcuuauaaaaauacaaacauagauaggcaauuuauauccauaaacaaauuuaggaacaaaacuuuaucauuuagaaacacuuuacagaauuucuacuguucuauuuuaacuuauuucuaagguuaccggcacugcguaaaauacuuagucuuauguguguacuugucauuauuaaaaacuauccaaaugugugguaguuuuaggaaugcugaagucauuacaccaacuucaaguugaaaaccgaagauuagaggaacaaauuaaaaacuugacugccaaaaaggaacggcuucaguuauugaaugcacagcuuucagugccuuuuccaacaauaacagcaaauccuaguccgucucaucaaauacacacauuuucagcacagacugguaagugugaaaauauuuauuuuguaucuaaggaaaauaggcuuucaguuuuauuuguauuauaagugaguaauaauuggucaccaguuauaugaagauguagaaaaggaacuauagguuguuuuugaagggcauaaagaauccuguuaagugaucaacuugaauuuaacuuucuuaguccauaauauaaugguaaaauuuacuuaaaugucuaaugaucucguuauugauuuaaagcgaugguauucaauauagauuuuuuuuucuuauuuaaaucagucuuaggaauagcaagacuagauauuuaagugguuuugauacgggcuucagcauaagcuuuuuaauaagccuuuaaucuuacacauaauguaauuuaauaggguaaauagguuucuuuuugucuuuuauuauucuagcuccuacuacugauuccuugaacagcaguaagagcccucauauaggaaacagcuuuuuaccugauaauucucuuccuguauuaaaucagguaauuuuuguaugguuauuuucaucuauguugauuuacuugugaauaauaguauauuaaaugguuuaaaauuauuuuaaacaguuuugcaguguucuuuaaacuuaguuucucuucuuucuuacgcugggacuuaauguccaguggacuuaguuucucuucuuucuuacgcuaggacuuaaccuccaguggacaaaguaccagcagcucaucagcucuuucuaccccaccuccugcugggcagaguccggcucaacaaggcucaggagugaguggaguucagcaggucaauggcgugacagugggggcacuagcuaguggaaugcagccuguaacuuccaccauuccugccgugucugcaguggguggaauaauuggagcuuugccagguaaccaacuggcaauuaauggcauuguaggagcuuuaaaugggguuaugcagacuccugucacaaugucccagaacccuaccccucucacccacacaaccguaccaccuaaugcaacacauccaaugccagcuacacugacuaacagguaagaaacuuaaguauguuuuggguuuuuuaguauaacagaguaccgguguugucuaugccuuagauuggggcuuucaauguguuccuuuguagauacaccuuaagaagucugccaaaaauuuuaaguauauuauacagaguacauuuauuuuugaaacuuaaguaauuuagauuaaaauuaaguuacuuuuaguaacagcauuauguucugugcugaaaauuagucuuaaucugugaugucuguuuuuaaauacuaguuuuucuuauuucuuuguauacuguaucauaaauucugaagaaagauaucguaguggagauaacaugaauauuaguuuccuaaaauuuauguaauauuuuuaauguucuaaucaaagauuuugauauaggauaaaggucauuuaucugaauucccaggaagugagacucacugguuucauuguacuggaacugcauuugaauguuuguucaaaacuaggggacuaaagcuauguuguuauuaagcauacuuuugggggaauaaauacuuuuaaauggauuugcaguggguacuagaaagcuauuuccuguagcucucuuccuugguguuuaguuuuaccauugggaccauuagaaaaggauaggucaaaucagugguauguuuggauucuuuguuucaaauauguguuuacuuagugugaguuaaauuauccuugaauaauuaaagauaaauuauuacauacgcuuguuagaaacacauguaaauuucuauuccauaaaaugaguuagggccuauuuguuuuauaauaaaaacauuucuugacaaugugaauucuuguuuagcuguacacauggauguauauaaacauacauauauauagaaauuguacauaacuguuuucagaguguuuggauucagaauuguacuuaaguuauuaaacaucaaauugaaaaguugucuuucauuuuuagacuucuaaaaaugcauuagagguguguaguaaaaaguaagaauuguaaucauuuuucagugccucaggacuaggauuacuuucugaccagcaacgacaaauacuuauucaucaacagcaguuucagcaguuguuaaauucucaacagcucacaccaguaaguucuuucuuuugauaauaucuuauuaggagcauguguucuaagcuguaauauucacuguggguacagauuucuccuuugugaaauaacauuauugaaugcauaaucaaaaaaguuuuucuugccaugugguacaggcugugauaccugcagugaugucacauucauuccugaacuuaaaagugacagggcacguggcauggugcugccauaggcucugguaacacagugcugagauguggugcguguuuucccggagcuucauuuugauacgggagauggauggacacgaugcacgcuuuuugguugugauaaauacugagaagaacaaagaaguggaauaaguggggaagagcauagggaaccgaggaccauuuuagauaggauggccccgccucugcaaggggggugacuuuugagcacagaccgaugugagaguucagggagugugccuuugugacuugagggaacgcagagagaaagcacguuggagguaaaggggcagcugcugucaaaggucuggacguacuuguguucggaagagaagucagcagccauguggucagagggugggagaggucagagccaaggggguggucuuagaugaucgcauacagccuuucuuggcuguggcaagaaauuuggauuuuaucuuaaguaugaauggaaagccacuggcgaguuuuuaaaaaucuauuacggaggauuucaaguguaccaaaaguagaguggagagcacccugaagaccuauguacgccucauuccauucucucacccagugcuaauaaucuuaguuuuguuuaucucauuucauucuccauuuuuuucaggauuaagaauuggaagguuuugaacagaauagugaaauaaugauuuacauuuuaaaggauuaguuuugcugcuauauggagaauagucuguguguguuauagggugugggggagugaagacagaggcaaaaguggaaaaagggagugauccaggcaggagacguagguguuaaaauaguaugggcuacguauugaaaacugccuggaauugugguauauauauguauauuuuugagagggaguuuugcucugucgcccaggcuggagugcaguggcacaaucugggcuccuugcaaccuccaucuccugggcucaagugauccuccugccucagccucccgaguagcugggacuacaggcaugucccaccaugccuggcuaauuuuguauuuuuuguagagacaggguuucaccauguugcccaggcuggucuugaacuccugaccucaagugaucugcccuuagccuuccaaagugcuggaauuacaggugugagccacugugcccagccaagauguuuugaagacagaaccaacaagacuuguuugcuggacauacaagagaaagaagaauucugaaugguugguuagugacuuuuacugagaugugggagaacagaacccaaccaauuuuggagagaaaaauaggugucauggacacacuaagcuugaaaucucuuuagauguacaagucaaauggagauaaggcaguugcacaguaggugucuggagucccaggcagagaugcaguuaguuagaaaucugggguuagugcugcacaggugaugagagccaucagauuugaugcggacuccuagagcaugaagacugaguccuggacacccuagaaaaggagaauaagccaguaaagaaaggcuauugagaaacuguggccagugagccaagagaaggacaguguggcaucuuaggggcaaggugaaggaaauguuuccagaaagggaggagucaacuguguaaaaugcuucugugguaggguaagaaagaauugaccaaccgggcgugcuggugcaugccugugguuccaguuaauugggaggcugaggugggaggaucacuggagcccaggagguugagggugcagugacaccugcaccugacagggacuguuucuuucuuaaagguugucuagaggcuuuuuacaguuugggugugaugaaaguaaaaaccucauuaaaugguucaaaaggaaaugggagggagaggaaguaaagauagcauaugggcaccucaagacaugucacuuuggaaagcagaggaaggggaagcaggaggcagauguggugggcacacggggcaguuucgacucauuuugaaugugacagcguguguguauguugaugggacauugcugggauaggagagaagaaaggugcuagcagaggaggagaugagaacgguauuucacugccccagcaaggcaggcagagcaacuggagguggguuuuauguggaggguugaagcaaucccacuuucagugcuucugauuuucuuaauuagaaguaaagugaucagcagagggaaggagauggguguuaacgguuagauaagaggggagaugggaaauagagaacuuguagaaggggagaaaguauggaccgagacccaagugggauuguggcucaggugcagggcaggccuggcccuguggacagucguggggcuuccuccagacccauuucccuagcacucuucauucaguugggcugcuuggagaaugcauugcuuaauuaacauagaaauuacaaaggcugacauccuuucuaaguauauuuauguacuauuuugcugcagucaaaaauauauugaaaauacuuuugauucuggaucauuuucagucuguuuuuagagugguguuaaaggcacacugcauguaaguguauauaaauucuuaaaugcuggccgggcgugguggcucaugccuguaaucccagcacuuugggagacggaggugggcggaucacgaggucaggaguucgggacaagccugaccaacguggugaaaccccgucucuacuaaaaauacaaaaauuagccgggugugguggcgcguguguauaaucucagcuacucaggaggcugaggcaggagaaucgcuugaaccaggagguguagguugcagugagccgagagcacaccaccgcacuccagccuggacaacuagagcgagacucggucucaaaaaaaaaaaaucuuaaaugcugacacuaagaugggaucuuguuuuuucuuaccaguugccucaucuuaauaugagcacuaaaacuccauuuauuugggugucuuccuauuaaucaagauuuuacucuaauaauagcauguguagcugucucauuuccagaacaugguuaaggaauuuucagcacaaauuauugcuuggagaccaugaggacuaaaggacuguacuuuuuccuucaucugccaaugucgugggcuaaaguuuguucauuuacagggaucaaacuuaacguaggugaggauuuuuuggaagccuccgcacagcuuccgcucgacacucuugcuugacucugcuucccccagaugacuugcauguuugcuaaauccaguggucccuucucauucuucaucuuaacgucaccuggcaacggcauuagacagaguugaucgcuuuuccuccuccuugaaacauuuccuccucuuagcuuccaggauaccacaucaucuuggugucuuacuaccuaacuggucauuccuuuuuagcauccuuuccuggguccuccucuucagccugagagugcccaagguggaauucagugaucucucaucacugucuguaaauagcaucucugugcugauacuuacaucuccagccagaccucucucuggagcuucaagcuccuguaaugcagcugcucacucaguagcuccgcuggcauaucuuaaaagacauuucaaacauaacguguccagaaccgaacagcugaucuuccugcacaaccccgccccacccaucguuuuccucaccucagcugauggcagcuccauccucacucugacaccccacauugacuccauccugaaaucagacugugccacuucucaaaaccuucccguuuuaccaugaauacaagccaagguggccaugccuugccacugcaagcucuguguucuccucacuuccuccuggcucccuccacccuucccggguccuugcugccacuggauccugcugggccugcuccucuggaggccuuuggcacugccuggaaauccucaccugcccccauauccacccagcgaauucccucuucuccuccaaaucuucauccagauguuaacuucccaaugaaaacugcccuggguaaucugcuuaaaauuacaaccugaccauuaaacccuacucccuccagacuuucucauacacaguuguguuucccuugacgcagagcaguaaucacauucuaacguuuucauuuauuucccuuucccugcucaauguguuucaagcaccaaaagcagugccuggcaccuaguaagcacucaggaaaucuauaaauauacgcugcauggaguauaugcuugcuguagagugguaacugcaucaagaaagcacccuaaugacaggcagaaacgggaacuuuaagguuguuuuaaguuuggaaaggguuugaccacgcaugaugcauucaaauguccaccuugauuucucuuaagcugcugcacuuccugauugaucaucacggauaaccuaauagagcucuccuauguguguccuguuuugaaaauaagcuguuugcugaagauacugacauuuuauaguagaugguuauuaucuagugcagcauauuuuucuagaugagauacuuguuuucuuucuuugcaaauaucuaauauuaaaggaaagaaaacauaaggcagcucaucugacugcugaauuccgugcuugggaacucauuuucucucacauguuuuuugccuaaggaacaacaucaagccuuuuuguaucaguuaaugcaacaucaccaccagcagcaccaccaaccugaacuucagcagcugcagaucccuggaccaacacaaauacccauaaacaaccuucuugcagguacacaggcacccccacuucacacagcuaccaccaacccauuucucaccauccauggagauaaugcaagucagaaaguagcaguaaguauauuuuccuuacuacaucuaaugaaacaagaacuguauugauuaaucggagaugaucauuuuccagccugguuuuguuccccugaucauuucuucuuaaaaccaguugcuuuuagcagauggauauuauaggcaaaggaucuaagccaauuuauacguccccuaaguauaucaguuugaauuugcacauuagguuugaaggcuguuuuguaauucagcaauuuucaagaugacaaaguuagcaagucauaugggacaaucaaaucaaaagacaauaguuggugcuuucugagaagcuuuguuuauagaaccagucuauauaucuuggaaauauuuuuauuuuacuccaaagugcuuuuuacacauuaaguauauuuauuaccaagaugaauauauacauuuuagggcacacaauccaauaauucuaccagauuagagggaguaaaucacagucacaucuguaauggaauucaaauuuuuaguuauuaauuucauguaagugauggcaucguacccuuucaaugugaaaguuaaauuaaaaauggaugcaggaacaguauucuacacauacaguagaacccauuuuaaggccguuucgauuaauucuccccuucaauuaggucuacuuuacuggaguauaaauguuuccccuaaauuccaguucagggcagaacccuguuagaggaaggcuauggggauguagaauggagacuggacaucaggaaaaggaagaagggagggacugaggugggagacuuggcaaaugaguguucaaaguugcaguguuugcuguuucccguuacuuugaaaguuuuguuuacugugcuuuuagucuucagaaacuuuaguuuguacuuaguaacgagaauuauucaaaauagaggauuguuuuucaugaacucuucagugcuuucugucugcccucuugucucgccuacuuccugucaucacacaccgcauuaccucuccaguguucugcugacauggacaguuuucagugauucuguauugaguucuuugguaguauuuuuucccccccaguguuucaccaaguguuuuucuuguguuaagaaaugcacuaauuacaaacuuuuccuagguuauacaauaugaaauguauuuaauggaaaaucacaguaauuuaaugagcuaauagagugcucauaauagagaacacagugcugggaggugcuguuugcuuaguacccugcuaugugccagguguccuugcaagauacagugacauuugugauuucagucuuuaauaauaggcuguaacuccauuuuuuuuauagauuaguaaaaggaaacgcaaagaaagcccaaggacaaauagcaaauguggaaucacagccgaugacuuucuuagcccauaaaaauuucauucucuacaguaccauguuacuucuguggaaaaguugauuuuggaagaugaauucugcauucauucuuuacaaguucugucccucagaugggcccaccucuuuggucuuuuuauacuguugaauuuaauguuuuuaaaguauuuacuaguaaauucaugucuauauauuacguugcaaguagccuugccaacuugcaagaaaaaagggaguaacuuucuauaccacauuuuaucucagucacaguuucaaauucggagaauauuaucaaaaguugauuuagcuaacgcaucugcucuuuuguuuaccugcagagacuuagugauaaaacugggccuguagcucaagagaaaaguugacaccugagaaacaucuagaaauugccuauccugcuguucuagcacuucaucuggcugccuuugcaguccuuuuacuacagcuaugaagaaacgcaacaagaaacucaaugcacaacaaaggauuaauugcugcaaggacauucuuguaaggcuuugauuaguuuucuuguugcuuuguugcacugaaauggaauucccaugccccuaccccuuaccccaguuuuuugaacauggaaagaaaauuuaauaacuuuuuaaagugacauaauuuacaugcaauauguuuaucaacucaagaauuuaauauaguugguacacaacuaguuuuguuuauaaauuggagaugcaaauagcaaaacuaaauacuugcuccauuuacaaacuacuugauuuuauuguacaaguugaaauaugcucuuuuguuuggguuacaguaugcuugcucuaagucaaauuccaaggaacuaauuucuucuccuggaguugcauugauucaguauuacaaauauauagcacaucaccugggacuuggcaaucuuuguuaaaaaaaaauuuccuuucuaaugggauuuggccaauuuugguaaugaaguuaggaugguaaugucugcaucugcuaaagguaauuuucuuuugagaauugcuuucuuuaguguuaagaccuacucauauuuugaagaaaucuugaguuaagugaguucugaggcugcugggggaaccagaucaauucaaagcuaaauacuucuuucagaaaggggccacuguggaaagugcuggugggguuugcccuugaucaagugccuccauugugcugcaagggcuguagacagcagggugggacagucaguccuccgagcagcaggaaucaucccgucaccugcagccuucccaugcuuccgccuuuauucagaacuuucugugccacuguagauagcucaggcaaaacuauuaccuggguauuuauccacuaaugagucacaagaaaaggaguggauuugguaagaauagagauuuguuuuauuuaaaccacuucccauuacugaccauuaaaagcucaccacuagaguuccugaaacaggugaaaccuguaugacagcccuuccacuuuggggagccacgcuuuugaugugacaguaccgcagagugauucccccacugaggaugucaucaucaaacucuucuuuggugugugaauuauuaguggaaaagacccagcuguaauuagaccuccacuguguacuuagcuggaagaacauguuaauucugcaauauguuucuugguuaaacauugcacaguucuuaccucauuucuguaaauaaaguuuugugaaucuguuuuguauugugacaaauucauaagauaacauugauauuuugauuuguaauauuucuaauugguagauuuaauugaaaaguaaaauuaauuuauuuuuauauguucaggggaauuuuaaagucaaaucuuuuguagauaauuuaaaaaaucagugugguuuauuuuacuuauuuaacccacugguuguuauucuguaacaguuuguauaaaugguaaauuuugaauguguuguuauuuuaccuagauguaaaauuccacauguauuaaaauguacaaaauguuuuguuaauaaaauuuaauaauguuuauaa

SEQ ID NO: 191179 - RNA, 49132 nt, Homo sapiens
gccagaggcggagccgccgcccugccgcgacuuucagacuccgaccauggccucgcgcugguggcgguggcggcgcggcugcuccuggaagccggcggcgcggagccccgggcccggcucccccggccgugcgggaccguuggggccgagcgccgcugccgaaguccgcgcgcaggugagguugggaggcgcgcgcccggcggggcucagaggucacggcuccaaugacagcagugggcggaaugaaugggagcggggagcacgugcgucgcgacgcgggggcgcgcgggguagcuccgggguagcuccggggugggacuccggagcugaggggugcucgcggugggacggagccgcgcguuggacugaaguaggggcgcccuacacgggguugcagaaagcgguguccuggggaccccgggagcguuuugggggguggagaaagcggugggauccguguccugggggaagcgcaggagcgaucagauugaccgcugcuauauggacaagguuaagccuggagagcgacugcagcuauuuacuuuggaguuagaggaagacagaucuugccugaaauuuuagagccaaagugcucagagcucucuccgagaaacggaggaucgaaucggccucggaauaguccgaaaaggucuuguggagaaugcagggcuggugcuaggguggaccggaccuuaguuguccagcaguggccucgggaggagagcacaccuggauggggcuggaaugacacuggaaggagaaaggcccgaggccgucaggaggagagaaacccuggagucaucuaaagucagaaucucagcgauagcccauucuuucagggucuccucugcugccuuuggguuccgaucuccuuuuucucccuuucuggucaguuuagccccuguaaauggacacugugagcccuucugcgcuuuguaaugauucucagugugccaugggguaggcccaugcuauuagcauaaccgugcaaaaucuauggacucacuguuacuuaaguuuauuugaauuuaguacucuuuuaauucagauuugguauacuuuauguguccguguucucaucaaacaucauuucccaguaugaaauauauaacacuuauaaauaucuacuuuguaccaaaguagaugcguaucacaaauuauccaaaacaaggcuugggccaggcacaguggcucacaccuguaaucccagcacuuugggaggcugaggugggagaaucgguugaggccaggaguuugggaccagccuaggcaacauagcaagacucugucucuauaaaaaauagaaaaaauucaccaggugggguggugcaugccuguaguucuaccuacucaggagccugagggaggaggauuguucgaucccaggaguucaagauuacagugagcuguuuauugugauagugccagugcacuccagccugggcaacagugugagacccuaucucuaaaaaaucuaaagcaaaaaagacguuuggagaccaaguggcagcugggcaacuagacaaugcuagagaguaaagagaacagaauauggggggugaggggcaugugggagaagaggcuuagaggaggaagguaggcuuugcugugauccauuucaggacuguucucuccagacuucagauauuucuaguuccacagaagaagccaguauuugaagagaugggugcauccacccucuuaugccacuacaugcuucuucuucuucuucuuuuuuuuuuuuuuugacacagagucucacucugucgcccaggcuggagugcaguggcggaaucucggcucacugcaaacuccaccucccagguucaagcgauucuccugcugcagacucccaaguagcugggauuacaggcguacaccacgacccccagcuaauuuuuguauuuuuaguagagacggcauuucaccauguugcccaggcuggucuggaacuccugaccucaagugauccacccccuccucggccucccaaagugcggggauuacaggugugagccaccacgccuggccugacacuucuuuuuaaaaaaguuucuugcccaccaagcaaccuuagccagggaaagugugcuuuucuggagagaauaugcuuuauggccuccccgucugcaugacgacaaggaggaauucuguggacucaugaugccaagaucauguauuucugaugugugugucagugaugccuuucacuauauguuaauauguuagcauucuggugucugccucaggcauguguauuuugguuacuucaagucucuuagggccugauaguccuuggggacacagaacuacaauaacuaagccacagggacaaagagcggcaauaauuaagccacgucuugcucuccaccagagcucuacuaccuccuaaugguuguacauucuucugacuucacuaguagugugaacaaauauuguaauacaauaaaaaccagugugcaugugaucgugccaaaucacuucucaauauaucuuugauuuuuuuuuuuaauuuauuuuuuuagagacggggacuuuuuguguuggccagguuggucuugaacucuuggacucaagccauuccccccucccccccaccccgcuugaggauuggcacacggccauguauuugauucuuacccagcacuuucucuuuagcugagcgugguggcucacgccuguaaucccaacaguuugggaggccgaggcaggagaaucccuuuagcucaggaguucgagaccagccugggccacuuagugagaccuccugauaugguuuggcucugugugcccacccacaucuaucucgaauuguaauccccaauuauauuuggggaccagggagggucaagggagggaccagguggagguaauuggaucauggggguggauucccccaugcuguucucaugauagggaguucucacaagaucugcugguuuuauaaguguuugguaguuccuccuguguucauucugucuccugccgccuugugaagaaggugcuuguuucuccuucuccuucuuccaccaugauucuaaguuucugaggccuccccagccauucagaacugugagucaauuaaaccucuuuccuauaauuauagauugcccagucauggguaauuucuuuauagcagugugagaauggaccaauacagauaauugguaccaaaguaguuggcauugauauaagauaccugagaauguggaaauuacuuuggaacuggguaacaagcagagguuggaauaguuuggagggcucagaagaagaaaggaagauguaggaaaguuuggaaauuccuagagucuuguugaauggcuuugaccaaaaugcugaaagugauauggacgaugaaguccaggcugagguggucucagauggagaugaggagcuuccugggaacugggcaaaggucacucuugcuaugcuuuagcaaagagacugguggcauuuugccccacccuagagaucuguggaacuuugagccugagagagaugaucugaaauuggaacuuaaauuuaaaggggaagcagagcauaaacguuuggaaaauuugcagccugaagaugugauagaaaagaauuuucuggggaggaauucaagcuggcugcagacauuugcauaaguaacaaggagccgaauguuaauagccaagagaauggggaaaaugucuccagagcaugucagagaccuucucugcagccccucccaucacaggccaggaggccuaggagggaaaaauggauucaugggcugggcccagggcccugcugcucugugcaagagcagcccugggacuuggugcccugcuucccagccguagcuaaaaggggccaagguacagcuugggccauugcuucagaggguauaagccccaagccuugguggcuuccaugugcugcugagccugcaaggugcacagaagacaacaauuugggaacuucugccuagauuucagaggauguauggaaaugccucaaugcccaagcagaagucugcugaaggggggagaacccucauggagaaccucuguuaggacagugcagaaaggaaaugugggguugcagcccccacacggagucccugcuggggcacugccuaauggagcugugaaaggagggccaccgugcucuagaccccagaaugguagguccaccaacagcuuccaccgugcaccuggaaaagcugcaggcacucaaugccagcccaugagaauagcaguggggguugaacccugcaaagccacagagucagagccacccaaguucuugggagcccacccuuugcaucagugugaccuagaugugagacauggagucaaagaucauuuuggagcuuuaaguaaugacugcccugcuggguuuggacuugcaugaggccuguaagccccuucguuuuggccaauuucuaccauuuggaaugggaacauuuaaccaauaccuguacucccauuguaucuuggauguaacguaacuuguuuuugauuuuacagguucauaggcggaagggacuugacuugucucagguaagacuuuggacuuggacuuuugaguuaaugcuagaaugaguuaagacuuuuggggacuguucggaaggaaugauugguuuugaaaaaugaggauaugagauuugggaggagcaaggggcagaacgauaugguugguucugugucucuacccaaaucucaucucaaauuuuaauccccaugugucaaaggagggccuauguggagguaauuggauccugggggcagauucccccaugcuguucuuguuauagcgaauucuuaugagaucugaugguuuuauaagugauugguaguuccuucuguguucauucuccuuccugcugccuagugaagaaggugccuugcuuucccuuuuccuucugccaugauuguaaguuucuugaggccucccuagccguuuggaacugugagucaguuacaccucuuucuuuuauaaauuacccagucuuggguauuucuuuauagcaaugugaaaacauacuaauacaccucguuucuaaaaaucagcuacgcauuguggcauguuccuguagucccagcuacucaguaggcugaggugggaagauagcuugagcccaggagauugaggcugcagugagcuaugauugcaccacugcacuccagccuggaaaaauaaaauaaaaguaaauucaugagaggcaagguugacuuucagagagugugugagggaaagguaagaaacaaaaucggaauuagaaaaugacuguugccccucucuuuucauucuucacugcuuuucugagcaccucucaccucccuuugaaaaacugcucuaaaguacuuuuaaagcagaaaauaguagcuugauugaauagauacuguauuaaauguauauuguguaccaggcucugagcuaagagcuuuacaucugcucucuaaauuaaucuccaccucucuccaugaguagguauuaucagaaagacaucacaagguaacacaaauguugagauuugaaccgagaucugucuuccaaaguccaugcuacuaauaauuguuaggccacuuggugguaaaaagcguccccuguauuaauuagcuguguaauuuuaauccuucaacccagauuaggggucuauaacugaauaacuaaaaaguuauucaguuagaauaguucaguuaguuauuauaacuaaucauaguuauuuggucaagcgcagugacucacgucuguaauuccagcacuuggggaggcuguggcaggaggaucacuuuugcucaggauuucuaauaauaguaacuauuacuagagaccugauaauaauuauuaagucucuuacugaagaaguuuuacucuuccauuaagaugcccuuauuuauaaguauuauaauaaaauacugaacucauaugaauuaauuacccauguagacugaaagacauagguugucauauaaugguugucauauaaagcaugaaggaggauugucacuuuguuuucuuguugcacuguaauugccugggauaucaugaaaguucuuacugguuuaaugaauauguaaugcugugggggaaagaaugaaacucaggccaacuacuuugacuggugucuggcaaagucaacuuucauugucauuuuaauauggcgccgggcgcgguggcucacgccuguaaucccagcacuuugggaggccaaggcgggcggaucaugaggucaggagaucgagaccauccuggcuaacacggugaaaccccaucucuacuaaaaauacaaaaaauuagccaggcgagguggugggcgccuguagucccagcuacucaggaggcugagacaggagaauggcgugaacccuggggggcggagccugcagugagccgagauagcgccacugcacuccagccuggacgacagaacgagacuccgucucacaaaaaaaaaaaaaaaaaaauauggcuagagcaauacauguucauuagagaagaaucagaaaauaucuaccaaaagaaggaauaaaacaaaacacccccacaauccgauucauuccagaauaacuacuuuuaacacccugguuugugugcuuucaaacucuguucucccauuuccaaaggauguugaggaacacgaacuuaaaauagacaguguuuguauaaauauaaauuccuuccuugcuauugaaaucuuuuuuccucugaccaaucuuaguuaaauggaaggaaauuguuuuaaaacuaauuuucaggucuggaaagauagauaugaauauggaaauggcuuucuuugggggaagggauggacugaagaugguuuuuauuuucuccuuuuuucuuauuuauguuuucugcaaugacaaguauuuuguaauaacaaaaggaaacuuuaaaauuauucuuccucuaaaguuugcaaucuaccuguaaaugggugauuagaagauaaagauuauaauuauggggguuuuaucauccaauguuacaguuuuucaggaauauucuuacaaguuucuugacauuuuuauuuuauagauacccuauauuaaucuugugaagcauuuaacaucugccuguccaaauguaugucguauaucacgguaaguuuacaguccauacugcaacuacuaaaauuauccauuuuuaaauuuauuguuguuuaaaaaauuuuuuuuguagcgauggggagcucacuguguugcccaggcuggucuugaacugcuggccucaagcuauccucccacccucagguucccaaagugcugggauugcagacauaagcacccggccuaaaauuauuaauuauauugccuguaaauuucuauucuaaauuguagaucucugccuauucaaaaaacaggaauauaauaaaguuugagcucaacccagagcacaaugaacauaguuuaguuuuucuuugauuuuguggguucucaaggcccuauuuauaaaagugaucuauugaucugucauuuagcaagaauagaauucuguauguuuuuccaaauuauaaugaccuuuucagauucaugauuaauuucuagcaaauauuugggcugaauuuuccguaucugagucuacuaaauauauauguauauaaaacuuacuugaaaaugaagucaugugcauuuuugcaugucccagguuucaucacacaaccccagacaguaaaacacacaguggugaaaaauacaccgauccuuucaaacucgguuggagagacuugaaaggucuguaugaggacauuagaaaggugaguuuuuuauucugcugugauguaauguuuuagcuuaccaaaacuuacuaaaauuuuauuuuauuuuuuauucuuauaauuauuauuauuuuuugagcuggagucucacucuguugcccaggcuugagugcagcggugcaaucuaagcucacugcaacccuugccucccagguucaugcaauucuccugccucagccuccugaguagcugagauuauaggcaugcgccaucacaccuggguaauuuuuguauuuuuagugaagacgggguuuugcuauguuggccaggcuggucuugaacuccugaccucaggugaccuacccaccuuggccucccaaagugcugggauuacaaaaaaacagugcagguuuucagaucuguacaaugcaguuugcaaucuugauugacguauggucaaguuucaaauguuucuugagaagaauacauaugacccagugccaggcaauaugaagaaugcaauauguauuuauguccagaaagagguuauggcaggguugggaaccugaaggaaaaaaaugguccagguagcucaugcuuguccaaugaguuaucccaccuuuccucuuaaaacccaccaccucccagugacuccagcugucucuuccuuaucuaauucugaaugucauugccagucugccccaaauauggcuuucuucauucaacucuuuuuccugaaaacuuucaguaguucccaaccucacgugguugggcaccguggcucgugccuguaaucccaccaauuuaggaggccaaagcaagaggacugcuuaagcccaggaguuugaggcugcagugagccaugaucccgccauugcacuccagccugagugagagagcaagacauuuuuucugucuuuagaaaaaaauuggcugggcacgguggaucacaccuauaauccuagcacuuugagaggacaccacuuccuguuucacagacaguaggggcuguggaggaagaacuccuucagcuccugcucugucgcaauuggccagcuugccugcgccuucucuggcgauugccugcucuccucccacccguggaagucaugucccuucccucucuaggggcagucccuuagccaaccucccuaguuucuuaggaacucccccagacauggccucucccucugucugcaaacuuucauuggcauggucuuccauauccauuggguguucaguuucuucaccugcauuuuuaaaaggcccauccacugacccagugcuucacucccucccuucccucacaguauccccugcccucugccuuccuccagugccuucauguucccuccacuauugcacuggggcccccuuuccagccucuccucugaagcugguuuugcuugggucacugauagcuucccugugcuaaauccaauggauguguuaccagcagcaaauuuguacaggucugcagcaaccucaauucuugccuccucagaagaaagaauucgacugaggggccuaaggcagaaggagagacggaggcaaguuuuagagcaggagagaaaguuuauuauuaaguguagaguaggaagggaaggaaguaaaguacacuuguaagagggccaagcuggugaccugagagaaagugugugguuugaccuuggaauuuggguuuuagauguuggcauacuuccagggacuugcaucccgucuccccggauucuucccuuggggugggcugcccgcaugcgcaguggcccgccaguguuggggaggggagcaugcucaguguguuuaccggaguuuugcgcaugcucacgugaggcauucuucccauaccagucccaguuuuccuagaaggacauacaccaauuaagcucugccauuuugccucuuagugugcaugguugagccgacucacccaacucccgagaucuuauugggaagcugaucaccaguuucagguuuuuguaucuauugagagacugccgucccuuggcaccagcugugaccaauuaguauuuuagcgacacaguuaacaacugcuugaccaucacgugauggucgccuuccuguugugggucggggagcccucuccugcccugcucaugccugacuagcuaucuacuguaacggacacuuccugguuuucugaccauugggcacuauugacuguaaccccuccuugaaacaugguucccuucacucugcacuuuguucccccuccuuauccugaggcuuuucuucgguucaucaccuccagcucacuuccuuuaauuuugccauucccugggguuccgugggcccccuccucucucucuuccuuauauaucuguguccauacuuacgucucucaaauaauaucacuacuccagguugaaucacaucucccacacccagguagcuaacuacucaccgggaacgccauggggcggccaugacggucucaggcuuaacucagcugagacucuacuuuucccccacgaguuguuuguucugcuguuuuccuguuccuugggaaccugggaagaacccaggacuugucccucuccuuccccucuauguccuucuagucugccucuugucaguccccacugccccaggccaggcaauuccaugccccugguccuuucauucgugcucuucuccucccugucucagcuuccgaggugacagcuuaccugggugacagcaccacacccaucacacuguguugugucaacggcagugaucguuuuacuucuccccaucuagacccugagcuccuuguaggcaaggcuugucuuacuuuaccuuugugaccucugugucuguuacagugccuggcacuaagucgguaauuuacugaaugaacgaugggcccacuuuguuguguucaccugugccgagcugagguucauugacucccacugcauccaggggauaaacucugacuuagucuuggaguggcagauacaagcgacacacacccgucagccggaaggcucuuguccucuuugugaaucagaacccuguuuaggcuucuaaucccacaucaaagcccaucuccuccaugaaauacucaguuuuucuagccugcacugaucucuuccuucccugaacuuucaauguauuuaauguacagcauuguucacgcuaccacuguauucgucauugauuguuucauauuugcaaaauguuucucuccccaguucaguuguaggcuccuuguaauccggcagcccaugccuuauaugggcucuaugcgcuuacgugggccucuaugaacccucaaaaugucuuuugccaaauaaaggccaagccagauggacugagcccuguuucuucuccuuggcuguggccuuacuaucuuccugccccucguaaacagcuuugccccugggaguuugaggcugcagugaguuaugaucgugccacugcccugaggccugggugacagagcaagaccuugucucuaaaaaaauuaaaauaaaaaauuuaaaaaaacaacuuugccacccuacccaucacaccccacccgccugaccugcuucacaggcucccgacggccacuggcuuccaccuuccccaucuuucucuucccgccuccaucuuucaagcugcgaaccagccccuguuccuuucgcuguccggcugucaaugagcccagagucccuuagccaccuagugcuuucuuccaccuccugcugucucuuggggucuucuggugucugauucugucagcggggcagguggcaguaccuguucuagcauucaggccacuuggggcugauccacgcauuguuuauguucuagccugcaggacagccagguggauggcccugcagcgugggagccuugcccacggaguguugaauuucucaauugaaaugaauacacuuaaauuaaaccaaaguuuuguagaagaaauccuggccaggcacgguggcucacgccuguaaucccaacacuuugggaggccgaggcggguggaucaccugaugucaggaguuuaagaccagccuggccaacguggugaaaucccgucucuacuaaaaauacaaaaaauuagccaggcauuguggcgggugcuuguaaucccagcugcuugcggggcugaggcaggagaaucgcaugaacccgggaggcggagguuacaaugagcugagaucguuccauugcacuccagucugggcaacaagagcgaaacuccgucucaaaaaaaaaaagaaauccuguuggcuuucugugcaguuuuuugaugccauugugacacagagaaacuuuauuucaggaacugcuuauaucaacaucagaacuuaaggaaaugucugaguacuacuuugaugggaaagggaaagccuuucgaccaauuauuguggcgcuaauggcccgagcaugcaauauucaucauaacaacucccggugagcucuuuuuuucauuccuuucuuguuuuuauauuugggaagucuuucuucccgggguuacuuacuguuucauuucccauuuaagaauuagcauauaccggcugggcaugguggcucaugccuauaaucccagcauucugggagccugaggcggguggaucgugagaucaggaguuugagaccagccuggccaacauggugagaccccgucucuacuaaaaauacaaaaaaaauuagccgggcgugguggcaggugccuguaaucccagcuacuugggaggcugaggcaggagaaucguuugaaucugggaggcggagguugcagugagcugagaucacgccauugcacuccagccugggcgacagagcgagacucuugucuuaaaaaaaaaaaaguagcauguaccuaaaaauucacuuugugauguuuagauucugacuuuaagucacuaaagucacucaggaaucuagucuggcaucuuuuuuuuuuuugagacggagucuugcucugucgcccaggcuggagugcaguggugugaucucggcucacuggaagcucugccuccuggguucacaccauucuccugccucagccucccaaguagcugggacuacaggcgccugccacugugccccgcuaauuuuuuguauuuuuaguagagacaggguuucaccguguuagccaggauguggucucaagguaugagccaccaugcccggcuaauuuuuuuuuuuuuuuuguauuuuuaguagagaugggguuucaccauguuggccaggcuggucucaaacuccugaacucaugugauccacccaccuuggccucccaaagugcugggauuacaggcgugagccacugugcccagcccauaaagcucuuuuuugaucuggguucuuuaauaaaaugagcuuggguuuugcugagcucuguugcaaguuagguucuccaggaggcagacucugagaugaaguuuaaaggacaggauguuuauucgggauuauccccugggauuacugacaccugagggagggggagaggauacaggacuggguagcaggagaagcugagcuggaaucaacagccugaaacacccucuagggugugcagguagaauggcccuucaucuaucagucccuggaugugggcugccucccgaaggggcacagccuaaggugagaggacucuuuguagccaaggcaauccuugaagaggcuaagaaaugaaggccaacagguaccaaccauaccugauacagcagcuggggcagagucaugcacugacgggggaucugggggcaugucucagaauccaccacaacucuguuuucuggacgugucaagucugaguuaucuguugcauggacucagucucaaaaaaaaaaaguuuuuaaaauaaauuaaugaaaugucuucacaauuacaucauauaaucuauugauggaaauuccaguagaccaugauguacuaauacaucucccuaguguugaacauuuguauuauauuuccccuucucaguagauauuuaaggaaugccuaagauuugucagcacugaauuuaaugacgcuguaagaaugagugucagauauugcuucuuaguggcuccucuccucugcccacagcuuucucugcccugcugcuggcccugccuuguccaguacauauugccaugcccaggucuggcugccacuuuagcugggcuuuucaaagagcucucaguauauuuguagcaagcagugaaaucucuggcauugaccuuuaaccauugucaggaccacuuucacuuuaccggaaggcagagcagcaaaaacgcucccucugagccaaacuugaaauaacaucuccugcaguccagagcagaguuccgcagccucgggacuguugaaauuuugggccacauuguucuuuguugggggucacugggggcugccaugugcauuacaggauguuuagcagcaucgcugacucuaccuacuagaugcccccgaguugguaacaaucaaaaaugccuccagauacugccaagugucccauggucccacgcagcgcagauucgccccugguugagaaucacuggucuagagaauguguuuauauuuuuaauuucucucuuaauauguaauacaguucauugcucucagaaauaaacaugggaaggaaauuuuuuuuuuuacugcuuuaaguacuaucacccacuguccccauaauuggaaguuuuucuuuuucuuuuucuuuuuuuuuuuuuuuuuugagauggagucucgcucuguugcccaggcuggagugcaauggcacaaucccagcucacugcaacuuccaccuccuggguucaagcaauucuccugccucagccucccaaguagcugggauuacagaugcacgcuaccacgcccagccaauuuuguguuuuuaguagagauaggauuucgccauguuggccaggcuggucucgaacaccuggccucaggugauucaccggccuuggccucccaaagugcugggauuacaggugugagccaccgcgcccagccaauuugaaguuuuuucagccugccuuauggaaacuguauaaauuguuaguugcagaaaacauaggagaauauaacaaaagccauugcuaguuuaaauaguaaguucacuacugcccucuccagggaaugucagagcugcagccuuauucucccuauaagugauuggagcagggcuuaggaaagucacagugcagagacagcguccggcauggggacaagucacgguuguggcguggguuugggugguacaguacccuagcaauucugcucuccaagccccaacuuccugacaauacuugcuuucuguggacucuucuggaucgggcacuuaaaggacuaaauauguagguauuauuuccaugccacuuaagaagaagggaugaggcuucuggagagcugggccauuugugauuuugcuuuugcugagaaaggcuuaggacaguagggggaaauggcagcuaaagauucaggagcagcaccauccauguucagugccaagagagccccuccagccucaguggccccagaucagugaaccugacauugaaccugacaggcuugcuuguuggugaugucauaauggagggauacuguuuuaaaccuuugacaaucaaaguuuaauggcucuuaggaggcuuaucagaugcuguguuuuuuuguuuuuuuguuuuuuuuuuugcuucugagguauguauuaaauuggggauuuuugcugggcacaguggcucacgccuguaaucccagcacuuugggaggcugaggcaggcgggucacgaggucaggagaucaagaccauccuggcuaacacggugaaacccugucucuacuaaaaauacaaaaaauuagcugggcaugguggcacgcaccugucgucccagcuauuccggaggcuggggcaagagaaucgcuugaacccgggaggcagagguugcagugagccgagaucacgccauugcauuccauccugggaacagagcaagacuccgucucaaaaaaaccaaacaaaacaaaaaacaugggggauuuuuaaaacaaaacuuuggaggggauuuuaauaaacgauagaagguauaucuuaagaaacagagcacgagggagaaacuacuacuuacugauuuuuauauuuuccuuuauuaagcuuuucaguuguccauuaaauguucccuacuagauuacggggaguucuuaacuugagguucacgggaguugugggaugucuguaaacaacuugacauuguaugcaaaauuuuguguauauuuggauuuuuuggggaaggauuucuauggcuuacaguuuauucucaaagggaaguagggcccugaaaagcucaggaccccguguuuguuuucucucugaaucuugcuaaccauggugucuggguagagaaaguaggaauccacacaacaguagacucagacuugacauguccagaacacagaguugugguggauccugagacuugcccccagaucccccgucagugcacgacucugccccagcugcuguaccagguaugguugguaccuguuggccuucauuucuuagccucuucaaggauugccuugguuacaaagaguccucucaccuuaggcugugccccuucgggaggcagcccacauccagggacugauagaugaagggccauucuaccugcacacccuagaggguguuucaggcuguugauuccagcucagcuucuccugcuacccaguccuguauccucucccccucccucaggugucaguaaucccaagggauaaucccgaauaaacauccuguccuuuaaacuucaucucagagucugccuccugcagaaccuaacuugcaacagagcucagcaaaacccaagcucauuuuauuaaagaacccagaucaaaaaagagcuuuaugggcugggcacaguggcucacgccuguaaucccagcacuuugggaggccaagguggguggaucacaugaguucaggaguuugaggcuagccuggccaacauggugaaaccccaucucuacaaaaaauauaaaaauuagccagucguggugacacacaccuauaaaucccagcuacucaggaggcuggggcaggagaaucgcuugaacccaggagguggaggcugcagugagcagagauugcgccacugcacuccagccuaggggagacucugucucaaaaaaaaaaaaaaaagaaaagaaaaagagcuuuaugauagauuucuauaaaauugcuucacucacugaaugcagcacaguuauagugucugcauguuucucagacaagccaaaccuaccuagccugcucagcugccucauugaagacacuguuaucacuggcaccuggaucuuggcaccauccauuccugugugaaacucuuuuaguucuaagaagugaauaucauugccagcaaucaggauaacagacuacccaaauugugcuguacagagaucuguugauaucaauuuugcaaauagccaauggcauuggauuacauuaguccaguuuucaaagcugaacuagauguuuagggggucaaauuauuagacacaguuuucacaguagauaacagguugagaguccaggugugauaacaauccuguauucagaggagguaacuuuuauagcacuauaaaaaacuaaggaaauuaccaaagccuaucccugaaaagacuguaacaaaacagccauuuagcacugacuggcuccagugauuccaaaggucaggccacuaacaacuguagagccauuccugguuucuguguguucugugucacugagccagccacugcugcugcuguuuaugggauaggcaagaagguugcuaccaaaggaaaugguuuugucuuucaccuaggagaugguucuguggauauguccauagucacuguuaaaacggaucuuugaaguacauucuacaguaagggacacccauuaagcuggagauuuugaugagcagauggucaucauuucaugcaugagugcaaggucaagcauaagaaccucagugagagcaagagggcugcagggcuugugaccguggugugugcaccuuguucagcacccuccaugccaggaugaggcugauucugucugcaaaggaaucaacuccuauacuuuuuuuuuuuuuuuugucuugcucugucacccaggcuggagugcaguggcacaaucucagcucauuucaaccucugccucccagguucaagcgauucuucugccucagccucccaaguagcugggauuacaggcacacaccaucacgcccagcuaauguuuguauuuuuaguagagacgggguuucaucauguuggccaggcuagucuuaaacuccugaccucaagugauccgccugucucccccucccaaagugcugagauuaaaggcaugagccaccgcgccugggcacuccuacacuuuccuuacccauccccaauuugaaagaacugaaugcugguuaguccauaguacccuggacccuauagagaaagcucugcacagagcaaccuggauaaguuguagauccagguaucaucauaggggucucucuccacauaucccaagauucagaagcucuuguaauuucuucuucaguggcaagcaaauaagcaauagugugaacccugcaucauuuaugaugcaacuuugcagacauccauuauauccacagcuaaaucugaaaauauucagggguugcugcuuuuagauaccaauuauuuucucuugacauuaaaaugcuaacaaaucuaugacuguuaggaucaaguuaaaaaaauucccacugaagagagacagacuuuauucugagccuuacguguuucuuuagguuuagaaggugaaugagcaguggcuggggaggauggccuagaaguuggagcucacaggcuuccucccugcacucugccauuccuuagauuggaggcgcccuugauacagaucccucccuacacacuggggguuuacuugcaauuuaagacuucacauuuuauauuaguaugaacagggaaaauauauuuuguaaaaccacauguaaaccucguaaaggauucacugguagggucauuauauuauucuaucuauuuuuagguauguuugaaacucuucauuauuaaaaaaauuuuuuuggccgggugcgguggcucacguaaucucagcacucugggaggccaaggcagguggaucaugugaggucaugaguuugagaccagccuugccaacauggcaaaaccccaucucuacuaaaaauacaaaaauuaucugggcgugguggcacacgccuguagucucagcuaccugggaggcucaggcagaagaaucacuaaaacaaggaggcgaagguugcagugagucaagauugcgccccugcacucuagccugggugaaagagcaagacuccaucucaaaaaaaaaaaagauaauuuuuuaaaucuaaugaaggaggaaagaaaaguccugacaggcaugcugaaucauagcauacucuugcaggugugaaguacagaggacguagccaacucucaagaccaagggcuucauuuuccaugcuaccuugccugucaccucucccagauccugggaaaaugugauccacuauuucacaguaggaaauagaaauggugcccaguuuuuugaaggcuugauucaguuuggcauuuuggagaugucaucuuaaggacagugugagguuuuucuguaaucugugcauuuuggucaucugucccacccucauguuauggauaagcaguggcagcauuucccagauguaagcugacacacacuaaagcugaacuggauaaaaaauacaucagguaaaacuauggaacaucugaaauaugauguauauucuacguagaagcuguguuacaguaccaaauaacauuucaguuucauccugauuucaucagucaacaauuuagccaugcaaaaugacauuuuuuauucuauuuauuuauuuauucggagacagagucucgcucuaccccccaggcuggaguacaguggugcaagucucagcucacugcaaccuccaccucccagguucaagugauucuccugccucagccucccaaguagcugggauuacaggcacccacuaccaugccuggcuaguuuuuguauuuuuaguggagacgugguuucgucauguuggccaggcuggucucgaacuccugaccucaggugauccucccgccucggcgucccaaagcgcugggauuaugggcaugagccacugcgccaggcgcaaaaugacauuuuuagauggauauauagucuaugaaauuucaaaauauuuuaagaaaucuuuguuguaauaauagcuucagauuaccaaaacaacucuaguaucuuggugagugcugccaauuucauugcaacuucucagcaggagccccgucugcugauguaauuuaucauaauggaaguggugcccaacuucugaaugcaugagaaaggcuagaccuuaccuguuguuuuaagguaaggucuacugcuaacuaguaggaggugucuaauuuauuagacugaaauucacuugcaaaaauauucuaaaagccuuauauuaaaaaaaaacuguaaaaguuuauaucuuuuccugugcauucaacucaaagaagauagggccuaguaaauuuaccugaaaaauauuuaaguauucuaauauaaaaacugaaucucacugagggauucagguggcuuaaaacucaccugaacccugaaccucuauuuucucauuuacugaaguuuauugggguuuuugguuuuuuuguguuuuuuugaaaugaagucucugucacccaggcuggagugcaguggcauaaucucggcucacugcaaccuccacuucccggcucaagugauucuccugcaucagccucucaaguagcugggauuacagaugcacaccaccaugcccgacuaaucuuuguauuuuaaguagaguuggaguuucacccuguuguccaggcuggucucgaacuccugaccucaagugauccgcccgccucagccuuccagagugcugggauuacaggcaggaaccuguaacugugccuagacuacagaagugguuuuuauaugcuaauuugucccuacccuccacugcuuuuguuuuaauacuccccccuuagaagaauuuguugugaucuagacauauuaagaaguuguaacugaaauauuaauaaagaaugaggccaggcgugguggcucacaccuguaaucccagcacuuugggaagcugagguggguggaucaccugaagucaggaauucaagaccagccuggucaacauggugaaaccccaucucuacuaaaaauacaaacauuagcuggaugugguggugugcacauguaauccaagcuacuugggaggcuaaggcaggagaauggcuugaacccgggaggcagagguuguagugagccgagaucacaccauugcacuccagccugggcaauaagagugaaauuccaucucaaaaaaaaaaaaaaaaaaggaaugaguagcacuguagacaugauuuccaggcugagagcaguugaaagggucuaggguuuaguucuaaggcugcugguaagaggagccagcgugacaucauauuuuaaaauuauauguaaagcaagaucaaaagcuuuccucaugcugauuuagugucgauaguuaaauuacagcaccuuuuauguaguuauacuucauuuuucauugcuuucugccgggucugaggaauuggaaugagcauuaccuugugcagauguucagauucgauuuuuaaagaaaaagucauauuucagaaucccucucccuuuuuuccccucuaagauacaaccugaugguauuugaaaauaagcauuuggaauaagugcaacauuugguuaguguguguuuaaaugaggauauguuuuagguuccaaaugguuauuucgccaguuugauuuucuugaaauuuaguuuuuaaaaauugccauagaugauggugguaauaaugauuaaaaugaaaugggggacauucccucugaacuguaaaauuuauaucuguguccugucuucuugagccuacuuauccuauaguuuguguuaaacuugggaaauaaaaguuuaaauuucuaaugagaagguuaaaugugaguuggaagaaaguuuuacaaacaucuucuguugguuacugagguugucauacuaaacguuuaauuuaagacauuacuacgcggggugcgguggcuuacgccuguaauccacacuuugggaggccaaggcaggcggaucacuugaggucaggaguucgagaccaaccuagccaacauggugaaaccccaucucuacuaaaaauauaaaauuuagcuggguguggugguguaugccuguagucccagcuacucauggaggcugaagugggagaaucacuugaaccugggaggcgaagguugugagccaauauugcaccacugcacuccagccugggugacagagcgagacccugucucaaaaacaaaaaagacaguauuaaaagccuugaacauugagacaguugagucuuuaaaauacuuuuaaaaaaugcuucucaccuaucuucccuauccaccccaaaauuuaauuguaaacuuauaaacuuaaacaccugaccaagaacacuguuauaaagaugauucuucagcccaauaagaucagccagacuucugaucguuuacuguuuuuuuggcuaaugguacaauuucuacuucuucaauggggaauucauaaaauguaguuguggcaggguuucucauacauuuguaaauguauagaaauggcuguguggugaagccagaguuuuuauaccguuucucuuagagaaauaacauucuuuauccuagauccgauguccaguuuucacaagcugauugcugagaagguucuaggcggcgucuguuaaaaagcauugcuuucuguuaauuagacaugugcaagccagccagcgcgccauagccuuaauugcagaaaugauccacacugcuagucugguucacgaugacguuauugacgaugcaaguucucgaagaggaaaacacacaguuaauaagaucuggggugaaaagaagguaugguuuuuugguuuuuuuaaaaucucucuuacugaaucacacacuuuucggaccgcauuuguuucucagauuugucucauuaaaaauaugcuugcucaaauguaauguggucuucugaauuucaaaaaaguauucaugucuuguccaaauacagauauuugauaaauaaauaauaaaaaauaccauggaaaaauaaacuuaguauuucuaauagaauuccuuugguuauaaggaaagggauuuucauggguguccaaaaaauguauuucaugaggaaucauacguuuuacuuuugggcuuagauuacccagauucaguuuaauuuuuuaaacauuuguauaauugagugcugcauauaaaugccaaagcaaacaaauaaaacuaauaaaagaaaaaagaaaccucagagagauacuguucugccaugaaaauucugucuuuugaaauagaaguucuguaauuggguuugguucauauauguauauauuaaagcauauuucuauauuauuagcauugggaauaugggaaacagggacuugguuugaggaugcauagauccuggguugaaggaugagaauaaaguugaacagaugagaaugaaaaugcacaggcauccaucgccaucaccacacacgugcucuacaaacaaaaaguuugugcaggccaggcgcaguggcucaugccuguaaucccagcacuuugggaggcugagguggguggaucaccugaggucaggaguucgagaccagccuggccaacaaggcaaaacccugucaccacuaaaaaaacacaaaaauuagccagcguacaccuguaaucucagcuacucaggaggcuuaggcaggagaaucgcuugaaccugggagagggagguugcagugagccaauaucacacuacugcacuccagccugggcaacagagugagacuccauuucaaaaaaaaaaaaaaaaguuugugcaaacaacuaccccacccucaccuccuuuucucucauagauuuauaguauuccugguucauuccuauuuaauucuccuuauuaaaagaagagauauauguauacacacacacacacacacacacacacauacauauauauauguuuauuguuaucuucacaugcugguuuuauuugaacauaaaugacuguuuugaaaucgagucuugcaauuucauuuauaugccuuuuauuucaaauuuuagauuaaaagguuuuacguccuguugacuaaauucuguacaucagaauguuggccaaaaagcagauggcguuuagauuuggagaggauguggguaacucuaugacccaucccugccgucagcuguaucuguuuucaggcauagccaguccuaaagccuuauguggagccuugggcgggggaagaggaucaagagaacaaaugauggucuccgccuuggcuagccccugugugucugccucugccacuggggaccucuuucugagggcaggucaaggacacaugugccgccuucaccugccucuuucaguucugacagccaucugcuuagcacagggcuacuugccaguuccuaccuguuucugccucugacccacaacugcuauguuaccgguacaaaaccccccacacacagugcccccucggugagcccuuguuaggccuggccugggcuuccuagcacuucuuuccuuuaacucccaccccuggccgucacaguccuguggcuuccaugucauaugcuggaccuuuggucucuaggaucuccccggccaggugaagaaggaacuaaaggccaaaggaucccgagccuugagcugcuaaugauguaggggcugggucggggaauguaaguggguaccuauauaucauaauuuguaaaaugacuuuauaggcauauacuuacaucaggaugucuuacauaauauguauauuauauaaaguggugauuaauugguaaacacaaugaacaucacuguuuagauacugaagaaccuaagacaauaaguaccuaaauaguuauguuaaaaauucugugaacucuagccuuuaugacuaauuacuacagaauguaacacuuacggcugggugugguggcucacgccuguaauccuagcacuuugggaggccgaggcaguuggaucacuuggggccaggaguucgagaccagccuggccaacauggugaaaccccaucucuaguaaaaauacaaaaauaccugggcguggugguguacgcuuguagucccagcuacucaugaggcugagguggggggauugcuugaacccaggaggaagagucugcagugagccgaggucaugccacuguacucaagccugggcaacagagcaagacucuuucucaaaaaaaaaaaaaagaauguaauauauaucuuuaaauaugcaaauuaaugugauauauaggguguauuugguuauagcauauaauucaacuauuuaugcaguaguuuauaacuaguugcuaauacaguguagacauccaucacagucuaaagaagacuggaaauauguugauugcuuaguguucaauggaaaaacuuuuuuuuuuuuuugucuaggaaugaggggcagugucacauaguacaaaaagcauuucacuuggagccaaaauucuuugguuuaauuuuuauugaaaauaacauguaucgugccaugcucuggggugugcucaguacuagcugagaugauuccuagucugagcucccacuccacuccacccuccccacugcccugggagcauagagacuagagcaucacugacugguacgcaaggugugauggucgcagcaugcauggguguuguacacgcacaaaagggaggcaucugaccagacugagggaucggggggaacuucuuagagguggcaucugaaccaauuaugcaaauaaguccacucagugaagaagggggcagaacuuuuugagcagaaggaacaguaaguggaaaggcacaaaggaagaaugaacauccaguguagugaaacugaaggcagcugcauuuugguggggcuggugagugaagcugcucucccucuccaggcauugauuucuucaggugucaacuggggagauggacauggucaucucugagagccaauacaguucaaguacugucccaaaucuguaaccgauuauuagaaacugggaagagugacauggucaucucugagagccaguccaguucaaacacugucccaaaucuguaacugauuauuacgaacugggaagugacauggucaucucugagagccaguccaguucaaacacuguuccaaaucuguaacugauuguuacggacuccuguugaggaagaagaagguaaaaaacccugcauccaagaugagcccccacuuccacgaagcucccuuccagucaguuucaucauuggcucuacugcucugauggauuuuucagaacguucuguuuucccccugucuuuuucuaggcuguucuugcuggagauuuaauucuuucugcagcaucuauagcucuggcacgaauuggaaauacaacuguuauaucuauuuuaacccaaguuauugaagauuuggugcgugguacguugauucugauuuuucuucuuuguuauucaacccugguguuuagccaggcaauaaagccaccucucaaaugacuccuuuccuucuuuauaggugaauuucuucagcucgggucaaaagaaaaugagaaugaaagauuugcacacuaccuugagaagacauucaagaagaccgccagccugauagccaacaguuguaaagcaguauguacguucugucuuucuucaaguuaaagccucauagcucuuuuuugggagcuaauuuuccuagaaaauauuucggugaagaaucuuaaaauaguacccaaaaaucccaagagguuaaugaggaaaagaaugacauccccaaacaauagaggacuucugcuguguuuucauuuuugccaucuucuuuugguaugcaggcguugacuuuucaucuuuucuucccaagaauucaaucaaaauaagcuuucccgcaccuuccccaaucugauugccaaacuguaucauuuugaacaauuuaucauaauuucucuaaugauugauaucacacacacucuuucugacacuucaccuuuuagaaaugaagugcucuguucuuuaauauaauauuuacucaggaaaagauaucuguuagauuguacuagcauucuaugaacuuuuuuuuguuuuuuuguuuuuuguguuuuuuugagacagagucuuuugcuguguggcccaggcuacaaagcaguggugugaucuuggcucacuacaaccuccaccucccagguucaggcaauucuccugccucagcuucccuaguagcugggaccacaggugugcgccaucacacccagcuaauuuuuguauuuuucauagggauggggguuugccauguuggccgggcuggucucaaacuccugcccucaagugauccacccaccuuggcccugcaaaguacugggauuacaggcaugagccauugcaccuggccaauacauugcaccuggccaauccuucuaauauuuuuacaugaaauauaaacaaguccuauuucuucagaguacaaauugaguauaagccauaacuguuuuuccccuugcuuucucccucccuccgcugugcauacacauguauacauuuuuuuuuuaaugaguaauaccuuuaauccguagacaaaugugugguauucaucguuaguccaagaaugaaaagcagucucuccauagaauuguuuaucugcccaucucuaagccugacagauacacagagacaaaaccuggacaaaugacauucccauguaauuacagccacaaaauaaggaagaccuguaagggucgcaugucaauugcugucaugauagacuccuaacauaauuaacagguaaagagagcuuuugcucagaccucucagaugaaaaagucucuugcuguuagugucucuguuuugaaaagugucaagaaauguauaauugcaaggcagaaaagaaugaggacaaucuuuucuuccuaaaaagaccuaauagaaacuuuaaggaaugugaauuauguagaacaugcuagccacagucucgaccacuuuugucuuuuuauuaaaagggcuauuauguuuuuauuuccaagaaauuauguggguuuuuuuuuuaaagugagauggaagaaaguauagacacgagaugcuaaauaagagaauagccuauuuuaagugggugcucuaacacuuuuacaguaauccuuuacauauuaucaugcccuugauggcccaacucucccugaaggucaggauccauccucuuaacacauuagggugccuuaauauuacuuacuaauauuuauccuuaagaggauguguuaagugaggcucauugauaauuucacaauuugagacugcaaacuuagaagcauuagcauggucaggcaagguggcucacaccuguaaucccagcauuuagggagacugaggcggaagguuugcuugugaccagaaguucaagaccaaccuaggcaacauagcaagauccccaucucuacuuaaaaauaauguuuaaaaaauaaagucuuagaagcauuaguaguagugagacuauuggaauuggaaacaccaagacuuacugucugcaccaugcagacauccugcaggcacgggguggggcggcaccaaauuggagcuagcacagaaauucacucagugauggaagcuuacaaaggguccaaagaaauggaccugagucaugauagagagguuuccuuguggucacuguuuucuguuuaagaagccaaagauaaugcacaggaauucuuuuauaaagauaugcaccucauucuucaaagauuagcagcugaacgaacagugaacauguuaacguggcuggacccuuauuaaaaaugaaauguuucaugcugcccacuagggggcaugcuggcaucgucccagcacuaccuccuuuucaugugguuuauuccuaaacuccacagcucuuagaauaauaaagcaaaaugauagugugagcuauuugaauaaaaguuucuauauuuaagugccuauggguggaaauauuccagagguguuauggauucaaaauggcuauuuuuacguacucuugguauuuaaaaugcaaagccaugcgagcuccaaauaaaugcaugcaaagcaaauuagacacaccaaaaagaggggaggaggagaacugaaagagcagaauuauuacagaagaagaacuaaugggauugcaaaauguauugagaauuggagggaaacuuacaagcugcauucuacuaaggauaccauuucuucaucucccuuccuuuuuuuagugaaaauaauauuaaaaucuaagagagggcugucuagggggauuguuuugugauugacugauauuaaaauagaauccauuuuaggccgggcacgguggcucacaccuguaauccuaacacuuuaggaggccgaggcgaguggaucacuuuaguccaggauuucaagaccagccuggccaacauggcaaaaccccgucuguacuaaaaauacaaaaauuagccgggcgugguggugcacgccuguaaugccagcuacuugggaagcugaggcaggagaaccgcuugaacccgggagguggagguugcagugagccaagaucacuccacugcauuccagccugggcaauagagcgagagucucucaaaaaaaaaacaaacaaaccagaauucauguuauuaucaaaagaugacuuauuuauuuacauacuuacucacuugcaaaauacauuuuguacucaugcaaaauacauuuuguaguuuacuaauaaagacaguggcuuguuucccaggaaaucugguggaaaugagaccugagaggucagagggccuguccaguuguuguuaagccagacaguagcugaguugagacuugaacccagagcuggguaugguaauccugccuuguuucucucucucucucucucuuuuuuuuuuuuuuucugaauuucuauuuucuccagggcugcuuguggccuggaauuaaugggcucucuuccuauuacuugauuuucaaagccucagaguaccacuacagaauugcauauugugggucacauuagcagaacacucuuuuuuuuuuuuuuuaauucauuuuuuugagauggagucucgcucuguugcccaggcuggagcgcaguggcaugaucucagcucacugcaaccuccaccucccagguucaagugauucucccaccucagccucccgaguagcugggauuacaggugcacaccaccacaugccacaccuggccucuuuuuuuuuuacaauauucauaucuaucuauaggccucauucagaucuugccaguugugaacuguuauaacgaaagggaaaacauauuuuucuguuccagcauccaguccaggauuucacguugcauuuugcugucaugacucuguagucucuugucaucuagaacagucuuucuuugccucucauuaccuugguauuuggaagagugcaggccaguuauguuguugagccucucagucgggcuucucugauacuucucaagauucgauccagguuaugaauauuuggcaggaauaccacaagagcggugcuguccucagcuccucauaccaggaggcgcgugcugucuugucugucccauuacuggugaugcaugccuggaucgcuugauuaggauacugucgggccgggcacaguggcucacgccuguaaucccagcacuuuggaaggccgaggugggcagauuaccugaggucaagaguucaagaccagccuggccaacaugguaaaaccccaucucuacuaaaauuauaaaaaauuagcugggcaugguggcgggcaccuguaaucucagcacuuugggaggccgaggcagguagaucaccugaggucaagaguuugacaagcguggccaacauagugaaaccaugucucuacuaaaaauacaaaaauuagccgggcguaguggcaggcgccuauaaucccagcuacucuggaggcugauacaggagaauugcuugaauccgggaggcggagguugcagugagccgagauugcaccauugcacucaagccugggcaacaagagugaaacuccaucucaaaaaaaaaagauacugucugccagguuucuucaaucuaaaauuacuauuuuaaccuauuuugggcaaaguauuuucagauuauguaaauauuauucugaugguugucaaauggcuguuuuucuauuuucaucauuucuucuauaucacucuucuacaagaaaguugguauccuauuuuuuuuguuauuauuauuucauucucaaaagagcugaagaguugguauuccauuguaaggaagcucuuaacuguaugggcucuuggauucuuauuuuauucuguaucuuuuuuuuuuuuuuuuuuuuuugagccaggguaucacucugucacccacgcuggagugcaguggugcaaucucagcucacugcaaccuccaccucccgggcucaggugauccucccaccucagccuccugaguagcugggauuacaugcggcugccaccauacccggaugacuuuuuuguauuuuuaguagagacgggguuuugccauuuugcccaggcuggucucaaacuccuggccucaagugaucgcccaccucggccucccaaagugcugggauuauaggcgugagucaccgugcccagccaucuuauuuuauucuguagauuauaacacugucauuauuuuaauacucaauuauccaacguauggccaguaggggaggcccuuuaaccuggcucuguguccuccaucauuuuuucagcaccccauuucuggcaggagauauucagcccuguuauucacuguucuccaaggagcccacauuccuuuugguggaaaaugguguuaagaaaccagaauuugaguacugggugucaucguuucuagacccacucaauggacagagcuaggaaauacauguauguauuauauguaauguagguagauacguguauaucuuucuguacccauccauacuuauucaaaaccacgagguaucaaacagauaguuccaaauccaucuaacaccacaggauuugugguuuauuccaggauuccaucuuuccauauuuguaacccccuucccaaacagugagagaccuggcuccucuucuccgcgguguauuuauuugcacaaucugagaauauaccauaggaguuuacaaauucaugacucauaucucugugaaaaacaaacccaguagcuagaauucaguauuuaucauuccuuuugucuugggccugaggauaauagaaucaaagcacuguucaaaaguuaccuuucucuacguaucagugugguuguguuauuauuuggaauauauuaacccauuuaugccuaguguuccauuauuggaaugcuaagcuuguggaguuauuucuauccuacugcucaaggucauuaccaaggucugauuuuucacaaaacaaauuugcaaccuccagcauaaauggguuaauaguugguuccuuuuuuuuuuuuuuuuuuuuuuuuuugagacggagucuugcucuuucgcccaggccggagugcaguggcacuaucucagcucacugcaagcucugccucccggguucacgccauucuccugccucagccucccgaguagcugggacuacaggugcccgcuaccacgcccggcuaauuuuuuguauuuuuaguagagaugggguuucaugguguuagccaggauggucucgaucuccugaccucgugauccgcccaccucggccucccaaagugcugggauuacaggugugagccaccgcgcccagccuaguuggauucauuuuuauuccacuuuagggauucccucucauucuugcugauuucguguuuugguuuugagcguuuuguuauuguugcuguuguuuugaauguuugaaacaacguggcugggcacagugucucaugccuguaauccuagcacuuugggaggccaaggcagauggauugcuugagcccaggaguuugagaccagccugggcaacauggcgaaaccucugucuacaaggaauacaaaaauuagcugggugugguagugcacaccugaagucccagcuaccugggaggcugaggugggaggaucaccugagcccugggaggucgaggcugcagugagcugugaucacaccacugcacuccagccuggcaacagagugagacucugucuaaaaaaauaauaauaauaaaaaaaauaaaagacauuaauguagcuccaaaagucagaacuauacaauacaguaacucucccuuuugcccuguuuucuuccccuacccccuuguagguaagcagucucguucacuucugguuccuccuuccuggguuucguuuagcacaaacaggcagacacaaguaugcuaucuucccuucuuucucacagcaagaaguaguacccuagacuacucugcuuuccuuuugcauuucuucaguuaacaauuuauuaggaaaaugauuccacauugguuuguaggaucuuccucauuuuuaaaaccacuguaucagggcugggcuuguaaucccagcacuuugggaggcugaggcggccgaaucacgaggucaggaguucgagaccagccuggccaacauggugaaaccccuucuccacuaaaaauacaaaaauuagcugggcgugguggcacacaccuguaaucccagcacuuugggaggccaaagcaggcggaucacuugagaccagaguucaaggccaggccggccaacaugguggaaccccaucucuacuaaaaguacaaaaauuagccagguaugguggugggugccuguaaucccagcuacucgggaggcugaggcacaagaauagcuugaacccgggagguggagguuguagugagccaagaucacgucacugcacuccagcaugggcgacaaagugagacuccaucucaaaaaaauuaauaaauaaauaauuuaaaaauuuuuuuaaaagccucuguaucagaucccauuauguggacauagcaugguuuauucagccaaucuucuauacaugggcauuuagguuuccaguuuuacaauuacaaacacuacugcaagggcugaucgugcauaaaccuauuuuuguguugugagaggagugccugcagggugaauuuagggguaauugcacaugugguuuuguuaggcaccaccagauuucccucuguugggucuguaccaguauguguuuccaccagcagcuuuucggaaccucuuuucccacagccuuacuaacuaaaugugccauuacacgcuugaguuuuugccaguccaguagaggagaauguauugcaguggaguuuuaauuuacaucucuccuuucugagugagguggaacauuuuucagaugcuuaagggccauuuauuuauuuguuuauuuaucggagucucacucugucacccaggcuggagugcaguggcacgaucucggcucacugcaaccuccgccucccagguucaagcaauucuccugccucagccucccaaguagcugggauuacaggcgugagccacugcgcccagcccuucccagucucguugagacguggcuuguaaggaugugaugcaaggugugaaccuuccccagaaagaagugcauacgcacagcacagccuggcugcagcaucugcuucaaacaaaacagucagccgagcuccacuuucuuugacuuaaucauucuucaugcuccacccauuuccggaaagaugugaggcaucccucugaugcugagcgcaagucugugcaccucuuugccuucuuguauguugugcuauguugcguccaauuuguggcaguuguuuucuguuuuccugcuacagaucuaggcaguacugaccugggauggggaagcaggacucucuggcauggucuuuaugcuaccccagggaaaucugggauaguugaaaucugagcaguaaugucccuucgccaugugucaggcagaagcugcccacuaaauaagcucuguucagcaugugugggcacagaggggacagugcagacagacugcagcuuuaugcuuacuuggacacauuccuugaccucuuggagguucuauuuuguugcccagcauagaagcagcacuccuguguugaagugaugaagagaacagugucuggagccagaccauguggaugaaauucagguuccagcguguuggagccauguaaugccugguaccgucugugucucaguuucucgaacuucauaagugacuuaagaugugagaacucucagaacagugccuagcacauaguggacgcucagaaauuguuagcuuuuaucaucaccaaccacauaauccauauuugugggauauugugagguuuaacucaaaucauacaaaguguucaucauaugugcuccacacauuuuaauccauuaaaauguucacuaacagauuuuuaggccgggcacgguggcucacgccuguaaucccagcacuuugggaggcugaggcaggcggaucaccugaggucaggaguucgagaccagccugaaaccccgucucuacuaaaaauacaaaaauuagcugggcgugguggcauacggagguugaggcaggagaaucgcuugaacuugggagguggagauuacagugagcccagaucgugccgcugcacucuagccugggugacagagagacuccgucuccaaaaaaagaaauagauuuuuagaaaaucuuucacuuuucaggaagaaagcuuauagucucuguggcucuguguugaggaaacagcauuaaucucacuacaggagacugcuucacuaucaguuauuucuacguggaaauaucuugauucccaguaucauucuguccugagcccagcacaucccaggcugcccaaaucuugccaugcucuccuuugagccaagcugaucuuagcuucucucgaaaguuucugaauugucccccauauggucucccagacucuucaguugaaaaaaggagcccucccugacagcccaggggucggugccugcucaugggaaggugguugcuguugaaagcaguuaugagcuuacuguucacucaacucaguggccaccugacccuuuauggugcaugcaauuuuaccauguacuuauggccaagcacuacauagucaacagaccucauuaaguugucaaaaagcauucucaggcugaggacguuaggcaaccuggcuuuaguuggcagaggugcguggacacugccaaggcuccuauuucugguuccaguggaugagguggaggaggauuauuuguaauaauagcaaacagccaggugcgguggcucacaccugauaaucucaacgcuuugggagguggaggugggaggaucacgagcccaggaguuugaggccagccuagacaacauggugagacuccaucucuaugaaaaaauuaaaaauuagcugggugugguugcgcgugccuguagucccagcuacucaggagacugaggcggaaggaacccuugagcccaggaguucaagguuacagugagcuaugaucgcaccacuguaccccagccugggcaacagagugagacccuauuucuaaaaagagauaauaauagcaaacacacauugaguucuaaccaggugccaggcaguauacugagggcuuaaaugcagcaucaugucuguuucucacagcaacccuacaagguaagugcuugugauuucuacauuguacagaugagcaagagagauucaguaacaugccgaggucuuguagagggcacaaaugcagccccacagucucacagcagagcccgcagcacugcaccacacugacgccugagcaaaguucacucccugacuggagagccacagaggcacgaccgaaggucaggggacaggguuuccuagcauccgcgagccuuacagaaaggcaacugugcagugcuccagcuggcuuucucauggagagucaacagagacauuuccccuccaguagaacacagaccgucucuccccucccccuuguugguuuuacccaggcuuuguuuucugaaaauguggcugggccugcuuaacaugcuuagcagggcacugggaaaugcacuucaguggccggugccagcuagcuuuuuggaguuuuaaaaagacuuucagaagucuuauuucucccccauugaaaggagggaaaaggguuuuuauacaguuacuucuuuugagagaaauguggaaacagugggaccagugaaguuccuuccgauaaugaaagagcgauaucugugucugaagcaggaggcuugagaugauuuuuauggacacaccaagaaauaacugcauucagaaacaggugaaauucccaacgaugaugaaaagaaaggacuacagaugggaaaauugugugugauuacauuaguaucucuuccugaaaugagggauacauugauagagaugauuaaagccaacaguaaucgggcuagcuugccgagugcuagaagucaguauuucacagauggggguccguuucuuuugcaugucaagaagguuuacuuagcauguuaccagcagaacuaguccaguuguagcucaguuuuuccuaagcagugggaaaggcugcuuauccugucugaaagcagggguuggagaaggagaauuuucuuagaauuuaacaacacaaucugagacugaaauucuugacuggaaaugcgguuuuguacaugcuuggugucccucugaugucagcaucuccugaguguguauaaucuagccccgcugccuccuauuuuaaggaauuccuucagccaggggucagcugcuuuguugcugccuggaagcagcuuaucucagaaugcucuuucuguuucaggucucuguucuaggaugucccgacccaguggugcaugagaucgccuaucaguacggaaaaaauguaggaauagcuuuucagguuaguaugcuuuuuauuuguaagaaugguggcguagugauacagucagcauucuccccuaguguguaaucgucaaaauaguaagaacgauggcagcaguguuggcauggcggugcuccuuacaucccauuuuuccuuuugccagcuaauagaugauguauuggacuucaccucguguucugaccagaugggcaaaccaacaucagcugaucugaagcucggguuagccacugguccuguccuguuugccugucagcagguagguuuuacaaacucccuuugacacaucacugcauagccccacagaacugaugucccgcggcacagcugaugggaagauugcauaaaggaauagaugggaaggcauucagauaagagaucacaggucugcauuugauccuggcugagugagauguuggggcuggucauuucaccuugcuaagacuguuuccuuaucugugaaauugagaagaucaccuuucucccagggugguugugaggauuagcuaagauccuauuugagaucuuugugucuuguggugugccauaggcauuugagguagcaucgugauuauuuccauauauuuuggccacuggcaaagugaacgguuucuaagucuugauuauaggacuggacuuuggugguccucagagccccuuaaaaggcauaggaagcaucaagggccuccaagcauaagaaauucuccgguucuagaaguuuaaugagacucugcugcucugagagaggcuuuagaaccucggccauugccucaaaaugucaggaagucaguggagugcaguagacccacauaguuccuucuuucuccggauugagggacugagucccccuuaaugugaaugaaaggcuuaggaagcuucaaagauguucccucgacugacaaagcagacauucucacagccuccuccagacccugccacauggcuuguggcuguacugaauguuacuugaaauaagugagacauuagcugguguuggaacaucucguuaauagauuuucaucuuaguaguauuuaauuuguuauguugcaaagcaguaagauguucaucaccgugccaugaaauucaacauuagcucuuugguguaaaauuauaguaacuuuuggucuuucagagauuuugccucuauucugucuucacguuuacaaaggucagucauguccuccauaaaauucagugauuccacugugauacagaaaccacggcccuugcuuuugguggguuucugauuggagagaggaaaggucaucuuucacccacuaucuagcauagccauuggcagcaugauucuucccaggggaggcugacguucuggguggcuggaccaggcuacuuuggcagcuugcuaaggcuaugaauggagauguugggguacucgguaggaacacccacccucauuauuacaaggcuuccauccucucaaacuuuggaggcugagguaagaagugaaagguaugcuguaaauagguccucucucccaaugaggcuuacuugccagcccaaaaucaaagaguauaauacaugugcccaguuuugacaaaaauuuauaaaaccuccuuuuguacauuaaggcaagagugaggaacauuugagccauguagguguuaugcuggggauuagaaaaaugaggcacuggcuaccaguaaccuauauaacugcgaacauuacuucucagauacuuguuaguaaacaugagugaaggaaagcaagauggacugagugugcugaaauccagcuagcuugguaaagauuccuuuaccuaggcucagauuaucaggauaaaaggaaaaagccuuuuucccuggagaagucuaugagaaaguuuugguugcucuauuuguaaaaaucuucaaauuguuaaguacuuguuaugaaccccaggauacuaaguuaccgguugaguccuacuuaaaccuuaaggugacugggugagaggaggcuggccucuucggacuguguuucacucugaauauauuucagaagaaacuaacuuacuuuccccuacacacacaaaggaguaauggcuaucucugcuuucauauauagugggggaaaggggaaauggaccucugcauaguaucugucaguaaucuacaagagacugaaaaaugcugguuaggcgguggcucaugccuguaaucccagcacuuugggaggcugaggcaguuggauuaugaggucaggaguucaagaccagccugaccaauaugguggaaaccccgucucuacuaaaaauacaaaaauuagccgggccugguggugcaugccuguaaucccagcuacucgggaggccaaggaaggagaauccuugaaccugggaggcagagguugcagugagccgagacugcacuccagccugggugacagagugagacuccgucucaaaaaaaaaaaaaaaaaaaaaaaaaaaaaggcugguuaaaaaaagcaagcaaaaggaaaaaaaaagauuacuguacccgaagccaugguuuuaugugugcuuugcugggaaaucccagucaugaggcaccuacucgugcucaccagacagcaguguucucaucugcccauaaggcagugaguugaaaaggcacauugcagccucagaaaagggaacacagaauggaguccaagcaggaagugacucuggacaggacucauuucaaaaguagacugauguuucugucuuguggcacaugggccagaaguuagccaaguauguauuuauaaguugccuucuaauaaaacagcaagguuaggcucuuuuguggaauacacuguaaaacaagagauucuuagcaagaaaugugucaaaagauauaugggacuaagauuaauucagguaaaaacaaguuccaaaaauaacguaagaauaugcaauaucuccacuuaaugaaaauguguuuuuaguuuacaaaggauucuuucauacauuaucucuaaucucacaacuccucuuugugguagauauuaugguguuuauucugcaaguaagaaacugaugcccaaaccucgccaaaauuaaacaucugguaaauggcacagcagggaacugaacaagucuaagaccaguauucauuuuauuacaucauacauaguguuauugccacugguaaugcugagaaguuaguagcuaugauaccacacaggccuucccacagagcagguaacuaacccaccugggcacugacgauacucaaagaaucaucucugugucaugucuuugcuauuguaaacaacauaccuacuugguggaguaguucuaagacgucuguaauccuuucccuuugguaggugaguuuuguuugcugaugagauggucuuugaacuuuuccauuugugaacacuggaccaggacaagcauucuugggaaaccaccuuuuccuuuuuaauuuggugugguggguugucuuggaguuuacuccagccagcacuugacagaaacucccugucuuuuggaauuccuuuauuuuuaacaucucucuuaagggguuuccugauaacaguugguucagaggauuuaaaaagaguuuuggggauuucuggagaagucccaggggaugacagcguccucccauguacguauguguacauauucucuuuaagaauaaaaaccucauguuaauuggauuuugaaagcuucagaaacaaaauggaaguguuuuacuuucucuggugaaacuuuuuuaauuuucaaauaucuuuuuuaaaaaaaccaaaucuuuccuuucuucugcuucucuuccuuauuugauaagucacuagacccaaacgucaguuguagccacguuuccaaaugccaucaccagccccugcaccagcugcacaggccuuaugcuaucguggugacuaguuggugccuuaguguuacccaguuucguuuggguagacucauacucaucaccuuagcaguuuaguuuauggauggguuucacagaguuacaacccgauuuauccacaggugguuuuccuacucuuaaaaacagcaccugagcaaacagaauuuuuauuugucacuaaaucugcaggcaacuguucuuccugcuguguuucucuuuucuuuuccacauacacauuaaggggacuggggagugcccggggaagaguuugauauuuugcauauuaaaauugcacacaugacauguuuggaaggaaggauguagucacucaaugcaaauauuuuuuucaaauuuugcuuucucaaugcuuuuuauaguaaaagcaucagugaaaacacccaaucagcauaucuuaccacacuugcugguacuguagaaaaagcuuauacaucauaaacaagguaaugucaccagaugccuacgagagaaucacaucagugucaacgauaaaaccuucuagauauccaguauugguaugugguauuaaaaaacuaaaacaggcuguguguaguggcucacguccauaaucccagcacucugggaggcccaggcgagaggaucacuugaggccaggaguuugacaccagccuaggcaacaaggcaagaccccaucucuauaaaaaauuuaaaaauuggccaggcacgguggcucacgccuguaaucccacuuugggaggcacuuugggaggccgaggugggcagaucacgagguuaggagaucaagaccauccuggcuacgguaaaacuccaucucuacuaaaaauacaaaaaauuagcugggcgugguggcuugcgccuguagucccaaguacucgggaggcugaggcagaggaaucauuugaacccgggaggcggagguugcagucagccaagaucgugccacugcacuccagccuggaugacagagcgaaacuccaucucaaaaaaaaaaaaaaaaaauuaaaaaauuagccaggugcgugccuguagucccagcuacucgggaggcugaggcagaggaucacuugaaccuauaggaguuugaggcugcagugagcuacgauugcaccacugcacuccagccugggcaacagaacaagucucauaacaaaacuaaaaccuacuugauuuggcuuuuuuaccguagaaguugauuugggcuuuccugauuucuaguagcuuguuuucuucuuaaaagacccaguaacuaaaggaaauuacugguuuucauaagaacuaaccaguugcuggcucuauaaauucuguaaacacauuagcagucuccacauguuuagagcuuuguucugacacauauuuuggucugaaaaaauuauuucuuugucugugaucacuuggcugcggcuuuucuauguaugcccuauuuuuucuucuaggauuacuaauaccauggucaugguuacaggacaacuuauuucauccuucagguucacugccagggaaaaacuggcagcugcuguaagcacugacguggccaaaaucaaacacaucuuaccucuuccguggagccauagacuguuagagcucaagggcuuccagucaugaagaugagaagccuaagaccccaggggcuaaggaagucacucggcuguggcagcugguagccaaaccaagacuagaguucggaucuaggaagugaagugauuugguguccuggcuuuuguauucuguuaauggugacacuucuaaauaguugcuaaguauuguagaauaucgauuuuaccuucaguuccuuuuuuaccuauuuuuucucucucuucuugcuaucaucuuaauucaggucuuuuuuauaaccuacucuaguaaccuguuuguucugucuaccucugacucuuaauuccaugguucucaaccuuggcggcacauuaaaaauaccagggugggcgggaggagguugaaaaucuuggugcccaggcuaaaccccaagccaguauaaccaaagucucugggaacaggaucuaggcaacuguauuuauaccuccccaggccaggcgcgguggcucacaccuguaaucccagcacuuggggaggcugagguggacagaucaccugaggucaggaguuugagaccagccuggccaauauggcaaaacccugucucuacuaacaguacaaaauuagccgggugugguggcgcacaccuguagucccagcuacucaggaggcugaggcagagaauugcuugaacccgggaggcagagguuguggugagccgaggucgugccacugcaccacuccagccugugugauggagcaagacuccaucacaggagggggggaaaaacaacaaaaaaacaaaaaacacuccccagcugaucccaguaugcagucaaugucaugcaccgcugcucagauccacucuacacacugcuuaaggcagagcucugcacauaaugcccucugcucagaaaccucaguagcuuucaguugguaaucaauuuagaacuuagaguagaaugccuaauucccauccucauccuaggccagugacucucaaaauguuggcagagaccagagauacuggugucaccuguuagaugguggcaucuguuagaaaugcaugccaaggcuccaucccuacucaaucagaaacugggggagaggccccacaagcaguacaggugauccugauacgauuuaaaguuuaacaaccauguuguuuuuuauuuuuuauuugagacggaguuucacucguuguccaagguagagugcaauggcgcaaucucggcucacugcaaccuccaccuccccagguucaagcaauucucuugccucagccucccgaguagcugggauuacaggcgugcaccaucaugcccggcuaauuuuuuguauuuuuaguagaaacggaguuucaccauguuggccaggcuagucucaaacuccugaccucaggugauccgcccaccucggccucccagagugcugggauuacaggcgugugccaccacgccuggccagaaccauguuguuuuaaagauguacuuuauuccuccugccucucuuaacucaguguuggacuaggauaaaacaucagaauaaacaaggacuaaugucuucuccucccauacaccaccacagugccuaggcauagacgguggaugucucuuagcucagcuuuuguugccacaguuuacugcucccccacaucaucuagacacuuaguuucauuuuuguuguuucuuguuauuuccuauuguuacaaacuaguguuagaacacuuguuucucccaagagaaauaaauagauuuucucagauuuucucucuuuuuuuguuaguucccagaaaugaaugcuaugaucaugcgacgguucaguuugccuggagauguagacagagcucgacaguauguacuacagguaagacuguuuuuuuaaaaaaaaggcagcagcaggaacaacguggcaaaauccuuuaauccaaaaauguaacauuaacuaaacauuaaauuauagauacaagacuguuuggucaacucuugaugugacaaaaacugagaagggaaaacucauuuuucugauuuuuuauuuucauuucucuucuagacuacuuacgaaauguuuuguuuuaacuggucuuagguaaggcacagacauuaauaucuuuuaaaagguaccuaagugauuguggugaacuguuaguguugaaacccagugguguggaaccagccuucccuguguccaucaacagaaucacugggcccccagucacccagccucggcuccagccucauccauguccccauccaugaccccauccgggcugcugcuggacugcugcaauagucuacucauaauugggcuuuccuaguccauccuaccuguuauaaaagugugacuaaagaaaugaucauugaaaacaauaaaccaacacaggcaaacuauacauuuauauaaauguuuuucuuuuaaagggagaaccauuuaaccccauucaggggcuaguggcuugcuuuaaauauauugccacguaucuucagaacuuuucuguggaagccagaucucucugcaugacuugaguuuuggugacugacuccugugagaaugagccauuuccaaguucacugucauuugcagccaacagaucuacuggaugagucggagugagcaaaaaaucauuacaaagcaaguguggcaugagaucuguacuuaguguaguaccugaaagacuuccaaauaauuaccuuccagauucuuaaaaaauuuaaaaagcaaccccaaccccuaaaagguuauuuuucucucuuaacugacuauacuguuaagccccauuauucacuacggguuacugccuuuuuuggagaaugguuuaaacguacuauuaaaaacuauggcagggagcuggagcugauaaagaagucaauauucccugggagagguucuggcuucagaaauaaugguauuauugaaagcuagagugggaaguggaacugaaaagagggaaguuaauaguagcaccuauggaaaauagcaaaguuccagcaauccuagccagaaacacauuuagaggaaacaaaaauccacgggaauguucucugaacaaauucuccaaaauucuagcucccuguucacccacagagcuucuaggccuauucccucauuaaauaugaauagacaacucaggguuacaaauaaguugacuaaagcuugcugaacaaaagagugggaccaaaauaacagggggaaaaaaaaacaggaaaaacguaaauaggaggauccaaaaagauaccacauucacaaaacaguacaggaucauacuuuuuaaaugaguaagagcaaguucuaagaaacugaaaaugacugaagaacaaacuccaaagaagggcugcaaugugaaauuguggaaauccucccaaguguaaaacagaaagggggaaauagugaaaaauaacaagagcuacaaggaccaguaccaucauguaacaaguauuucaggaagaaaauaaacaaaaaaguggucacuuaugcuagaaaauggugucaaaacuggcucaaugaauagcaaagauacuggauacuagaaggcaguggaggaaggucuuccaagugaggaugaaacauuuuaaaccuaggauccauuaaauccgaaggcaaaagaaagucaccacacaucaggacuaaaauguugacuucccauaaacacuauuuuauuuuauuuuuauuuuauuauuuuauuuuauuguauuuuucuuagacugagucuugcucuguugccaggcucaaguugcaguggcacaaucuuggcucacugcaaccuccgccucccggguucaagugauucuccugccucagccucccgaguagcugggacuacaggcacccgccaccacgcccggcugauuuuuguauuuuuaguggagacgggguuucaccauguuggccauuauggucucgaucuugacgucgugauccgcccgccucggccucccaaagugcugggaauacaggcgugagccaccgcgcucaguccccaugaacacuuucuggguagguuauuugcagauguacuucaggaaaacguguggaaaacacugagagaaggcaggcuucuguacaaaaaggaacagcaaacuaaaauaugucauguuuugagcaacugguauagaaaaucagauguauuucaaccacaauguuaggaauauuccauuucuaaaugucagagggguccgggcgcaguggcucacaccuguaaucgcagcauuuugggaggccaagguggguggaucacuugaggucaggaguuugagaccagccuggccaacauggugaaaccccgucucuacuaaaaauacaaacauuagccaggcgugguagugcacgccuauaauccuagcuacuuaggaggcugaggcacgagaaucccuugagccugggaggcagagguugcagugagccaagaucacgccacugcauuccagccugggcgacagagcaagauuccaucucaaaaaaaauuuaaaaaaaauaaauaaaugucagagggaucaugagccauggagaaggaaauagaauuauaguauaugacuugauucugcaauaaauauuuuuacaucauagaaaugauacuuuauuaguauuuggcuuuuagaaagaaccaauauuuuaaaacaugguuauagaauaggauguaaauaucuauagucuaacaaacaguauaguuaaaggaaaggacaagagcucauagaagauaaaaucugaaguugaugcuaccuaacagaaguaaucaacaaaacaacuaaagacagcagugugaugaugaggcggcacauugugggugggcuaaacccucaucuuaacaaaaagguaacagguaauaacuaaaauugguaaucaagaaauaaaaacuaggcugggcacgguggcucacaccuguaaucccagcacuuugggaggccaaggcaggcagaucacuugaggccaggaguucgagaccagccuggccaacaugacaaaaccccaucucuacuaaaaauacaaaaauuagccgggcaugguggcacgcgccuguagucccagcuacuugggaggcugaggcaggacaaucgcuugagcccgggaggugaagguugcagugagccaagaucaugucaugcacucuagcuugggugacagagugagacccugucucaaaaaaaaagaaaaaagaaaaaaaaaacuauuggauaaagugagugccuuuggaagaaaggaagcugauuuucaucauaaacccucuguacuuucauuuuguuaugucuuuauucuuuauuuuuuaaguaaguuuuacuuguguuuuuuuuacauuuaaaaauguuguauaaagauacuuuguacauagaacuucugagaaauucuaauaaguaaaaauuaggggaaaacgaaugacuauguaauauugaugagcuaguugcuuugcaugcuaauagaauaaaaauuugcuucaauaugagaaaaaggccuaaaggaaguuagcacuaugagucgggaaaagaacauuagagauguaguuugacuguuaacuguaauccucagcucaucugaucucaaaacuauguguucauuuauuauagcaggaaguuaaaacgcugauucagucagugacaggcaucuguucuguuuuguucuguaucuuauagagugauggugugcaacaaacaaccuaccucgcccagcaguacugccaugaagcaauaagagagaucaguaaacuucgaccauccccagaaagagaugcccucauucagcuuucagaaauuguacucacaagagauaaaugacaacucuuucuguucuuucuggcagcuaucuuaccagacugugccuaaagaauuuuguggaauacacuuuguuugcuucaugugcagauaaccaaaaaucauuuuaaaagauaucaaacuuauugaugggcaauuuauuuuuuuuuauugcaaaaguuuuuucagaaaacuuuuuaaauguaauuaauaaaccaccugaaucugucauucuaguccuauaaauuauaaucaagguaucuugaugguuauaugugguauuguuuacacuguuaauauccacauguaaggccauuacacaaauaaauaaccaauguuaaaauucaa

SEQ ID NO: 191180 - RNA, 114492 nt, Homo sapiens
gagaaauaaacgcucgcgagagaacgagguucaggcggcugcacgaaggggguggaggggggcuggagagagugaggaggaaggggaggaggugccgucccacaauaccaggcgggagggcggguaggcgguuuguauccgggcugugaggugcucggagccucggcggaccuugcugccucugucucuuuaacgcgagaggaagcgaugcagagggguggaaaauggcagagcugcagauguuacuagaggaggagaucccgucuggcaagagggcgcugaucgagaguuaccagaaccugacucggguggcagacuacugugaaaacaacuacauacaggugaggcgcucuggcggccggcgggcgcuggccgggucgaggacccgccggagugaccagcccacugggcgggguggggaacugcccugaccucagcggcugccaccaacccgagccccuaccgcagccccaaccccagccccaaccggggacagagcgaguggccgggcugagggagucgggcugcgauacaggaaguggcuguggugguggaaaccgauagaaggggagagagaaaaugggcgagggagccgggagcccgccgcugccgcagcccggcgccccccucgcguccgcuucccccagggcccggccaccggggucgcgcgccccccagguagccuccaguccgcagggcuggagucccggaauacccccgagcugccgccgcgccgccucucugcgccgggagaggagguccaggacgggagaggggagaggagagggcagggacgaggcugaagccgcagaagggagaggaccagcgggguguguguugugugucggcggaggguggggugggggcgauuaugucaguuucagcccccagagggugugucuuuuauuuauuuauuuauuuaaaaaaaauuugucaugagucacauuacaccgaccucccggaggagaggaggaagcggguguggggagugagggagggcguuugagagaaguucaucuuaaaauuccuuuaauugaagguuuguaaaucugucugcuuguccauuuucaagucggguuuuuuuuauuuuuuucccccucucaucguuuucacuuccgccccaccauaauguauucuaagagguuguuagggcugcuaucauuaauuaucaaacacgaauuguucuuaacuccuuggaaaaacggcuuacccucccuucucccaaaaguucuugagcuguaggcuucauaaguaacuuaaaauagacuggugucaucgccgguugcuuauuuucugagguuucucucuuaacaagcuaaguaaauguauaguaugugaauccaaauacagaaacgaacagagguagccucugaacuacaacguaaaaauaucuguuauuguaaauuagaaaacucuugggacuuugugacagaugcuuguuuguucguuucucuuuggaugauuggaagugaauugugugugguaguuuguuuugaagaucuuuaacuguguaaaccaacaguuugcgcuagaaacaaaguagcacaguccuuuguauaaauauaaaggcaccaggaaugcucuugcuuuugguaaggcaaggccaaaacgugcuuugaaagguuaggguuauugcaauucagaacuaaauuguuuauagaaaugucucccaugugauuauaauuuuuaagaaccgauguuucuguguuggcaaaugcuuccccucuuuauuuuuagagggagaugcuguuuucagaauguuuugaauauuucucaguuuucauguuaguaacauuguaucuucaguagcacuacucggaauuuaucuucacaauuuuuuuuucaagcuuucacuuuaggaauucuccugauaagugaacuuguugaaugccugccacaucuacuguaucacuuugugcaaacuuuauauuuagcccuucgaaaaacuuuuaaaaaucuaguagggauguggauaugguuugcaaauauaaaagugaucucguaguuuaucgauauuaaaaauaggcaacuuuuauucaacuuaacaugaaaagccuugaaauugaggagaaccuuaauuugcugaaaguuuuaaagauuuuugaaagccaaaaggagagcacaguaaguuuaauuucucgcuuuccagaaaaguuauguguucucuguagaagucaguagauaagugcuucauacagggguggcuccuuuuuguuuugcauguugggaaaucugacaaguauauagugugguaacuauguguuggcaacuguuaguaacuguaaacguguuuuaaccugucuguguacuauuacuuuuucagguaguuguauguuguaaugcuuuuuuuuuaccccucucugaccccuuuccuuuacuccucuugcuacaaucauguaacuuugaagcacuuuaaaacuucauugcuaauaucucuaauuaagucauguuauuuuucauacagucucucacuuuauaaaauguuagugccauggugcacgaauagccacagucaguggccccguuuuuuuuuuuuuuuuuuuuuuuuuucuuuuuuugugggggcggggugggguauaauccuaaaucugacaccagugagguguuuuguucauauuggaaaaaaaaaaaaagaauucacgcaaagcaaugauuaucuaaauaccuuaguagccuuuauacguugggcugcaugauccaggccacuaguugccucccuaagggacucagacagggucaggcucagaaagugauguggaaguugaugugguagguggugcugcugacuuuggugcuaagaauggggaaugaauaauauuagaaauauccauuagggugucuguugaggucuuucuguauccuuccugugaccugauuggguuauuuauaacuaauacucuuccuaaauauauaucucuucucagugaaaguaugcaguucacgugugcuuugagaauuuuuaaauaaggugagcuaaguuauugcuugggugauuuuuguucugagauucacuuuucauuucguuuuucuacaguuugaaagugcaguccaguuuagcuaagguguguagcugagaaacucuuuuggcuguggugcauuuaaguucuugcggcaguuuauuaguucuuugguucuguugacuuuuaacuaguagguuguauuauuaauagcaaaacaucugaaaagauucuacuacauuaaaaaggacaguuuuuuucuuucuuuuuuuuuuuuuuuuugagacagacuugcucugucacccaggcuggagugcaguggugugugaacaccauucacugcagccuugaccuccugggcucaagcaguccucccaccucagccucccauguagcugagaccacagguauaugcaaggacaggguuuuaacaguugccaugggguaaauaauacuaaaaauagaaaguuuuuuuuuuuuuuuuuuugagacacagucuugcucuguugcucaggcuggagugcagugaugccaucauggcuuacugcagccucaaccuccugggcucuggagauccucccaccucagcccccccagguagcugggacuacaggugcgcaccaccacucccagcuaauuucuguauuuguuuuguagagaugggguuuugccauguugccuaggcuggucucaaacuccuggucucaagcagucugccugccuuggccucccagugugccaguauuacagacauaggccacugcaccuugccagaaaguguuuuuuuuuuuuuuuuuuuuuuuuuuuuuugagauggagucucgcucuauugccugggcuggagugcaauggugcgaucuuggcucacugcaaccuccaccuccuggguucaagcgauucuccugccucagccucucaaguagcugggauuauaggugcccaccaccacgcuuggcuaauuuuuuguguuuuuagcagaggcaggguuucaucauguuggccaggcuggucucgaacuccugaccuuaggugaucugcccuccucggccucccaaaguguugggauuauaggugugagccaccaugccuggcugaaaguguuuuuauauagucauuuauguagacauacagaagagacuuuuccauauuccuuuacuaugaccagauugaauuuuucaugccaaggacagugcuuaauuugaacacacauguuuagccaguucucugugcucuaccuuagaguuaguucauacugccuuuguuaugggaacuauucugggaaauaggaaggaaagccgagugaaaaggaguagaaacugcuuaagaagguuugucaggaugcagauugguagguuggggguaaggacagaaaagucuucauacagcuuaacuuuaaaauuuaauuuuauuuuuugucuggauuucuaccaggagcuuuauuuggguuaacaaguauguucuaaagccuaggaguaugaaggggauaucaucccaguauguuacugugagcuacucacuucagcuugcuuuccuccuccugugacauuugcuucauuagcacauuuaaucucagaagguggguaauuuuugagcaggauccguuuggaguagguaaaagcuaacauuucugauacuguacacuuuaugccaguuuacaaacugugucaguuuuuuuuuuuuuuuuuuuuuuuuuuuuugaguaacagauggacaguuagagguuccgagguauuaaauacccaaccuaaaguucaguagcuuguaugagguggggccuggaaucaaacccagauuuucucgauuccaaaucccaaauuccaucuaauuaauccugaauggguuuuuuuuuuuuuuucuuuagacagagccuuacucugucacccaggcuggagugcaguggcaugaucucagcucgcugcaaccuccaagcaauucuccugccucagccuccugaguagcugggaauacaggugcaugccacugcacccagcuaauuuuugcauuuuuaguagagacagggucucaccauguuggccaggcugaucucgaacucuggccucaggugauccacuguccucagucucccauggaguugggauuacaggugugagccaccaugcccagcccagaaugggguucuuuuuuuuuuuuuuuuuuuuugagauggagucuugcucugucacccaggcuggagugcgguggcacgaucucagcucacugcaaucuccgccuccuggguucaagugauuuuccuaccccagccucccgaguaguugagauuacaggugcccaccaccaugccuggcuaauuuuuguauuuuuaguagagacggaguuucaccauauuggccaggcuggucucaaacuccugaccucgggugauccacccgccuuggccucccaaagugcugggauuacaggugugagccaccgcacccggcccuaaacaggguucuuauggcaacauaggggauaaaaacaaugugcgcagaggguaauagagaaggguagaggguaauauaauugccucuauuuauugaauacguacuccauugcagucucugcugguugguuuuguauuaucuuuaauccuuacaaacucgccacgacagacagugcugucuuacauaugaggaaauuaggacucauaaaaguuaaguuuuguuuagucauagaguuaguaauuggcagucaggacuuccuucugacucuggcagacuccauaggcugugcucuuuucauaucauacuguuuucacaugaaagaaucuagaacucaaaacugguucaggaauaccguggaauaaacagaauagacugguauugggcaagccugggaaccuaacaacucuuuaccauuguuuccagguugugaauauaagaagagauauguuuguaauuuagggacuugccuauaucaccaaaagaugguaacuuuggcauuugaaguguucaacuacagguuaaguauccuuuauucaaaaugcuugggaccagaaauguuucagauuuuuuuuugaauuuuggaauguuugcauuauauacuuacugguugagccucccuaaucugaaaaucugaaauccagaauagucuaaugagcauuuauuuuugugucauguugaugcucaagaaguuuuggguuuuggauuuccagauuagggauacugaaccuguauaggaauuacagccuagcuuuucacugagcucccuggauccuuuuuucuuuuccugcauccuugccugucuuuuuucuauuguuagucuguguugcaauugugcuaagaaauuuugaagaagcauuuguagagauuaacaaaaaauauguggaaauauucuggguagaugugauuucuauacaaaccagguuuggggaaaaacagucaaagugauucaggagaugaggauagacuggaaugguuagaauuccuagaauugcacuuugaagugugaguaaaacagugacuagcaaaguuagagauguagguuggaaauguaaauguauuuaacagaagguuagauaauuuuauggaagauccucaguuaauuguuaaaucgacccauaccaugucauuacauguuuauucaugcuguugugucaaggugauacagggcuggguagagcaggaucugaccuagcauaucaguucuuuuuuuuucuuuucuuuccuuuuuuuuuuucuucuuucacaccaagucugugaacccagcauaucaguucuuaugaaaguccauaucacauauaucaguucuugcuaauacucucaaggugagaauacugcauauuuuuaggacuauauaauauuugcaaauuuguauuaaaacuaaugucuucucuuuuuucuuuuguggcuuuaauacuaauaacagcuuuauauguaguacuucugacuaguccuggucuguuuagaaccucaauuuuagcaugcuucugucuuuuggagaguuuucuuagaaaauuauugaaauaaucucuuaggauacuugcaaauuuuucuugugugcuucugcguucuccaguugauucugauagcucaggaaugcuaauaguccuuguggaaaggagauauuuaggcaacuggggaucugcugugugaccauuuacaguaaccuuauuuauauucagugaaauuauguccuaagaauuaagacaguuaacagucaaaaauauguuagccagaaaggaagaguguucauauugggacaagagguuggaucaaacucuaggauauugugcagauauaaaucuauaaaacccaugaaaauaguguuggcaugaaaaguaagguaaaggcugggcgugguggcucacaccuguaaucccagcacuuugggaggaugaggcgggcggaucaugaggucagaagaucgagaccauccuggcuaacauggugaaaccccgucucuacuaaaaauacagaaacaaaguuagcugggugugguggcgggcaucuguagucccagcuaccugggaggcugaggcggcugaauggcgugaacccggaggcggagcuugcagugagcugagauugugccacugaacuccagccuggcagccugggugacagagcgagacuccgucucaaaaaaaaaaaaaaaaaaaaguaagguaaaauugauaguuaaugcuaauuuugaagcauuuacaaaguuuugauugggagguuguauauuuuuccuaauaucaucuuguguugauuguaauauuuauugaaauuaugguuugauuguagaagaaauaauagucaaaccccagaacuacaaacuuuguagaucuuaauauuuacuaagacaucauguuagaaaaaagggauuuuuuuuaaaaaaaaaaaagggcauuguugagaaauaagacaauaggaaaguagcaauuacuggauuuuuuuuuuuuuuuuuuuugagauggagucucgcucugucacccaggccggagugcaguggugugaucucggcucacugcaagcuccgccucccggguucacgccaucgauuuuguuuuuaaaggaaauaguugacguggucauuuuaacaguaaauauccaucccuuagaauggagacuugagauuugacuacugugugucaauccaaauaaguacuuuuaacuuuggaucuacuaauuuucuccaucuacaaaauaaaacuuucucagacauaguugguagugaacccguguuuaugaagaaaaucuguuaaugagggaccacacccagcuaauuuuuuguaauuuuuguagagaugggauuuugccguguugcccagguuuguccugaacuccuggacucaagugauccuccugccuuggccucccgaaguguugggauuacaggcgugagccaccaugcccgaccagcaaaaacacauuuuugaaaaacuucaauuuaccuuuaauucacucauuuccugaaugcuuuaucauuaauuuuuauuaauaauuucuacauucuuugacaaaauuguauuugguacauuuuauuuuuccuucuauggaaaggcaaguguggcacuuuuucagaacccaugggaaauuaaugcccuccacuuaaacaucagaaauguauauauuauaucauauagaaaaagauguuuccuacuacgucaaauauuagcaacuuaagaguuguaacaacagaugcuuauuuuauuuuauuuuuuugagacagaguuucguucuuguugcccaggcuagaguauaauggcacaaucucugcucaccucaacuucugccuccuggguucaaucaauucuccugccucggcauccugaguagcugggauuacagggaugcgccaccacgccuggcuaauuuuguauuuuuaguagagacaggguuucuccauguuggucaggcuggucucgaacucccaaccucaggugauccacccaucucggccucccaaaauguugggauuacaggcgugagccaccgugcucggcccagauucuuauuuuaauaaggcaauauagagaaaagaguacaugggugccauuuuauuuuuaauuuuuaugaggguuggggucuccuauguuccccagcuguccucguaauucuggggucaagcgauccucccaucucagccuccugaguagcugggucuacagacuuuccccccaagccccucccaccaugcucagcucaugggugucauuuuaaaauugauuauuacucaaaagugcgcccucaacauaguuaggcaaucccacuagauaaccucgccaguuuguucuuccacuuaccacaaacuauuuuaauuuuuuucucccuuuuugaaaucugacccuuuccuuucuugucuuuugguucauagagaaaauagacuucaucauauaagaccuauaauuucuuaccacugcaucuccaaaccugcuauccucgcucacccuauucuacuccuuuuuauaauggaagagagacauucuuccuccuagcuaaaguccuaacugugggucauauccuguccugccuuuuuguaaaccuuaugcuccugauaaguuuauaccuccucucuuuacugaauuugugcuuucacaauugaaacauuucagaucucugucguacuugaaaacucuuuugacuucauauacucaucuaguaacugaccuaucucuccuuuauggauuaacuaguuuuauuacacuauugucagcuagcugcaguggcucaagucuguaaucccaguuacuugggagguugaggugggaggauugcuugagcccaggaguuugagaucagcuuggguaacaaagcaagacccugucucaaaaaaaaaaaaaaaaaaaaaaaaaauuagcuuagucuguagucccagcuacuuggcagacugaggugggaggaucacuugagcccaggaguuugaggcugcagugagcuaugguugcgccacugcacuccagccugggcaacagugaaacccugucuuuuaaaauaaaaacaaaaaaccaagcauuuuccuccaucucccacuuuucauucacucuuuaaccuguucuauuuccacugcucucugaaugcuaauaaccuccauguugcaaaauucuuucccauuuuaguucucaugugcuuuuuuucucugcaucauuuugcaugguugguuuuuccuacuuuuuuugagaaguuaauccuuuggcuucucugauagaccuuucuuucaugcuuuuccuauuacucucuggcccauuauucucuguuacuauuaaguauuaaaguggcuucauuugggcucuuuucuacacaucucaccucaagcuguuuuauuuauucccaucuaaaucucuagauuagaucuuucuucuguugagguuuagauucauauaucuaauaaccuacuugaccccuccgcuuguuugaaucacaggugccucagacauaagaugcuagcaacugaacucaacaccuuccucuaaaccuaucacuaccaaccacccacucacugaaaaccugggcaucauucuuuucuuuucuuuuuuuuuuuuuuuuugagacggagucucacucuguugcccaggcuggagugcaauagcgcggucuuggcucacugcaaccucugccucccagguucaggcaauucuccugccuuagccucuugaguaguugggacuacaggcaugugccaccacaccuggcuaauuuuuguauuuuuaguaaggacaggguuucaccguguuggccaggcuggucuugaacugcugaccucgugaucugccugccuuggccucccaaagugcugggauuacaggcgugagccaccacaccuggccgagaacguuuuuuaggcggguucuaucuguuagcauuuacuguacuaaaacuaaaacugagcaguuuaaaacauucauuuaaagggauaucuaauguguuuauuauuaacauaaauaauguuuuaugaaaaauguaaccuuaguuuuccaaaacaaaaauguuuagggcaagaguaacauuauuuuacauuauugcaucucagugaaaaauaaauggcaacaaaauucuuauaucugcuucugcaguuaaucuguucauuuuguuuugguugaaguauaugaaggaaaucuguccucacacaguuguguaguggaaaaagggggacuauuguaauaggcugugcacauaauuguggaugauuuucuuugauacaacaacaaaacuugguagaugguaguuucuuaaagguuaguuacaguguggacucugaaacuauaucaauaaauauuuuauacuccauuacuuuaaaauacauugcauaggccauuuggaaaauauuuuucacugaguuaugcagaccuucugaauguugacacauuucauuauacaaugugaaaaaauugcaaucacuaauauuaacacagaucucacuagaagaauuuucaaguauugcaaagcuugcaaguucacauugauggauucaaguuuuccaagaucccaguuuuugcuugaaagcuugaauuuuauuauuggcaacaaauauuaccaguuauuuuccuugaaguauuaggcuuacuuuauucauuuuuaggaaaaugucugccaaaugcucaagucuaaauaaucuuaguuuaccuaucaguuguuuuugaaguaauaaugguguuccaugaacaauuggcuuauucagcuugcaaauaaacugcacaagugcuuuuuccuaacaggagccaucauacuuaguauguagcagaaguacuguauguguacuuccauuuugucguauacaauauuaaaagacauuuucucaagggucaagauuuaauagaauuaauaaauuuuccugcuucaucaagaacauuuuaaagugaaaccggcuuuuuuaaaccuuuuucuuuuuuuuucuguggaugguuggcaguaaagaacacaaugaguacuaguaucgucugugacauugccuugauuaccucuaagaggcuauuguaauuuuauuuaccuuuguuuuuguaccuucaauucaaaugucaacucaggaaagaaagcaaauaacauuaguaguauuauaaaaauaauuuagaccucguggacccccuguaaaggucuuaggaauccucaggggucugcagaacacacuagacaacauuugggauagaugauugguucaguagacuuaauaccuuccuuuugugcuaaugggagucugaauuuuaaauaucauuguauacuacuauguauauugagcaucccugacuaauguaguugccauuaaaauaaaaaauguaaaguuucuuauggagaaagucuuggccgggcgugguggcucaugccuguaaucccagcacuuugggaggccaaggugagugggucaccugaggucaggaguucgagaccagccuggccaacauggugaaaucccgucucuacuaaaaauacaaaaauuagcugggcgugguggcacaugccuguaaucccagcuacuugggagacugaggcaggagaaucacuggaaccugggaggcagagguugcagugagcugagaugguaccauugcacuccagccugggugauagagcgagacucugucucaaaaaaaaaaaaaaaaaaaaagccucuucuuauauugcauacugugcuaauuauuuugguucuuaauauuugggucuuacugcucuguacaauucaccuuucacuaguacugauuuugaaacugauuugcugcuaaaaguuucauaaaucuguuaucuucaaauuucauaccaaaaauuuaguaauuuguugauaugaauuuauuugauucauaggcgguuuuaaaauuaaaugauuuuuaggaaguagugagaaauaauauuuuuaauuuuaaaaugauauaacaaucauucauuucuaauuugaguauguuccaaauuagaugugaagaaaucucuuguuauuauccauggcauguaucacuuugguacuaauauauuuacaucuucuucuucuucuucuucuuuuuuuuuuuuuuuuuuuuuugagacagggucucgcucuguugcccagguucuggagugcaguggcacgauuacuguucacuacagccuugaaauccugggcucaggucauccucccaccucagccucccaaauagcuggaauuacaggugugccaccgugcccagcuaauuuuuuggguauuuuuuauagagacaggguuuuggcaugugguccagucuggucuugaacuccugagcucaagcaauccuccugacucggccucccaacguagcaauccuccugacucggccucccaacaugugagccucccaggugugagccaccaggucuggcccaacaucuuaaaaaauaagaauaacccaacugaagugggagaaaaggacaaaaaacagaggguacacuuuuuguuuuaguuguuucucuggcauuuucccccuuuuauuauauacauuuuauguuuuccaugaaaaaaggcuuugcauuuaucuuuuccucuguuaaauaauaucucuuuuaaaagguuugagaagccuauuuuuuuucaguuccaucuucccuuaaaauuaauaauaaucaaauuuugcuuguuuuuuuuaaagacagggucucucucuguugcucaggcuguaguacaguggugcgaucucagcucacugcagccucaaccuccugggcucaagcaauccucccaccucaccucccaaguagcugggacuacaggugugcaccaucacgcuuggcuaauuuuuguuauuuuuuuguuaaggacaggguuucaccauguuuuccaggcuggucuugaacuccuggggucaggggaucugccuaccuugaccucccaaagaguuaagauuaccggcgugagccaccaugccugguccucagaguuugcuuugaauagugggaagacaaacuggugauaacucuuauucuuuuagaauaaucagauaauaccauaaagaucccaaagaaaacuggcaaaauuguauaggcucccaaguuggaaccacaggaguuccaaaaggaaugcacaguaaaaugaaauauauuuauaauuauauguauugugcuucuuaguaugacagaguauauuaguuugucacauacucaguuauucugcgacuuuuuacacguauuaugugucagacuguuuugucaaucagauacaguuucuacccucaagugauuuuauaguuggccuccuccauuaaucaaauaacucaaacuauaauaaauuacaucuagggaagguacaugugacaugaaaguauacaucaggugcugccaccuagcuuggugugucauagaaguaauguuggaguugagaucugaagggugaauauauguuaaccgagaacauuugggggaagggaaaacagugucucuguggaggggagagcagcauguguacaggcucaaagguaagagugaaggcagagugauuuugaacaaguuacacacuuguguacuucagaguaaacagagucaucugugaagagguagguagguaccagauaaggauuuugaucuuuuuuuuugucugaggcugaugagaaggcauugaaaguuuuaagcaaggcugggcgcaguggcuccugccuguaaucccagcacuuugggaggccaaggugggcccaucgcuugaggucaggaauuugagaccagucuggccaacauggugaaaccccgucucuacuaaaaauacaaacauuagccagacaugguggugcuugccuguagucccagccacucaggaggcugaggcaggagaaucacuugaaccugggaggcggagguugcagcgagcugagagcacgccacugcacuccagccugggcaacagagugagacucugccucaagaaaaaaaaaaaaaaagaaaagagaaagaaaguuuucagcaaugggaugauauaauuuuuacuuuuuaugaaguuuacucuuguuuagaguggagaacagauuggaaggaggauugacuacagauuggaaggaguucagaacagauuggaggguggcuagucuagaggugaugguagcaauuggugaugguuuuucuaaaaucuuuuuuuuuuuuuugagacggagucucacucugucgcccagacuggagugcaguggugugaucucagcucacugcaaccucuaccucccagguucaagcaagucucucugccucagccucaguagcugggauuacagguacccaccaccgugccuggcuacuuuuuguauuuuuuuguagagacgggguuucaccauguuggccaggcugguauugaacuccugaccucaggugcucugccugccucggccucccaaagugcugggauuacaggcaugagccacugugcuuguccauuuuuucuaaaaucuucagugccugaacucaucaugguagacugugacuauuauuuuucuuuucuaaaaagaggaguauuugaggcuauugggauuuguugaacugaaauagagaaagauucauucaacaaauaguuaauugccuacucuauggaagacugucuguuagguauuaugauguggugguaugaugucuauauuauuauuauuauuuuugagacagaguuucgcucuuguuguccaggauggagugcaauggcacgaucuugguucacugcaaccuccaccucccggguucaagugauuuuccugucucagccucccaaguagcugggauuacaggcacaugccaccauacccagcuaguauuuguagcuuuaguagagaugggguuucaucauauuggucaggcuggucucgaacuccugaccucaggugauccgcccgccucagccucccaaagugcugcgauuauaggugugagccaucaugcccugcuuugugucuauauuauuuauaagcuauguagaaaucacugaaaagccuuaaaucuaagaaaaagaaaauuggucuauaguauguauaguuaaaugaggaaauguucuguauggaagaaaaauaauuguuauuuuugaaaggguuuugauuuuaguuugggcagucagaaguuugcuuauggaaagagaauaugucaagcagcuuuuuuuuuuuuuaaagcauuuagguaauauguuccuauaaaagggucaauacaguuguauuaaaagucaaaccuaaaaugucucuucuucuucuccccauacugcuauuauccucuccccucaaacuguaugcuuguuuucugccuuuccaguuuuuguacaaaggaugugcuuugggaagauucaucuuacauugguacgggauggauuggagaagggagagacuggauggacagugaccaguuagaggacugucacauuugucucacuguaaagaguauuucaugaauugagauagcuguaguaagauugaaaaggaagauaagaaucagcaagccuuggugaaggagauauggguggcugcgggaaaaggagaacccaaagaaggcuuauuuaaccgguaucuauuuuccccuagcauaaagcuaaugcgccuacagaagguaauuugcagucacagaagugaaucuauagacccccucuuuuucagcuguuaguacacaguugguuucugacacuuuccagcuuuuacuccuccacaauugaauugauuggcagagcaguggguuggagaauaggaauaaagcuugacugcuagcuggcugcgugggcagaacagggaagggaagagggaagaggagaggaaagggauuccaguuucucuggcuauauacuguuguggcaugaggugcaugucuuuugauguuaauuuugauguucuaucauaaccuucugcauuacagauuguugguauuuuuauauguguagucuuuauaaauuucaaauacauaugacguggguugaaaaugaucucuuuuugaaaggaacuuuuagagagaauucuaaggaacaguaguguuuggggguucucaggcaaaguuucuccuaaagaaugaguuuagccgagucauuaauuuaaagaguugaggggaagggggauugggaggcaagggauauauauagguaguaggaacagaaagauagcaaggcauguuugggagagcugugaguagugucaagugccagggaagguggaggagaugaagucuuagucaaaaacauacuugaacugcugucacuaaacuguagaagaucggaucaguguuucccagauuugaaaauagaaaccguguuuuaaauuuaacacugguaagaugaaauugugcuuuugcuauguccugacauauucuguucauuugucuagacacguuuggcauaaucaacagaaaccacuggaugagugguuaaauauaagauaaaugaguuauaggucugaaucaaucacuuuuguaugagcuaauugucauaacuuggggacugcuuguaugaguggcuuuauuguuaguguuuauuaaugucuugugguauauagagcuauuuuuuuuuucaacucaauuggguauuucuuccacccauccuaccucuccuaccuugccccacuaccacaaagaagaagaagaaaggcagcaugguacuaucucuaugaaaauccugccacucucauuuuugcuuuuugggugaggagguacggugcugcaaggugggaagaaugugugauauauuaauauuuacaucacugaggagaauugcaauacauuccuuuuauagucacauggaaguuuuaggaaaagcuuugcuucuacauauauauauauauauauauauauauauauuuuuuuuuuuuuuuuuuuuuuuuuuuuuuuuugagacggagucuugcuaugucauaaaggcuggagugugguggcaugaucucagcucacuacaaccuccgccuccaagguucaagcgauucuccugccucagccucccaaguaucugggacuacaggugcaugccaccacaccccggcuaauuuuguauuuuuuaguggagacaggguuucacuguguuggccaggcuggucuugaacuccugaccucaggugaucugcccaccucauccuuccagagugcugggauuacagguguaagccaccaugcuggaccccaccaagauauuuugaccuauggauacuauaaaucauauaaucuuuuuuccuuuaucuuuguggauucaugcaaaagccagagccaaacuuguggcucuaauuuauuauuuauuuauuuacuuuuuaagauggagucuugcucugucgcccaggcuggagugcaguggcuagaucuugguucacugcagccuccuccucccggguucaagcaguucuccugccucagcuucccgaguagcugggacuauaggugcacaccaccaugcccggcuaauuuuuauauuuuuaguagaggugagguuucaccauguuggccaggaugguuugaucuccugaccuugugauccacccuccucggccuccuaaagugcugggauuacaggcgugagccacugcgccuagccucuuguggcucuaauuuauuauguaguacucuguggucuguauauuaaugucuugccuuuaucuuuuauauuauaugguaaaacccugauuuuuguauuuugaauuuucuuguuuaauuguacacauuuuuguacugguauaucaauagcuaauggccucuccccagaccaaugaaauuggcaucuuuuuagggggagaggguuagauugggucucaggcucuggaauuuuuuaaaaagcucaccagauagugcugguguccagcuagaauuuucuuuuuggauuccacacuaaaagcuuaggccauaaaagcaaaaauaaauaaauggaaugacgucaaacugaaaagcuucuucaaaacaaaggaaacaaucaacaaaauguaacaaccuauggucugggaaaacauauuugcaaaccauuuaucugauaagggauuaauaucuaaaauucaugaagaacucauauaauucaauaauagaaaaauaaucugauuagaaaaugggcaaaagacuugaacagauguuuuuucaaagaagacauaaggauggcugacagguauaugaaaagguacucaacagcauuagccaugcagaaaugcagaucaaaaccacugugggcgucaccucacaccccuuaggguggcugucauaaaaaagugaagugauaacaaauguuggcgaggguguggagaaaauggaccccuuguacacuguuggugggaguguggauugguacagccaugauggaaaauaguauggagguugcuaaagaaaugaaaaauagaaguacuauaugacccagcaauuccuuaucgggcauauaccuaaaggaagugagaucaccuuauaaagauaucugcacucccauguucauugcaguguuauuuacauuagccaagcuguggaaacaaccugaauguccacugauagaugaauggauaaagaacaugugauaugcauauauaauggaauauuauucagccuuaaaaugcagauacugccauuugccacaacauggaugaccuggaggcaguaugcugagugaaauaagccagacacaggaagacaaauauugcaugaucucauauguggaaucuuaaaaaaaauaaaaaaaaagagucaaauauacagagugaauaaaagaguggguuaccaggagcaaguggguggggaaugggaaauguaggugagggguaagaaaauagcaaguauguaggaugaaagagccuagagaucuaauguguaacauguagcuaauaagaggacuguagcuaauaaaauuguacuauauuuggaauuccugcuaaaugaauagauuuuuagcuguccuugccacaaaaacaaaccaaaaaaaaaaaaaaaagguaacuauguggguugauauauauguuaauuugcuucacugcaguaaccauuuugcuuucuauaugaaucccauaacaucauguuguaugcuuuaaauauauacaauaaaauuuauuuaaaaaaugaaauaaaauauaugguugauauaaaaagaauaaaagcucaccagguagugcugauguccaccuagaguugagaaucacuuuucuagagcaagagugggcagguguuuccuguaaagggccagauaguaaauauuuuaggcuuugcaugccauauggucugacacaauuacucaacucugcuauuguaguaagaaaaccauagaugauauguaaggaauggauguggcuauguuuuaguaaaauguuauuugcaaaaauggggagaaguauuuggccugagcagggacauaguuucuugaucuuuguuauacagccugaauuuuaauuacuaugcuagaaucuaaugguagugguugaugauggaccaaaacuguauugguguggcccauauacugaggugaaugccuuuuuaaaaaugcuuuuguauccuguuaauugguguuuagauuucuaagugauuaaauuaccuauuugccugggaucugaugugauaauuuauuaauaaauuauuauuuuuugucucuuguuucugugugaacagaauaucccuuuguucacaucucagauuuuuuggaauagcaguagcauagaaaauucaauugauuacaguagagauuaauugauacuuacaguuuuguaaguuuuauacucuuccagaauagauuaagaaauuaggauacacguaauuugucagguagugucauacugguccugauuuuugauuuggaaaaugugauuaaugaaucacuaggcuggagauagcuaagacuauucugugaaacuguguuguaagcugguuuaagugagugucuuagucuguuuguguugcuacaaaggaauacuucaggcuggguaauuuauuugacuugugguucugcagaccguauaagaagcauggugccaacaucugcuucugaugagugcuucaaguugcuucuacuuguagcugaagggaagggagcugacauuugcagagaucacuuggcaagaagcaagguggggaggugcuagacccuuuuaaacaaccagcccuuuggaaguaguagagcaagaauuuaccugaggaccccaagccauucaugagggauccucccccauaacccagacaccucccauuaggauccaccuccagcauuggggaucauauuucaacaugagguuugaggggacaaacaucuaaacuacagcagugaggaaauacaaucgauggaaggacaagguacuuuugcuaguauucauagaaucuugaauuuguuuuuuuuguuuuuguuuuuguuuuuuuugauacaggaucucucuaugucaccccggcuggagugcagucgugugaucauagcucacuguggucccaaaguccuggguuccagcaguucccuugccuuagccuuccaaguuguugggacuacaggcacgugcuaccauuuuugccaucuuuaccaucuuuaaagugcaaacuuuaaagauuuauuuauuuuuauuuuuucuguagagacaugguuuugcuguguugcugugucugcucucaaacuccuggccucagguaauccuccuaccuugaccucccaacgcauugggauuacaggugugagccaccaagccuggcauguuuuuuuuuuuuuuuaaacagaaguacuucuuuuucucaagucaguuaaggguggugcugauugugacaguguuaacuaccacccuaccuaguaguuuguuaaaagaugcauuauacugcuuaaguaauuuccuaguaaaguuaccuuuuuuuccccuuauuuuuguuuuugagacaggguccugcucugucgcccaggcuggagugcaguggcaugaucucggcucacugcagccucaaccuccugggcucaagcaguccucccaccucagccuccccaguagcuaggacuauaggcucaugccaccaugccuggcuaauuuuuauauuuuuguagagaugagguuuugccauguucuccaggcuagucucgaacuccuuagcucaagcaauccacuuuccucagcuucccaaagugcugggauuacaggugucagccaccauaccuggcuaguuaaauuuauuugggcaugaauuaaagaugugguuuugucacuucagugaaggauaaccuagaaacguguuaaauguuuaauuuuuguuucuuccauuuauagaacccuauguguagaacaucaauuguuucauagaucaaaaacaugcucaguuauccugagaacauuuacuuucucagucuccgcucuuuacccucccagugaauuaaaauucaugcgguaugcagaguaguuaaugaugacuuggagugguucaucauagaggccacauuagaauuauacuuuguucauuuuuagaauuauaaauggaggcaguguggcauaguggcagaccguggucuuugggagacguagcgguucuauucuuccuagcaguguuaucuugggcaaguuauuuaaccacuacaaauuucuuuuuccucauuguuugcuaggcuaagugggauauuucacuuaaagaugucuuucuuguuuaugugucacagaauacauauugcaacagaauccuugucuccuuuuuuguggccucugauuuccacaaucuaguuuauaaaacugcagcugaagugauguuucuaaagccugaaacuagucauauuuuuucuuccuaaaaauucuuuaguguuuccccacuagacuuacaaugaaauccacauucccuaaaaugcucucaagggccuauaguauuucuggagccuugugguauauucccccauugggucuacugucguaggcuuacucaccuuuaaacagauacuguucauuucauucugcuuggaacccuguccucugcuccuuccucuucccuuucccuaaacugauucugauguuuagaacauuagguaaaaugaaguucccauaccucaggugcaugugaaagauuaagaguuggccgggugcgguggcucaugccuguaaucccagcacuucgggaggcugagguggguggaucacgaggucaggaguuccagaccagcuuggccaagauggugaaacccugucucuacuaaaaauacaaaaauuagcugggugugguggcggucaccuguaauccuagcuacucaggaggcugaggcauuagaaucgcuugaacgcaggagauggagguugcagugagcugagauugugcuacuguacucuagccugggugacagagcaagacucucucucaaaaaaaaaaaaaguaauaagauuaagaguuguguaaagaucaguaucagugagcuuucauuagugccuucaucugugaaaccaagauaccugcuuagguuacuaugugaaaaugcuuugaaaacuaagcugggugugguggcucaugccucuaaucucagcacuuugggaggccaaggcagguggaucacuugaggccuggaauuugagaccagccugggcaacaugaggaaacccugucucuacuaaagauacaaaaauuagcugggugugguggcacccaccuguaaucccagcuacugaagaggccgaggcaugugaauugcuugaaacugggaggcagaauugcaguaagcugagauggauugcaccacugcacucuagccugggcagcagagugagacucuguuucaaaaacaaaaacaccagaaaaagaaaauuaaauacuaauuauauguaacuguuaacaguauugccgucaaguauuuguaagaagacaucauuuccuaauguuugaaguuaaagauuauucuaauugugaauagaauugugucccccugccauccuuauguugaagccucaaacccgucucccccaccaugugacuguguuggagcuagggccuuuaaggaggugaauaugguuaaaugaggucauaaggcuggagcccugaucccauagagcuaggguacuuauaaaagaggaaaugacaacagagauuggucucucucugccaugugaggacacagcgagaagguggcugucugcaagccaagaagaaaucccuugcuagaaccagaaccuacuggaaccuugauuguggacuuccuggccuucagaacugugagaaaauacauuucucuuguugaagccaugcagucugugguauuuuguuaauggcagcccaagccgacuguauauuuaauacaguuuaaaauauaauugccuugugggaaaggcaaacuagagugauuucucagguaacauuuuaaugaguaacauaaccagcuauaaauuacuggacuaguuuagaaaacagccucaguaauuugagaauuacuuuaguagaucuuuugucuguguaacuaggggguauuauuauaaauuguuacuuucugguucagccaagacccuuuuuaugaaaguacuuucuccucccauauaaaaguuaaaucauuuaggguguauuuggcuauaaguaauacaacucaguuaacuuaaacaguaaggagcauuuauuauuucauguaacaaauuccaagguaggaauuuaggguuagaguuaggguuaauucuucagcucaguaucaucaaggauucacauucuuuacauuuucacccucaguuuugguggggugguagggagguacuauuagccuuauucuuaguuuccugguaucugcaagaugguugcaacagaaauguuacgcggcuauuguggaucauuuggaaaaugucacaagagggaaaggaugaaaacauaaaucacucauaauccaacuauuuacaugccuaucuucucauugucuggcauauuaguuuguacagguacuaauuauaucagacaaaauuaggucacacuguuuacacaaauacauguugucgguuuccacuaagauacuaucaagaggucaggcguaguggcucacgucuguaaucccagcacuuugggaggcugaggcagguggauugccugaggucaggaguucgagaccaggcuggcuaacauggugaaacccugucucuacuaaaaauacaaaaaauagccaggugugguggcgcacgccuguagucccagcuacucgggaggcugaggcaggagaaucgcuugaaccugggagguggagguugcauugagcugagauugcgccacuacacugcagccugggugacagagcaagacugugucucaaaaaaacaaaaaacaaacaacaaaaaaagauacuaucaagagaauuauccaugucauuaaaauucucaguaaaaauaggcugggcacaguggcucaugcuuguaauccuagcaguuuaggaggcugaggcaggaggauucuuugaguucaggaguucgagaccagccugggcaacauggugagaccccaacuuuacaaaaaaugcaaaaaaaguuagccagacaugguggcaugcgccuguagugccagcuacuugggaggaucccuugagcccaggauuucaaggcugcagugagccauaauugagccacugcacucuagccuggacccagucucaaaaaaaaaaaaaaaauauuaguaaaaauauuuuuuucccuucaaguaaugguuguugaaaaaguuggauacagaaaaauagaauauuaaaaauuacccauaucucacaacucagaaauaaccacucauguaucaauauauuuccuuuuagaacauuuguguguguguguguguguguauuuaaaauuagguauagaauaauuuuuuuuuuuuccuuuggagacagggucuaacucuuucaccgaggcugaaaugcaguggugugaucauggcuuacugcagccucaaccuucugggcuuaagugauccuuccaucuuagccucccaaguagcugggaccacaggugugcaccaccacacccugcuaauuuuuaaauuuuuuguagagacgaggucuugcugugcugcucaggcuggucuugaacuccugaacucaagugauccucccacuugggccucacaaauugcuggaauuacaggugugugccauugugccugacuaauuuuaguuuuuugaggaaucuucauauuguucuucauaaugacuguacuaauuuacauuucaaccaacaggguauggguauuccccuuucuccauguccucucuagcaucuuuuauugccugucuuuuugauauaagccauuuuaacugggggugagaugauauugcauuguggguuuuuuuuuuuuuuuuuuuuuuuuuuugagguagaaucuugcucaguugcccacauuggagugcaguggcacugcagccucugccucucgguucaggugauugucaugccucagccucuugaguagcugggauuacaggugagugccaccacaccugacuaauuuuuguauuuuuaguagagaugggauuucaccauguuggccaggcuguucucaaaguccugaccucaagugauuugcccgccucggccucccaaagugcugggauuacaggcaugagcuacugugcccggcuuaauuuuuguauuuuuaguagagacaggguuucacuauguuaccuaggcuggucucgaacuccugaccucaggugauccgccugccuuggccucccaaagugcugggauuacaggcgugagccaccgugccuggucuguugcauugugguuuugauuuguguuucucugauuaaugauguugaauauuuuuucacauaccuguuugccauucguaugucuucuuuuguguguguguguguguguguguguguguguguguguguguguguguuuuguaugucuugagaaguaucuguccagaucuuuugccauuuuccuuuuggauuauuuguuuuuuugccauugcauuguaugagcuccuuauauauucugguuguugguccugugucagauggauaguuugcaaauauuuucuuccaucuauggguugucguuuuacuuuguugauuguuuccuuucuugugcaggagcuuuuuagcuuuauguaauuccauuugacuuugcuuuguugccugugcuuuuugagguugucauuuuuauugacuagaugauauuccaguauauuaauuuuuuuucuuuuuuguauuuuugagauggaaucucgcucugucgcccaggcuggagugcaguggcguggucucagcucacugcaaccuccaccuuccggguucaagcgauucuccugccucacccuccugaguagcugggauuacaggcguguaccaccacgcccggcuaauuuuuguuuuuuuagcagagcugggguuucaccauguuggccaggcuggucucaaaacuccugaccucaggugauccacccacuuuggccuuccaaagugcuggauuacaggcaugagccacugugcccggccccaguauauuaauuuuuuaauaauuugucauuggcuauuuagaucucuucuaguuuuuuugguguuguaaauaaagguggcaugaauauccuugaacauacagauuuuuugcauuuggccauuuaugucuuuugggugaauuucuuguaaugaaguguguguguguguguguguguguauaaauauugugauauacauuaucugauuguauuuuuuuuaguaguacgugagaguauuugcccaagcuauauucuugaucaucauggcucuugcuauauaauuccuuuuaagaagaauuaaaauuauaugagaagauaacuuguuaacauggaaggaguuaauggaaggaagcaaauguuuuggacuaauagagcuauuuucuauuaguaauacuuaaguauauaacagauuauguguugaaauguaguucuuucuagagcugggguuuuucagguuuugcauuaagacuguuuuugaaauguaagccuuguaguaugguguaggaugguaaaagaguuuggggaaagcgucauugucuuaggcuauagcugugguaaaacuuaaaauuucagaggcuaauuaucuaguuauugggaauacccuggggauacagauugaaucgaaaaggcuuaaaaauauucuacauuauaguuaaacuuggaauucuguauacugaguaaguaugcuagcaguugauuguucuguguagcucucccguuaaagaagagaguaugccccaacuggcauuccugucagucacaacugugugacaccacaggcagcagaggcuucccuagauguugcugggaaugaaugggcuuccagaccucuuaguaguugcuuaagugggaggugguagggaggggcuguguuaaagcuuauaaugaaaggucucaaccugaauugucaugcaaaaaauuuauuuuuuuugcuggauacuugccauaaccugguaggauuucuuuuuaguuuucacuuuuauuggaauaggcguucugcuggagaaaauuagauccuuuuagugguagcuaggcauugcauauauguaugcccuaguccccaugacucuguacuuaauagauuauuugucaguaaugaaccagcauuuggcccaugugcucuuuuuucccugauccucucaucucuccccacagagugauuauggauucuuccuggaagguuucucaggucucuaaccaaccagcccguuuguuggccuucagcaaaguagauguuaguuuuuguguacuucauaguguauaaaauuauuccugcaacagguauuaaaaccugagauuuaaaauccuuuccauugguguuaacauacauuauuuauuuauuuauuuuauuuuauuuuauuuuuugagauggagucucacuuugucacccaggcuggagugcagugacgugaucucgguucacugcaagcuccgccuccuggguucacgccauucuucugccucagccucccagguaguugggacuacaggcgcccgccaccauucccagcuaauuuuuuuguauuuuuuaauagagauaggguuucauuguguuagccaggauggucuugaucuccugaccucgugauccgcccgccuuggccucccaaagugcugggauuacaggagugagccacugcgcccggccaacauacuuuauuuuuuaaaaggccguuaaauugagaaguguuucuuauauacuguauuucaugaauucuaguaacugccccuccccuacuuaguaucucugaaauugggaaacacuuuacaaguaaucauguccuuaaaaagucaucagccagucagcggucauggcauauuugucauuguuugugcuuaugugaauuugguuguuuuuccuuguggcuuaacuggauuauugcacccguaaccuuuugaacaacaaaccauuuaaggaccauuugaggauaggauagaagccaaguuuuuguuguaaaacauuuuuuugacaucuucugguaaaaucaauaaauuagcuucaucagcguuugcagaauugguguuggcagcuuggaagaaaaugaugggaagaaaacucuggaaauagcugugcaacguuauuuuagauguuccauuauuuguaaggggaaguucacagcaucagcuauuaauauauaguauucuugacacaauguucaaucugaaucuaaucaugaggaaacaaucagaugaauccagguuguaggauuuuuuuuacaagauaccuggauuuaaaaaauaauuucuauguuuugaaaggagaaaagggucaggauugggaguguguucuguauuuaaggauaugaaauagaaauaugacuguuaacagcuaugaacaaucuuugauuagaucuuagaucauauggaauaaaauaaaacauacguaaagagguuuuuuuuuccuuugagacagagucucgcuuugucgcccaggcuggagugcaguggcacuaucucggcucacugcaagcuccgccuccuggguccaagugauucuuacgccucagccucccgaguagcugggauuacaggugccugcgaccacuccuggcuaauuuuuguauuuuuaguagagaugggguuucaccaugcuggccagucuggucuugaacuccugaccuuaagccauccaccugccugggccucccaaacugcugggauuacagaugugaaccaccaugcccagccacauguuuuguauuuuuuuuuuuuggaaguuggagaaauuuggguauagguuuggauuagagauaaguuaaaagcuauaaaagacaaauauguugugacagaugugacauuucuagaaggaaugggaggagaguuaaagacauggaaacaaaaugguagaaaacuuaaaaaaaugcacaugggacccuuguuuuguuaucuaagugggguuauuagacuguuaucagucccagcaacucaggaggcugaggugggaggaucaguugaacccaggagaucaaggcugcagugaacuaugaucgugccacugcauuccagccuuggguacagagaaagacacugucuuuaaaauuaaaaaaaugggcaaaauauuugaacauuuuaucaaugaagaaauggaugcugcacaagcacuugaaaacauuaugauuugauagcaaaauggaaauuaaaaccauaaugagauaccacuauauaccuacuagaauauuuaaaauuaaaaagacugaccauaccaaguguuggcaaggauguggagcacuagaauuuucauaaguuucuagugagaaugccaaauaauguuguuucuguuucuuuguaaaauaguuugguaguuuuguuuuuuuuuuuuuuuuuaaaggagacagggucuuguucuguugcucaggcuuggaguguaguggugcaaucacagcucauugcagccucaaccucccuggcccaacugauccucccaccucaagcucccaaguagcugggaccacaggcauaagccaccaggccuaucugauuuuuuauuuuuguagagacagggugucacuauguugcucaggcuggucucgaacuccugagcuuaagcaguccucucgccaugaccucccaaaaugcugagauuacagucaugagcccccaugcccaacugguaguuucuuacaauguuaaauauacacuuaacuuaccaugugacucagcaguuguaucuuuagguauuacccaaaagaaaugaaaacauaccuccacacaagaccuucuacucaaauauucuuaguagcccagaacuggaaacaacccaaauguccaucagcugauaaauggagaaacaaauuaggauacauccauacaauagaacacuacuuagcgguaacaaggaugaaucuuaagggcauucugcuaaguggaagaagccagauacagaagacuguagcuuucaauucuauuuauaugaaacucuagaaaaggcaaaacuguugugacagaaaggaagucagugguuuccaggguccggaggauggggagggaguuaugagggaaauguucuuuaucauggugguuauacuacuguacccauuuaucaaagcacauugaauuguacacugaaaauuuuuaaauuuuaauguaugcauuucguacuuaauauuaaugcugaccucccuuccucauccaagaaaaaaaugaggugauccauagcauccuacaaaagucgcuagugacuuuuugguuuguuuuuaucuuuuuaauauuguuaugaagucuuaaauguaaacauuuuguguguuucauuccauugaaguuaugauccucauugauccuuacauugaguccuuuugacaugacccuagaaaauuccucgguggcuuuuuuguuuuguuguuuauuuauuaaaauugacauauaaaaauuguguauauuuaugauguacaauauuuuuugaaaugugcauacauuguggaaugucuaaguuaagcuaauuaacauacauugccucacaaaguuucuuuuuguggugagaaccuuaaaauuuacucucagcaauuuucaaguauacaauaaguuauuauuaacuauagucaccaaauuguaaccagguaccuuuugauacacagccuguuuuaggugcaucacuauacggauuauagguggugcuccauggcugcuagacagucuuuauucuuagaucuuuucauuggacagagcugggauauuaugaugugauaaauacauuuuagguuuaaacuggugcuuuuuuuuuuuuuuugagacagaaucucgcucugucaccuagguuggagugcaguggcgcgaucugggcucacugcaagcuccgucucccagguucacgccauucuccugccucagccucccgaguagcugggacuacaggcgccugccacugcgcccggcuaauuuuuuguauuuuuaguagagaugggguuucaccguguuagccaggauggucucgaucuccugagcucgugauccgcccgccuuggccucccaaagugcugggauuacaggcgugagccaccgcgcccggcuaaacuggugcuuuuaguuuaaaucuagaacuaaaggauucuuucuuaaccuggauuuucuuaugucaaaaucuauuuugaaccaugccccaaauuucaguucucagugacauaauuaaugauuugcuauaucccacccuaugcaaauaacaguaucgguaauaauuucaguauuaacaccagcaauaaagagacuaaaaacaauuucaguuuuuccuuccccucuuucaauuacuuuuauucuaaugguaaauccuauuaagaauguacauucgaauuacugugcuuugaagccacuuguagagugguuucucucugguuuaggccacuaauuggaugcacaguuaggcucauuugauuaauuuaccuuuacuuugggguaauuccuuuuuaaauuuaaauuuuauuuuauaauugugugaauuauuuacaggcaugcuucucuuuauugugcuuugcuuuacugcgcuuugcagacugcguguuuuacaaauugaagguuucuggcaaccuugcaucgagcaaguguuggugccguuuuucuaagggcaugugcuuacuuugcaugucucugucauauuuugguaauucuuaaaauauuucaaaccuuuuuauuauuacuguaucuguuauggugauauucgauguuauuacuguaaucguuuuggggcaccacaaacugcacucaugugagauggugaacuuaguaauuguuguauguucugacuguaccaccaacugaccauuccuucugucucucccucucuuugggccucccuauugccugagaugcaacaauauugaaauugggccaauucauaacccuauguuggccucuaaguguucaagugaaagaauugcguguuucucauuuaaaauaaaaaacuacuaaugggagcuuagcgaggaaggcaagucaaaagcugagauaggccaaacguuaagccucuugcugcaaacuuuagcuaaguugugaaugcaaaggaaaaguucuugaaggacauuaaaagggcuaguccacugaacacaugaaucauaagaaagagaaaagcuggccgggugcgguggcucacgccuguaaucccagcacuuugggaggcugagguggguggaaucacaagggacaggaguucaagaccagccuggccagcauggcaaaacccugucucuacuaaaaauacaaaaaauaccugggcaugguggcuuaugccuguagucccagcuacuugggaagcugaggcaggagaauugcuugaacccagcaggcagaguuugcagugagccgagaucacuccauugcacuccagccugagugacagagcaagacuccaucucaaaaaaaaaaaaaacaaaaaacagaaagugaaaagccuuauugcugauagggagaaaguuuuaguggucuggauagaaggucaaaccaggcugggcgugguggcucacaccuguaauuccccugcauuuugggaggcggagguggauggaucacaaggucaggagaucgagaccauccuggcuaacauggugaaacccuaucucuacuaaaaauacaaauaauuauccaggugugguggcaggcaccuauagugccagcugcuugggaggcugaggcaggagaauggcaugaaccugggagaaggagcuugcggugagccgagaucacgccacugcacuccagccugggcgacagagugagacucugucucgagauaaaaaaaaagaaggucaaaccaggccgggcacgguggcucacgccuguaauccuugcacuuugggaggccgaggcugguggaucaugaggucaggagaucaagaccagccuggacaacaugaugaaauccugucucuacuaaaaauacaaaaaauuaggcaggcaugguggcucgugccuguagucccagcuacuugggaggcugaggcaggagaaucucuugaaccugggagguggaaguugcaguaagccaagauugugccacugcacuccagccugagcaacagagcgagacuccgucucaaaaaagaaaaaaaaaaaaaaucaaacuagccacaauauucccuuaagccaaagccuaauucagaacaaggcccuaacuguucaguucugugaaggcugagagaggugaggugagaaagcuauagaagaaaaguuggaagccagcggguucaugagguuuaaggaaagcagccaucucuauaacgugaaagugcaagguaaagcagcaagugcugauguagaagcugcagcaaguuacccagaagaucuagcuaagauuaucgaagguugcuacacuuaauaucagauuuuccauguagacgaaacagucuucuauugggagaagaugccgucuagggcuuuuacagggagagaggagaagcccaugccuggccuucaaaggcuaggcugacucucuuguuaggggcuaaugcagcuggugacuuuaaguugaauccagugcucauuugccaugcugaaaauccuaaggcccuuuagaauuaugcugaaucugcucugcuugugcucuuuaaccagaacaaccaagccuggaugacagcauaucuguuuacagcaugguuuauggaaucuuuuaagccaacuguugagaccugcucggauaaaaagauuccauucaaaauauuacugcucauugacagugcaccuagucaucuaagauggugauguauaaggagauuaauguuguuuucaugccugcuaacacauacuuauuuugcagccccauagaguaauuuugacuuuccaaucuuacuauuuaagaaauacauuuuguaaggcuauagcugccuuagauagugauuccucugaugaacuugggaaaaguaaauugaaaacuuucuggaaaggauucaccauucuggaugccauuaggaacauuaguaauucaugggaggaggucagaauaucaacauuaacaggauuuuggaagaaguugauuccagcccucauggaugaugcugagggguucaagacuucaguggaggaaguaacugcagauauggugggaacagcaagagaacuaaugagaauuagaauuggagcccgaagaaguggcugcaaucucacaagaaaacuugaauggaugaguuguuccuuauaggugaacaaaggaaauaguuucuugagauagaaucuacuccugcugaagacgcugugaaccuuguugaaaugacaacaaaggauuuggaauauuacauaaauuuaguugauaaagcaucgguagugcuugaaaggauugacucauuaaaauuuuauuuacuuauuuauuuuugagacagaguuuugcucuuguugcccagguuggaguacgguggcacggucucagcucacugccaccucuggcuccugggcucaagcgauucuccugccucagccucccaaguagcugggauuacaggcacauaccaccaugccaagcuauuuuuuguauuuuuaguagagacaggguuucaccauguugaccaggcugaucucgaacuccugaccucagguaauccucccgccucagccucccaaagugcugggauuacaggcgugagccauggcacccggccaaaaaaaauuuuuuuuucagagacagggucucacuguguugcccaggcuguccucaaacucuugggcuuaagcaauucuccugccucagucucccaacuggccaggauugcagguacaagccgccaccacacccaggcuugauuucaguuuugaaagaaguucuacugaggguaaaaugcuaucaaauaucgcaugccauagagaaaucuuguuaaaacaaaagucaauagaugcagcaaauuucauuguugucuuauuuuaagaaauugccccagcuaccccaaccuucaaaaaucccacccugaucagucagcagccaucaauauggaggcaaagcccuccaccagcacacaaauauuaggacucucugaaggcucugaagaugguuagcauucuguuuuaagcaauaaaguauuuuuaauuaaggcauguaccuaguuuuuuuagacauaguacuaucgcacauuuaauagacuacagcauaauauaaacauaacuuuuauauauacacugucucuagccaaaaccgcaguaucuuugcagugugccuguauguaguuccaaagagaaaucugugaaacaagauaugcuuaagggauucuaucuacuguccauguuuucucuauccuauuuauuaccucuccuccuguaugugauuuuuuuuuuaaugccaagguuuguuuuuccuuuaaaaaaacaugcauuuucauauuucccucuguuaagaaguagcauauuauacacauuuuuucccacauuuuuuuuuucaccuuagcaauauucuggagaucauggagucaugguaacagagaaauuccuugaauuccuuguccuuauuauggcaguauaauacucuauuguguggagauauuauagcuuauucaaacagucuccuauugauaguuauauggguuguuuccagucuucugcuauuauagauagugcugcagugaauaacuguguacauaugguuuuguauuuuugccagugauuuuuugagauacauuccuaaaagugagcuuacugggucagaaaguaaaucuguguguaauauugcuggauaucacuuaccagugcaucagaguuuuuucucacagcuuugcugagugucuugucagacuuuuguauauuugucauuugggugaaugagaaauaguaucucauauugguuugcacuugcauuucuuuccuauaaugagugagguugaacaucuuuucagugguuaagagugguuccauugcuuuuuuggugagcuuucuguuagaucucuguuccauuuuuuuuuucuguguagaacuggaagggacgugagaccauuuuguuuagucucugaguucaugacacugauaccuggagaaauaaaugauuuuccugaaguuguagguagcuaggauagccuuuuuuuuuuucauuuuuagauuauauguuagugauauuuacucuuugugguguaaguuguugauuccccuucuuacccaccuacaguuugucaccuuuuaaccuugcuccucuuugaggaguucuugccuucugaguuaucuauaggaguuugggaagaagggguggguaaggaauuggagcacauaagauucacaguaguuuuuguggggcaugauaggcuugaaucaucauagauaacaaggaaguuggauuuccgauggugguuaguggacacaggaauauaaggcagauuggauuuaguccauuucauuguaaguggauugggagcuugaggcugacaguaaaguccuuaugauguaaugcagugaauuggugauggaaagggucuaggcaaggagaaccaguuggugcagugugucucugauacugugacuacaguuaguggccccuuuaguggaugagcuacucaggagagagugguucccagcuggcacauagggauuucugccauggcuuaauucaguaguauccugagacuaucauauugguacagugaguuuuuuuuuauugaauuucucuaguaaaauaauauaacuuugccuuucuauagaauauauauuuaaugaauguuaaucuaaauaaguauuuguuguuuuuguucuuauuucaggcuacagacaagagaaaagcuuuagaggagaccaaagccuauacaacccaaucucuagcuaguguugcuuaucaaauaaaugcauuggccaacaauguacuccaguugcuggauauccaagccucucagcuucggagaauggagucuuccaucaaucauaucucacagguaacagcuuauaaaaugcuuuaaauucaauuuaaaaaaaacuacagcauaugccaaagaaguaaauagccugcauguauggauuucugacucaucuuacuggugauaaucauuaacacuguuuuaguuugguaaaccugcuguuuuucuuuuaguccuuuuuuuaucaugauaagguaaacauaacauaaaauugaccauuuuaaccauuuuuaaguguauaauucaguagcauuaaguacauucacauuguacaacugucaccacuguccuacuguuaagagcuuuucugacguaaaguuauuuguacauaaagaacagaauuuuuauaaguuuugacacacauguauacccaugugaccaucaacacauucaagauaaugaaccauccccuuucccccugccaaauuucuucauucuccuacguaaucccucccucuugucccuuguccuuaggguuucugucccuagagauuaguuuacauuuucuaaauuuuuauauaaauggaaucauauaguauuuacuaauuuuuuuuuuggucuggcauguuuuacuauggauaauuauuuugagauucauucauguuuuugcauguaaaaguaguucacucuuuuauugcugaguaguuucuauuguuacacauuuuguuuauguguucacauguugauggaaaucuggguuguuuuuagguuuuggcuauuacaaauccuaugaaaacauuuguaugcaaaucuuuguguggucauaugcuuuuauuucuuuuggguaaguaccucugugcagaauggagaggucaugugguaggugucuguuucacuuuagaagaaccuaccaaauuguuuuucaaagugguuauaccacuuagucuuaguuugcugaguguucuuaucaggaauggguggugaauuuuaucaaacgcuucuuugcauuuguugaaaugaucauauauauguguguguauguauauauauauaugucuauuaauauggugaauuacauugguuuguguguguauuaggaauuuuuguuucuguacucuugagugcuguugggcugugguuuucuuguaaugccuuugucugguuuuggugucaguguaaugcugguuuuauugacuguaaugggcaguauuccaucuggaccuggaguguuccuggugaaaaggauuuuaacuacauauuuaauuuccuuuguggauacaagccuauucuguuuauuuguuuuuccuugagugagcuuuuuaucuuucuaggaauuuagcuauuucaccuaaauugacagauuuauuugcauaaaacauuuauaauaauccuccugcuuuguuuuuuuuuuuuuuugagacaagagucuugcucuguugcccaggcuggagugcaauggcgugaucuuggcucucugcauccuucgccuccuggguccaagcaauucuccugccucagccucccaaguagcuagaauuacaggcgcucgccaccacgccuggcuaauuuuuuguauuuuuaguagagacgggguuuugccauguuggccaggcuggucuugaauuccugaucucaagugauccacccaccuuggccucccaaaguguugggauuacaugcuugagcgacagcacccugccuaaucucuuauuuuaaaaauaucuguagaaucuauaauaauuucacauugcucauucuucauauugguaauuggugucaucuuucuuuuuuaaacuaaucauuauggcuaguuuaccaacuuuaucgauauuaaaaacaucuuuggccuuauuaauuuucuauguuuuuguuuucuguugcauugauuuccauucugaucuuuauuauuucuuuuucuuuuccuuaccuugggauugauuugcucuuauuuuauacuuuuuuuuuuuuuuuuagauggagucuugcucugaugcccaggcuggugugcaguggcaugaucucggcucacugcaaccuccaucuuucagguucaagccuuucuugugccuuaccuuucugaguagcugggauuacaggugcaccucaccacgcccagugaacuuuuuuguauuuuuaguagaggcaggguuucaccauguuggccaggcuggucucaaacuccugggcucaagugaucugccugccuuggccucccgaagugcuaggaucgcaggugugagccaccacacccagccuuauuuuauacuuuauuaaggugaaagccaaggucauuuaauuuacuugagacccuuaaucuuuucuaacauagguguuuaggucuguaaaugucccucuaaauaguguauuauugggaggccgagguggguggaucaugaggucaggaguucaagaccagccugaccaagauggugaaacccugucucuacuaaaaauacaaaaauuagccgggcgugguggcgggcaccuguaaucccagcuacucacucaggaggcugaggcaaauuacuucaaccugggaggcggagguugcagugagccgagaucgcgccacuguacuccagccugggugacagagcaaaacucuaucucaaaaaaaaaaaaaaaaagugcauuagcuguaucucauacauuuagauauguuaugcuuucauuuucauuuagcugaauauaauuucuaaguuugcuuuuuuauuucuuucugacccagggguuauuggaaauguguugcuuaguuugcaaguauuuucagguuuugcaaggauauuucugcuguugauuuuucuaauuuaauuucuuacuggucagaaaaauacaccucauuugauuuuuuuuucauuaaguagcuuucccccgcagcuuuauugaguuauaauugacacaaaaaucauauauauuuaagauguacaaugugauguuuugauauacauauacauugugaaaugauuaccacuaucaagcugacuagcauaucuaucaccucacacagcuacuuuuuuuguguguggcgagagcauuuaagauuuccucuuuuagcaaauuucaagucuacaacccuauauuauuaacuauagucaucaugcuguacauuagaucuccagaacuuauucauccugcauagcugaaacuuuguacccuuugagcaacagcuccccauuucccuuacccccuagucucugacaacuaccauucuacucucugcuucagugagcuuugauuuuuuuagauuccacaucugaaaaagggagaucauucaggguuugucugucugcgccuagcuuauuucacuuacuguaagguccuacagguucaucuguugugucauguugcaaauaacagaauuuucuuuuuuaaggcugaauaauaggaauuguagucuguuuaaauaaauguauauguauaucccccccauauuuuccuauucauccauugauagacaccuagauugaugcugugucuuggcuauucugaauaauacuuuauaugcugugaguccuuucauauuuauuaagaauuguuauauaucccagaauaugcucugucuugguaaauguuuugugugcauuugagaagaauguguauuuuucucuggucagguggaaugucuauaaaucucauuaagucaaguugguugauaauauucaauucuucuguaucuuuacugauucuaucuaauuguuuuaucaauuauuaaggaagguaaauugaaaucuccaacuauaauucugaaugucuauuuuucuuugcauuuuagucuuuuuucuguuacguauuuugaagugauacuauauuagguacacaaaugcuuuggcuuguuagguccacuugaugaauagacccuuuaucuuuguaaagccucuuuuuaucuuggguaguauucuucagaaaucugcuuugucugauaugaauacaaccauuccagcuuuccuuuuauccucuuuuucugccuccuuguguguuaauggagugaauuuuuuuuggggggggugcugauuugguguaacacuuuguucugcuucucucuuuuauuauuucauucauguuugccuuagggcuucugguaaacaucuuuaaacuuuuuaauaucacuugaagguagacuaugcuauuacuucaggaguauguuuaagacuuuguaauaguugauuccacuucucuccugucuuagggcuguuggugucaugcacuuucuuuuuucuuuuauugagacggagucucgcucugucacccaggcuggaguacaguggugcgaucucggcucacugcaaccucugccucccacgugcaagcaauucucugucucagccucccgagugaguagcugggauuaugggugcccgccaccaugcccggcuaauuuuuguauuuuuaguagagacaggguuucaccaucuuggccagguuggucuugaaccccugaccucgugauccacccaccucggucucccagaguacugggauuacagauuacagguauaagucgccacgccuggcuugugucacgcauuuucuuuuuguguauguuuuaaaccccacaaugcuuugcucuuuuuuuuuuuuuuuuuugugacggggucucgcuuuguuguccaggcuggagugcaguggcgugaucuugccucacugcaaccuuugccccugccuucccccaccccaccuucccaguuucaagugauucuuaugucucagccuacugaguagcuaggauuacaggugcaugccagcuaauuuuuguauuuuuaguagagacgggguuucaccauguuggccagguugguuucaaacuccugaccucaagugaucugccugccuuggccuccuaaagugcugggauuacagacaugagccacugugccuagccauuauuuuuguuuugaaaagcaacuagcuuugaaugagauuuaauaugaggaaauuaauuccuuuauauuuacccauaguuauuauuucugaucagaaaauauacauuauaugauuugaguccuuucaaauuuguuaggaauuuuuuuuuuuuuuuuuuuuuuuuuuuuuuuuuuuuugagauggagucuugcucugucucccaagcuggagugcaguggcaccaucuuggcucacugcaaccucugccuccuggguucaagccauccuccugccucagccucccggguagcugggacuucgggcaugcgccaccaugcucagcuauuuuuuuuuguaguuuuaguagagaugggauuucaccaugcuggccaggcuggucucaaacuccugaccucaagugaucugccugccucggccucccaaagugcugggauuacagacaugagccaccgugcccggccaggaauuguuuuauagcccagaguuuuggugguuuuuauucccuuggaauacuuuagcaugaaguguugcucuauucugcuggugaugaguucuuucagcuuuuguauaucuaaaagagauuuuugcuuuuuaucccuguuuauuauuguggcagaauaugcauaagauaaaauugaucauucaaccauuuuuaaguguacaguggcauuaaguaccuugacauuguuuuguaauuaucaccaccauucaucuccaaaacuucuuuccuuuuuccaaacugaaacaauguaccuguuaagcacuaacucuccauccgcaagugauccucccaccucagcuucuugaguagcugggacuacggacaugugccauugugcccagcuuauuuucauguuuggugguauccuguugccuuuuuagauuuuaggacaaaauugauauagauuggaacuuugcuaaaauaauuuuuuuuguagaacagaaucuaguguagagugauucaugcugguucuugaggacuugcacaaugucuggcaaaugacugguuugcaguguuuacugaauuaaaauaaaucucuuggccggacaugguggccuguaaucccagcacuuugggaggcugaggugaguggaucauuugaggucaggaguuugagaccagccuggccaacauggugaaaccccgucucuacuaaaaauacaaaaauuaggcgggcgugcuagcaggcaccuguaaucccaccuacucaggaggcuaaggcaggagaaucgccucaacucgggaggcagaaguugcagugagcugagaucccaccaguguaccucagccugggcgacagaguaagacuccgucacacacacacacacacacacacacacacacacaaagucuuugcaaaauuacuuaggaaaaauauaauagaaccuaguuuuuaguugauucuuauacauggauuauaaccagaggaucacuguacauuuuauguauaggcagugauuauuuugcaugguuauuggagauuauaaaaaauggugaugcaugcucaagguauacaaaacaaucuuacuagucaauggguaaaauuaugguuguucugugaucuguaaaauuuuuugucaaaacauuaaaaucucucuuuuuguuauaaaugaauagagaaaugaaaaaaaaguuaugcuaauguuuaguauaccauaauguaaaacauucgagguauugagaauuaaaggguuuuauuucuuaagaaaguaguuugaauagugcuugcuaccuucucacuguguaaguuguuaugaagcacacauuuuuuucugugccuuggcaaauugucauucuccuuucucuggguggaucagcuccucucaacauuuuauccuuuggauuuuaaauguugugaaauaucuucuagaguuucuuuaacauaaaguuuuuauggguaucauuuuaucuguaguaucuucuucccuuucuucucagccacuuuguucauuuauguuaauacauuugccuucaugauauucuucuggcugcauaucuguagucuccugaauggcagcaauguuagcauuccuguaugcauuauuucuguuuuaaucccauuuacauucaauucgaauuucaccucuaucuagcauuaucacuuuucauguauuugcugcaguuucaucuuuguuggccaguucucucuuugauacccaguuuuguaaaaugucacaauggcuuaucauuuaggggacaaggaagcagcacaacuauguacuuuguagucuguggauaaacuuaauaucagauguacagagaccauucaccaauaaacuuugaaacaaagacacgauugguaaccaguaaugaugcucaucuguuacuuauguggacuucagaccuagcagcgaaguuucugcuuugugcgauuauuuauaguucuugugguaacugaaauuuauuuauuuuuauguuuuuaugagacagaauccuguucuguugcucaggcuggagugcaguggcacagucauaguucacugcagcuuugaacuccugggcucaaaugauccucccgccucagccuccugaguagcugggaccacagaugcacaccaccauacccagcuaauuuuuuuggguggugagguagagaugggaucuugcuguguugcccaggcuggucuuaaauuccuugcuucaagugaucuuuccaccuuggccuuccaaagugcuggcacuacaggugugaaccacugcaccugaauguaacugaaauuuaaauuguguaguuggaggacugguguuaacuaaaauaugguaacugaaauucaugcguaucagaacugugcaaaacaacugccuauauuuuguuuuuucaguaacaaaacauuuucaaauuauuuuucuucuuuauuuaauuaugaauauucucuguguucugcugagcuuacugaauucaauucucauucuuuggaagaugucuuaauucauacagauguaguuauuucaguagauuuaaaaauaaagcuguuaauacuaucaauugacuuacugaaucauaaaaaaauuaaggugacuagguaaaugaagcuuuuguaauucuguaaauuacauugaauuacuuggaacucuuaaaugcagcugaaaucuaauuggcuaaauuuacauaaaaacaggcuuuuggggggggcauuuauucuuaauuggggaauuaaaaagaguauuuccuugcucuuccaaauugcuauucuuaaaacauuguuuaaguaaaugcauuguagugaaagaaauuuuuuuuuaaaucucucagagcuuuaugagggauuuacaucugucauaccuuggcuguugagugguguguuuuuaguuaaaauucugcuuuauaaucucuuaauacagcauagauuaugugccaauuaggacauaaucucaaaauuuagaauucagagcuuguuugaguuuucaguuucaaaaaauuuuuaaacuaaaacaaacaaaaaucaucuccaauucuaucaggacuuggauaaacuaaaccuuaauuauuucaggaaagagucccuuuccuuucaguguggagcuuuuaacuuucuguuuguguguugacauguuuuagauuuauaaaguuuucuauuuuaacaauuuuaucccccauuuuuccugucuuagauuaaguuaccaaauauuaguagcuuuccuuggugaaguaauuacugauaaguccuuucuguaaccaauauucacuucuuauuuuguaaauuuuuaaaagauucuuauagugauauuucuuaugacacaguagucaucuaaaggugccagucacuuuuccuggaaaauauaggaaguaauacuaggagaaagugugcaacuguuaaauucuuucacaucaccaacuuuuucacaauuaaaguauuugcuuuguagagugcuuagcaauguccauuaugauuucuuuuuuccauuggcaauuuugggcuucccucacaucauggaaguuagaacuggaagggacaugagaucauuugguuuauucucugauguuauaguuugugacacugaugcccaaaaaaauaaaugauuugccugaagucguagguagcuaguauaacauuagaaaucaaaagaugggcaucuugacucauagaugauccacugauuuucucuucuguacuacaaugccuccaauuuguaaucagagucuucaaaauuuaggaauuggaugaauugccccauccagucuauuucuacagugggcucacaaaaccuuauauaacaaaccuucaaaguaacugcaucuuuuaggagacuguuuaguuuuauauaggcaaaaaccuaguuacugugggcacuggggagguagggcggguaccuagaauggaaacacuaacugagucagugcucugguuucucagauguuuuguuaggaaccuuuuacaucuuaaauuauugaggaucuacgugggcuuuggauucauuggguagaucuuccaguauuuaucauaucagauauucaaacaaauuuaaaaaguauuuaacucauuuaacaauaaaagaaauccacuguuaguacaaauaacauuuuaaugaaaaaaacuguuauccaaaacaaauaaauuuaugagaagaguggcauuguuuuacauuucugaaagugucuuuaaaauguuugguaagacgaucacuggguucucaugucugcuucuucauucacucuguugugauuuguuguuuggguugaaguaugugaagaaauuuugcuucacaaaaauauguaguuagaaaagacaggaucuugggaacuucaggagucuuuagaucagucagagaacuauugcuuuaugugguuauuacaguuuaguuccuauagauuauguauugcgaauauuauaugcaggccaucaugcucccauuuuaaaagaaucacccaauuugauaauacauccccaccuguaguuucuuuuggcucuccgucauacauuuuuuguuucauccuuacugacugacuacuuggugauauuuuuggugccauuauccccauuaugaaggggcuucuucagauuccuaauggacuguugguauuuaucuuagauuuccucagccaguuucuuaaagguguuucaugauuuuuuuuuuuuuggcggggggauggaaucuugcucuguggcccaggcuggagugcagugucgugaucuugacccauugcaaccuccgccuccuggauucaagugauucuccugccucagccucccaaguagcuaggauuacaggugugcaccaccacaccuaggucauuuuuguauuuuucuuagagacgggguuucaccauguugaccaggcuggucuugaacuccugaccucaagugauccaccugccuuggccucccaaagugcugagauuacaggcaugagccaccacgucuggccauuucaugaauuuuaacaucaagcaugguacucuucuuuggcacuuacuggcugaguuguguguccccccgccaacaaauuuauauuuugaagucauaacucccagucccucagagugugacuguauuuggagauggggucuuugaagagguaauuaaguuaaaaugagguuacagaauaggcccuaguccaguaugacugguauucuugaaagaagagggugaagacgcaaagagaagauggccaucuguaagucaaggagaaaggcccugagaagaauucaguccugguaacauguugaucuuggacuuguagcuuccugagucgugagaaaguaaauuuccuagccacuuaccugugguacuuuguuauggcaguccuagcaaacuaauauagcccucuuauguugucauuagcacuaucacuuuuauacuuuuuuccagcuauuauggauauaaacuuucaccagaaccuucaauauugacagaaagauauaauguagauugauaagugucauuugucauucaaaaucagaaaagcaugacauguacaguccuugcccaguggcuaaggagcauucauuagcacucacuugauauggcugauuuacugugagaaaaguauguuaaugguacuagucaguacucugguggguuuguaugcacaucuaguauuucuaagaugaaccaugcuaugcuguauugaguaaugcccccaaaagauaucccuaaucccugagaauguggauguuaccuucuggcagaaggggcuuuuugcaaguauaaauuaaagaucuugagaugggaagauuauccuggauuaugcagugggccauaaauguaaucacagauguccugauaagagggaggcagaggaggauuugacauagaagagcagaaggugguguggaaacaggagcagagauuagaaugauguggcgauaagucaaggaaugcugguagucaccauaaucucgaagaggcaagugaacacccccuccugagccuucucagggagccugucccugcucacucuuggauuugauccuguaagauuuuguucagauuucuggccaccagaacuguuaagaggauaaauuucugcuaaaaacuuuauacaaaucuuugcauaaauuuauacaaauuuauacaaaucuuugcauaaauuuauacaaaucuuugcauaaauuuauacaaauuuauacaaaucuuugcauaaauuuauacaaauuuauacaaaucuuugucagagauugguucuucaugaaauagauuaaaauuggaauuuuaaaaggauguuauaaaauuguauaauauucuuaacaucauaaggaaaacacgaaaaauuucucaaguuuccugccaaaguccuauuaugaaauaguauuuuuuaucuucagcuuuacuguuuuaagacugauaccuaaccaaaacaguugcuaauuuuccuguuguaaauauugaggaccaauaguaaaaugauuuagagcaaauuuccuaacuccccuucuuuggaaggaggacaccuuuuauuauuucagauuaauuaagcaugcuugcuuuaauuauaguuauuaacacgguaaauuuauagaggagcaagcuauaguagagauacacuaauauagaauauagauucuucucugaauguaaauacaugcuacagaacacauacauucuuauuugggggcuagagugacaaagccuuaucuuggcacuaaauuuuagcucaguauuaucuaaaauaaaauuuucuuaauuauuacauugauaaacauuuguuucaaaauuauucuacagggauucuuaauagcaccuagcagagagccugguacuacuaugagcuuacuuauaaccuuaguuauaguaaguuacuucauguuaauugcagaaauuuaugaauuuuaauauauuuuagauaucugaaauuuuugaaauuaaauaaaagauacucuaaaauauaccagugauuucugauagcauuagguuuucuuccuuuguauuuucuuuccuucuccuuccuccucucucccucuuccccuuuuucuuucuuucccuacccccuuacuuuuuuccuuccuuuaacauuuccugccaaggaaacacauuuuggcuaaaauauaauuuguaucaguuaauuuuuuuuuuuuuaaaagaacagguguacuaaacucucccagacuauuaguuguuggugugguaaccagaccuucaugccaucagacgaguuaaucuagugcagggguccguaaacugugauccaugagccacaucuaguccuucccccuccauuuuuauaaauaaaguuuuauuggaacauagcuguguuccuuuguuuacauauuguuacggcugcuuuugcugacacauggcaaaguugagucguuacgacagaagccauauggccugcaaagucuuaaagauguacucucugauuguguccagaaaaaguuugccgaucccugagguguuauaaaaacauuuacuucaaaaaauuuaaaaaguguucaugggauuuaacaccgguuucucuauuuauaguaaguaacauuuuuuuuuaagauaauuuuucuggagguggauuugcugaaauuccuuaaggagccagaaauuuugaagaguggggcuggugcagauugcaugaugauacaaguuguacauguuuauggcuucauuccuaccauauccccagcauauaggguuagcuugcguaagauaugauggaagaaguucuguuagggguuugguauucugacaccagugggguacugcaguacuguucugacacugaucacacagaguuagugcagaccacacaagggaagggcucaguuccagaagucugccuucauuucaggugcuaguggcaaguaggguccccauucuacccauacuuauggccaacuagcuacaaaucuggggaguuucccacaaccccucucaggguugauaauuuacuggaaugauucaaagauuucagggaaacacuacccauaugauuacgauuuuauuuaauggauacagaucaggaccagccaaaugaagagacacacagggcaaggucugggaguuuccaaacauagagcuuccaugcccucuucuuguggaaucagggcaugcuacccuccuugcucaucagcguguucaccauccagggagcuccaccaggcaagcuccaccaggcuucagugucuagaguuuuaucagggcuagugcuguuuucucacaguuuuugguuuaugcagaaagaaaaguaacauuaauuaguguccauauguauuauaaguuaaugaauuguugucagguaaggcuuauauauugauucuaauauuuccccccuuuuuuaugugaaaaugaaaguuuauaguaauauuuuuguuuuauuuuuauuuuauuuauuuauuuauuuggacauagggucucgcucugucaccuagauuggugugcaauggugugaucauagcucacuguauccucaaacucccuggcucaagggauccgcccacccagccucccgaguagcuaggacugcagaugcaugccaccgugcuuggcugguuuuuucaucuuuuuguagagauggggucucacuauguuucccaggguggucucgaacucuuggguucaagugauccuucuaucuuggugucccaaaguguagggauuacugugaggacuaguaauuuuuuuuuuuuuuuugagauaagucucacucugucgcccagucuggagugcaguggcacaaucucggcucacugcaaccuccgccucccggguucaagugauucucgugccucagccucccgaguagcuaggauuaaaggcgcccaccaccaugcucggcuaauuuuuguauuuuugguagagacgagguuucaccauguuggccaggcuggucucaaacuccugaccucaggugauccgccugccucggccucccaaagugcugggauuacaggcgugagccaccgugcccggccaguuguuuuuuuuaaauguccuuauuggccaauaaaauuggcagcaauacuuuguacuucucuuucugugucugucugucuccccguccuuuauuaccuuucccccuucuccccuacuccuuugcuuugucugucugccuccccucccuguccccucccccuuucuucuggaaucuuuuaaaaacaauuuauuaaucugugaaauccauaguuagaauaacccagacuguuccaucucccaguuaccuuuuuuguuguuguuguugagacggggucucauuuugucacccaggcuggagugcaguggcaugaucucggcucacugcaaccucugccuccugcguucaagcgauucuccugccucagccuccugaguagcugagauuacaggcacgugccaccaugcccggcuaauuuuuuguauuuuuugcagaaauggggucucaccauguuggccaggcuggucuugaacuccugaccucaggugaucuaccugccuccgccucccaaagugcugggacccaguuauguucuuuuaacacaugcauacacaccagcccgccaucccaccccugagugaacaaagaaugaaacuugaaccaucacccuuauggggucagaauauuauuuauuuuuaggauagagaauaggggcaaugcuauggauuuaguuucuguuccaggaguaaaccaaccaaacauucuuccugugguaauaacagaauaguuccuaucaaaugagucuucuuacagauaacuuaaacucugaacaaaauauaaaaaacaaagaguaccugaagaacaacuaauagcagaccgaaacuacagauaagagauuguuauuauacacuuuuaaaaaugaaauagcccugguugguuugcuacuuuuuuguguuuuuuugaacagagucucgugacgcccaggcuggagugcaauggugcgaucucagcucacugcaaccucugccuccuggguucaagcaauucuucugccccagccucccgaguagcugggacuacagucaugcaccaccacgcccagcuaauuuuuguauuuuuaauagaggcgggguuucaccauuuuggccaggcuggccuccaacuccugaccucaagugauccauccaccuuggccucccaaagugcugggauuacaaacgugagccaccaugcccggcuggguuugcuauuuuuguagcuaguuuugcaccaugcuagacagcuaaaacucaguuaggaaacugcauauagcuugugacccagagggcagaguucauggugaccacaacagcuggaaagugaguggaaagagagaccugaagggaaagagccccaaauuuuguguuaaaacuuugccuguauuacaggcugagcuguguguggagcgaacugcaugcaacucagccaaggauaaaagaacugaacaaagauuucagcugcugcccaucuuggaggagaaaguuugcgauuuaagucaagcuaaguuuaguaucaacuuuuuuuuuugaggccgggucucacucuugucgcccaagcuggaaugcaguggugugauuaugguucacugcagccuugucuuccuaggcucaggugaagccuccuccucccaccucagccucccaaguagcugggacuacaggcaugcaccaccacaccuggcuaauuuuucguauuuuuuguagagaugggguuucaccauguugcccagaccugugucgaauucccgggcucaagcgauccaccaccuucugccuccaaaagugcugggauuacaggcgugagccacugugccuggccuacuguaaacauuuuuuguuuguuuuuucuuuucuacuucuuuaucuuuuuaauuuuucugcccuugaaaaucaaaacauuuuuuaaaggacuauagcagaaucuagaguuucuguaagguaucauuuaccacauauaaaauguaaucuaaaauuaccauacuuaggaagaaccaugaaaacauggccaauauucaagaaaaaaagauaaucaauugagauaaaacuugcaauuacaugcauguuggacaaaugaugauuucuuaugugugacaacuuguggauucagggacuuaaaacuuuuuguagucaaagggaauuuuaggauacugauucuagucuaauucauuguuuuucucauguaucuaaggucuaacuggcacuuaccaguuuguuagccucuugcacugauauuacucauuuucuuuccuucuuggugugcugcuuccccuguaagguguuaacuuguuugguguauaugauucaaggaccaggagauagaaaccauucuaacuaucuuaaauauaaauuuacucuccacaaauaaguuccagaacucaaaaacugaucugcuggggaagcuauaaccacugauggugccacaggaauuacugaguuuaagaacguuaugcaaggguuucaggccauggcuuagaaagcugcugccauuguugcugccucaacugccucuugacacccacaaaccuggugacugggcauugaacuuggaguccagcuguuguuuccagugcgguugccuguaaacauccaaacaguuggagaauggacacuggagcaucaauuuggaaaaaaaccuuauuucuugacuuacuuugccaauaggaaauguaaagugguaauaagagaucuccacuucacuuucaguuuccaaaucccaugaaaguauuuuauugauagaucagaaauuguauccagaagccugguggugagaacaacuggacaauguugauuuuagcuuuuuagcuucugcagugcaagcagauauucuuggggcaaggaucaggaggguagaaugaagauugaaugagcugguuuuacagcauggcuugaaggaauaacaguugaauugggucuuaaaggaagccuguucauuuaucauguugauacggaguauagaugcauuccagucugagguaauggcauuagagaaagacaugcaugguuuuuucagggugauuagaauguaggguaugauuucugcaaugaggaaaguaccuggagaucaauuugcaaaaaccuaaaguucuaaauuauagcuuauuuuccuuugauuugguuucauugcugaggcuaauuguguugugcuaggggaguagcugguauccuuuggcuucuucucugcuucuuguaucugcugggugcuggaauuacacagcuccugagucagagcaauaugcuuagcagaaauaagcaucagucuuccugaaccaucagauggcagacugacgugauaugcccugaaucaaaggaaaggcaguaucuuuuggaaauuggagacucuguucuuugcuuuuaggguaaacagcuggcaauccugcuucuguucaauaugcuuuuuggagaaaugaaucaccuaagccugcauucugccucaaauaaucuguauuugugggguuaaggaagcaaaucuucagucccucccuguugaucacaaagugugggugaaaccauuucuuuguuguguccuaaaauaugacaacggaguguucucauuaaccuuagaauaaaaacuaccuuuuuuuuuuuuuuuuaaauaaaaagugacuuuggaacuguccuugagcuugaguauaaacagcuaguuugggagucuccuuccaaauuucauguucuuuugguugucuguaagccguucacucaccaggcuacugcucagaccucugaagucugagucuucacaguagccuaaucuugcuuuaaagucuggaaauggauuuuuacuuccuauaguucagauaccauagcauggcauaaaagucucauugauguggucucuucaacucuccuauuucugccaugcccagcuucuugaaguguugcagacacagcuguaaauuugugcgucuuuguuuuuccaauuauguguuugucuuaccuggaauucaguuuguccuguuucuguucugccuaauaggaacaccgucugaggucuucacuaaucagcucaggauagaguuacuggcccucucuuuguuuuauaccuucuaacuuauuccuucuuuuacauugauuuuuggguauauguuuguguuccuuaccuuacucuuuaaagauaaggaccauguuuuauucaucucuguaucuuuauuacauaguaacuggcauuuacauaguuugauaaggauauggaaagaauaagacagugugguguauuuuggagucauaaagaccuguguuugaagccauguucugucacugugugauuuuuccuaccuaccuuuuugaguuuaguuaucucauaugcagaauuuggacaauagugcuaaccuuggagauuaaauaaggaauugcuuauaaagcauuuaccuuuacauaguguuggcauuauuagucaucauaucugucaucccuuuuuucucuuauauucaaucucucuuguguucccacuucgaauaaacauuuaacauguguaugucuucccaucuuaaguuuuccuaaccaugccuuuugauauauugccuuucucuguugucaguuuacaaccaaguucuugaaucugcuguuuccuggcagcuucuuccuucaaacauauguaugccucaauccauugugauuuuuuuuuuuuuuuuuaaauagagccuugcucugucacccaggcuggagugcaguggugcgaucuaagcucacugcaaccucugucucccggguucaagagauucuugugccucagccucccaaguagcugggacuacagacaugcaccacgacgacuggcuaauuuuuguaguuuuaguaaagacaggguuuugccauguuggccaagcuggucucaaaguccugaccccaggugaucugcuugccucagccucccaaagugcugggauuacagacaugagccaccacacccagccgaucuauuguauuugacuuuguuuccuuccacucccuggacauugcuuuugcagagucaucaauuauauuuguucuuaauauaauagaauuuuuuuuuuuuauuucauccuuuguacuacauagcagaauuuuuuuuuacuucauccuuuguacuacauaccagguuuguaauuauguuuauuuguaugcguacuuauuuaauggcuauucuuucuuuugagguuaaguuuaaugaugacaggaaccuuaucuguuuuguauaucacuguaucccuaguaucuucaauagggccuggcaaggaguugauccucaagucucuuaaauuuucagugugucacuuuagaaaaucuguaguucuuugcaaauagggcacgaugucaauuuuauuuuuagaaagauucuccauuuugaagcagaauggauacacucuaguguaaaauuucaauuaucaauuauuugguucagaauguuaaacagaugacuuaaugugaucacuaaacauuuuugccugccuguuuccugaaaaagucaaaauuugggaaauugaaaaggauaacguagauuagaauuuguguaauaauuuaguauuacugguguuugcauuguucucuacauuuccacucugccuugcaauucuugugaaaugaccaggcaagagcuauuuaaccaagaaauaggagagcaaauggacuucagccauuaaaaaaucccuguaccuguuacuuuuauuaaaaacccacacccauuucugucagaugaggucaugucaauucuuaaacuuugccuuuagccuaaagguaaagggaagggaagcaugguauaaaagauugaucuuauuuccccuugcugcucuaguuuucuucuuuucccuuuuuuucccucauauucugugcuucaaacauccuaauuuauuuacucuucuggaaguguauguuuguagugcuagucccuuugccuggaaugucugucuccccuauuucuucugccuaacucuugcucauuguuuaggcuucgucuuaauugucucugccuaauggaaaccuuuuccuugcucccagaacacuagguuugauuuuuccuaguacuucuauauauacuccugcaugacagauagcuucuguuugaucuuccugaucuaugcuuuccuuuuucucuccuguucugugcccgguaggcuuacuuguauggauuuugucaaucaguaucugugacuuggaucacaguucagcuaguguagaaaacagguagauuggaagcagugagaaaggccaauucagaauauuuauuucccugguuucuucgcugugagguuaccuuggguuggcaguguccggacacagguacugccuccuccagguggucuucucugugugacuuucuguuccacauuguuguaaucucucccaccccuugccauuuggauuuagaaguacugcuccugcuguuagcgcuacuuccuauauuuaccauguuuuccccuuuccccucaucacuccauuguguuuacuuccuuuguauguaaaugcucugugaaugauugucauugauuuauuguauuaguuuuugauuggaagucuagcuaguauauccccaacauguauuauuugugauacugccuucucucucucaaacaauugccuguuuuugccuuugcccucauuuuagguaaacaggagccucagucggugaaauucuaaagcacucuacccacuuuagauaggacagugcuguuuuaguuuauauuauauauugagagucucuguaagacuugauuugaaauuaggguugaauaauaaaaaagguuugaaaauuagugacuacaagggaaaaaauccuaaauuacuuuuaauggcauuuaaagguucuuuaaaggucuggcaucuggcgccugccuuaauuuuuugccuuguccuaacucuucuuagacuuuuaacuuccagggauaacaaauguucucucccauguuagugucuugacauauguuauuacagacaugcaucaccuagcuaaugcccacucuucguuuaguucuuauuaaccuaacuuuuuuaaaagggugguuuuccccuguuucuccuuucugaccuguuuccugucagcaaacaugcuauuaggagucucuguuaacuauuuuuguggcauccuauacuuucccuucauagcauuuauuauuugaauuauauagcuauuugucugauuguucgguaugugccuuccauaggaggucuauuauggucauugcucuauucccauugucuagcaugcaugcaugcauuuauccaacaaauaacagggaaggauguuagaguggaaggauaaucacaucaucucuuuggaggaguaugaugcagaauuuagggccauuagaauucuuuacuucaguuaaugaaaaaucaguguaucuuuuuagagaaauuuuauuggauugcaaguuacaggcauaggacaaaagagcuuuuuauuuugaacaguuugagaauaacuugcugguaugaugcucucauugccccuaaauacuguaguguguauuuucuuuuuuccuuuuuuuuuuugagacaaguucugguccuaucgccuaggcuggacugcaguggcgugaucuuggcucaccgcaaccucugcgucccgggcucaagucauccugccaccucagccuccuaaguaguugggacugcaggugcauaccaccacgccuggcuaauuuuuguauuuuuuguagagacaggguuuugccauauugcccaggcuggucucaaacuugugagcucaagugauccgccugccuuggccuccaaagugcugggauuauagguaugagccaccgugcccggccacgaugguguguauuuucuagaaacaaauacauuuuacugcaucaccguauuacgcucaucaaagucgggugauuaccacugauacauugcuaccaucuaaucaacaaauuccauucaaguaugccaguuguuccaguaguuucauaggaaaggauccaguucagaaacauuaaaugucaugucuccuucaucuuccucagucuggcacaguuccucagucuucucuugaccucaucugaccuugauccuuuguuuuuugagauggaguuuugcucuuguugcccaggcuggagugcaauggcacaaucucggcucaccgcagccucugccuccuggguucaagugauucucccgccucagccuccccaguagcugggauugcaggcgugugccaccaugucuggcuaauuuuguauuuuuaguagagaugggguuucuccauguugguaaggcuggucucgaacucccgaccucccaaagugcugggaugacaggcgucagccacugugccuggccccuugauuuuuucuuuuugaggcaagguccuggucugucacccaggcagcaguguaaugguccugucauggcucguugcauccuccaccuccugggcucaaaugauccuccugccuuauuuuuuuguuuuauuuuauagagaugaguucucacuauguuucccaggcuggucucaaacuggaggguucaaccauccucccaccuuggccuaccaaaguacuggaauuauaggugugagccaccgugcgcggcugaccuugauacuuuggaaaauuuauagccaguuguuuuguagaaugugucuccguauggguauguguaaugcuuccuugugauuagauucaggaguuuuguuuuuguuuuugagacacagucucacucuuucccccaggcuggagugcaguggcgcgaucuuggcccacugcaaccucugccuccaggguucaagcgauucuccugccucagccucuugaguagcugugacuguaggcacacgccaccaugcccggcuaauuuuuuguauuuuuaguagagacgggguuucaccauguuggccaggcuggucuugaacuccugaccucaggugauacaccuagguuggccucccaaaguguugggauuacaggcuugagccacugcgcccggcccgauucaggugauauauuaaggaugacuuuuugaaggcaguaguuuccuauuuaaaagcugcucccacugucuuaauuuuuuuuuuuuuuuuuuuuuacguuuuugugguuuauauuguaaaauuguuuuccaaguguuuuuaguuuugugucuuuagaaucugugauaauauggaaaucuagaggaagccuguagagaacuuggcaugcccaucaagaugugaugucccuaaaaauauuuugaaagagagcagcaaaauguacugucagaggaauuuuuuucaauuaauugggaauaauugauuuugcuauaauuugucauuaagaucauuucuaauugaaaaauucuuuggguuuugaauugcaaaugguacuugaacuucuaacgcauaaauaaguauauuuaauuauggcagaacuuauuucuaaaauagccuucuugguuaaaacaaauuguacacauuucaucucucaguuuuagcucugaaaugauuugaaaauccaaacgaaggcagucagaaucacuguucuaagccuauuuuuagauuuuuuccccuucaguugguuuccuuucuagccaccugcaguuuuaugugcaguugcacgugcucauuuuuucuaauuuccccccucccccgaagcuuggcaagcagcuucuuuauugcuuuugguuuguucuuuuugaagagcacaguguaaauuauaaagccuucauugaguauuuaaauguauuuuaaaauauuuuugagaaaaugcagcauaauuauggaauacaggacacucugccucuaagaaucuuuucugauuauaguucucgauauuauauuaauauacuauauauuaauaugcagaauauaucuuuuuuauucuugcaguuuuuuucuguuuuuaaagauuugucuggaugacagagcuuugggagauggaacuggaaaaaagcuaaaaaaauugccucuucuaagaaaucauauaacuggauucacaaaaauacagugauacuuauuuuaauaggaguacuauugaauuuacauuuaauguaguuaaugauauauuugaauucaaaugaaacaacaucauuuuguguuuucuacuuaugucaucuguucugucucuuuuuucuccuuucuuucuuuuggauuaacuuccuucggagauuuguuacauguguacaugcugacuccugcuuguggugaauuuuuuuccuuauguguuuuguaaauuuguguuguaagcuuauuuuaagaucucauguguugagaucucugugccacuuaagggauauaccauugauaagcuaagcugaagguauauucccuguucugcuaaguguucuaggaugccgucaguccaggacuauuuauacuuuuugaaccugaaaacuucauggaaauguguauacuuucuagaacauuccccaaccccaccucagugugugcgccuuaguuuccuauaguugcuguaacaaaucaccgcaaauuuaguggcuuauaacauaucuuuauuaucuuacaguucuggaggucagaaguuugaaauggguuucacugagcuaaaauuaauauguggauagggcuguguuccuucuagaagcacuaggggagcaucuguucccuugccuuuuuucagcuucuagaggccaccugcacuuuuggcgcaugaccccuucauccaucuuuaagucaccaauggccaguugagucuuuuucguauggcaucacugaucaguacugacccucuggccucccucuuuggcuuguaaggacccucgugauuucauuugauucaccccccccaauacuggauagcaccccgucucaagauucuuaaucacaucugcaaagucccuuuugcuauaucaguucuaacuucccaccuucagcaagcccaaaggguauuuuaauuuuguccccauguggcauaaaaguacaagcuccuuugcuagaggccaaaaagcuacuacagaguagcugcagccuuguucauguuuucugcucugaauuuuuguccucucuuuuuccuagucucccuggauuuucuuuacucucuuuaguuuuggacugugaauuuuaaaaagaugcuuucauagcaucuuuaaaucaagcauuuuuagguaguuucuagugggagagauuucagguuaucuaaugugccauauugcucuaguuggcauugcuuauauuaguaagguaauaaugacuuuaacaagacauaaagucuguuacuuuguuuuccuauuauccuuuaauuuaaaaugcuuuuaaugucaaucaaaaccccucagugaaucucaucuuugaaaagucaguuaauugugauuaaaacucaguuucuucauaugaacauuccguucuacucugauaucgacaagccaugcuuuuuuucuuuaaucugaacagcaugucuugguuuacagcucugaccccacuauucagccagaucagguuuuuccuaccaugccuugccuuccuucuugacugucugcugagauucucccucauuuuuacauuuucuguguuucugcuuaucucauuugagcuaaaggcauauagauacucuucuguaccaagcuguuaucuuuggacuucauuuuacaacucccucccuuccucccugugauaauaugugaaugugauuaaaaaccagucacauacuaccuaagggauuacaaugacaagcggaauucagugcaaucccuuccuaucccuagucgugcuuucuagagcacuuauagagugcauauuguauaccaggcuuuuuacauaaaugaacaccuaugaauuaauucauucuuauaacaaccucauuuuacagaugaagaaauugauacacaaagagcuuaggcaacuuguucaggauaauacaucuauuaaauggcaucauuugaaccaggcagucugguuuuagaaucuacuuguuaucacuaugcuauacuguccuuaguuuuagacuaaaaauuacuuuccuuuagacuuaaaaaauaaauuuuacuguguauauuugagguuuacaacaugacguuauggcagggguccccaaccccugagcuacuggccuguacuaguccguggcuugucaggaaccgggcugcauagcaggaggugagcagagggccagcgaacauuacugccuccugucagauuagcuguggcauuagauucucacaggagcgcaaacccuauugugaaccuuauguccaagggaccuaaguugcaugcuccuuaugagaaucuaaugccugaugaucugagguagaacaguuuaaucccaaaaccauucgccugucuccccagugcguggaaaauugucuuccacaaaaccggucccuggugccaaaaaggggacugcuguguuauggaauacauauagacaguaaauuaguuacuauagugaagcagauaaacacaucugucauuucacauaguuacuuuuguuaagugaugagcaccuaaaaucuacuuauuuaaugaaaauccuuaauacagucaugcuugcuuaaugacaaggaaauguucugagaaauguauuccuaggccauuuuguugugugaacaucauagaguguacuuacgcaaaccuagauaguacagccuacuguauaccuaggcccuaugguacagccuguugcuccuaggcuacaaaccuguacagcauguuacuguccucaguccuguaggcaauuggaacacagugguauuuguguauccaagcaugucuaaacauagaaaagguacaauaaaaauacaguauuauaaucuuauggaacuauuguuauuauguggugugauauauaugugguccauuguugaccaaaauguuaugugacacaugacuguacaauacaguuuuauuaacuguaguccucguguuguacauggaucucuaaacuuauucugaauaucugcuauuuuguaucuuuugacccacagcucccucuccuuuccccccaaaauaaccaugguaaccacuguuucauucucuauuucuguguauuugagcucuuuuauuuuauuuuuugagacugggucucacuccgucacccaggcuggagugcagugacacaaucauggcucauugcagcuuagaccuacgaagcuuuugagcucuuuuauuuuauuuuuugagacugggucucacucugucaccaggcuggaguuucuccguauugccuugguuauuuaggauuuuuguggcucuguauggauuuuaggauuguuuuuucuauuucaguggaggaugccauuagaauuuugauagggauuggguuaaaucuguauauugcuuuggguaguauggcuguuuuaacaauauuaauuauuccuaucuaugaacaugggauaucuguccauuuauuugugucuucaguuucuuucaucaguguauuauaguuuucaguguacaaaucuuuaaccuucucgguuaaauuuacuccuaaguauuuuuuuuuggaugcuaucauaaauggaauuguuuucuuaauuuccuuuucaucuggguuauuguguguagaaauguuacugauuuuuguauguugauuuuguauucuuuaacuuuacugaauucauuaguucuagcaguguuuuuaucuuuucugugggaucuuugggguuuucuguauuuaggaacaugucauuugcaaauagagauaauuuuacuacuuccuuucugauuuaaaugccuguuuauuucuuuuucuuguuugauggcucuugcuaguacuucuaguacuguguuaaauaaauuuuuuuauuuuagaagucaacauauuuuaaaggaaauaguucauuucuucucccuuccaauauugucauugagaugucuuaugugucacugauugcagauccuuuguauauucuuaucuuuuucucucuggaaacuuuuggcauauuuaaucucuacuguggugcuuugaaauuucacaguuauguaacuugguaugguguuuuugguuuuuuuuuuuuuuugagacagucucgcucugucgcccaggcuggagugcaguggugcgaucuuggcucacugcaaucuccgccuccuugguucaagcaauucuuguaccucagccucccgaguagcugggauuacaggcgugcgccaccaugccuggcuaaguuuuguauuuuuaguggaggcaggauuucgccauguuggccaggcuggucucaaacuccuggccucaagcaauccgcccaacucagccucccaaagugcugggauuacaggcaugagccaccacuccuggcccuaaguaacaacuucuaaugucuaagauugcuaagaugaguuguauuuauuauuggcuauaagcuuuuucuaguuucauaucaucagguaaacucaguuaaaaacuugaauaagaacugggaaacaauaauaauaauaaaaagcuaacauauauugauuuuucuacaugccagacacuguugaaaauccauucuauauauugcuucauuuaauccuuacaguaacugugugaaguugauaacuguuuuuuugcuuguuuuuacaucucguauguaugguaaggaaacugagggcauaggaugguuaaguaacuuacccaugugcacacaguuaguaaaugguacaaccaccuauuaaauccacacaguuugguuccugaacucaacucuuagucauuagacuguacuuccugacauauguagagaauuuuauuuuacuuauuuuuuauuuauugagacauggucuuguuuugucacccaguuuggaauguaguggcaugaucacuguuuacugcagcuucaaccuccuuaagcaauucuccugccuccuguguagcuggaacuacaggcgugagccaccaugccuggcuaauguauuuauuuuuauuauuuuuauuuuuauuuauuuuggagacaggguugcucaggcuggaguacaguggcacgaucuuggcucaaugcaaccucugcauccuggguucaagggauucuccugccuuagccucucgaguagcugggacuacaggcgcacaugucaugcccggcuaauuuuuauauuuuuugguagagauggcguuucaccauguuggccaggcuggucuugaacuccugaccucaagugauccacccaccuuggccucccaaaguggugggauuauaggcgugaaccacugcacccggcccuugccuggcuaauuaaaaacaauuuauuuuuuguagacacagggucucacuauguugcccaggcuggagaauuuuaaauauaucaucuuuuuaagaagggagagacacucaugaaauauuaaaacaaauguuaguuguuagguaagaaguaguagguugaagaauuaaguucaaauucaugaccuggugcuuagaagaucaacugugaucuaauguucuauuaaaagcucauauuuagcuuagauucuaguuuggauaaaaaaugauuaucacuaaauuaggcaaaaaaguuuccuuuuugagguggguauguaauuaccacauagaguauuuaguaguuugucuuauauaauuaagcaggcgaggaggagacagaaaaaugucaugggaaguacuaaaaaauuagacgugggccagaauguuagugacagauucaguuuuucccaggccaaaauauuucagaauaauucugauccaagugguuuuuguuuuuccaccagagucugauuuugcagcucaucuuuucuaaauagaucuauuuuaugguguguauaugggucauucugaaucaaguuaacuucgaaguugauugggaccuuguuucaagcuuauugaacaaagaucuguaacacagaauuuugggcauaaggccauuuccagagucugguccaaauaagcaauaacagacaaagauugucucuuucuuggcugaaggcuuccucugugcagcuugucucaggacucucuucuucugcccuuuuuauaccccucuccuuucucuauucagggcaaaaauauuuugauuuucauucuguaguuauuuuuuagcaaacauuuauuguguuuuuacuuauguacaagguucuuugcuuaaaaccuauaaugcccuuccuguaguagcaguggcaguugugaggaugauaguaggccuucugagaugauauuguagaaaauccauggaacguuaaguaguguugcuaugucauacuucuuuccugccuggcuuucugucuuuugaugauuaagaaggauuuuucuggaagaucuuuaaaagaagcauauguguuauuuuuauuuccuccagagugacaagggagaggaaaaagaacaaaaugaaaaccuauuucuauacagcaguuuaaaauaaucauaucuuaaaagauaauuuuaaaaucuugucugcuuauggaguuugucauuuuauuucuacauuuuagaaaauguuuuccucucuaaauauaauugcuuuuagaauauuuuaauguuuccuuuagaacauuuguuuaccacacaauuaauuuuauuuauucaauucccaaucuacuuauuuuuauaaaagccuugcuugaccauuuaaaaagaaguuuucaaauuuggucuccuaauuuccauaaucuuuucuucaacucuuaauuagaguagaguucaacuuacuuuuauucauacuauuuuagcuuuucucucaucucggagaagguguuguguuuucaugccucuuuucccuggcuuaugcuguccccugugcuuggauuuugaccuuuuuccccacucuccuuuuuucucuuucaccugccaguuauggcuggcaaaaaugagguuucuuucauggagucuuuugauguugcuucaggaauauuaaucauucuuuucuguaugcuauuuguguguaauuaaagacaaaaauuacacuuauucaaaagaauaaauguaauauauguuaugcauauauaauaaaucagacaucucugaauccaucguuaaaacuaaaaacuagaaaaugaccaauucuguuucuuuucucuguauacuucucaccaaccacaaaagggauguuuaucauucccuugcacuaaacauuuuuuuaaaucgcauguauguguaucacuaaacaauuauuguuuaauuuugcuuguguuugggcuuauaacaauggauucauccuguauguagucuagcauggcuugcuuuuuuuauucagcauuauaauuucuaagauuuauccguauuacauauacauaguucauucauuaguaguuuguucauucucauuauauaguguauaauauuucaaguauaaauaugccauuuauuugcauuuaaauguaaaggaucuggaauuaguuuuuuccuaugguuugagguagggauccauuuucaguguuuuuuucuauauggcaaaauaguugcucuacucaaauaaaacauucuucuuacugugcuaucacuguaagauaccaaguuuccuuauaagcaugauuuuuuuucugaauucucucuucuguuguauugguccauuuauuuaacccuguaagaacccuacuaucuucuuuacuauggcuucguaucucaauaggcaaguuacccuccucccuucuaguuuuucuuuuagaccaugucuuagccauucuuuccccuuugcccucccauauaaauuuagaaccuuuaaaaucucuguuggcauuuuuauuggaaugcauugaagcuguagaucaguuuggaaagacuuggcaucaagguaacaugggauagaagggggacaaucggguguaugugugguugugaguagauggggguguguuguaucuggcuuugaagaccauuuaaguuuuuuuccagguuuuucuuucaaacuccuaucucacuguuuccuuauuucuuauuuauaacuugaaguaaaauauaauuggauaggggagagagcuuuuaggguuuuauucaggguguucuaguaauuuuuacuuugaauauuucucuugauuauguuauguuccauauugccuuuagucucucucacaacucuugauaugauuuuugcuugucauaaugagucugccaaaagaguuuuccacuuguauuauauucgcucuguuuuuuuuuuuuuuuuuuuuuuugagacggaaucuuacucuuaccugggcuguagugcaguggugugauuguggcucacugcagccuugaccucuugggcucaggugauccucccaccucagacuccugaguagcugggacugcaagugugugccaccaugcccagcaaauuuuuuugcauuuuuuguagagaugggguuucaccauguugccuaggcuagucucgaauuccuggacucaaaugauccauccuccuuggccucccaaagggcugggauuauaggugugagucacugagcacagccaguauuagcucuguauuaugccucuugcauuacccaaauucagaggccuuguuugcuuuuauuggacuaacuagaacuaugucauuuuuaccagcccauugcaguacaguuucauuuuaugugauaaaaauacaacauaaguggucacuucugcagcacguacacuaaaauuggaacaauacagagaggauuagcauggccccugugcaaggaugacaugcaaauucaugaaguguuccacauuuuucugacaaaggucuaauauccagcuucuauaaggaacuuaaaagaaaaaaaaacaaccccauuaaaaagugggcaaaggacuugaacagagaacagacacuucucagaagacauacaugugcggccaacaaucauuugaaaaaaaauucaacaucacugaccauuaaagaaaugcaaauaaaaaccacaaugagcuaccaucucauaccagucagaauggcuauuauuaaaaauucaaaaaaauaacagaugcuggcgagguuguggagaaaaaggaaugcuuuuacacugcuggugggaauguaaauuaguucaaccauuguggaagacaguguggugaauccucaaagaccuagagacagaaauaccauuugacccagcaaucccauuacuggguguauacccaaaggaauauaaauuauucuguuauaaagacacaugcacauguauguucacuguagcacuauucacaauagcaaagacggaaucaaucuaaaugucccaucagugauagacuggauaaagaaaaugugugguacguauacaccauggaauacuaugcagccaucaaaaaagaaugagaucaugucuuuugcagggacauggauggagcuggaggccauuauccuuagcaaaguaaugcaggaacagaaaaccaaauacugcauguucucacuuauauguaggagcuaaaugaugagaacauauggacacauagaggggaacagugcacacuggggccuacuggagggugaaaggugggaagagggagaggaccaggaaaaaccuaauggauacuaggcuuaauaccugggggaugaaauaaucuguacaacaaacacccaugacacauguuuacuuaugcaacaaacuaacacaucuuacauauguaccccugaacuuaaaaguuaaaaaaaacauaaaauauuaauaaaauacagaaaaucccuuuuaaaaugugaagauuuccuucacauuaaaaauuuugugaaccacugcguaauuucaaaacugaaaaggggauuaaacaguuucuuuuauugucauuugauguuuagucaggaaacggaaacaccaucauuuguuauacgucuugaauuuugugagcuuugaauuauauaaaacauauguaauucaaauguguguauguauucaugcuuuaaaaggugauucccccuguacauguucauuuuuuugguuacuuccaaauuuguuccauguauauucuauuuugauuuugucucuucuccuucaggugcugaugcaucaagcauggucuucauuuauugacaacuugucuuuggguuuuuaucuuuucucuaguuaguacuuuugauaccccuaccucuaagauccacuuucuuuuuucuuuuuccuuuucccugguguccuggugcuugaggauagaacuggcagacgggaagcugcauggcuccaaagacaugccaagggggccagagcucuucccuuugccucuguacauaacagggagugggacuacaaguuccugccaagaaaaugaggauccacuuuuuuuuuuuucucaaaugaauuuuagcauuuguuuacguuggaaucaguugaguuuucaaacugcugguaucuuuuuuuuuuuuuuuuuuuuuuuugagacggagucucgcucuguugcccaggcuggagugcaguggcgugaucuuggcucacugcaagcucugccucccagguucaugccauucuccugccucagccucccgaguagcugggacuacaggcguccgccaaccacgcccagcuaauuuuuuguauuuuuaguagagacgggguuucacuguguuagccaggauagucucgaucuccugaccucgugauccgcccaccucggcgucccaaagugcugggauuacaggcgugagccacugcacccggccucaaacugcugguaucuuaauguuuauuagacuggcuuugaggaguucuuaaaaauuguauugccaguggcaaaacuggagauuugaaccuaaaucacauucaucauauuucaaauacauaauguguuacauucauguuuucauauuaauauuuuagaaaugcuuuaucuuaauugcagaguuguagauuggguaguuugauaaauaagauucagauuuauuauuuuuuaguacuuuuuuguaucaagcaauguuagaguuucuaauaugcuauucccauuuuauauaagcuguguuaguccguuuucacauugcugauaaagacauaccugaaacugggaagaaaaagagguucaguugggcuuauaguuccacauggcuggggaggccuaagaaucaugccgggaggcaaaaugcccuucuuacacgacggcagcaagagaaaaugagaaggaugcaaaaguggaaaccccugauuaaaccaucagaucucgugagacuuauucacuaccacgagaacaguaugagggaaaccgaccccgugauuaaaauuaucucccacuaugucccucccacaacacgugagaauuaugggaguacaauucaagaugagauuuggguggggacacagagccaaaccuuaucauaagcaaaaugaaauuuuaguuaauuaaaacuugcauaaaauguuauauccaauaagcaaaagaguuaguauucaaacauaauuuucuaauuucaagauugcacgcuuuuuuuuuuuuuuuaaccagugggucuaaggauugcuauaggguacucuccugggccaucuaguucuucucaacugggguuacucugauuuugacucucauauauuaagacuaaaagcuuauuguuuuuuaaugucagacugcugcuuuugcuauguaaaguugaagaaaaauguaugaaaguaaggaaauucaaguaugagaaagaauuagucucgcugaaaaagcuaacucucgcuuggugaacauaugcaugcuguuguuauacaaauguuccaaaccuguucccuuuuuuuugcucacccugccauauggaggguugugcuuugcuggacauguuguguuuuggacuucuaugauucagaauugagagaauggagagggaguagaccagaguagaauuuuucaaguaauuugaaaucguguccugaauaauucugcagugugugagugaaguaggaagggugaaaaaaggaugauuuuaaggaggagaguuguggauuccaugauguuugagaaaaauagggaaagaacaagacauuuugaauuaauuuuucccuugaggacuggggaccaugugggaugcucuuuuaauaggguuuaaacaggugagauguacacauuuuucauuuuguuuucucaaguuuacuucuuuuguaaagaucuccaugguuacaccauagagagcagacuggaaaaaggccagacuggguacaaguggaccaauuagaagacuguugcaauagccaaggugagagaugauaguagauugaguaggauuaaaguguuagaaacagauuucugguauuuaaagguagaugugacaggauuuaguaaaauuaaacaugaaguaaaugcuagaugucugacuuacauaaaccaauagagaauugaaguaggagcauugaaauaggauugaggagccuguguguuugauuuugaacacguucacuuuaagguaccauugaaauaucugagagaaugucaguuuuauacacgaaccuauagcuuagaggaggguucuugaauagauaaagaaaaguuuguguguauauaugguaauuuaagccugaauguggaugaguuugccgaggggucauaaagaggaaaaugaacugggagacacugucuguaacgugaccuuagaaaggagacagagaaugaguguucgggagaguuagaaacaaaccuagguaaauacugguccaucuuuuccaacucccauugaaaucucaauauuuucccuucuauggaguuagggauuccucaacuuaauucugugcugagcagaacugagcuaaaauuuguacuagugcuggaccuauuagaaaagggaggaguuuaaaagauguguagagaggcggggcaugguggcucaugccuguaaucccagcacuuuaggaggccgaggcgggcaaaucacuugaagucaagucaggaguuugagaccagccuggccaacauggugaagccccgucucuacaaaacauacaaaaauaagccgggugugggggcacaugccuguagucccagcuacucgggagucaugagacaugagaaucgcuugaaccugggaggcagagggcgcagugagccgagaucgcaccacugaacuccagccuaggcgacagagcaagacccugucaaaaaaaaaaaaaguguagagaggcauucuacaaaaauggggcucuuuacguuuuguaacaucaaugaaucaaugauuguaucagauaauccucagaauuacuuggggauggggguggucagaauaugugaauuguuucacuauaaaaacaguuuuuucaagaauugugaagagucagauuuugcccuccaugcaagcuaaaaucuuuccuagaugcugguagaagacagaagacuucuggaccagagacauaggacuuuauuacugaugagaauaacuggaggcagaguguuagcauuugugccaguuugccaagcccacugcuccacagaggaaggugaaaggggccgagugauggcauguggugaugccucuccuguaaugcacugcacucuguuacaggagagggaccaccaguuuagggaacccaaacuuugauaauagguaguaagccuuguaagccuaccugaacuucacccuggagggagaugacuuuuuuuuuuuuuucccagacagagucugacucugucgcccaggcuagagugcaguggcuugaucuugguucacugcaaccuccaucuccuggguucaagcgauucucaugccucagcacccccgcaaguaacugagacuacaggcaugugccaccgugcccggcuaauuuuuguauuucuaguaaagacggaauuucaccauguuggccaggcuggucucuaacuccugaccucaggugaucugcccuacucggccucccaaagugcugggauuacaggcaugagccaccacacccaacuggagaugauaucuuuauuguacuagacagcaaacaaaccugccuuuuacuccugagggagacacuguuucuugaucccucaagaccauuccuuauauaauacaaacauauguagcaaguugguauggaacaaaaugagucagucccucuacucacaacagguacagaaacaugaaagacucaaguauaauugccuuccaacaguauucacccuucauuucuauaccuucuuggcuucugguaagauuucuuucccaugauuaugcaacuucauuugucacucugauuaaucuuaccgacagaggcugggaccagauccauucaguuuuucuuauaacacauuucauuacaguuacugucaacaggauagcaggaugaggccagacugcaauauugacuucaauuaugcuccccaggguccaagacccagccaacagaacaaaugcaauaaaccuuuagggucuaccuaagagagccagguggcuuucucuuuguuucugugcugacuuuacucuuggcccaaggcauuaaucuaguuacugcagaauauagagcacagauuuggccuuggucuacaaagaggaagcguagggcuauucuucuaucuguaacaauccuggauagugauuuuagaccguccugaaugccucuaggcccaaggugaugucauugauugcuucagcuaaagucgggaacaaauuucaaauaaaguuuucuaauuggaugacucccauuauagugauuuuucccuuggugugcaagucaucacauuuucugaagggaggcaaugcccgacuuccaaacaagaaauacucccaaggacugugugugccuauaaagaauguguuguuuauauuguccuacuucuccccgcuccccccauucccccccaccuccccaguuaugugggaccuacuuuuaagucagacggcacaggcugacaguuucuccaauguggccucccugauggcugguaagccuuaggguuccaaguacaguaugaauacuucucuaguacugguuuguggagagauggccugaaggcagucaguccaaucuguccuguuuauuaucugugccaccaacucaauggcauucaucugucccuugaaaugacugucccuugaaaagaugccuaaaguuauggacagguguuucacgugggagauuugggagcuuggaccauccucugcugcuucugagagacugugcaguuaaggagaaugaugauugaguagugaucaaaguuguguggugggguaggggcagacccaguugucaguuaaauuugagguuuugcacauuugcagagaaauguccuuugugagggaugauucuaaaagacggaucacuaauguccccccuuuuuccuuacuuccccgcaucuaagguguuuuccccacaggugccagacaggguuguuguaccccuuugacugccacaaaaucagugugucccauuccaguagcuagcuuuaccuuuuuuccagucaucucugacucaaacccagaccuuuugucuggaagggccaggugcaagagugacaaagggcccuuuuauuaaacuuacagagacccuuuuaugucuccuacuuuuguccacaugagccacucuaggggaagcaguguacuuaacuaaguggucauuauuauuuaagaccaaagaaauccagcaagaaaauccagaucgucaauuccagguggcugaaccugaauuaaguuuauaccaaagaccuccuuuuggcuggguugccacccagagaguagaccaaucaagccagccugggauuuccauuagaggaaagaaagaagcaucauguuuaggaauggucaggguggaaucccaaguggccaggagauguucucuuccuggagacagccacauucagugaccaaacugcuguacuccuguguagaccaggaggaggugacagagguauacucagaaaucuuuugaguugauuaaaauuuuuuuuaaaauuguggcaaaauacauauaugaucaccaucuuaaccauuuuaagugugcaguucagugguguuaaguauaguuacaauguugagcaaccaauaaucucuaggacucuuuuuaucuuguagaaauuaaacccuauacccauuaaacaaguguccuuugagcuuuccucccccaggcaaacacuaucuccauuuucugucuuuaugaauuugacugcucuaguaccucauauaaauggaaucauacaauauuugucuuuuugugacuggcguauuucacucaauaauguccucaagguucauccauauuguagcaugugucagaaguuccuucauuguuaagucuaaauacuauucuauuguauguauauaucacauuuugugcauccauugaucuguugauggauuguuggguuacuuucaucuuuuggcuguugugaauaaagcugcuaggugacccugcuuugaauucuuuugaguauauaccuauaauuggaauugcugguuaugugcuaauucuguuuuuaauuuugugaggaaucacuauacuauguuucagagugacugcaagugcacaagggcuccaguuucuccacauccugauuuuuuugauaguaaccaucauuauggaugugagguugugucacauugugguuuugauuugcauugcccuaaugauaagugguauugagugucuuuucaugugcuuauuggccauuugccugucuuuuuuuuuuuuuuuugagacagagucucacucugucgccaggcuggagugcaguggcauaaucucagcucacugcagccucugacucccugguucaagcguuucuccugccucagccucccgaguagcugggacuacaggcacacaccaccaugcccagcuaauguuuguauuuuugguagagaugggguuucaccauguuggccaggauggucuccaucuccugaccuugugaucugcccgccucggccucccaaaguguugggauuacaggcgugagccacugugccuggccucuauuugccugucuucuuuggagaaaugucuagucaagucuuuugcccauuuuugagucggguuuuuuuuuuuguuguuguugagguuuuuugagcugauuuuugauaaggcuguugcaguacuaagcgauauaagaugcuguggaugguagacugucaccuaccuugacuaacagcucauuguugagugacuuuugugauaaaagguguaccuauugucagauugcaaaugauguggaaaguaaaaauaggacacagauuagugucaaggaccacgguacuguggcuggagucagcugauugaacuggaauagcaguaccagacccuggaaaagugucaucagcagugagaccccacugauagccugaagaagguugucugaugcaaccaaucugccaguagcaugugaugugguuccucucaccaugagacaaaugaguccuuuuccaggacucauaagucuaggaugagguggcagccucugcaucaggaacauagagucuuuuacuuuguauccacucuaugaugauagauauguugcugugucugguaugaugauggauccagcagcagugguagcagucuuaaccgugcagcuugaucaguggcuugauuauaauuggucucaucagacaauggacccuuacuguaaacaucuauauuagugacccagaugguuugaucagcaacuacaauugaucuccaugguuuuuggacagucuuaaauaugucauucuguaguuuuccaaguggcugacuaaauaccuaggcaguugguaauagccugauagucaguaaaaauauaacaagguuuucaaggggaauauuggccagaucugugagaauguccuugaguuuugcccguggaacaaagcaaccacacccauuuucaguucuguaucaugggcacuggaguuuacagcccacuaggcaccacagcgucucagcuuaguugaaucaucagugaaacaggcccaggcauuuagggaaccucugugaaucaagggccucacugagcuagcagauuugguuuagguggcagaauguaagaucagacuuucucaaagggagaagcugcugcuuuuucauguaaagcugagaugcccuaggggccagacuggcugcauucuugaauauuaccaguuccaugugaugacagaggcuuguugggccuuucccaccuuauuagucauugcauuugaguugacucauucccaaaugggaaucuuuucaaaagaggcauaccuaguagcuacgucagggaggcauugaauccaaacccaagagucaccugaagagguuguuccucuugccagagggucuagucaggaaagucaucugugcacagacuuguacucaaacaggucauaaggauuguggggccccaaaccuacuaaugccuuucuacaugggcuauucgcagugagcauaaucucccuggagcuuaugagcccucacaguucaggccuguaaaauaucaauaccacuauacacucagaaguggaagcuacaaacaguaguacauugaaugguccaaagagccccacccaaaaggucacaguagcuucccuucccuacuuugaacccuacccagaccucagcaguuggaagcugguaacuuauucuuccacaggauggguaugaaggugccuugggcuccuguauccaacagagccauaaaauguugagucugugcucuccccaaaguuauguagccuacccagguguguguggucuuuagucuccuuugggaacuuggagaacuuggccccacuccuaaucaucuuucuucauaaagcagcugagguugagggaugagggaggcugggagagaguagcuuugcaccagugaacaagagacauuugcuuucaguuuugaguggugcuauagcugugugcugaucaguccaauaaaccugcaguaauuuuggugcuaccaaaacccuguauucugugcaagaucguuauugcuugagcccaggaguucgagaccagccugggcaacaucgugagaccucgucucuacuaaauauuauauuuaaaaaauuagccuggcauggugggauacaccuguuaucccagcugcucaggaggcugaggucagaggauugcuugagugcaagaauuugaagauugcagugagccgugauuguuccacugcacuccagccugggugacagagcgagaccuugucuuacacacacacaaaaggucaucauuauggaugguauccauuucuguuugggaacaccuugaucgaacaacuauagcuuuguugcuuucugaugggggaaauggguuuuauacccuuuggcugacgggcuugaucugcacaauggcaucauuuuuuagaagucugccuuaauguaggcucuuuacugcuccauuguuaagauaaugucaagauuauaucucuuaaauucuugcuugauuucaauacuagggcuacuggaguuuucuaaggcugcaggacugacagcaagaauuaucuagauucuuugagcuaguuucugauucuucagugaauuaccuugauccgcauuuuaaacccaaucuaguacaguaggagucuguagacugguugguguccaagggaguuugucucagggaaauuucccugagaguuucaaagguuucuuguaguggacgguuauaccaccagaaaaugcugaggcccuuuccaguuaucuugaaaggauuuaauguugacaagguagacugcgguaggagcugagcacuaagauagccagcaaaaugccauucuucuuuaacaaccauuacaugccugagcaauguaacuacaugccccuccucuuccaagcaaacuagccaaaguucuaaagauuuguuuggcucugccuacaaugguugcaccuuuucuuacuuucaaacucaguguagauguaugucucuguaacugucguccaaaggaaacagaaccuuaugugccccugucucccucuucuagacaaaucuuagucuggaagauuucaugaagcagaccugcugaggcugacugucagcuugauaaggaaguccuccuaucugcaggaguguugacaauaaccaaggcaucauucaggcuguugucuuugaaucugccuacuuccugguacuuauccugaaacuuccucuucauuucagccucauucacaggcacuaaaguggaggaucauucauugccugguugaccauacaauuuggacaacauguugguuaaugauucucguggacuuuucucaauuucuacuaacuggucuuuccuuccauuucuagaaaguuuuguccccaucagcauucuuuuucauugccaaaacuauagaaaauuaugaugguccugagauuuauccuuguuaacuaaugaguuagccuaccacaauuucauggguucuguuggaagacaugagacuccugggucagagacaaaggacaucauuacucauggcaauaguaguagccagagugucggcauuugugcuagaaaacagccccaguuuccauaggguacugcaaagagccaggugaugccugcauacacaguuguguacauuagagaaaaaguauucucaacuuaggggaccacaucuuuuauaaugggcagaaaaccuuucuccuggaggucuacauuaacuuuauuauauuggacaguaagcaaaucugccuuugcuuucuaaggagaugcuauauuuucuaaggcuguuuacucuauaaacauccagaacaaagggaguuagugcaucuucucacaagauguacagaaaugauagauacucauggagaggugucuuuaucuacuugguuuggaauugggauagcauuuuugauuagaaguucuuucucgauuaaaaaguucugaugaaauaagauagaaucauaauagaucugauucaagcguaacauugagcuguucuuuuccaugggaguaccuuuuuuuuuuuuuuucuuuuuccuacuucaguucauauccuggccucgucucaccuagacugccacaauugccccuuaauugguuucacucucugcagucuuguucuuucugucuucaauaccucugcuagugggaucuucuuaaaaugcagaggugaucaugucacucaauuuaaauuugucaucaguuccuuauuaagccagauuuuaaguuguugagcaguuguauaauuauuucucaugugcugguuacuauccaguuuuaaguuggcaacuaaauuaaaaaaauauuuuuaaaaagucuuguagaccaguccuagguaggcucuaccaaacaggugucuaggcugcuugcugacaguuuauaucugcucuuaccauuuuucucucuuaaaccuuugucugcaggauguuauucucucugccuuuaauauuuuucauaucuaccucuugacuccuguuuauccuuuguacagaguagguacagaguagguaccuacucuguaaagccauuaaaugaacccuuuucaaccuaguuaguugucuuguucucagcaccuuuauaguaauuuugaaugaacugugcauaugucauuauagcacuugccucauuguguuguaauuacuuuuuugggggguguguggggagguucugcaucacacugaauaaauaaagugucagcuacucauaccaggacaacuuucccuuucuacacauaccaaaucucucucuuuuuuuugagacagggucucccucuguugcccaggcuggagugcaguggcauaauuacagcucacugcagccucgaccuccccgguugaagcaauccucucacuucauguccccaguagcugggaccacaggcacaugccaccaugccuggcuguuuuguacuuuuuguagagacaggguuuugccauguugcccaggcugaucuugaacuccugaacucaagcaauccaccugucuuggccuaaagugcugauauuacaggcaugagccaccaugcccggcccacauaccaaauuguuaggaaagaaaacugcuuuccagagaauuguuuuagaaucaaauccauuacauuaguuggugcuuuaaaccaccacuaaauauucucugcuuuuagccuaguauaauuuaauaguauucacuggaaaauagacauaugguguacagcccuguggucuguccuaaauaugguccaguguauauggauagcaaacauauuaugucaaauaauauuuucuuguuuuguucaaauuaaaauauagacuguggauauucauaaggagaaaguggcacgaagagagauugguauuuugacaacaaauaagaauacaucaagaacucacaaaauaauagcaccugcgaauauggagcgcccuguaagguauauucggaaaccuaucgauuacacaguucuggaugaugugggccauggugucaagguaagcauuuuauauuacauuaacaagcuaauuugcauauccaguaaauauuuuggauaggaaauauugucauaaagaugauuuuaauagauucucuuuagcagcuggcauuauaauuuucauacaauauuuaauaugaauuuuacuaagguuggggugcaauuuuaucaguugaauaggcuguauuaaaaagauauuaaaauuagaaaugguuauuaagccauaaauccuagacaaauauuacccauuuguguugugaauucuaugucuuucuuucacuacugaacauuuaaaaauaaaagucuacaugcuuuucaaaauuacuuuagaaaauaauuuauaaauacuuuuaucguuucauuucuaaauauguauauauauuuguauaccuguguguguaucuauaaugccagcaacuuauuaaaaaaugaaaauuguauguaauuuugucuuaaugccccccaaucucccccacaaaaaaacccccaacagauuuucaggagagauaugauguguugccuguguucauuucuaagcaugggaaauuagcugaucuugaaggauaccuguagugugucagcuuuuugguauuuaugggucauuuugcaagcauuuggaaugaccaaaauucuuucgcugucucugcucaggauaaacuauuccuuugaaauuugguaguuccuuuccaagaggacuauuugauuuggauucuggucuucagaauauuuuauaaguuuuuaaggggucagcuagaaucuugaagcuuguccuagcugauugaucugacuggugcuguugcuagaucuguuacauucuggauuuucugggguuccuggucgagagaggaguauagcugacagcauugaccuuuauucugccccucucugagacuauuggaaucuccucuucacuuuuuaugucuggaaauuguauguaaaauuggaacacauugcaaaugcagaggugacugcuuguuuauuucuuguguuuuuauccagggauguggcuaggauuguauaagagcugaaauucaguuuuaauucaaggugcuuuaaacuagacugaucucugggauuggaguuucgagaaucuggggaaaaugucuuuuguguuacuauccaccuugggauuuaaagaaaaaggauauauucaugcaugcauguauguauacauacauaccuguauaugugcacacacauacuugcacacgcacacacucgcacucacuucuccccauuuugccucaccuugauuauucuuccuaccaaagcaauacauauuuauuaaaaauuuuuucugucauugucuuaguagugaauauccuccauuaccuuaucccucaacgaguaauuguguuuaacauuucaaaacauaguacuuagcugaguauaagaugaauccaaauuuuacaaggaaguuuugggugagaaaauuuaacuauuucaucguauauguguaagugggagguguaaacagcauaauauaugcugaaaguauaugaaugugaauuuuggaaaucugcuuucuagccauaauauggauacauuagacacaggguuggggggcuugguuuuuuuuuuagauuuuuuuauuguggugagauacacauaacauaaaaugacuaacucuuuuuagguguauaguucugugacauuaaguacauucacauuguugugcaggcuauuuuaaaauauauuuuuggcgagggaugaaggugcauggucugugagaagaauauauuuuagaagcugauuauuuggcauauuugucuauaguuuguuucugugacugaaaaauacacacauacauacaauuacuuuuccccaguagucuuaaugcugcuuuauuuucuuaguuuuguguucucucuaaaggaucauuguuggcuuaaauauuuccagagcauuguagagauguguaaagguagaaauuuugguaguaguuaaugaacacaugccaggccaaaauuauuagaaggaaaaguuuaaguuuauuuuaaaauuaguguuuugaggauagugagacauugcuuacagcuuucgaauuauuuuuguaucuuuugcccacuuuucuauuuagaaguuucuuuucuuacugacuuguaagaauccuuuguuuucuguuugaagagaguagacccucauauauuggcaaauauuuacucauauugcuguuuggcuuuugacuuugauguuuucugguauuuaagaaauaaacauacagaauuuuaaaaauuauaucuaaauauauuaauauuuuucuuaucgcuacuaggcuucaugcuuacgauugccauacuccaagauuaauauuccauugcauuuucuuauuuugugauguaaauuuuaguguuuugguauuuguauuuaaauauaucuggguuuuauuuaaauaguauuuacuguguuaaugcauuuuaugcuaugaaauaaacgguacauguuaguuuaauaggaauuuaaaaauaugcaaaauaucccaaaguaaaucugguucgauuuuugggaauaauaauaagauauguauaagagaaucccagcauagagaaacuaccagaaccuauucauaaaggagaaugaaaagaagaugaucuuuguaagugagcacaagguuugagaggaagcuagaauagagaaggcuugaauacuuagcaaagaaauuuacauuuauuuugaugaacacuaguaauaauuaacagccuggaucauaauuuacaaaggacuuuucauauguaguuggcccuuuguaucucuaaguuugcaucuguggauuuagccaaccuuggauaaaaaaauuccagaaagaaaaaguaaaaaauacgaggacaauacaagaguaaaaaauaauacaaauaaauacaauauaacuacuauuuacauaccauuuaccuuguauuagguauuauaaguaauugagagaugauguaaaguauacuggaggguaguguuaguuauaugcguauacuacaccaguuuauaugagggauuugagcauccuuggauuuugguauccauggggguccuggaaccaagccuccuugauauaccaagggaugacuggauuacuguguguuugugugcuuguuuuuaagcuucaaaagauuaugugaucuaggaguuguuagauuuuauuauuggucuuaaaagauaagcuuagauguguuacuuuuuuuggaguuuuaguuuacagugauucaugaaucgggcagcuucagaccacaggagacaugaagcagguagaaguucaagaaagcaagacaagcaaaauauuugauugguuagaaguuaauugugguuucugauuaguaaaguuccuaguuagagguuaguuggagguuucugauuaaguuucuuuuaauuguguuuugguuugccuaaguaggaacccagaaugcuggagccgucucagccuaauggucucagccuaauggcuuucugauuaauuuuuuuaaaacaguguagaaacuaaagcuuuauaauguuuacauaggaagauuuuuuuuuaauuuuuauuuuauaaagcagaggagugaguuaagaaucauuucaaagaaagaauuggccuuggcugggugcaguggcucaugccuguaaucuuggcacuuugguaggcucaggugggaggaucacuugaggccaggaguucgagaccagccuggccaacauggugaaaccccgucuccuaaaaauacaaaauuuagccaagcaugguggcacacaguuuuaaucccagcuacuugggaggcugaggcaggagacucgcuugaacccgggaggcagagguugcagugagccaagauugagccacugcacuccauccugggcaacagagccagcaaaaaaaaaaaaagaauuagcauuagacauuuagugccuaugacauacaaaacuaugauguacuuagaagauagggaggaaucaaagggaauuucaaacagauuccaggcaaaugguaaaauuacucauccauaaagguaaauguuaaggaaacaaagugagauuuuuuuaaaaagagacagggucucacugaagugcaauagcucaaucacagcucacaacuuucuaggcucaagugauccucccuccucagccauccaaguagcugggacuacaggugugcgccacuaugccuggcuaauuuuuuauuuuuuuuuuucaagagaagggguuucgccuuguugcccaggcuggucucaaacucuugggcucaagcaguccaccugccuuggccucccaaaguguugggaguuacaggugugagccaccgugccuagccugaaaugagaucuuaaggaaauaaaaaaguuucauuuuggauauauuuuggggauauuuaaauaaaaaauuuuauagauuucuaacaaaaauauuaguauuuugagguguaagauguagagguuauuuccuacuaacacuugccaacauugacacaucugcaugucuaauaacacuuaauagaggaggccgaacuucauaagagguuaaagcuuauaccauugcauaguagcacagaguucaaguagaauuuucauucccaaucuaauucuucuuuuauucuuuccauuugggaccagcuuauacuugaaugcuaauuuuuuuguuucuuauccacuugaaaugacaaaugaaggaagauauguggacauauuuagaauauuuucuugguuauuuuaggauaguauuuaguauuauguauauacauuauaagauauacauugcuauguaaguauauacuauacauguauaguauauaucauaauacagauacugaaguauacauuaguguauuuuaucuucaaggauccuaauaauguuauacucaaaauuuauucucuagaugugaaaugucaugguuagguaggguaccagauguuguuuccagauagaaguaagcaguaucauuuuaaacaaauauugaaguguaccaaauuucucgcacaguuucuauaaaugagaauguauccaaaagacaccaaaucucuccuuuggaugauuuccuuugauacugccuuguggccaccugaaaaaugguaguuacuuguugagaaugucagauguuauuuaaaaaaaaaaaaagcuugaagcccccaaaucuguaaaaaauuagacucuaaaaccugaagauauuuuuuuuuaguggcauuguacaaguagugaugcuuuaggacuacacauuguuucauguuguguaggcuagucagcuuuaauagaaguagccuuuaggaucaaaacaacuuuucuucaacuuugaauuuugacuuaacuggcucagaugaaaacuuagaacuaaagcuacuuagaacuuccuauuaguguuggccugcacaggauugggguucagaagcuaggaaugagagaguuuuccagacccuguuuguuuauuucuuaguuagaaucuggcuaaguuaucacugugcaugaugaauuuguuuuuaaacaucgagauacuagguccuuuuuucauuuuuggaagcaaucugugguuuugaauuuuaauguuugcaguuuaucacuuuuuaaacuauacuaccauugaaguaaugaauacucauacuuggacauucauuauccaguaaaguguuaggucucaugcaccgauauguuaaaauagcuucacaucuaauguguuaugguguuuguauuuaaaugagcguauuuuuaaaaucaucuguuacucgguuggauuaguuccauaggacaaaauacugacuuaaaaaaucauugagccugcaugagauuggaauaauuaaguggugguuuccuuaugaauauaauucuuuugaaaaauacaugaaacacaugaguauuuccccaguacguauggaucucuuuuucuuuacaaaguaguugaaacauggcuggaaaaaagcuuauuaacaugaauugaguaacuguaaauguaaaccuguccuaucggauauaacuuaccuagcauuaaugucuacuuuuucccccccuuuuuuugccaacguaaaguggcuaaaagccaagguaagagccauuacuuaucauuugauccacaguauuuccucuguauugauagaggcugcagagccacuaaaauuugaaaacucuucuuaugucugucugcuuuucccuguaggauuuauguagauuauuuaauacucaaguucaguucaaauaagcaacauuuagcuuggcuguguuaauauaucaaugauauauugacaucuguguuuauauaggaacauuaauuuugcuaacauuuauugcuuugcucauuuuucgauaguugccuugcuuucauugacuuacaauuaggagguuucccagacaucauaugugacuuuguuacugaauuguuaggaugaagaugauuuuucagaugcguauuugagcaaauugacaaguaagaucuauaguuuguguucaugcacacauuucaaaaauuuuaggaaacccaguguuugaaugcagauaaguuugaucucagugaacauguuuaacaauaaaauaagauauuaaauccagucaucucaccuguauuuggcuacaaugugauauaaauggcauaaaauaauaggaagaccaagugcaagugguuccuugacuuuuuaaacuguaguaccaaagucuuuauucaaacugucugggaauccuuaauucacauucugauauuuaaaaaaaauaauacaugguguuaaaacaccaggagaacaauuugauauaaaaauaaaagcauuucuuucuacauuuuagcauggaaauaaccagccugcaagaacuggcacacugucgagaacaaauccuccuacucagaaaccgccaaguccucccaugucaggccggggaacacugggguaagaauucaacuacauuuugcaaaagaauucauaugcuaaaggaaaagauguuucugugacuuaaguaaguguaugggauccaugccacacuacccucucuaugugacgcuaccuuuuacaaauucauuuuaauuccuauuuuccugaacagaaucccaaaugaaucugccagcuuuguaauauucucuauaaucuguacuaggaaaguuuuuauguauguauaaauggcaugauuuauuuuuuugucaucuaauuuuuaaaaaauauaaaucugacuuguuuguuuuaaauggaaugauuagaguauuccaaauggugccuuugcauguguuuacaguaucuauauuguagaacuuugacuaguggucuacuuuuguguaguauggcuuaguccacagcucuucuguuucgccuauuggugucugagacuuagggacucuuuacuuuaggaaaguaugcacuuuacuuguaacuaugcuucugcugguaaucuuaggccucuucacacuagaguagcuccaugggaaggccaguugggcaaguagaaaagauaacaguggcuucuuccuuccuaguucucaguguacuaaauauagcgaauacuugucaaagcauuauauuucuuuaagguuguuuuucuuaauacuggaaauauuauauuggauuucuuauuuuuuggcagagggguuguucaacaaucagucuucuuuuaagaaggucuuaguuuucauuuuuauucauuaaacccucugccccugaaaaaaaaaaugaaguuauuaaacagaauagucgaaaucauuuauugagaaaguaaugauuagaauguauaucuccauuuauugccauauugagaugggaauaaauugcagcuuccuauguaaauaaauuuagcuuccuguuuaaagaacaguggcuuaugggugacuguacugagaaaaauguacauuuuaaaguuugcuauuauugagcauuuaaaaaauuauaaccauaauuuuuagaaauaagguuaggacuuuaaauuacccuuuccuauguuuuuccuaggaaaagguaacaaauuuuaguuuucauguuaaaguaacaaaauucauauaucccagugaagaauauuuuuuaaaauuacaaacuuugucauauauauuuuuaaauccugguauacauggucacaaagggagacucacauauuuuugggaaaaauacaauuuuaucuuuuuuauucauuauuccuuucuccacuaugcuccuuuagacggaauacuccuuauaaaacccuggaaccuguuaaacccccaacaguuccuaaugacuauaugaccaguccugcuaggcuuggaagucagcauaguccaggcaggacagcaucuuuaaaucagagaccaaggacacacagguaagccuuuagguugaguaucucaacaucucuaaaguggguguaacugacuggcgacaaacuccuauggaggugcugaguaaaggugaggugccacucuaaugcuaauauaaaauguaaaaguugggggaauaauauuauauauguuccuguaaguuuguguuauaacuucuguuuuguuuuguuuuuuuaacuuuuuaaaacaucuauuuguacuauuaauggauuguuuguauuuccuccuuuugauagagguacagacucuaucagacucuacggguuaagacuaaagaauuuuuuucuuuuuuuuuuugugacggaguuuugcucucguugcccaggcuggaguguaguggugcgaucucggcucacugcaaccucugccucccagguucaagcgauuuuccugccucagccucccaaguagcugggauuacaggccugagccaccacgccuggcuaauuuugaguugagacgggguuucugcauguuggucaggcugguuuccaacucccaaccucaggugauccuccugccucggccucccaaagugcugggauuacaggugugagccacugugcccagcccuaagaauguuuuaaaaugcucuuuuaaaaaaauucaaggcaaaccacucaaauacuuuuggagaaaagauuaaauaucauaggaauuauacaacgugauuuaaacuuucagagauugaaggaaagaagauuaagcuuaaaucugagggagauuuuuuuaagagaaucaguauacuagaauauguuguuauaauaauaauauuauuauuaucuuuuuggagauggagucuagcucugucacccaggcuggagugcagugacgcgaucucggcucacugcaacuucuaccacccaggcuuaagcaauucuccugccucagcuuccagaguagcugggauuacaggugcaugccaccacgccuggcuaauuuuuguauuuuaguagagaugagguuucaccauguugcccaggcuggucucuaacuccugaccucaggugauccacccaccucggccucccaaaguguugggauuacaggcaugauccaccgcuccuggccuuguauuuauuauuuuuaaauguccuaaaagucaauuacccgguggguuuuuaaaaauuuaguuacagagcauaacaagcauucagaaaaguauccacuucaguaaguauacagcuugaugaauggacacacacucauauaaccaucacccagaucagaaaauggaacauuaccagcaacccagaagccccucaugcuccuuccugguuaucgccucgaccuucuucccccaaaauauagccacuucaauuuuugagugcuuuauaaaaccagauaaauuuauuauauaaccaaauuuguuuuauucuucaguuuucucucucacuuaauaacgugggcagggaaccucucuuuugccuucacucuuagguugguaaaugagagauaacuuaucaaaaugauuuaugggaauuccacuaaauaggguauaucaagaugcgagaugcuagguaagcgguauuuauuacuauuggugcuguuaguaaacaaauuguuaaguugauaucugcaguuacuguaucaggucaaguucuuugaggaacaaaauuguucucuuuguuguuauugaacucuuggaucaaaguauaguuuuucucuauaguggaagcauaguuuaaucauauucaacaagcaguuauuaaguguuguuucauuagauacuaggcauuugucaauagggcauaguucuuuuuucaagagcucauucuguuagaacagggaucagcaaacuuuuucuauaaagggccagauugucaauauuuuaggauucgugggccauauauaugguuucugaugcaauuacucagaucugucauuguagcacaaaagcagccauugacaauacguaaaugaauguggcuguguuccaguaaaacuuuauuuauagcacugacauucuaauuucauauaauuuuaauguguuacaaaauauuauuccucuugauuuuuuuaacuauuaaaaaauauaaaaaacauucuuaacucacagguaguaaaaaucaggcaauggaccaguuuuagcccacaggccauaauuugccaaccccuuguuggaaaaaagacaguaauugaagaggagcauaauaagagcauaaauauucauaugucuaugaugcagugguagcacaaagcuaaguauugaucaccuggcuugagggaguuagggaggucuucacaucuaagcuaugucuguuuuauaaaugacuuuuuucuuuuucuuccauuaacauaugauaaucuaauuauagaaugaucauauugcagaagaaaauaaaaaucuuauccaggcauugcaaaucuuugcccuuugaauuucugggcuuauugagcaaauuauguagauuuuaaaacauaauauggagccuaaggcugcaugugcacaaauauauguuuuuacacauguacacacauuacuauaaacaacuggauggcacaagaucuuauaccuuacuagaaacaacuagagggagccagguccuagagcuaacaggacaguacauccacaggaaguagaauagcgaggaguugguuagaguuuaucaguagcaacuauuccagaauguccacacugaaacuucacuauugucuuucuuugucguuaugcuuauuuuccagaaaauuucccuauguuaucaccuuucuuugagaugagaggaaguuucauauuaauuuuagacuagaacggaguacccuuuuaauuuacuuccacaucauuuguacuuucucuuuuguuguaucuauuacauuaccuuuucaugucaguuuucccauuaugaacuucagaugguguaguucaugacugcauuguucacugcucuucauagcagguuuugaauaaacaauuguugacucguacuauaagauuuuguuggugauaaauauuucaacagagaugguuuuaaguacuguguuaucauuauauugguuccagauagguugagaaguagaggaaaccauuucaaauauuaggauuaagauuugugaugaauaacuuaaaaauuucuuguuacacacacacccccacccaccugcacccaccaacccucccauugccuaccacuuucccucccacucucccucccacucucccucccucccucccucucuccuuucccuuccucccucccuccuucccuuccccucuuccucagguucugcauccccagaguaaggcagucucggguugaaaauacaguauucaugggaugcagaaccuguagauaaggaaaaccaauguuucauguccacugguucuguagggccaacugcaggacuugaacauccauggguuuugguauccaagggggcucuugaaaccaguccuccaaggauacugagggaugacuauaugacauaaaaggaguauuuaguggccuugggugauuacaguuuuuuuuuaaauaugucucuagaauugguuuuucacaguuuuuuuuuuucuuuucaguggaaguaguggaggaaguggaagucgagaaaacagugguagcaguaguauuggcauucccauugcugugccuacaccuucgccacccacuauuggaccagguguguuauuuauuaaucuauguuuaauacaugauaauauuuaugagcuuuauuguggaaggcugaaauaaauuagucauauugaguaaaauuauuaauuaaauuugugaucguugcuagaauaaaggcugauaacaaaguuaacaauauuuuuagauugcuuuucacaaagucuuuaggauuucaccagcuguuucuccuuauauauacugcauauuaaguaguuuuguuaaauaacuuuuuguuggccauuuugcuuuagaaauauauucauuccucaguguccaugggggauugguuccaagguccccugcggauaccaaaaugcauggaugcucaaguccuuucuauaaacugguguaguauuugcauauaaccuacacacauccucucauauucuuuaaaucaucucuagauuacuuguaauaccuaauaaaauauuaagugcuacuuaaauaguuauacuguauuguuuagggaauagugacaagaaaaauaagucugcacauguucaggacagauguagccaucuauuuuuuucccugaaauauuuuugaucuaugguugauugaauccagggaugaggaacccauggauauggagggcugacuguauuugccucgcauacuagucaagaaugacauuuauuauuucaagagcaaaccaguauuguacgauacuccagcuggagaaucagugucuauaaaggugaauuauguuucuaagaguuuuaauguugcuuuacaggccaguaucuacucugguguuugcuuauuuugugacuuuacuacauuuaucuaugauauucaauauauauuucaguaaaaugcaauaaauguaaaauaaaauuaagauaggaaaguuacuuuuagaaagcaugaaaauuuaagaaauccuuggagagcauugaauuagccccuugauuuuuaguaaaugaaauggagacuuuuuauauuguuaaaaauguauauuuuuaaaguaugauaaugaaaaauguuaggaaagaaauucuuagcuuuucaagcauauuuuugaaaaaggagaaaaagccacuuauaaacauaggcauauuugauaguuaaggcagguauaaacucgguagccucuuuauguacaaaauucauacucauuugagcaugcuuuacauggggguaucuuuuuucuuuuucuucccgauacauuguacuuucuugcuguuucaaaauguugaguuuucuuuucuuguacucugaccugaauuauaaacuauuuuauuagaaaacauuucugucccuccuccuucuggagcuccaccagcaccaccucuggcaccacuucucccagugagcacugugauaggugagauugcauagccauuggagccauugaacucacuuuacauaauucauaauaaacuccucugugcuaguagagugcuggcuuuuauaguuauuagguugcaggugauaauacaaaguuuaaaguauuaaaucuaauaucacuaacuucuggugaaaggcuucugcacuuauacaguaaacaaauauaaaacaacuuuuucuauaauaugaaaugcuugguuuauaaccaacuuaauguguuuuuaauuuguuguuuguuuagauuuuucuagucuaauccccccugccccgcacaagugaaacuuaauuuggaacucucugguauauacaacagucaaaggaucagggugaagguggggacaggaggagaaaaauugaaaggcaaacgauaugugugggaugggguacucugaggcuuuccuguggaucauaguuugaaaaacucugauauggcccaguuuuuaugacaucucaggaugccaugaaauaguuuucucgauaaaaugcauuuaaauuguucacaaguuggggaugacugaacugagcauauaaggaauuuuaaauauauuuuaaaugucaauguaaaaaccauugagucuagaaauacacaaucacaguaaucuggguagaaauggauaaugagguguuucaaauaaugagagcugaguuucagguuaagugaaauaaagcugucuaacaacaucuuuuccaaacauuugcacauaccaaggaaaagggagaaaggagguaguaaaaugaagacccuaagaauagaaauuguugguagaaaaucugugagaaaaaaauagccucaacccaauuaauaaccagaagaauuaaaauuaaaaccacagugagauacuauuuuauauccagcagacagguaaaaagguagaaguuagcuaguaccaguguuggugaggauguguguuggugaggaaagcaaauugcuggugggaguuuauuaauguauacacucacuucagaaaguaauuuauugauaccuagucaaguugaacauguaccuacccuagauuuaucaauuucauuucuacauauuuacccuagagcacuaguucucaaaauaugguuaagggaccccugaggauuaccaagauccuuucaugaaguuuuugaggucagagcucuauucauuauuuguccuuuucauucucauucuguuauaacuauacgguagaauuuucuagaagcugcaugaaguaugauaaagucauugcuuugacuccuaaugaaauguguacuuguguauucauauguuuuaaagauauaucaguuucaguaucuaauaugguaauuaucuacagcuauaacccaugucaacaaaaggcuuuugggguugucuaagaguggacccuaagaccaaaaagugugaaaacugcuguccuagaacagugguuuucagagugucauccccagacaaucaguaucugagaauuaguuagaaauacagauucucaggucccuucuagaccugcuucaaucgggaaacucuugaggaugggaguuucugcuguuauaauacagcagucuauauuauaacaagcuguaaggcugggcacaguggcucacgccucuaauccuagcacuuugggaggcugaggcaggcggauugcuugauccaggaguucaagaccagccugggcaacauagcaagaccucaucucugcaaaaaauacaaaaaauuuagccgggcauggugaugcaugccuguagccccagcuacuugggaggcugaggugggaggauggcuugagccugggagguggagguugcagagagcugagauugugccacugcgcucuagccugggugacagagugagaccccaucuuaaacaaaacacaaggcuucaagaagaaauacugaucaaugaugaaguuugagaaccacuguccuagagauucaggaauuauauuuaggaauguucguagcaguaguauugauagcacaaaucucaaaccaaaaugucuaauaguaguagaauggauaaauaaauuaugauauauuuacauacaaauaaaauagcaaaaaugaaugacauugauaugcauagccacauggaugaauuuuugaaaauauuaucaaggaaaaagagcaauucaacaauauguacagauugauuccauuacaaaaguuuauaaauuuguaaaaacuguguguauuguuuaagguuauauauguguauguguguguguauauauauauauauauauauauauauauauauauauauauauaugacaaaaacuauuuacagaagaaagagaauguuuaacauacaccuuguggggguuggaauccaggagaggagcacacaggaagccucagugaucuuguuaauauucgauuucuugagcuguauauuauuuaaauuuuuuuauacacacauguauguguauaauucacauguauaacauauaauuaugcauauaagucacacacucuuuggcauuauuuauuuuaugauaaaauguuaaauucuaaaauaggcucagaauugcuaaaugauuggcuuuuguucuugaaucaccaauaaaaauaacucgauuucuguacacuuuuuuauacaagccggagaaauguaaaauccuuuuacagagauuucuauuaaaaaugguuggcugggaguggugacucacaccuguaauccagcauuuugggaggccaaggugggaggauugcuugagcccaggacaagaccacccugggcaacauagugagacucugucucuacaaaacauaaaaaauuagauggguuugguggcacucuccuauauccccagcuacucaggaggcucugguaggaggauugcuugaguccaggagguugaggcuucagugagcugugaucccaccacugcacuccagccugggcgacagucagacucuuuacccaaaauaaaaaaauaaauuaaaaaaaaaacaguuaaaggcuuacucuuuuuuuuuuuuuuuuuuuuuuuuuuuugagauggagucuuucuccgucacucaggcuggaaugcaguggugcugucuuggcucacgcaaccuccaucucccggguucaagugauucuccugucucaaccucccgaguagcugggauuacaggcauaugccuccaugcccagcuaauuguuguauuuuuaguagacacggguuuucgccaugauggccaggcuggucucaaacuccugaccucaggugauccgccugccucggccucccaaagugcugggauuacaggcaugagccacugcaccuggcccuuaaaggcuuauuucuuggcucucuggaaaaaccuagcuguccaaaauuacuuauucacgaaggcuuuugaauagacaauuauuuuuaaacuguuucuauuuagaaaaugagcauguggaugauucaaauaauuggugacugccuaugacuugggaguuccaaaauguuagaucagcacuucucuuaaugaacaaccucugcuguaugguuuuaucugauaccuugugugaccucuaagaaggauuagacaacugaaugaagauaaacuaggacgcuggcuuuuuacuuacucugucauuguuuguuguuuagauggggcaaggaaaauaauaauaaucccaaaguuaacuuuggaaaguauaguuaacuuuagaggcuuugaacucuauuaacauuuuaaauaugaaacuuuugaaauguugggaaagaugacacuuaauacaauguuaaguauuaauauuuucaucaguuucgauauuaacugaugaaaauauaugagcaugcuaauuuuuuuuuuuuuuuuaaaagcagauucuuuggauguacuaugaaaaagaagcccuccaggcauggagaaagagaauagauuugcuaaacaaaacuaccuuaaaaugccauauuuuauagagucaaaaaauuuucugcuucugucaguuauaaaaauuuaauagggaaaauguauguuaaucuuaaaacuuuggagaucuacaacaaaucugacauuacaugaaagugcuuugaaacgagaaauggcacauuucuuaaaaaugauuuuacuuaauauguauugauacuaauaacugcuaauucaauaaaaacucaaaaauauuaguaaauaaaaauuuauuguuuaacuuggauuuggcuagauagagacuuaucauuauaagacucuaucuagccaaaucaaaauucugaaaguuuugucaguggaaaggaagaaauuuguaacucagacaugaaucuacuuauaucuaaagacugaugcuuccuaccucacaccaucuuuugguacuuauuuuauuggaaagacaauuuacauauaaaagcuauguauuugaaaaugcacaaaaaauuuauauaucauauuagcaaaguaccauuugggauuaugguuuuuaaaagcuugagaauauuacuuauuuacuuuugcagcuuuccaugcagcuguuuuuuuuucucucuguuuuugacuuuggagauaaaguuacugauuuuuaucuuuacuuuucucuuuauuuugugccuuggucuugaaaaaguaauaaauauuucuuacugaggcccccuccugcuuuguucugccaucuaaggugauuacaaugcucaagucucuuuguugguugccuuugacuaaugcuuuucagcagccccgggcucagcuccugguucccaguauggcacaaugaccaggcagauaucucgacacaacucuacuacuucuucgacaucuucugguggauacagacgaacucccucugugacugcucaauuuucugcucagccucauguuaauggagguccacuuuauucucaaaauucaaguaagcuugugcuuugcaggcauacagcaacaguggagcuccuuuugaaggaaauuauuugaaacuguuauucuugccagugauagacaacaauugaaaaccaugauguuucauguuuauuuuuguuuuaggauauuaguccuugaaucauaccauuuuaagaguaauuguuuaccacuuucucuuccaaaauuuagacuuaccaaguauacuuaacuaaauuuaucgagacgugucuauauugaguauaccaaaauuuaacuuuaauaugcgauuuuauuacauaaguagaacuagagaacaaaaacauugcagaaauaaacugaauuuauuggcauguuugagacagcguaguaaugguaaaauuaaagacacaaacauugucaaaguuuuccuucaaauuaauauaaugaaauugcuggcuaucacuuuuaaggucauuaacguguucagaaaugaguucaaaaccgauuaaaacuguuugugaugccugcuuaauuacucugucuuugaauaauucuaauggugggaauuucuuuugauuucuuucuguuuaccucaaauugcacaucucaacacuaauugcagucaguguuuaaaagcugguaagaaaagaaaauaguuuuagcauauaauguuaggaaguuagaauaguguaggguagucauuaauaucacuuuccauauuaagauguucaaugcaaaaaggaaaaaaaacaaaauuagaaaugaaccuguuguccacuguuugcuuuuagcuuaaaaaguugugcccacugggcauagaaugagacaagcuuuccuacauggcuuuuguggcucuuucuagagccacauguuauuuuuguuuauauaaaaacacuuaauacucagugaauucuccauauuuacauaggagguugcuuuaaguucuuuuuauuuauaaugaaugaccuguauauguauuuuaaagcagagcuaggggaaaguuuuuuuuuuuuuuuuuuuuuuuuuugagacagaguuucacucuugucgcccaggcuggagugcaguggcgcgaucucgguccacugcaaccucacccucccaggaucaagcgauucuccugccucagccaccugaguagcugggauuacaggcgccugccacuacaccuagccaauuuuuguauuuuuagaagggacagcauuucaccauguuggccaggcuggucucgaacuccugaucucaggugauccacccaccucagccucccaaaguggugggauuacaggcgugagccacugaaaguucucauuaguuuuuuguuuaaauuuuaaacauaaauuauguuauagcaaaaauuccuaagaauugaaaaccacuuuaucagaaauaucaaaauucacaaauaaucccaaaauuuauauagcuuuuuuuccagacuaaaauauuaaagcuacugagaaguguuaaacuucacuaaauaggauuuuaccuaacauuugguaucaaaagguagccagugucugucuaaauauuccagauuaucuaauaauucacuucacuuguuucaucaacuuuauuuuuuucauauucugaauuuuuagaucccaucuuuuuguguauuauuuuucuuuuccccacuuagacauuuaauuuacucugcaaauaggauuuuugugacuuuuuuauauaauacauaguuuuauaguuuuauuuuagcaaugcuuguguggauuauuuucaaaccguauacuuuaauuaaugaccacauucuuuugaauauuggaaagcaaauuuggccucagauuuuaaauaaauuauuauguuuugucaaauuaauuauccuucaaucugaguuacuguugguguuguaguaguaguaguaguaguacgugaauguuuuuaguguuuugaugugcacauuuucccuucugucuaaauguaguaaugauuaguaucuucacagcauagcuuuucuuuuucauuacauacuaaccagcauggcuaguuacuaagaguuguuucuaaacacuuuuuuagguuugugagaguuuuuuguuuuuuaagucaaaaccucuaaccuuuuauuuaggagccuucuauagaguauuagaaugaaauaggauugcuuucauagugaauugaauguuaucuuuagcuauacaaugaauauuaaugcacauaauugcuuuguuacuucuuugaacacugaacuucuuucaaauuuuuaugcuuaccaacagaauuugcauguuggauuaauugaaacaaccuuuugauuaauccuugguaaccaauaaauuguuuuucucuaucaauuuaguguuacuacuuggugacuaccgauagacuaaauuuugcuaucuaguccuacugacuuuuucuaagcaaucuuuggcaauuacugucuuguuaaagugagacaaagucacaaacauaugaauguuuacuucuaguguauguuauaauuuuuaauacaugaguauuugguauuaauuuccugucaauuaugucaucuccacaaaugcauaugaauguguuucaagcuauccaaugaguuguuaaaaauuacuuuaaugcaaagaacuacguauuuuaacuuauuggagaucagguuuccuuuuucagaacagugaugaaaaggucacuuuugagauaucccaugaaacucugacugauuaacaugauauauucccuuguaaauuuaggacugauauuuuuaaacauaaaauugccaacuuaaaaaaauaacaaccuuguuuuacaaacaagaguuuuuccuggagagcugugugugaauuuagauauauaauaagaacugucuuuaaaggaaaccugugauuaauauuuuuauugauauaugaaauaaauagcuauuauauauuuguuuuauuuauuuggguccuaauuuacaacauuaccuuaaagcuagacaaaccuguuauagcuauggcaaagacacaauauucuggaaaccuauguagguauuucauuguuaccuauuuuagaagucuuuccuuagaauuugaaaauuuuauuuuacuaaagugaaugugaugguaaauuuaaauccuccccaaacaauguaacauuaggauugaauuaaguauauuuguucuuuuauaaaauuaauuaauuggcuaagcacaacuuggccuuuagguuugcuugugggaaauguacuccaagguucugcagguuuuuguuuuguuuuuuguuuuguuuuguuucauuugcaaacuguucuuugcauacuuauguuugugguccuuguaacugacuucugcuuuuuguuuguuuccuuuucuuuccuuuaucuguuuuacuucccccauacuguguuguugcuaccaguuucuauugcuccacccccucccccuaugccucaguugacuccacagauaccucucacaggcuucguggccagggugcaggaaaacaguaaguuuggaaaaacugagcuauggaagaguagaggcugucuccuuauagcaugcauggcugacgaugagucaucguuuuccuuacuuuuauugagaagcuaaucuugaaaauaggugcagacauguuacugaaacugaagagcacggucuucaguuuuuucucuuugugugcaugguuacugacccauauaaauuucaaagcugcaauuuucuuaugucuuuacaugauccuaaaacaggagaucugaucuuuacauauucuuaaggaaagaauaaucaaacacaaaaauucaaauuauauggaaacuuuuagcuucuaacaguuacuagaauuagaagacauuuuuaauucuaauaaauuuaucaagagauagguagauauacuguaagauuaaauuuaauaugaaauuggggcagauuuuccccccuuaauuucaaaauuuuagggaaagcuuuguagccucagauuuuuguacauacaugauauugaaccuacguaaagguucauuguuaggauaagauugaaugaccaggaauaaguaaauuacauucaugcuauccauuucagugugagugauaagcaauuuagcauccuuuucacauuuuggcuacauccaggcccacgaagauuguuccugaauaugaaaaucaguuaacuuuuuuagaucuucucucgaaugaaguucagggauuuuuuuuuguggggggggagaaguuauuuuggauauauggcuuuaaucaggauagacuaguuuauauuacugccugauuacuuuugaaauuccagaagauguguaauccuaacugcaugaucacagugaaucuuauauaaagugaaaaauaccacuauuacugaauuauaauaugcuagaaaagcuguugaugguaauguggucuauuuuuaauuuacuucauuuggaccaucaccaugaaaauaaaucucaggaugguuugaacaaaugaauaacccacuugcccagccuauccuccaagaaaauauauuguggcaaauuccauucuucagcuuuugcugacccuguuguguuauucuccccauucccucccuccugccagucaaauauuuguguacccgauguuacgugccagacuccgggaagaauaccagcaguuuaagacaaaagccccuuccuucaggaaaugugugauccaauuggcuuguuauaaaauguuguuuuguaauguugaaauuucugaguguaagccauccuuacuguuaauauguguuugaaaacccuaaugugugcaaacauuuaaaaagauaugaauaaucagccugggcaacauggcaagacugucuguacaaaaaaauaaaaaauuagccagguguaguggcaugugccuguaguuccagcuaccagguaggcugaggcuggggcaucauuugaguccaggacgucaaggcugcagugagccaugaucacacuacugcacuccagccuagacgugcaaaaauaaauagagugcaaaaauaaauaaaugcauggauggauggauagauagaugugaaucuuauuuuuaaaaauaaaugaguaaggguaaacugcuggucauuaaugcugcagaguuuaaaaacaaggccaguguaaacuuuugaacugccauaucaguaagaauuauuaggaaauaauuuaaaauagccauaaugaacaucaguuuuguggguccaaagugacugacuagcuauuugguaaaucuuuucuuuauauagaaauccaguauuaguguacauuauucuaggcauguguggucuuugcuaaagaggcucuugguacuauauuaguucuuuuuaccaaacauaugaacuugggucagucagugauucuccuugugccacagauucccuaacuuuauuugguuucuguuuucuuugaaaguguguuaggaggauugguguuaaaauauguaucaguacuuuaaacguuuuaugaaguacaaauuuuauguguucucuuaaauacccaguuucuuaugacacucaaagugggugauaaugaaugcauguagcagccuauuaauaaguauuucaguuuaagauaugagccucuaaaaaagucagcaguguguuuacaucucuuuaugauuaugcagagaauuagauuaaccaagacuuccuucgccauaauuugaagauaagacauguagauuuacagcaguuggacauaaagacaauuucgugaaaacauuaaacuaaugugauaaaucaagaguaaaugcaagguaccaacauacauaauuuacacauuaagccaaauuaaggauaugaacuauggcuguuugaugucaggaggggucuguacccauuuuccucuccucaauaauauuaaaaaguuuuauagaggaaguuaugggcaaagauaaaauggaucuaggaaugaggcagaaaaauuaauuguagacccguuugauagguguuauagugagcauuaccauauaggguuuguuuucuaauagcccuuucaucccucgagaggauaaaauagaaaucacagcauugaagugguuauggaaauagggucauuaucugcaaauauuuuaaaccuggagcccuugguuguauauucagcacauuauuccaaggaggguagacuaaacguuuaaaccuauaugacagauagauuauggcugauuucuuugaucacguaaauagccccagaaauuggcauuugauuuaguauguuuguauuaugaacuucuccccugcaggaauuauguaauuccuguaucaauuuguaugaaaacauuuucauaugucuuuugaacuuuuaaagaaauuuauugaucagaaauuuaaguuaagcauuaauuggguuccagcuuugaauucuuuaaauuuuaggagcauuuuuaccugauauuauacuaguucauugaacagagcucuagccugacauuuucccauuucccuguuuacaccuuugacuguguaaagcacacacauauauacugaccacgaccaucuagaguuugagguaugagucauuuuuauuguuuuguuuacuguaaguuccuuuuuguuuguuuuuuuuaauuacaucuucaacacuuuauguuuaaaucuuaauuguugauguauucuuagaaaaucgaaucuuuaggaucuaggcuuucccucaucccgugcuuauguuuuacuagcaauaaugcaaaauuuuagcuugcuuucuacauuaaaaaacuaauuaugaauauaaaccuuuuuaaaaauacucaauuagauuuucuacugguuggggauucuuuuuccauuuuuucaacuuguaaaauguaaauaacagaguagaaaaucugcacacagaagcagaccuaauacuaccaacuuuacuuuucucuucaucaaaacaaacaauaaucaacaaagaaacaaaaaucuguccacaggagacugaauuuuuagggaaccaaagcuguuucaagccaaaaucaggggcaugaaugagcagagugaagagugaucaaaccauuaacguaauguuacucauaucauuacugcaguccaaaugacaaaagugacauagauuuauuuuagauuguuaacauuugucccgaucugaaccuuggaauaaggaaacuacuccuauaauccuuauaaaaagagacauugucuccuaacacccugcauucauuaauuuguaguacuuccagauacccuuauuuuuagcucauuuuguuauuuuuaaaugauucuugaguagcauaaacuuuaacacaccaagcuuuuauuucuaaucauugcauguuuuauuauagugcaugcuguacuuaaguuagagcuuucuuaaauucuguuaacuuauaaguuuccaucuagacuuauuuuugauucaaaucaaucauaugaaucuuuuuaguugcugauaguccaacuccaccgccaccaccuccaccagaugacauucccauguuugaugacucuccaccucccccaccaccaccaccaguggauuaugaagaugaggaggcugcaguaguucaguauaaugauccauaugcagauggggauccugcuugggcccccaagaauuauauugagaaagguaagguacagucauugaguugaugugaaggaaaauaaccuaauuguagaaauuuagaacuauaaagaacaucuaauccaauguuucucagccuuuuaaacugccuuaccaaccaagaugauuuacuuaaaccuuacuuccuaaguuuuguauuauucccaguguacagggggauucuuucuuuguauuuuaaauaaaaguugcaguguuagauuugcuuucaaacuacauaugcguucagcugaagauuaacuugcuggacggcauuuuauagaugaaacagcuaaggcacaaaaauggaguuauauguaauuaguaaagauuuuaaaaguucugucaagcucuauugauuaccuuucauaucuaaauauggacggucccugauuuaugaugguucacuuuaggaucuuuucaacuuuaugaugguacaaaaaugauaugcauucaguaugcuucucaacuuaugauggagcuuugucuggauaaaccuguuauaaguaaaaaaaauacaaguugaaaauguacuuucaauuuacaauauuuuccacuaaacaguggguuuauugggacauaaccccauuguauguaaguggaggagcaucggucuuuaaaaauauauuaguacuaucaugagaaaagccucaauuaagguuucaauuaggugauuuuauaaaacacaagagaaauuaucaggauuguauuucaugaaauuaugaacuacucuaaagucuaauuuaccuauaguacccgauauucacuauaauuaucuauuaagaaauauagguggggaagaaacaaauccuguuucuaguuuuuauuuuuucauccaguucugugcuauuuuaaaaucuguauuucuuuuugcagaagugggaaucaauuaaaaauaaaaucuguauuucuauagaguucugaaaaaugcuugugauuuaguugaacacuuuugguugccuuugaaauauauuuccuucuauugacuuuacuggguuaacggacuuuaagcuaguagauguagcucuugagaccagcagcauucuuuccugcccaaguuuuggauauguggcaaaaguaaauuuguuuuccuuuuauauuuuuuuauuuuuugagauggagucuugcucugucucccaggcuggagugcaguggugcaaucucggcucacugcaacuuccgccucccagguuccagcaauucuccugccucagccucuuaaguagcugggauuacaggugcccgccaccacgcccagcuaacuuuuguauuuuuaguagagaugggguuuugccauguuggccaggcuggucuugaacuccugaccucaagugauccgcccaucucagccucccugugcugggauuaccggcaugagccgagcguggccuuauauuuuuaaacaguaaguaauuuacauauuguuaagaaagucuugaauauucuacuugagauucccauauaccuucaaauagagagcuguuguuacuuacgaggaugauaaacuugagugaccuugaauuguguuuuuacccauauuuucuuacuuggugaagccaauuaacugugaaaaugggaccauauuuauauaaguugacaaauuuggaaugauauauuggguaauauauuugauaguagaggaggauuaaaaaguauauucccaagaacuaggggugagcacacuuuguuugguauaaagccagauaguaaauauuuuaaacuuugcuggcuauacagucucugucacaacuacucaguccugcuauuguagcguaaaagcagacauagacaauacaugaguaaguagauguggccauauugcaauaaaccuuuauuuacaaaaauugcgugguuuggauuuguccaugggccauuuuauacauuuuggauuacuuucucuuuccauagcaguuugcaaaggaagugaauauaggcuaagcaucccuaucugaaagucccaaauucaaaaugcuccaaaauccaaaaugaguuccaacaugaugccgcaaguggaaaauuccacaccugaccucacgugaugggucacaaucaaaaugcaggcacaugacacaguuuauucaguguucccaagggaaaaauaaaauuaccuucagacuauguguauaagguguaugugaaacaaaaaugaguuuuguguuuagacuugggucccaucuccaagaugucucauuacgcauauguaaaauuccaaaaucugaaaaucccaaauccaaagcaguucugaucccaggcauuucagauaaggguuacucaaccuguaucuugaacugaaaaaauuacagacaccacagaauugcaaaguucucuaaguauuaauuaaaauccuuuaaaguaaguaaauauucuuuaaaaaaaaaucuggggacagucccuuaaauuagcauggguccuugaaugaguaggaugugauuuaccuuccaguaacuguguuuuuucaaauuagauagcuuggauuguuaccugguuuacugaauggcuaugcagcuuucuuugccugauaauuauuuugaaaagccggugcuuugcauaugauaggcacuugguauuugaaugaauugaaacaucuaauaaauucuaaaauucagagagcuuucuuaaagugauugacagaaccuauugauguauucagucuaaucagauugucauuuggcucuaagauuaagccaaugauuuaaguacaugguuggccacugaccuacuuauauugauagauacaaaaauuaagaaaucuucauaaaaauaguuuugcugugcuauauauuuaauugucuuugucuuaaaauucaaguaaauuuuggauauagugcacucaugugauauuucaacuguuuuuuccauaguuguugcaauauaugauuauacaaaagacaaggaugaugagcugucauuuauggagggugcaaucauuuauguuauaaagaagaaugaugauggcugguaugaaggagucugcaaucgagugacuggucuguucccugggaacuauguugaaucaaucaugcacuauacugauuaauuuuuuuuuuucuuuugaaguagauucuuauuacucagucauacugugggacuauuaugguuaacagaacugucuuaauauguuuuaaaaugugcccauauuuucagaacaugcuguuuuauugguaaauugaaugucuaccuguaagcauaaaucuuugaggcaguuuauguauugcugaauagcaauuuauacaagaagcuguccauaacugauuaugcuuauguacuuacuuacacauuuuuaacuuuaugaccagccuaaauauucugggggaagugggguauaauauuuaacgaaucaugauucagauuguaccauuacauguuucagugcagcaugguuacuaacgcuaugucagacuaauauuaaaaucagaaaauuuaaaugcuggugcuggucagacuuuuuuuguuagauucucucauuuaaaaaaaauacuguuuguuuaaagcaugcauaaaaauuuauguauugaaauauacuuaaaaauucaagaugcuucccauuuguguaauauuuaccuggaggacucguacuuaggugucuuaacgugaauugagucuccaaggucuccaugugaaacaagcaaaaagagaauuaucuguaauguuguaauuuguaccuaaguuuuuuaaugagugaaauuugcauuauaaacuuuuuccauucauaaauacauaagugaaccaaagguuuuuguccuuuccuucacugauuugcuuuaaaaaaaauaaaagauaaugauuuauugcagaauuaugauucuauuuucucaauauguuaacuuggaaaaaaauuuuagccuuaucuuaaucugucccaacagcaaugugacggauuuuugcagauucaaaaucugcaaugguuauuuacaagucaaucuacugaauuccuuuuuuaaauaaucuuuugaaacuaagaaaaugugucaaauugugugcauucauucuguagguaaaauucuuaaggauugccaugucaguccuucaguuguacagugaacuguuguacacugguucaaugaaaggaaguuaaaaguaccuuuuacauauuguaaaaguggauacaguugauuugugaguaggcacucuuuaauccauuaccuggcacuagcaacauuagaauuuuaaaauaaaauaauugggaaagaaggugggucauguauuaaucagugaacagagauuuaccuaaccaacagacuuggauugucuuuugacauaaucaaaaugcaacacaugcacuuugugugucuccucuuaauugaagggagggcugagggauguuuucucuucuugucuuguguauaauucucuauugcuuaggauauuaaaguagagcacucaaguguggguuucuguguuauugaggauuuguuuggaauucaaauuacaguuauguacuggaugcuacagacuuauaacagcauagugaaugguaagacuagugcaaaacaguuauuucugaaaauuaaagaccauuauugcuaccaaaucaaugugacuauuucauaugcauuuugccuuuguuaauuuuaaacaaacaaaguaucauuagugaucagcuagcuaccuucuacuuuccauuuuucaaguggauuguucucuuaauuuguauauaaccuguugucuaaauuuuauguacagucuuuuauaauaaaccauucuccuauaugaaauuuuggauacuguuaaaauauaacucauguggacuucaaugcagacuucacauuuuucugaccuuuacuccuacgguaaaucaagacaaaccauuugaauuuuaacauugguuauuuauuuguguaauggccuuacauguggauauuaacaguguaaacaauaccacauauaaccaucaagauaccuugauuauaauuuauaggacuagaaugacagauucaggugguuuauuaauuacauuuaaaaaguuuucugaaaaaacuuuugcaauaaaaaaaaauaaauugcccaucaa

SEQ ID NO: 191181 - RNA, 32096 nt, Homo sapiens
uuuuccucacacuaaaucgaaaacucucccuguugguccugaucuguuucagucaggcaaauuacauccugggaaaacgucagaugacaggggaggccacucgcuuccugcucauccaguuucgacacuuucugugcuuucauuagcuuccagaccucagcccuggcccucgcuuuacuguacagucagaacugguuucuacgccucgcgagggugggaggucguguaugggaggaggaccgcuucccaccagccucguugggaagccaggagaaaucucuucaaauccugcgauucagagucaagucccagucguccuuuuucuggucggcccagaacuguuugugccuccucccucaugaggaaugaugucaguggggccgcggucgccgcccacgaagaguguaaggcugcgaagucggggcuuucccgacgcccccuccguccgcgucugcguaggggaggugacgagggcggggcgcggcggcggggugacgucacggccgcgcgcggcgugggcggagccucacuuugaacccaguuggcgggaguggcugcucgcggaggggcagugucugcggggccgcuguaugcuguccagcgauggaucccaccgcgggaagcaagaaggagccuggaggaggcgcggcgacugaggagggcgugaauaggaucgcagugccaaaaccgcccuccauugaggaauucagcauagugaagcccauuagccggggcgccuucgggaaaguguaucuggggcagaaaggcggcaaauuguaugcaguaaagguaggaagucaacgaguagcaaggaagggguuaggcccuucggcccuccuuccugccccaccggcuugggcaggccccgggguugcuggagcgaggagucuggguggccuggcuugcugaagccuccagagcccugcgagcugacuucuuuuuggggcgacaucagcggucgggucgggugucucgccucuguuccgcccuucccuccauaucucagaugcccagugagaacagcaaaguuugacucucuucucccugcccagcguuagcaaaugaggaaacugaggccaaaggcaaagggacuugaccgaggugauuacaucggucuuaguacaacaggcacuuaaagccaaagccgugauucguagucucacccuggcuugaguuagguuucuuuuuuauuuuuuuuugaggcggagucuugcucuguuucccaggcuggagugcaguggcgcaaucucgacucacugcaagcuccgccccccggguucacgccauuccccugccucggccucccgacgagcugggacuacaagcgcccgucaccacgcccggcugauuuuuuguauuuuuaguagagacgggguuucuuuaguagagacgggguuucaccguguuagccaggauggucucgauucccugaccucguauuccgcccgccucggccucccaaagugcugggauuacuggcgugagccaccgcgcccggcgaguuagguuucuaaauccaaaagguuuuuaguaauuagugguuuuguuuaccuuguuugcuuugacgugcagaaucgucgaaauuuuucuaccacagaagagugauuaaucuguaggcacugauaacuuuuuaaguuuuauucuuaaccagaagaaagauuacuauuuucugagaagucuuuaauaauuuuuuuuuaagacagucuuucucugucgcccaggcuggagugcuguggugcagucucggcucccugcagccucugccuccuggguucaagcgauucuccugucucagccucccgaguagcugggauuacaggcgcgcgccaccaugccuggcugauuuguguaguuuuuuuuuuagccgagauugaauuuagccagguuguuuugguuauguuggccaggcuggucuggagcuccugaccucaggugacccgcccacaucggccucccagagugcugggauuacaggugugagccaccgcgcccugcccugcuaugaauuuuuuuuuuuuuuuuuuugagauagaguuucacagugacgugaucucagcucacugcaaccuccacuucccggguucaagcgagucuccugccucagccucccgaguaguugggauucccgccaccacaccgggcuaauuuuuuguauuuuuaguagagacgggguuucaccauuuugggcaggcuggucucaaacuccugagcucaggugaucugcccgccucagccucccaaagugcugggauuacaggggugagccaccgugccuggccuuaugcugguuccuuuuuaagugcuuuucuucuacccuuuugugcucuucuccaccugucuuauucauguauuaagauucaucuuagcuccccuucacaccuucccuaaucuuucagaauuggaagaucugauugaauugguuacuuuauauguuccugagauuuuuacuuuuccuucuacaguacuuagucaugaucaguugaaaugaaaacaccaauccauguguucagucaguauuugcuuagcacccacccucuuugugucuacgaacuggacaacaauggggaacaaaacacacaugcccucauagccaguggaaugauaggaaaaaucauguuaccagcuugcuuugucaguuucccucaguuuucuuaaagaaaggaguuaaggcaggaauuuaucauguacuaaugauuuuauuaaguacucgaauaaaucuuugaaagaaauaugccuuuuuuucuuauagcaguccugagaauugaucccaguguuacugacuauucaguuuagugcuccaacuuuauuuuuauuuauuuauuuauguauuuuuaauuuuucuuagugcuccaacuuuaauaguucuguuucuguacagauuaccuugaaacuugaaaagaguaauuaguuuucuguaagacagcauuugggacuguuaaauuucaguaguucuaaucauuccaacuuaagauuuuuuuuuucuaggcaaacuuccgacauucuuccucuuucugauucuauccccaucuaucaaaaaaucagaaguuaaaaaaaaaaauuaaguaguuacuccacgcccaggugcuaguuaucugugggcuuaugaggaauguaacugucuuuugacuucguuaucagaacaguggaacagaauuuuuuuucuauuaauaugcagggcagucugggaauauuuaauuuuuuuuccuucuugaaagagauuaugauacuucugccauuuaauaccaagauaagcaauucuaucuugaagauuuuuuuaaaccgucuuaacuauuuuuuguacgugcuuuccugauagcaguguaagguccacaugacaucuauauguguucucucuguuagcguuuucaugauggcaacuuugaaaccugagaucacucuguaauuuaaaaacaaggcagggagcuguggcuuccacguguaaucccagcacuuugacagggguauugcuugaggcucauuuugggccagccugggcaacguagugagaccuugucucuacaacaaaauuaaaaaguagccagauguagucaugugugccaguagucccagcuacuugggaggcugaggugggaggauaacuugagccuaggaaaucaaggcugcaauaagcuuugaucaugccacugcacucagccugggcaagagaaugagacucugucucaaaauaaaauaacaugauaucacuuuuauuuuaucuauuacagguuguuaaaaaagcagacaugaucaacaaaaauaugacucaucagguccaagcugagagagaugcacuggcacuaagcaaaagcccauucauuguccauuuguauuauucacugcagucugcaaacaaugucuacuuggugaguaaauaauuuuuauguuguuucuuuauccauuaagcagucauugaaccuagugauuuaagagaaccauguuuugguucagagugcuugcauuugaauucuggcugcacucacugccuuggcaaauuuaccuguuauauuaguuagaguucuccaaagaaaaagaaccaauaagauauaugcauacggugcguguguauguguauguauauguacauagagagacaggccaaggggccauggcucacaccuguaauucaagcacuucgagaggcugagacagaaagaucacuugaggccaagaguucaagaccaacuuggggaacauaaggagacuccaucucuacaaaaaaauuaaaguaaaaauuagcugggcauggugguaugcagcuagcuaauagagauaccauugcacauaauugcaccccagccugagauagagucucccucuguugcccaggcuagacugcaguggugcaaucuuggccacucugcaccuccuggguucaagcaauucuugugccucaaccucccaaguagcugagauuacaggcccagcuaauuuuuuguauaaauuagcugccaccaggcccagcuaauuuuuuguaauuuuaguagggacgggguuuugcuauguuggccaggcuagucucgaacuccuggccucaagugaucugcccaucuuggccucccaaagugcugagauuauaggcgugagucacugugcccagccuaaacaguuuaauuuuuaauuaaaaacuguuauggcaacaugaauaaaccuaguauuaauguauuacgaguaauagcaagaaaaggucguuucauuacagagccaugccaaauauuguaacuguaaugcccaaauacuagauuuuuaaaguaaucauauuguuuuuauuucacaauauuaaauucuuuuuugaaagguaauggaauaucuuauugggggagaugucaagucucuccuacauauauaugguuauuuugaugaagagauggcugugaaauauauuucugaaguagcacuggcucuagacuaccuucacagacauggaaucauccacagguaaagacugacuucuccaaauuauuacuuaaaaauucaaguaaucaaauuacauauuugagucucagauauucacaguaaccacuugcacuuauuuccagguuaucuaaaguuuacuaguaacuuguauucauuuagaaauuaacucuucuuucaucucccuguguuuuuuaaaauauauugcuuugaacaugaguauagcauguauuuauuuauuuuuguauuuacauauuuauuuauuuuuuucuuuguugagacagggucucacuuugucauccagguugugcagugcagugacuugaccuuggcucacugcagccucgaccucuggggcucaagcaaucccccugccuuagccucccaagugucugggaguagaggugugugccauuacucuuggcuuuuuuuuuuuuuuuuuuuuuuuuuuuuuguagagacaagguucccaggcugcucuuuaacuccugggcccaagggauccucccaccucagccucccaaaaugcuacgauuacaggcaugagcuaccacggcccauuaaguauggcauuuuaugugaagaguauugaauccuuuccgcuccucugcauuauacaaaagugguauauuuuguaguccaacugauuuacaauguuuuucucuaugcaaagaaagucagauuaagugacuuauuaaaucucaaucuuaccuuccuuuaagaagguaaauguaggccaggugugguggcucauaccuauaauuccagcacuuugggaggcugaggcgggcggaucaccugaggucgggaguuugagaccagaguggacaacauggugaaacccugucucugcuaaaaauacaaaaauuagccgagugugguggugggugccuguaaucccagcuacucgggaggcugagacaggagaacugcuugaacccggaaggcggagguugcagugagccgagauugugccauugcacuccagccugggugacaagagugaaacuccaucucaaaaaaaaaaagaaaagaaaaaaaagaaaguaaauguaaauuugaacuggcuugagguugauuuuaucuaauaagguuucuuuauuuuaauggaauaucuaaccaaugauaccaaagauaaucuaguauuaauuuaucuuuuuuguagauucugauaaacaguacgaaagauguuuugcuuuugagagauguuuucuguacuuuucaaagccaucaaugaguaucuuuauuuuggaggaaauaaauaggguuugccuccuuuguaacucuuuuuuucuggaaauucuaacauuaaaacuagcccuuuuuugguuaucuaauauuugccuuuugugugugcagggacuugaaaccggacaauaugcuuauuucuaaugagggucauauuaaacugacggauuuuggccuuucaaaaguuacuuugaauagagguaagaaaaauaucaaguaaguacuuuuuuaaaacauccaacaggccaggcgugguggcucacaccuguaaucccagcacuuugggaggccaaggcgggcagaucaccugaggucaggaguuagagaccagccuagcuaacguggcaaaaccccaucucuacuaaaaauacaaaaauuagcugggcgugguggcaugcgccuguaaucccagcuacuaaggaggcugaggcagggagaaucacuugaacccaggagauggagguugcagugagcugagaucccgccauugcacuccagacugggaaacaaagugaaaaucucucucaaaaaaaaaaaaguccaacuaaaaauaaauauaaaaaauuaaaaaaaaugaaaagucuaacaaauuauagagacuacauuucauuaacuuccacuguuuucuuuguuaguuuacacuaaauaaaauuuguuauuuaucccagaauaggcuagaaagguauaacggguucuuuuuuccacugaagaugaaaaauaggagugauuauucuuggcuauucagagguccuugaagguccuuugaucuucacagaggaacucacaauuucuguuuuucugacuuuuaucccaagugaaauugauucuuaccaauuaagcaucaguaaaaugaccagaauaacuauaacaugaugaaggguuaauaacugaaaacauauucaaauauacacggccaccacuaagaccuugaucaacaaaaggacaaagaaaaugaauacacaguuaacacauauauguauauaugggacuguguucuuuucacuaguaguaauuaaauaaaugcuaauauaagaaagaguaaaugaaccaucuuacacuauuaaaugggcaaaagaaaggaauaccgaugguccaguuaguaauacuaccaaaaaagcacacuaauauuuuucugggggcauuguaaauuagcauagugcuuucuggaggaaaucugccaauauguuuuuaaauauaaaaguuuuuaauucucuuugaucuaguggcuuaugcuuuggaauuuauucuaaggaaauuguucaaaugaacaaaauacacauaaaugaaaucacuuguagcaacauuguuucuaauagggagaaacuagaaauuacuuaaguucaucauagaaacauggauaaaugauugauuaucaacuuagaaacauauuguauucuuggccgggugccguggcucaugccuguaaucccagcacucugggaggccgaggcggguagaucacuugagguugaggucaggaguucuagacuagccuggccaaccugaugaaaccccaucucuacuaaaaauacaaaaauuagcugagugugguggcacacgccuguagucccagcuacuuaguaggcugaggcaggagaauugcuuaaaccugggaggcagagguugcagugagccaagaucacgacacugcacucuagccugggggacagagcgauacuccaucucgaaaaaaaaagaaacauauuguauucucuauuagaaaguguagacggaugggaaaguauuaauaaugaaaauaaccagaaauuggacuuaaaaacucuggaauuauaacuauuaauauuugaaaauauaugcagaucuacaauucuucauguggaaguacaaaguucaacaguuaugaauaccuaaaacuuuuuacuaaguuugguaaaaucugaucuaugcugauguagggguauuuauagucuuuuguuuguuuguuuguuuugggaugggguuuuugcucuguugcccaggcuggagugcaauggcgugaucucggcucacuacaacauccaccucccggguucaagcaauucuccugccucagccuucugaguagcugggauuauaggugcccgccaccacgcccagcuaauuuuuguauuuuuaguagagacacaguuucaccauguuggccaggcuggucucgagcuccugaccucaggugguucacccgccucggccucccaaagugcuaggauuacaggcaugagccaccgugccuggccagggguauuuauagucuguugauuccaguucaugugauuauucauaugauuugccacuagggauauuucauaauaugcaguauauuuaccacauuacuuuucuaaaaucuaaacauuuuugaauugugauuucaaagaaaucugacuuugaaaucuuauuucgaaaucugauucuaaggauuucagauaagcuauuggaaaauaucacaaaugacaaaaauuuugcauuaagauaaaauuguugauaaauuuaagucacuuuguuuaucauaagggucuaauuuuaauaaaacuuuuuuuguaaaauaucauauacguguauuauuauuaucacuucaucaaugugaggcauaaaugacauuuguuguuaaaacuuucaguauacuuucauuuauuuacuuauuuguuuuuuuuuuuuuucuuugagacagagucucgcuuuguugcccgggcuggagugcuggagugcaggggcacaaucuaaguucacugcaagcucuaccuccuggguucacgccauucuccugccucagucuccugaguagcugggacuacaggcacccaccaccacgcccggcuaauuuuuuguauuuuuaguagagaugagguuucaccauguuagccaggauggucuugaucuccugaccucgugauccacccgcccuggacucccaaaguguugggauuacaggcgugaaccaccgcgcccagccuauucauucauuuauuuauuuugagagagagucuugcucugucacccaggcuggaguacagaguacaguggcaugaucuaggcucacuacaaccucugccucccaggcucaagcgauucuugucccucagccuuccgaguagcugggacuagaggcaugagccaccacacccagcuaauuuuaaaaaguccuauaagaacauuagaguucugggauuauuuuuguuuguuuaagagacagggucucacuguauuacccaggcuggagugcagugaugugaucauagcuuacuguagccuugaacuccugggaaaagcaauucucccaccucagccuccccaguagcugggacuacaggugcuugccacaaugcccagcuaguuuuuaaauuguagagauaggucucacuauguugcccaagcugguuucaaacuccugggcucaugggauccucuccauuuggcuucccaaagugcuaggauuacagaugugagccaccaugccuggauaagaacauuagacuucucuuaccauuuuuuauaucuaaguggaauaguauaguauuaugugucaguguugaauuauuuuaaaauauuaugcacugaaacaugcuaauaaucugggucaguuucuaucuugaccuaggcuuaaacauauuagcuaacgugaggggccuaaaauuaauauugauuccauaccaucuccuuauuuauuuauuuaguuuuugagauagaguuuugcucugucgcccuggucggagugcaguagcgcgaucucggcucacugcaaccuccgccucccguguucaagugauucuccugccucagccucccgaguaccugagauuacaggcgcccaccaccaagaccagcuacuuuuuguauuuuuaguagagacaguguuucaccauguuggccaggcuggucucgaacuccugaccucaagugauccaucugccucagccucccaaggugcuggcauuauaggugugagccaccgugcccagccacugucuccuuuuuuaacauuugguuuacaaaaaauuguuuuguugucauauacauaacauucauuuuuagucaaugggagguaaagguuuuaaauacauuuauauacuuuucuuugcauacauagauauuaauaugauggauauccuuacaacaccaucaauggcaaaaccuagacaagauuauucaagaaccccaggacaaguguuaucgcuuaucagcucguugggauuuguaaguacuugagaagaaaauuaacaugacauaccccuucaugaucaccacuuaaaauuuaaaaucaccuuuaaaaaaaaagaucaaaauagauuuaaauaucaagcauuuggauuuacuuuaacaguuugucuacuuaggugguauaacagucuauguacuuaggugguguuuuggggaagguaaaccuguuguuuuuauuuuucucuuuuuaauagaacacaccaauugcagaaaaaaaucaagacccugcaaacauccuuucagccugucugucugaaacaucacagcuuucucaaggacucguaugcccuaugucuguagaucaaaaggacacuacgccuuauucuagcaaauuacuaaaaucaugugaguauaaaagaaaagguaggccaggcgcagaggcuuacaccuguaauacuaccacauugggaggcugaggcaggauuucuuucuuuuugagacggagucuuacucugucauccaggcuggagugcaauggcgcgaucucggcggcucacugcaacccaggaguucaagaccagccugggcaacaaagugagacuucaucucuacaaaaauuagcugggcauguuggugcacacuuguggucccagcuacauuggaggcugaggcaggaggaucgcuugagcccaggagguugaggcugcagugagccuuaauagcgccauugcacuccagccuuggugacagagugagacccuuccucaaaaaaacaaaaaaugccccaaaauucaaaacauuuugaguaccaacaugacacccagcaguuugggcagccgaggcgggcggaucccuuaaggucaggaguucgagaccagccuggccaacaugguaaaacccugucuuuacuaaaaauacaaaaauuagcuggucgugguggugggcaccuguaaucccagcuacucaggagguugaggcaggagaaucgcuugaacacaggaggcggagacugcagugagcugagaucauaccacuguacuccagccugggugacagugagacugucucaaaacaagcaagcaauuuaccauuauuuauuugcuuuauccaguaguauuuuuuaaaaaucccuuguaaguguguauaauugacauuuguaagcgcauaaaccucaguguuaauaaauacaaguugaauuaaauacaaguguuaaauuaaauacaaguugaauugaguaaauguagucauauucuaaccuuauagcacgucuggauauaccacaucaauaauguuccuuugucaggaauggguucaaauuggaugauagcuauuccaaauugauuugcuccuaguuauacauuaauuuggugguucauaccuguaaguacagcacuuugggaggcugaggcgagaggaucacuugaacccaggaguuugagaccagccugggcaauauagugagacccccaucucuagaaaaaauuaaaagcauuagccagauuuggugguccucacgacucaggaggcugagaugagaguaucgcuugagcccaggaggucaaggcugcagugagaguaaucauaccacugcacucuagccuggaugacagagggagauccugccaugaauuagucaaucaaucgaccauucccuuguucuuauucuuuacugaaugaacguuaaggggauuuuguucgguucuaacuuucauagcaguacuugugucuaaacauagugggauauguuuagauauauuaauaguauauguaucuaaacauaaugggaagcaugccagcuguucuuguggacuagauaguguuuacaaagaaauaguucugauauguaauucuuaauacauauuaauauguaauucuugauacuuugcuuaauuauauguaaagauucagguucaguaaggaacuaagaaagcuguaacauggaauucaauauugucucuucucuauaggucuugaaacaguugccuccaacccaggaaugccugugaagugucuaacuucuaauuuacuccagucuaggaaaaggcuggccacauccagugccaguagucaaucccacaccuucauauccaguguggaaucagaaugccacagcagucccaaaugggaaaaagauugccagguuugagggacauuuaucuuaaugaaaaucaauuauguaugucaaaugaaugugagaaauauuauaccuuuucauauaaauuccauaaagaaaugaaauuguuacaugaauggcagucauaguauuaaucagaaauucauuuuccugcacauucugucaaauucuuuugaaauauuucauuucucauucaauugugacauuguucuuacuugauuauauaaugagauucuugcaguaaauugauaauaaaugcuuggcuucuguguaucuagguggaccucacuuguuuuuagaaguccuucccaugauacagacauuggcuuguugguuuuguuuuauuuuguuuuuaaccuaugucauuuaaaaacucauauuaccuccuucuauacuguuuccugucaguuucuuguuuaauggaaugguaacucuucuggaucagaaauaacuuuuagaccggaaagguaacgugggugugcccuuaaagugucuguucugaggauauugcuugccaaaugaauggacuuacuuaaagucacuuuacuuaacuuacauauuguuuuugccuuuuuaaacaguuauuagagcuaagcccuuaaagugucuguucugaggauauugcuugccaaaugaauggauuuacuuaaagucacuuuacuuaacuuacauauuguuuuugccuuuuuaaacaguuauuagagcuaagagauacuaaaggugguaggaacuaaaauuuaaaaucauaauaagguuuccuucauagaaggcugauaaaauaaugauagauuaggauaacacuaauauccaaagaauaaaccuuuuauuugcuaaaauaauuuugauucuauuugcugcuuauucucagcaauagaauuuuauuauuauuggauauuuguauucuauaagcaagaucaaauuaacguuuaacuaaggcagaguuucuuaaucuuuuuuccuucugucuuuauaaaguaaagguacuauaugcugcaagauaaacagauuuccauucccaguacuauuacugcacuccuuuccuauugaagaaaacauauuguuuacuauuucaaauuauacacagcuuuacuauccucccacuucugcaucccugagggaugcaccgaugggauuauaguggugcuucucaaguuaugaucagaggaaugauaaggcacccucugaaaaaccuuacacugauccccacaugcaucauuuucugugcuuacagaucagugagauauaauucaagaauauccuuuuuuaggccaggcgcgguggcucacgccuguaaucccagcacuuugagaggcuaaaguggguagaucaccugaggucaggaguuugagaccagccuggccaacauggcaaaaccccgucucuacuaaaaauacaaaaauuaacugggcgugguggugggcgccuguaaucccagcuacucaggaggcugaggcaggagaauugcuugaacccgggaggcagagguugcagugagcggacaucaugccuccagacugggcaacgagcaaaacuccaucuucaaaaaaaaauauccuuuuugcuugagacuaaaugcucauuauuauuacuaaguuaaugauaguuaauaaaguuuacuauucauuuacacaucaaaaauaagcacuauuagaguuuacugaagacucacucuacuugacuaaucuuguaaaaaucuugaucaccaagcaccaauuugcaauauuauauacaaagcugaguacccacaaauacccacagauaguuggaauucagaaaaaaaaaucauuauuaaugcauuaucaguucaucuuguugacaauggacuuuaauuucugcucuuugggguuuguaauuauuaauuaccauuaaugucauuucauccuuaucagcuugguuuuuuaauacuuauaugaagugauauauauuuacacugacaauauuuuaggucuauaauuuuucauugacuaaauuucaagcccugugcauuuugcaguucaaaacagaaucauccaggccaggugugguagcuuacaccuguaaucccagcacuuugggaggccuaggcagguggaucaccugaggucaggaauuugagacuagccuggccaacauagugaaaccccaucuccacuuaaaaaaaauuaugcaaaaauuagccaggugugguggugugccccuguaaucccagcuacuugggaggcugaggugggagaauugcuugaacccaggaggcagaggcugcagugagcugagaucgcaccacugcacuucagccuggacgacagcaagaccccauuucaaaaaaaaaaaaaacagaaucauccauauaccuauugcaaaauagauauguacguaaugcagccuuaccccaaaaugugccugaauauguugccuguuaauuuguccuguuuaaguagccugugauauacaaucaaaauaaguauuauagaauaauuuauuuaaaguuuagaccguuucauucagaauaauguauauaagcuuauaauugcuuacauugcuuuuuaauucucuguuguuuauuuuuuccauuugaaaguggcaacagguagcauaauaguuuauggggucauuuauccuaccuuaacggaccauaguuaaaaggucaaugaaucucagcuuuauauaacuaaaacaaauauuuuuuucccucuuaggaaagugaugaagcauugggcccaacaaugaugaguuggaaugcaguugaaaaguuaugcgcaaaaucugcaaaugccauugagacgaaagguuucaauaaaaaggaucuggaguuagcucuuucucccauucauaacagcagugcccuucccaccacuggacgcucuuguguaaaccuugcuaaaaaaugcuucucuggggaaguuucuugggaagcaguagaacuggauguaaauaauauaaauauggacacugacacaagucaguuagguuuccaucagucaaaucagugggcuguggauucuggugggauaucugaagagcaccuugggaaaagaaguuuaaaaagaaauuuugaguugguugacuccaguccuuguaaaaaaauuauacagaauaaaaaaacuuguguagaguauaagcauaacgaaaugacaaauuguuauacaaaucaaaauacaggcuuaacaguugaagugcaggaccuuaagcuaucagugcacaaaagucaacaaaaugacugugcuaauaaggagaacauugucaauucuuuuacugauaaacaacaaacaccagaaaaauuaccuauaccaaugauagcaaaaaaccuuaugugugaacucgaugaagacugugaaaagaauaguaagagggacuacuuaaguucuaguuuucuauguucugaugaugauagagcuucuaaaaauauuucuaugaacucugauucaucuuuuccuggaauuucuauaauggaaaguccauuagaaagucagcccuuagauucagauagaagcaucaaagaauccucuuuugaagaaucaaauauugaagauccacuuauuguaacaccagauugccaagaaaagaccucaccaaaaggugucgagaacccugcuguacaagagaguaaccaaaaaauguuagguccuccuuuggaggugcugaaaacguuagccucuaaaagaaaugcuguugcuuuucgaaguuuuaacagucauauuaaugcauccaauaacucagaaccauccagaaugaacaugacuucuuuagaugcaauggauauuucgugugccuacagugguucauaucccauggcuauaaccccuacucaaaaaagaagauccuguaugccacaucagguauauuuauaacuuucuaauacuguuuuuuggauuuuagaaaaacuaugaagacagacauuugccucuaagcuagacuaugcgguauuaaucauauaguucuguucuucuuguugagaaucugugggcuguuggaaguuuucacccagaaaaguaaagcugguagaaaucauguuuauuauuuuuagcuguaaugccuccuuccauuugugucguuuuauguacuuuccuaagaaaauacaaucacauauuuucacuugauccccacaguacuaugaguuacaaaauuaauuuucacuugauccccacaguacuaugaguuacaaaauuauuauuauuauuauuauuauuauuauuauuauuauuauugagacagucucguucuuuugcccaggcuggagugcaguagugugaucuuggcucauugcacacuucacccccagguucaagcgauucuccugccucagccucccaaguagcugggauuauaaggggcccaccaccacaccuggcuaauuuuuguauuuuuaguagagucggaauuucaccauguugcccaggcugaucucaaacucgugaccucaagcaauccgcccaccucggccucucaaagugcuaggauuacaggugugagccaccucaccuggccagagauaauuuaaguccgcucuaccuuacugccuuccaaggacauauuuagaugaucucuucuuaagagaauaaaaguugaaaaauauguuucuuuuuuuuuuuuuuuuuuuuuugagacaaagucucgcucugucaccaggcuggagugcaguggcgcgaucuuggcucacugcaaccuccgccucccggguucaagcgauucuccugcuucagccuccugaguagcuaggacuacaggcaugugccaccaugcccagcuaauuuuuguauuuuuaguagagaugggguuucaccacguuggccaggauggucucgaucucuugaccuugugaucugccugccuuggccucccaaagugcugggauuacgggcaugagccaccaugcccagcgaaaaauauauauuucaaagcuuacucucuauauucuaaaccuuuaccaacccaaaguuuuacuuuuuuucuuccuuugggaaaacaucauaacauaaaauguguaaccccugaauuuauguuucgaaacuugaguuuucuacccaagacuuacuauuaaaugacuuagaagucccuuaaccucagaccugcaauuuuucuaaaugucuguaagggauaauggcaccugucuugcuggucuuacaaaguuguugugaaugccaggcgugguggcucacaccaucuuugggaggccaaggugggaggaucaccugaggucgggagaucgagaccagccugaccaacauggagaaaccccgucucuacuaaaaauacaaaauuagccaggcauggugguguaugccuguaaucccagcuacuugggaggcugaggcaggaaaauuccuugaaccugggaggcggagguuguggugagccgagaucgcaccacugcacuccagccugggcaacaagagcgaaacuccaucucaaaaaaaaaaacuuguugugaaauaacaaauuauccuaaaaauuuuuaaaugcuauuuaguacaauagguuauauguaguucugucuuacguguugucuuaaucauuuguuagccauagccuuccucaguggcucuucuuaagcuuguauuaguccaugcuaucagucuucuugcagauuuuuucacugaacauuuuucuugcagauuuuuuuuauuguuucuuaucuagaucuuauuggaauaaucaguguugucuaagcuuuugaacuucaccagauaaaaggacuuuuucauaauuauaacuaauuaugcauucauuuucaaaacuuaucaaaaauuugacuacauccuuuacgccuaguagccuaugagcuaguuauuuggcuuguguguuucaccauuuucuauucgguguaaaaggaauuaagauauuuguuaucucuuaaacccuuuuugaauuagcagaccccaaaucagaucaagucgggaacuccauaccgaacuccgaagagugugagaagagggguggcccccguugaugaugggcgaauucuaggaaccccagacuaccuugcaccugagcuguuacuaggcagggcccaugguaaggcaugcaugucuugaguuuuugaaguguuaucuaucacuacauuaucuuucaagguuaaauuuuaaaaaauuucuucaguacuuacguuaccuaaaguaaaagaaaaugaacucaucuaguauauauauggcauuugucauaggaaaauaaacuagcaguagccauggcugucccacucucugaauguaaaagaccagaugcuggaguacauguagucauuuguccuuugccuucugguucagucucaauguuccagagaagccccaccugccacccuugauauuaucuuaucucuuuuuuuauuuuuuuauuuauuuuuauuuuuauuuuuugagacagaguuucucuuuugucacccaggcuggagugcaauggugcaaucucggcucacugcaaucucugccucccagguucaagugauucucuggccucagccuccugaguagcugggauuacaggcauccaccaucaugcccgccuaauuuuuguauuuuuaguagagacaguuucaccauguuagccagacuggucuuuaacuccugaccucaggugauccucccaccuuggccucccaaagugcugggauuacaggcgugagccaccguacccggccuaucuuaccucuuaauguuucuucagguuggauggaguuugggcucaggaccacaauguugggucuaaauuucuguucagucuucagaagccuauuccuguuuagaacuuauucucaguuauauccuuaccagaagagucaagccagaaaugaaccaucauccuucaaaacagaacauaaguauagaaagauagggcugguuacgguggcucacgccuguaauccuagcacuucgggaggccaaggcagguggaucacuugaggccaggaguucgagaccaagcuggccaacauggugaaaccucaccucuacuaaaaacacaaaaauuagcugggcaugguggugcaugccuguaauuccagcuauucgggaggcuggggcaugagaauugcuugaaccugggaggccgagguugcagugagccaagaucgugccacuacacucgagccugggcaacagagcaagacucugucuaaaaaaaaauaaaaauaaaaauaaaaagaugacauuuucaccuaucuucuuuucuucccuuucucucugaaaacuguucccuuccugcauucugaaaugaacuguauucaucuuccuagggaugcuguagcacaaacugggugucucaaaccaauaaaaauucauuguuucacaguucuggaagcuagaguuccaaaaucagguguccacagggcuauacuaccccugaaaccuguagggaaauccuucuuugccucuuccuggcuucugguggcuugcuggcaauccucaguguuccuugacuugaagaugccucauuccaguucucccucuuucugugaugguguucucccugugucucuaucaucauagagcuggcuucugagaaggacaccagucauuaggagcccaucuuacuccaguaugaccucaucuuaaccuaaucuuaaccuaauuaaucauaguugcaaaaacccauuuccaaauaaggucacauuuuuagguacggguuaggacuuaaacauagcuuuuuugggagggacacaguucaacccauaacaucaaccucuucuacauguugauguuaguuacuucccuuuucuuugagcucuuuucaugaucaucuguuucauccuccccaccccaccucucacacccuuucuucuguuuguauuuccuugccggcuuuuauccucagccugaaaauaaguuuccacccuugucuccccaacauugccuaacuucucaaagguuuccucuuuguuugauuauuuugcucuggcaacuuaucaucucacuauuuaacugaaaauucuuuuauuuauuauuuauuuauuuauuuauuuagagauggaguuuugcucuuguugcccaggcuggagugcaguggcacgaucucagcucacugcaaccuccgucucccggguucaagauauucuccugccucagccucccgaguagcugggauuacaggcaugcgccaccaugcccggcuaauuuuguauuuuuaguagagauaggguuucuccauguuggucaggcuggucucgaacucccgaccucaggugaucugccugccuuggccuucugaagugcugggauuacaggugugagccauggcgcccggccuaacugaaacuucuuaaugggcaccagugauuuccuuauugucaaauccaauugucucuucucauuccccugaccucuguugcugcucuucaguuccuuccuuaccucuucuaaauauaguucuuggagauucugccuuuacccuuuuugcccuacacgugcuccauguucaucucaucacucccaugaugucaguuugucaccuccauguugaugauucccaaaucucugucucuaauccugacuuucucuaggcagcagacagacagccaaucuggcuauucaguauucuacugaucuuucaaauguugggucucaaaacuggacuuguggggccuggugcuguggcacauggcuguaaucccagcacuuugggaggccaaguuggguagaucacuugaggucaggaguucaagaccagccuggccaacaugguaaaaccccaucucuacuaaaaauacaaaaauuagccaggcgugguggugugcaucuguaaucccagcuacucaggaggcugagacaggagaaucgcuugaacccgggaggcggagguugcagugagccaagaucgugccacugcacuccagccugggugauagagcaagacuccaucucaaaaaaaaaaaaaaaagaaaacacugggcuuguuacccagcuagcucuuccucuguucccuaccucaguuucaucaccuucauggugacacaaucuuuguuccuacauucaagcauuuaaauccagccaauuagaucucugcagcauuucaccucucauuuucuucucugccacuguucucuuuaagaacucaucuuucucuuuuauuauuuuagugcccuucuaucugaucucuucaacuucaucuuauuaucaauaaucauugccaccggauuuuucuuccaaaaccaucacauggcuuauucuauuucccuucucagaaaacuacaguggcucccucuuagcugcuaaguaaaauccaaauugaucacgacauuugagguuauagcucucauaccagccuugucucucaaagagucucuuuauaugccuuauguucccauuccauuucuuaaauacauuuaauuuucaggucuucccuauuuugcuuguguauuaaaccuuauuugagcaaagccaguuuccuaguaucuuccagucaaauuccuucucauuucaucauuucaaauguuaccucuuccauaaagcaucccuugaucaacuacugggaauuauucacuucuauguuaccuuauuagaaacuguuuaaaauuuaugccauucuuccuguguuguaacuaauuguuuauuuaucuccacuacaaaagcuuaagaaaacuuuuugaggagacugugaguuuucuuucuuuuuucuuuuuuuuuuuuuuuugagacagucucagucuguugcccagacuggagugcaguggcgcagucuuggcucacugcaacucccgccuccuggguucaagcaguuguuugccucagccucccaauuagcuggguuuacaggcaccugcccccaugcucggcuaauuuuuguauuuuuaguagagacgggguuucaccaucauggccaggcuggucuugaacuccugaccuugugauccacccaaaguguucagccucccaaagugcugggauuacagguaugagccaccacacccagccaagagugugaguuuucugccuucugcauagcacuccugaauuccuuggaagcacucaguaacugauauuaauaaucucuacaauauuggcaauagacauauuuaguguuccucuuucucgcuuagccaaagcaaguaaauuccuaugagcacugauuuuuauauagugccucuuuugcucugucacagauuugcuagcccauuuucuguauuauaauuugcauuaucucuaacuuaggacacagugugaaaguaagcuucaaacauaaagauguauuuuauagcaucuugccacuauuuuagugagacaucuagcucccucagcuaaacaacaugcugacaacaugcugaggcccagccaugaccuucuugaugccccuccaucuugccucucagccgagaugagccagggagucuguccugaguuuuccguaacuuuaugugcaccuuuuuguuucagcuuaguguguuaaaauugucuguauugucucuuccagaguaggcugguuucucuuugggaaaagagauuuuucuuaaucgucuuuguauccuuuauaucuggcacaauaccuggugcccaguucagugaaugaugagggaagggacucuaauaauuuuaauacaguguaccuaacuacuguuuucuuacaugcaggauuucugacuuccggugagugagcuucucuauaaaguaaugcggcaaagcacauuaaacugaacagucaaaguauaacuagaucacauugcauaaaaaacuauuuuuccuuuuagcucacuugugaaauacaaaaaugaaccgucuucuguuuucugagcagcaagacauccagagaggugguucuucucugugaaaagaaauauaggccugaggcguuuuucaucaacuuuuaaagguagcacagagugaagacgcagucuuuuuuauuauaacagaaaaaauaguauugauacaaauauuaaaaauggcugggcacuguggcucacgccuguaaucccagcacuuugggaggccgagucaggcaggucaccugaggucaggaguucgagaccagccugcccaacauggcgaaaccccgucuccacuuaaaaaaaggauaaaaauuagcugggugugguggcuuauaccuguaauccuagcuacucaggaggcugagguaggagaaucacuuguacccagguggcagagguugcagugagcugagauuacaccacugcacuccagccugggugacagagcgagacuccaucucaaaaaaaaaaaaaaaauugacaacuacagaagggcucuaauuuuccaaaucuuuucauuuuauuaucauuagaaaauaaaaaaguguaacaauaucaacauaucccuauaaacuaaagaaaugaguuuugaauuagaaagccagcaauguaaaacaaaucuguucuuuuucuguggcuaauaacauauaauugcaaaguuuuauuccauuaugugaucuuauuagacuuugacuuaaguauauggguauguguggcauauccauagagaaaucauguauuuuuuuuuuuuuuaacacaaguauauuuuggcugagcugguaaaaggggccuaauuucuaaccuaaguaaaauaaggaaauuuuuuuuuucuaauuccccccuacuuuucuguuauuugguuacauuaucuaauccauugggauaauucuuucucagugcugcuugaaaggccuacuaacugaggugguuuguauguuuuuauaguauuauagaaauagaagccuauagaauauuugcauuuuguauuccuuuaagggaagaugggauuauauggcucgcagguaaaauggcacucuaaaugcaugcagcuauuuuuccuaaaaucagauuccacaaugcuuuccuaguugucuuaaaaugcagugguggcaguuguuuaaccacaguaaagaauuuugugaaguugucuuuaaagaguaacuuucaggcaaauuuagcacuagacuaggaugccuauucuuaauuuauauugaaguuauccauuuuugaacuaaaauuaaccuuuucuuaggaaacacuuuguucauagaacuaaaguauaaaccaguuuauaguuuauaagaucauauuuaaaauaaucguuaaaaacaucuuuguggccaggugcaguggcucacgccuguaauccaagcacuuugggagacugaggcagguggaucgcaaggucaggagaucgagaccauccuggcuaacacagugaaacccugucucuacuaaaaauacagaaaaaaauuaucugggcaugguggcaggcgccuguagucccagcuacuugggaggcugaggcaggagaauggcgugaacccaggaggcagagcuugcagugagcagagauugcaccacugcacuccagucugggugacagagugagaguccgucucaaaaaacaaacaaacaaagaaaaaaaacuuuguauauaaauuuugcauccaaugaauauuuuauuuagaaaucaguuuuaccuauaucuuaagacaucuccuacuuaccucuugaaaccauaguuuaagugaauauucuuuguuaaacuaauuugucccucucuguuccuaaaaggaauaaagccacauuaaaauacucuguaauuaaggccuucccuaguuaccaggcuuuccuccaauuacuauaaauguugcugccuuaucucauaccuugugugggauacagaauaaucauguaaauguuuacauuuccugauaugaaauugaguaguagucugccuauuuuagagaauaauuuuaggauuuaagauacauaacauauccagaauaucagaaauuauuaauaaaugaaaaaaauggcuuuaucuucucuuuaaccagcugugguaauugguaaucuaaacuucuuggaaaauaaagaggaaagcaguugucacauugcccaagugaaaacaauguggguuuuugcacuuuugauuauaccaaaauguucacauacuaauguugcagauagugacuaucuggggcugauggcgugggcaauaaaggaauugaugaagacaguuguagguaaagaaaggcaaauuuauuagacgaaguaggaaaauacauuguaagguuguaacgagcaagucaccaagaggggagcugaucacaaggcgacaagggcuugcuagagauguuacagggcggugcuugucccggagaaggccgcaugcugcgcugauaaugccaagguugcagugagcuaacucgcauuuuucuuuucuuuucuuuucuuuucuuuuuuuuugagacagagucuugcucugucgcccaggcuggagugcaguggcgugaucucggcucacugcaaccucugccucccagguucaagcgauucuccugccuuagucuccccaguagcugggauuauaggcaugugccaccacgccuggccaauuuuuguauuuuuaguacagacaggguuucaccauguuggcugggcuggucuugaacuccugaccucagguaauccacccuccccagccacccaaagugccaggauuacaggcauaagccaccgcgcccagcucuaccuugcauuuuuguaucaaucaagggucuggugauacgugggcacaggacaauugugaguuauuuguacaggagggcugugcguccuggaccaugaggaaaggcagacuugcagcuuaucugcuuuuucuuuuugcuucccccugguccuaccagccuaacucguuuucccuaauuaggacuccacaauuaauauuucuguucaucaaauauuuguagagaaugcuugcaacuuuagcuguuuccucuucgauuacagguccugcgguagacuggugggcacuuggaguuugcuuguuugaauuucuaacaggaauucccccuuucaaugaugaaacaccacaacaaguauuccagaauauucugaaaagaggugauucuuuuucuccuauuaagauagucauuuacuggcugggcauaguggcccaugccuguaaucccagcacuuugggaggccaaggcggguggaucgccugaggucaggaguucgagaccagccuggccaacaugguaaaaccccaucucuacuaaaaaaaaaauacaaaaaauuagccaggcauguugacgggcgccuguaaucccagcuacucgggaggcugaagcaggagaaucgcuugaaccugggagguggagguugcagugagcugagaucacgcuuuugcacuccagccugggugacaagagugaaacuccaucucaaaaaacaaaaaaaaguagucauuuaucucuggauacuauuauuuugagcaguaauaaacaaguuuauuuguauauguauaauuuuagauaucccuuggccagaaggugaagaaaaguuaucugauaaugcucaaagugcaguagaaauacuuuuaaccauugaugauacaaagagagcuggaaugaaagguaugguuuuguguuaauacauuguuuuaccauugauuuuuugcagauggugaauauuuauaaaaauagcaaguucuggcugggcgugguggcucacgccuguaaucccagcacuuugggaggcugaggcgggcugaucacaaggucaggaguucaagaccagccuguccgauauggcgaaagcccaucucuacuaaaaaauacaaaaauuggccgggugugguggcucaggccuguaauccaagcacucugguaggccgaggcaggcggaucacgagaucaggagaucgagaccauccuggcuuaacauggugaaacucugucccuacuaaaaauacaaaaaaguaggcaggcauaguggcgggugccuguagucccagcgacuugggaggcugaggcaggagaauggcaugaaccugggaggcagagcuugcagugagccaagauugugccacugcaaucuagccugggcaacagagcgagacucccucucaaaaaaaaaaaaaaaaaauacaaaaauuaggcccagcgugguggcgugcaccuguagucccagcuacucuggaggcugaggcaggagaaucgcuucaacccgggaggcggacauugcagugaccagagaucacaccacugcacuccagccugggcgacagagacucugucucaaaaaaaaaaaaaaaucaaguuccaauauaauacuacagauaaucugacugcuaaauugguacaaagauaauucgauuuauuucuccccucuagguaugcauugauauauugguccuuauucuacaugaaaauucaaugugucacaugguagaagaggcaaaaaaaauuuaguguggucaaauggcaauacuguauucaugcauuagauuuuauuaaucggugggugugguagcucaugccuauacuccaagcacuuugggaggcugcagcuggcaaucguuugagcucagggguuuguguccagccugggcaacauggugaaacugucucuacaaaaaauacaaaaaauagccaagcaaggcagugcgcaccuguaguuccagcuacuugggggcuuaggcaggaagauuacuugagcccaggaggucgaggcuacagcgagccauguucacgccacugcauuucagccugggaaacaaagugagacucuggcucaaaaaaaauuauuuaucucaaguaucuaaaacaaucuuaccucuuuuuuuuuuuuuuaacauacguuauuauugcuauuuauuuauuuaaagacagugucucacuauguugcuuaggcuggucuugaacuccugggcucaaaggauccucccaccucagccuccccaaaaugcugaauuacaggugugagccaccuugccuguccuaaaacaaucuuguuagugucuuggguuuuucaaagccugauaaaguuaaggaaauacaggaaaucuuuuuuuaugaaacccucuguucugucauuuuuaaaaacaaauuuauuuucccuaaucuugcgagagagauguucuguaauuucuuauugcuucauuuuugauacuauuauuuauugauaaauguacuggaucccagguuggcucaagacaaacuugguauauuauauaccacucaguaguuuucucaaugcaggaguauauuaagcccuaauuuggaaacuaguaaaucucauuagcagcugccuuaaaauucuuuuguuguuguuguuguuguuguuguuguugagacagagacuugcucugucaccaggcugcagugcaugcaguggugugaucucggcucacugcaaccuccgccucccagguucaagugauucuccugccucagccccccaaguagcugggacuacaggcaugugccaccacgcccagcuaauuuuuguauuuuuuaguagagaugggguuucaccauguuggccaggauggucucgaucucuugaccuugugauccuccugccucggccucccaaagugcugggauuuuaaaauuccuuuuguaacgagguaugguaauauagagaaaagcauuacgucccaaaaugcauuucuuuaucaaguagaauguauucaggaaaaugagcuucagaaaugugucauuugcaucagcuucuagguguucccuguaauaauuucuuucuuuuuuugguuuugggauuuuuuugagacaggaucugggucugucgcccaggcuggaauguaguagcacaaucucggcucacugcaacuuucugggcucaagcaauucuuccaccucagccucccaaguagcugguacuacuggugcacacuaccacacccagcuaauuuuuguauuuuuaguagagaugggguuuugcuguguugcccaggcuggucucgaacuccugggcucaagccauccgcccaccuuggccucccuaaguacugggauuacaggcaugagccaccacgccuggcccaguuuguuuacucacugauuuaaccaauccuauagagugccuucuaggagcuaggugauauugcuucaggcccugggaauacccuagggaugaucuagacucagaucccuguccucguggaacuuacauucuaguggaaagagagacagugaacaguuacagacacaacauaaugucauguagugguaaauacuaggaagaaaaauaaagcagggugagaggauaugaagugauggcacgagacuucuuuuuagacaguguggucaggaggaccucugugaagaggggcauuugagcagaaaccuguguaaagugagggagcagacauuuggaaagucagcucuagcuuuuucaaggcacuucagacuuagauuauacuacuuaaaacauauaaacacacacacguuucaacuucugaugcuguacauuggauuuggacauacugaguccuuguaguauuauuucagaauagaugugagugucugaaugcaacauauuggucagauugccauuauaaaaaacacuaucacauauaagaaggauuuuuuuuuuuuuuuuuuuuuuuugagacggaaucucguucuguugcccaggcuggagugcaguggcaugaucucggcucacugcagccucagccucccagguucaagugacucuccugccucagccucccaaauagcugggacugcagcugcaucccaccacaccuggcuaauuuuuguauuuuuaguagagacgggguuucaccauguuggccaggcuggucucgaacuccugaccucaaguaauccgcccaccucagccucccaaagugcugggauuacaggcaugagccauuacucugcccaaaagagcauacuuuuauuuuacuagguagaaggaaauaggaacaaugacagguaaugaaauggcaguaaagaggugaggaaggcuuugaaaucuuguaagcagagcagcucagugauauagagcuuccaauguagccauaagcuagaagucaauauguuguagagaugcaagucagugaaaucaaggaagucaaagaaccaugaagagaacgugucagaacugucaucaguaucuauucuugaagucaccaugaaggauaaggauggagcacagggaagaaagggagaagggggugagcuucaugcuaaagcugucuagggcaauagauacugcuaaggagcguggugauagaaacagguggcaaggccuuagagucaaaacuggagcauucaucauggaagaucaauggcauggaagguuuaucaaggagcagaaaguaggccacacucucuuccccugagucagggauucuuuaacaagaugcaggcagggugggcgcgguggcucacaccuauaaucccagcacuuugggaggcugaggcggguggauccccuggggucgggaguucgagaccagccuggccaacauggugaaaccccaucucuacuaaaaauacaaaaauuagccaggcuuggugguacacaucuguaaucccagcuacucaggaggaugaggugggagaaucgcuugaacccgggaggcagaguuugcagugagccgagauugugccauugcacuccagccuaggugacagacaaaaaaaaaaaaaaaaaaaauuagccaggcaugguagcacucaccuguagucccagcuacuugggaggcugaggcacgagaaccacucaaccugggagauggagguugcagugagccaagauugcaccacuacacuccagauugggcacuggagagagacuccauuucaaaaaaaaaaaaagaugugagugccgggcauggugacucacaccuguaaucccagcacuuuggaaggccaaggugggcagaucaccugaggucaggaguucgagaccaaccugcccaacauggcgaaaccccgucucuacuaaaaauacaaaauuagccuggugugguggcacacaccuguaaucccagcuacucgggaggcugagguaggagaaucgcuugaacccgggaggcggcgguugcagugagcagagaucgcgccacugcacuucagccugggcaacggagcgagaccucgucucaaaaaaaaagcugugagaaagauaggcuucuaaguuaaggcaaaucauucauucugucauuaaacaaauacaaaccaggcaccugucauaugccaagugauauucaaaauggcccauguagaccuuugugaaguauguggccuaacagacauuaaacaaaugucugugaaacugacauaauaaaguaagguaaguuauaugugagacauucucuuuuuauaauaauuccuguaaagcaguacuuacuuagguaaugauaucauacuguuuuguuuuauauuuuuccuaagagcuaaaacgucauccucucuucagugauguggacugggaaaaucugcagcaucagacuaugccuuucaucccccagccagaugaugaaacagauaccuccuauuuugaagccaggaauacugcucagcaccugacuguaucuggauuuagucuguagcacaaaaauuuuccuuuuagucuagccuuguguuauagaaugaacuugcauaauuauauacuccuuaauacuagauugaucuaagggggaaagaucauuauuuaaccuaguucaaugugcuuuuaauguacguuacagcuuucacagaguuaaaaggcugaaaggaauauagucaguaauuuaucuuaaccucaaaacuguauauaaaucuucaaagcuuuuuucauuuauuuauuuuguuuauugcacuuuaugaaaacugaagcaucaauaaaauuagaggacacuauugagagugagccacuagcuugauuuucuuucuccucugauuucaguucacuguucaguuuagcauuaaaauaauaaaauaaucauacaguucc

SEQ ID NO: 191182 - RNA, 699 nt, Homo sapiens
uagcuggcaaaggcguuuaauagaaaugagaugagggcaggccgccccucccccgcccagcuagcgcaggaaguuccugggguagagcuggaagagcuuucccuccugugugggcucgaagccguacuuuuccagguugucagggucgaagguaccguccuugaaguccuuuucgauggcaggcgccacggcuucgcugaagagcugcgcggccgucaggggcgucuccucgcucucaggggcgagguagcucacguagggcuugagcuugaagccggucagauccgggacgacgaacuccgggaccaucuccuugaucugcacgaaccuccagcccgaggugaggaagccgaugcccuuggcgccccggcccuugcggccccugaagcugcgcgggccccgcuugcucguccacuugcucauucgguccgcaccccggaccaggcagcgcgccgcugcggccaggacgcccaugccgcgcccugcgggaggagagagcggguagucgcggccccgggaacccggccagccccgccccuggccgcgcgcggcgcccgccccaauccgacagacucaccuggaccggagaccccacacgagcuccaagcggccccggcuccggcgccaacccggccucgaccuugcuccgcuuccgaccgcugcgucgcagcaagagcggcuccgauuggccgcggccgc

SEQ ID NO: 191183 - RNA, 699 nt, Homo sapiens
gcggccgcggccaaucggagccgcucuugcugcgacgcagcggucggaagcggagcaaggucgaggccggguuggcgccggagccggggccgcuuggagcucguguggggucuccgguccaggugagucugucggauuggggcgggcgccgcgcgcggccaggggcggggcuggccggguucccggggccgcgacuacccgcucucuccucccgcagggcgcggcaugggcguccuggccgcagcggcgcgcugccugguccggggugcggaccgaaugagcaaguggacgagcaagcggggcccgcgcagcuucaggggccgcaagggccggggcgccaagggcaucggcuuccucaccucgggcuggagguucgugcagaucaaggagauggucccggaguucgucgucccggaucugaccggcuucaagcucaagcccuacgugagcuaccucgccccugagagcgaggagacgccccugacggccgcgcagcucuucagcgaagccguggcgccugccaucgaaaaggacuucaaggacgguaccuucgacccugacaaccuggaaaaguacggcuucgagcccacacaggagggaaagcucuuccagcucuaccccaggaacuuccugcgcuagcugggcgggggaggggcggccugcccucaucucauuucuauuaaacgccuuugccagcua

SEQ ID NO: 191184 - RNA, 33266 nt, Homo sapiens
cagagugaaacaggagugcuuuauggucugaguggaguguuugggaggagugccucccggcuccugccuucgggcucaccugagcgggggcgcagcugaggccacugugggaaacacaacccccacucccaggagaggccucacaugcugccuucggucucgccagccuucuagcguggggccugggccgcccuuuagggugagucugcacacccguguucagggcucccggccggaagcggaaccauaggcaugcugcggccccagaugagcgcggagggcaagcaggugccggggcagcgcacaccccacagccaagcggccccugcccagccucuguaaacagacccucacaggucccuccugggccucagucacaucccugagaaacacuggcggcucugccccgagagggccaggguguccaccgagccuggcugaagccagcuguccccucccuucuugcagagcaggcucacacugggccugaaggcccagcaccugcagggcccagccuggggaccaccaaugcccggccucuuccagcucagaagcgcacacggcagccacggggcagcggcaaaggcgaugguacagaggcaaaugccuccccaggcagugacaggcacgccccccgccccagggcggccacugcccacgccggccuagagcuccucguagucgccacccccaggguggcggccgcccggggccccgccccccaggaaagccuccagcucaucggcagccguccucucccugcugcgcgggggccgcugcugccgccgucgccgcuccuccuugcccuccuccuuguccuugcucuucuuguguuugcucuucuucuuggcagcuuuuucuucuuccugaggagcacaaggauggggcgccauggagucacaggaagccacagcccuggucccaggaccgcaugccacccaguccuggccugccaggaaggggaguagccaguaccucuuugccuuuuuucuucuucuucuucuucuccuuagaggggguuuugcccuccuuaccugcacagacaggacagacaguggcucaaacucaggccaacggggaccccaagcugggugacaggacuucucuagaaacucacaaagcagcgagccccagcccuccaggaggcccugcugauggacaggaccacacugcaaacaucagcuccugcagggggcugccaggagcauggcacagcauccuggacucaggagaggaccccggccagcggccagcagcugggaggaggcccacguucuacccaaacuccagcaggcugaccgcacucuggugcccccacccaccuuccucacugcucuccuuggguccggccuccuccagccccagcccgaagagguccgagucauucuucagucugaaggcggggagagggagcuuggggggugggggcggcucggcagggcccucauccucgucagucacaucggaggggucaucucgcacgggaaagucauccuggagcagggagagcaacuggucaggccaucaucccucccacacccccagggguugugggaucucaaaccaggccggcaaggcccaaguguggggacaugagaugccucuuccagaagccuccucccacugcacccacccagaucaggccugugggagggacccuggccaccuggcugaccucugccccgggaggacucgucuuaccgcccugcgcugugugucugaucccucgcucucaaagucggggucauccaugacgaaggacagcauuugugcagcaaugggucccucggggucacucuccgacgaggaggccugcucacccuuccccggcuccaucucagcagggggccuggugcugcugcgcuucuccggaccugugcgaacagagacaccgccuggccaggggggugcugcgguccucgugggagcugucccccuccguggcuucgaagcugguauggaggaccuuuguggacaagcagagggucagucaggguccucuggaggcguccugaacugccccacccgggucuccaggccgcacccguggggacaccugcccuuaccacuuggucucuggcucugagcacugcuggggagcuggggcagggccuuuugugggagcugccacuucugcuuccuccucacucgaaagagugaugucuugacuggggacggggccugcaggcagcgggggacucccacguggcuggucuucgagguccacaucguccuggaacccugccaccaucggguugccgcccagggccuccccaucacugcaaagcagggggcaaagcggucaagggccacgggguagggauggcuggccgggcucacgggccuugguucuaggcgcccugguacccagcacacccuggccguggggccaccccaccccaggugcuguguuguggagaggcccccucauggucacagggcuucugagcaggaaggggucgggggcacaagguuggacacagugcugcccugcggccgcucagugggugaaggauguggagccgcacaagugggcgcucguggaggaggcgggcccagcucagggccacggggcuuucuguccuuuguguauuucuggaggaagccgcugccccacagcaaugggugaggcugaggugcugaggccacuguggguggagcuuguccagggcuguccugggaccaaaugcagggcuuugcugcaggcaaaauuuggggcagcuuggcagacagaguggugggaggggcuggcagauggcuggggaggcggcucuagcucccagcucuaggaccugcaggaagccgccccugucucugcagcaccuggauccuggcccuguggagaccacaucugguggccugaaccucccauaugaccugcaguggccucuccaauggcuuccauguggcaucugcccacagaagaccccaaggugccccuguccucuccagggugugggcagagcagguggccaggccuuucugaugucuggaagccccguccaagcccuucccucgucugcuccagccacagagcugcucuguccucagccaacagugaccagccggcggggggccccuucugcgccccuagaaagccagccccaccugcugcucgggcacccuggaggcuggggggcaaugggagaggaggcccaggcccaccccucaccugucgcuguccugcugggcagccuuggcccccaccuucuucucgucccuggcggggguugugucuuccaggaagcugcgguccaggcggucgucaggaacaaaguccuccacacucuggaccguugcugggcccucugcggccgggacuggcucugugaacagugaugccggguccucuucacucggcaccagaacccucacugcacccaaccccaagccaggcccacccgggaugugcccacgggacugggacaagcaggaagaagcguggagcgcuccgaaauccaggaccccaccugugagggccugggggucugggaccaguuugggaggggcagcuccagggccuaccuggagguggaggggcugccucgguggcaggugacgucccaaacagccuagagaugaugcugcgccguggggcgggggcugaggggcacgcaggugggggcagggccucugagggugguacagggggcacagaggaugguggggcggcauugaggggcagcuguggggcgggcuggggugugccggggcuggagcuccccguggacacagcgccugcaggcaccacuggugacugggagcccggggaugggcucugcccguuggccgccaguggggacgcauggccacggcugcgagccuccaucaucuccaggaagcugaaaggcagaaggcgggugagaagccuggcuccccugccucucccugaggcccucaggugacagggggcucucugcugcugcugcuggggcugggaagagccacuguguucugggccacccgccccacagaggccaucauccccauccacuuccaagggcagcagugccagccaggcacgguggcucaugccuguaaucccagcacuguaggaggccaaggcaggcagaucacgaggucaggagguggagaccguccuggcuaacgcagugaaaccccgucucuacuaaaaauacaaaaaaaauuagccgggugugguggcgggugccuguagccccagcuacuugggaggcugaggcaggagaauggcgugaacccgggaggcggagcuugcggugagccgagaucacaccacugcgcuccagccugggcgacagagcgagacuccaucucagaaaaagaaagagcagcagugccaaaggguggggacagcaggcaccagcguacauguguccagcuccccugaaagucacuucggaucuguucugaggcacagcuguugggggcuccaugcagagguggccagauggcagcaacuggaccuucccgugagcggggguuucugggaagaggagggggcuggggcuugguggagcacgugcggccaucgcagcauccagcugacccaacucucaggcccaggaaaugccaggauugguucaacagagaagcgcccaugcggggggcuccauucuggggcuggccuggcagcuggaagccacgggucccucuccaggcaucaaacugccuucccucucggucucuugcugugucugagccaacagccagauccaaggugacccacagggcucuccuucuggaaacagagaccuccuggggggccucaggagggccacugauuccguggucccugccugggucccaggggaggcaccaagccccuagcuguacaggagccugaggcagagaacgggccagcugucccacuggccgcaaccccggggcuaugcacugcccaggcccacucaggaggaugcucugagccgcccucugcuaucgaggaccagagaccuccauguccuggccuguaugccucuucaacacagggagcuucccaaagucaagcagcuccccagaaagcacaccccaugcuggcaucaaucugggaggccaagccccugaugggcaggcagccccagcagcacuccaugagcaccagcaccuggccacggucagcgguacucagaguggcaggcacagcaugaccuguaugaggaguccacgccaggggugacugugggggggcugcugggggcagugcaaaccugaguccuccuccacccgugcccaaaggugacuaauuuaccccaaacaggggacacuccccucugcugucuccuuggugcagcccauggcccugcaccacggccacgcccgcagcccccacaccgcccgcacgggcggguccggccacauacaugccguaguucugguccuccgucuccugcugcaccgacagcuccuccagcguggcguccauguccagcugguucgucuccagcugccgcaacagcgucucccucugcagaaagggagcacgcaggccugagcagggcuccuuccugcugcgagugccccagccccacagccccugaaugcacaggggacgccuccugcugccaaaaccaggagaugcugcagggcuggcugcucagcaacucauggagcucugcgcugggccccacuugaaccacagaagcccagaggauuccucugcgguggccggcacgacaccuacacacugccagcauggcuugggggacagcugucagucacaggcauaaaccucaacagcaagcacccccacccacacacgcaccucuaagagugaagaagccgcaccuucaccugggaaacaaagccccucugcuccccgccacgcacaccuccucugguggcaggacacauccccggugcacgcgucgccaccgucccacacccacaagcagcuggcucuggagcaaaccacugcccuccuggccuggaaccccaggcuggucugaugagcugcgggucccuguggcugcucacuuuagauucaaaugaaauacaaacgccggagccucacgaacuccugaccucaggugauccagcugccucagcauccaaagugcgaggaugacagucgggagccaccgugcccggccccuucucuuuuuuuaaauagagauggggucucgcuauguugcccagacuggucucuaauuccuggacucaagugauccucccagcuuggccucugcugaaauuacaggccugagcuacuugccuggccucuccuuuuuuuuuuuuugaaucaucuuuuucagagauuuuuuuuuuuuuuuuuuuuuuagaacagggucaugcuauauuauauugcccaggcagaagaucuggaacuccugggcucgagcuguccucccaccucugccucccuaacagcugggauuauaggcgugagccacugcgcccagccuggagagguuuuuaaaauaaaaaugugaggcugggcgugguggcucacaccuguaaucccagcacuuugggggggccaaggcgggcagaucacgaggucaagagaucgagaccguccuggccaauauggcaaaaccccgucccuacuaaaaauacaaaaauuagccaggcgugguggcaggcgccuguaaucccagcuacuugggaggcuuaggcaggagaaucgcuugaacccaggaggcagagguuacagugaggcaagauugcaccaccguacuccagccuggacagagugagacuccgucuccaaaaaaaagaguguauuaaagucauuaagguccccaggcuauaacaacaacaaaaaaaugugauuuacaaagagaaaucuacagacuugucaaccaaauguaaugugugaacucuggauccuacucugaauacugaccaaauaucugacgacuggaagaacucuuugggaauuuuauuuuuucaauuuguuauuguggcuuauuucuccaagaaaaaccuucugugaguuuaacaugcgguauuacauuagguacuacggucagguuaaaaaaacaacugauuuuuuuagagauguguuugaaauauuuuuaggugacauaaagaaggccugaaauuugcuuccaggcaauccaggggcaagacaaagaggaaacaggggucccgcugcugagacaggcgaggacaucagaucugcuugaacacauccauagcaaaaggauagucacacacagcucagcccuacgcuuccagcucaagacucuguccagggucccguucucucccugggaggcuuuggaaggguuuggagggcaaaccauuagggaauggagcagcugagcaguggggagcucucuaaggaguaaucaacccagugaugaggggacggcucugcaggaaggaggggccuccccagcagugccggcacaggacaagucugacugccgccuuccuuccaacccaaacguccccagcagcagucccagccugcaggcauccucacuucuucugacaccaggacgacagcacagccccuuuccugggcaagccugacauccuucuggagaaagaccaaggcugcugcagcugcagcugggccccaggucccccagacccagucggggcagcccagggcgaggagguucaggucccccagacccagcuggggcagcccagggcgaggagguucagguccccagacccagcuggggcagcccagggugaggagauucaggucccccagacccagucggggcagcccagggcgaggagguucaggucccccagacccaggcggggcagcccagggcgaggagguacaggucccccagacccagcuggggcagcccagggcgaggagguucaggucccccagacccaggcggggcagcccaggcaaggagguucaggucccccagacccaggcggggcagcccagggcgaggagguucaggucccccagauccagcuggggcagcccagggcgaggagguucaggucccccagacccagcuggggcagcccagggcgaggagguucaggucccccagacccagcuggggcagcccagggcgaggagguucagguccccagacccagguggggcagcccagggcgaggagguucagguccccagacccaggcggggcagcccagggcgaggagguucagguccccagacccaggcggggcagcccagggcgaggagguucagguccccagacccagcuggggcagcccagggcgaggagguucaggucccccagacccagucagggcagcccagggcgaggagguucaggucccccagacccaaucagggcagcccagggcgaggagguucaagccucaucauuugcugggcuacuuugcagccacagcuggccuggcccuuguuucuacaaaggaaagugaguuuaguccguaggccaaaguugguuccuugguuuugacacaagcaccagggaaaugugagaugugaacagcgaguaccucggugacucacgccuggcaucccagcacuuugggagacaggugggaggauugccugagccccggaguuugaggccgcagugagccaugauugcgccacugcacuccagccugggccacacagcaagaccuuaucucaacaaacaaaaacaaccaaaaacacugggggaaacugagcaagggguccccgcagagguggaggggcuccugggacugggucuagcccucaggacccuguacccucugccacccagagcaggcaggugcaguagaacgcugggcccuugccagcagccaaucuccgagcagguccacagcuuucucagggguuaggagggagacccguugcuacacaggagacaccuggaaggaggugagagaccagcagccacuccaccccacguggugagugcuuaccugaagcugcaaaaaugggauauugaagaacuuaugaagguacuuuaggccgaagcuguucuucauggaagacucagcauagcggaaguaggaggaaccuggaggucugcuuucagaaaggaaaaaagaugcaagagaaagacccuugcccuggugccaaggaucaccccugggcccacagcuguggguccgcacugcccucccuccuccugcaggcuccugaggccacaggacccugcugagcccugcuaagcagcuaagccgagugcccuucugcaggugaccccacagugccagcacuucacccuggcacacaguuccccagcacacaguucccggcccugccaucggggagacccaggcuucagugagccccacucagcggcgagacccacauccgccgggccccaugcuaacguuaaccccucccugggccucugccucagcacccucccccgcacaccggagcaccgggcagggucccucgggagcagggccaccgcacccaccuguccagguugucgaugaagucacgcacgucguccggcaggaugacucggugcucgcccaugucccgguaguuucccagcacgcacacuggcacgugggugggcacuuuuggaagcucccggagaauguaauugaagguccucggagaacaggugaggaccuggcuuaguuucagcccugcgacgcccugucccucccuggaaaggugcugugcgcccaggcccgaggaugguggcugcuucucauuuccaacauccaacccagcagaagcaugccucgugcaugcagagcuagagggaagugccucgagggccuucgcaccccucagccugcagcccccgcccgucccucucccugacggcagguacuugaccgcaccccacacuggaacgccccugccugucccugccuucccucagagcaccccauguccgcaucccuacaaaaccaccucuggcuucaucuguguccacccucauuccgcacuguccucugugccccuuggugucgacccuguggcugguccuccaggcucccugcccaccggggcagccgaggacacccuggggugccucugcggcugccggugaagcgggcuguuuggagagccuugucuuaagcagacaucuccuggcacggacggcaagucuccagagucugccuggcguggaacugccaguuucccagcugcgugguuuuccaaauggcuugugaagaaauaaccagcgcuucaagugacaaaacuuccccacgacugaaagccaacauaagggaguaaaaaaugcaacauccuguuucuaacuucauuuucuuucauuuacacgcagucauuuaaacgggccccucaccaaggccggcccaggggcaccucuggccuccuaagcagguggccuucuggugucuccugccucucguggcugugaagggccugcguggugcuugaagccgcugucugagccaguguuuuccauccuuccugcugggcaccaggggcuccagacagagcauugcuaccauaggcaucgccugcccaggcuggugcugccaacagggucuccgggcccacagguaagcgccuuugccgcgucuucucaggcuggcucaagucucgcugucacucccgcccacuccucgcacggcagcccaggcggcugcagcucccuccaggccguuccuguggcagcagugggaggugccguggaggccacacuguguccacacucaacuucgcuugggaaaagccacuucccacccaccaggcuggccugcugccuagacaggagaggccggagggagaggagcaccacugcucgcccaggugaggccagcgugugcgcccgagcugaacucgugcccugggguggggccgccagccccgugugugguucuccugccauccgugugccacacccccaccgagggcucuccugagggugccugcggucaguccuuggugguggugcugaaggcugggagggcaggcaugguucccagcauuggcaaagguuggcagaggcccagagcauggcuggucaggugcuucaagccgcccucaggccugggcugcugaugcgugcugagugugcggccccgugacaggcgguacgcuuaacccuggugugggggucuucccaaguaagagaagcugcugacuaggcccccaggccagacccacugcugggaagagcagaugccuggacgugucgggcaugcugcuccuggugcuccgggcacuggcuguggcuaggaggggcccugcaccaggacacuggucuucacgcggcccucguucuucuaggagccuugugccaagugugcguccgcagcacccccccgcuggggcuccggugcguccugggggacacugcacuccugaggagcugaguggaucccaugcgacuccacaguggacucugggggcuugcgccuggucccccagagaucguccugugugccacugcccuuagcugauuucgcugucaucuucuugcuagaaugaaucuuggcuguggguccuccuaggucaugaagacggaggucgcggggagcccccagcacaagcagccacuugcuuccgccaagucucagauggguuuucaggaagaacaguggggcuauggaaggugcgugccuugccccagaugccuuuugcagccggcccacgccaucccgccccauaggcacaggcauagucguugcccagcccgacauccaggccagugccccuuguggcugagcugccacagcugcccagcaagagucccucgguccugcagaacgaugcugcucuaaccauuaucugcugcacaaagagggcgcccaaggggcuaggggggugagagucacaggcagcugcccccgccagcucccucuuaccacugcuugguaaugucgaacaucaugaccaccccguugcaguucuuguacacguccaggaacucagcauccagggccauuucagacuccgccuggggacaggagggaacaggugugagacuggcccaggcugggccccacccguguggcccacaguuuuagaaaaggcuggauagucuucuaaucugaaaagauaacagccauuuccauuuggaaacgauaugcugaagagaugggauagcuaaacauagguuugccccaaagggucugacggucaacaccagccucgcugauggcucccugaacaagccuccuacccaggaccucccacugaucacagcaguguccgccccaggccucacggauaaccaaaccaccacucgaaaauagaagugggugcuggacuaccagcugcccucagcuagaugugcguuccggaagguuccagugcccacaaacaggguuagcugcagugcugugggcagagucacuccaccccaugcucuaaagggagugggaggcaccgcacggagagugcgaggcccugggugugucgggcucagguuggguuggccccagguggcuccggugagcgaaacucacgcccauggcgcugcgagauguguccugugcuuugaagggccgagcccaccgagacugggauaaaaguuuggcgaguucacuuaaauaccucucaggucacucaaaugcaaauaggggucaguccaacgugaugucugucgagugcaggugagccggccacccccagauacagccauggcagugugggguuuucagagcaguugggaaggccagcggcccccguggccacagcauaacuggggugguuggggucaaaagcgugugaagcgcugggcaccggcucacgcaccccggggcccugagccacugcuacccacuguguaccuggcacucaccuccugggggucguucuccaucuuuaagccgucgccucgcuuuuugcauuuuccuuauuuaaaaacaaacaaaaauuacgagguggaaccccugggccuugggccauaggaggagcaugguccccccauggccacucagcccccagcuccagcgggugcucuacuccaccaccccaaacagccugcagcgugggcacccacaagcucuggagcagcaggaccugggcgaggccccucuguaggcucuggaggcagggcugggccgggccuggacaggaggugcuaguuggggcugacaggcucagcagcuccuggacaggcugcggugggauggccuacagcccuacaccaggaggguuugcugcugaaggaagggcccccuccccccagcucccccaaguccagggugggaggaaguacaagggauauggugggaaggugaggggccucccccugggguaaaaguggggagaugagcgcacggacucucaaggcaacaaccagcccgggaggaaaggagaggggggcagggauuccagcccugaaauggccucgggagggaggagggcagcugugugguguccacgguccaggucccccugagccuccgccaucaaggucaccauggcucuccugagaaugaggggccgugguccccucccuuuaacuccacaaugcugaccugaggauaaaggcuccagaccauccugggaacucugggggucccagucuuggagucacggacugggacaacaaacaaaaccccuaagaacagauggggcucauguguuuaaaacgccacguccacuucauuccacagcuuguuucugaacugcucaccacgauguaacccagucagggggucagccccucccucacaagguacaggggacagagccagcccggaggagccuccccagucuggccacaaagggcucagcagaguccccaacacacacacagcacagcacugcuggcugucgggggccugcacccaggaaggaugcucacagccuaaccagcaccccccgggcgagccauugagacuggcuggaucugcuuuggggaaagcaggcgggacuggaggggagccggguccuggcugaccaggcggaggugaggauugucggcucaccugaggcugcuccauucagccucccucuuggcagccugccccaugcagcgucagcuaagccugauggccucggcuuccucucacccuugagaacucaccaggugcccaagagaccucaacccccuccaaugcacuccccaccggccgcccuggcugcuguggacagugcucacaccucgcacagugggcacugagucagggcggggauggaaggcacacugggccccaucaugaagcuggggaccuuuuccuccugaggggcccugguuuaggcugagugagacucucccggugggugcuaacaggugggugcaaggguacacauguaaccccagaggaagcccagggccaggcggccucugcacccacaggccuccacaccagccccgggcacagcaggccaccaggaagggggggcccauccuaagccguggagaccacacccuuuacagugcccaguuaugaaccccacucugggcaaccgugucuacgggaagccugugcccgcuccacgccaaggacagacccaggaagccagagcuggaggcacaggaaaucucugcagcuccgaaaggggccaggaugggggucaggacggcccuuccugagccaccugggggccacaggcagaucugauagcuucuccucacaguggggaugaggacaaugauagggcgguggguggccaccucucuaacaccagagaccacgcagagcucugcagagacagcaucuggaacaccaggucagcacgggccacaagaguccagcgcaauguggugggagccgcaggggcccagcaccccugcgggaacugcaugagcaccugccucuaaccccccauggccaaacccaccccaacaaagcacagguggagggaggggagcaugcgccauccgaacagacaccaucacacagaggcggcggccgccuuuccagcagagccucguaacgaggccacagccaggccugugaggccggggcgugcacguggccagcccugcacacaccacacaugcacacggaccaugggccccggggagggccaugagcuccacccugaggacuuagaggaacucaugaccuuguggcugaggaggagaccaacgaugucgaggacaccccgggggcuggugcugcccucccacgguccccagagugcaggucuguguggcuggggaucccuggcagggacaggagcgcaggagcuggguccucagcuaugggcagggggccgccuggugcugggcuacuccgccaggcagugcaggaggagggcucccaaaauagcacccugggccuuggggcucaaagcacaccccccggcugcaccugccgccaccgugcacgcggucacucagagacggggaguaugcuaaagcagcaaagcaugcagugccacaggaggggcugcgccacgcugcggggucgccacuggauguggaggggagcagagcagcaagacccugggcaccguccacgaggauggugggugaugcaugggcgccgggggaaagaaaggaagccucucugcgcagagcacacagucccagagagaagcagacacagaacagagacgccucaccuuugucuacuacaucccagacuucaaccuucacgaugucauccguggcugaaacagggagaauccuaaaauuagugcccaacaugaaguucccaagguggcacaaagcgguccagcuggugugguugucugugccccgcagccaccggcucccaccaggacuuccgaguguccagaagcaggggauguguccuccccagacgaccacauggcggcuccuucaggccuucgcucagacacagcuucagugacaaacugaaugcacgguaucucccuccgcagccccaauccugggcacggccccucccucccgggccccgauccugggcacggccccucccuccagggccccgauccugggcacggccccucccuccccggccccgauccugggcacggccccucccucccgggccccgauccugggcacggccccuccuggccucagcauacuggaaggggacccuccuggcugggucgaugucuguguuuuugcccauggaguacgcuucugcugacaggugcgaaugaaugggcccgccugugucaccuucugacccuguuucuucauccagugacuggccucuaguucacuuugagggagcagaaucuaaguaaucacugagggcggaggccggacccucccuucggagccaccugagaggccccaggccugccucacaccgcaccaucgcagcugggccugcuggugccaaccacuccuccugagcucccaugacugugcucuguuguggggcgugcuggggacugggggagcugauggauggagccucccgcccacccaaggauuccaaggggaagggagaaccagaggggagaggcacgcccggggcccucacacagccaggcaucugcccccacaccaaucacauccacgucgccugagcagaggggcaugaacgcugccaucagccucaccccaaaccaggaagagggugcgguggcagguagagcuucugugcgccggcccugugggcucuguguccugucagcccagcaccacccucccaggcccuagagagcagcagaugcccagcaacuccacggcuguuccugcacagcaguccaagugucagcugucaccacguggcagcucaaacucaucuuugccucccacuaguaacccacuaguuuuuuuuuuuuugcagugaaaaggaaagguguuuaaaacagcccugggugggagugguggcucacgccuauaaucccagcacuuugggagcccaacgugggugaaucacguggucaggaguucaaggccagccuggccaagauggugaaaccccgucucuacuaaaaauacaaauaauuagcugggugugguggcgggcgccuguaaucccagcuacucaggaggcugaggcagagaauugcuugaacccgggaggcggagguuccagugagccgagaucucaccacugcauuccagucugggcgacagugagacucugucucaaaaaaaaaaaaaaaaaaaaaaaacccaaccaaaccaaaaaacaaacgaacaaacaaacaaaaaaaccagccccaaggcuuuuugcugucacgauucugaacacacagggcagcugcucugccucccacagcaggagccucgccacagcugucaccucccccaccuucccgcaucuacccaggcccagcccacccacacccaauugagaccugggggaggggucuaucccaccaucaagcccaccucacugaaccuuuuagugacacgaacuuuccacaagggcaaggcucaaacaaaggucuuauuacuguuucuggugguggagaagaugucgggcuggggcccaagaaaaaauaccaugugcaccaagagggugcaggcaagggaaugcuccucggaauguaccucuuuucagcccccgaggcgcccgcgugcccacucaccugcggccaacgcugccccaagcugagccucccaggucaguggggcuucaugaagcucacucaggcagcagggugauccaccccaaaagagccccagaguucacgccagggcccccacgucagcagggucccucacagacaagaacucuucggggagacccccucuggggaaugcaucucccaggaaccagggcugagggaggagaagccuggagcccgaacccacuggggcacccaccacacuuacucuuguagcuccaguggaugcuggugaccuggaucuccuguguggggauguacuccuccacgaacggccggcccugcaggcggugccacagcgcugucuugcccguguuccugucuccccggaucacuaucuucacuggggacgggaagagaaaaagaaaaggcaaauuaaacgaaccgaacccaagcugcagcuuuaagagcaacuacaaggagagccgguucugcugccaccuguuucaucuuucuugcuagaaucagaccaggugaccggcaggcaggggaggaagacgauggguggguaccauggcaaccucucccaucaggaggacaccuggcagcacacagagcaucaacggcgaaccgggcccagggggcagcuuucuacuuggagccaggucaggcuuucuacuuggaggacgugguucugcccuagagcccaccccugggaccccuggugacccucagggucagggcccaccaccugaggagcucuccacagcaccccaggcuucugcggauugcuccuaaccagguuuucugcagcccuggagucuuuuuuuuuuuuuuuuugagacggagucucgcuuuuuugcccaggccguacugcaguggugcuaucucggcucacugcaagcuccaccucccggguucacgccauucuccugucucagccucccgaguagcugggacuacaggcgcccgccaccauguccagcuaauuuuuuguauuuuuaguagagacgggguuucaccguguuagccaggguggucucgaucuccugaccucgugauccgcccgccuuggccucccaaagugcugggauuacagacgugagccacugcgagcccuggcgucuucagugcacaauucugcagaacgcggggccugcaucccagcucacgcacaacgcgugugugccggguagccccgggccugggccugcuugcuccggggcuggguuggagaggccacugcccagcuuguuuugaaaaugugaugggggagggagggcagcugggaggggagcacggacuuagcaaaggcgggagguggcucagaacggguggagauggggauggaccuggcacccgacuggacuaagaacacccagccugcggaggugcuggaagaacaggaucgagaaugaccgagaagcugugcggacgcagcagccagcacugagacagcugcccucggaccugggcagaccccgagagcuucucacacaggccuuggugaacccaccacaggcacgggggagagagaagcccuggccguccuccacguuuccaggaggggagagccagggaagccagggaagggagccggguugguggggagcagaggcaaccaaggagcaggucugcaggcuccucccacuuccccaggucucgggccucccgcccgcucccccaucugugucaggucugcagccuccucucacucccgcaacgccccccccagguuuucugucagggggaccccaagcucccaacgcagagggcgcccggccucgaagcucugagggacccugggcugucccugugccccacccggcuccucucuccuggcccaguccccucccucuaccucaaggcaccuguucccacagucauuucuucuccccugaagcuuguucauuuccucgcccauccuagguaccucaacgcgccaacuuucaacgccucuggucauaucucggcgccggccagcgcugcggcaaaaccuccagaggggacccaggcgcccucacggccacgguggcggccgcaccggcugggggcagccaggaggcuccgcgcuucucccggccgagcccaccccgcggaaggcugggcccucguuccccucccucucccgcggagaacuuggagaacagaggccgccugcagcgcccuccagcccggcggcccggccuguggagagcacagcagccccaagcggagccgcaggcgcucagcgcagccaggagggagccaggccccagcgcggcgggaggcccgagacgggccgcggcgcccucccuccuccggcccgaggcaggaacccgggcgcggcccacagcucugggcucagucgggcggccgccgucccccccagaugagcagcagcccgggcucgcagagacugcccgggccgcgcacgcauagccucgcugggcccgcgagagaacggcggcgccauccacguccgucccgcggccccgagguccacggccugagcggcggcccugccuccccgccccggcaccgcucaggcggcccacgcgcugugcuucccggugguuuccacaugcgguggucccgucuccgggucuuucccgggaguggggcguuagcaacgcggagagcgcagagacggucacagcgaccgcccguuuucccgcggccagaaccaacgcgcugacgucccuugguccccgcaucucggcuccucaacccuacgggacagaacccacuuccuucauuuuguaaaaauggcacaugcucuuuguaaggaacuuaaacaaggcagacaagcacaagaaccaauguuaacaaagccucccaaugccacugccggaaaccagcccucaugaacgcggggagcucauuccaggcaucuggccaguuuggcuucugcagaacgucggagaguuggggucacacagaauaauuucucucacucagcgauacgcacuuaaggcucaugcaggccucuccacggcuugagaacaucuuuucaggacuaaauaauguuccaccaucuggaugcacggaguugauccauucaucuacugaaggacgucuuggccgcacuuuuccuugaauuuccauugauauuuuucucuuuucguaauauauauuauucggauacugcaacacccacacucagccucuguuuauuuuuuucauaucauuuaccagcugucauuuugcugugagauuuucccuuuauuuucuaaaccuuccuuugauuuuauuuuugcuuuuuaaaaauuauuauuggccgggcacgguggcucacgccucuaaucccagcacuuugggaggccgaggcgggcggaucaccugagcucaggaguucgagaccagccuggacaacauggagaaaccccguaucuacuaaaaauacaaaauuagccggguguggugguggacaccuguaaucccagcuacucaggaggcugaggcaggagaauugcuuaaccccaggagguggagguugcagugagccaagaucacaccacugcacuccagccugggcaacagaacagaaccgucucaaaaaaaacaacaaaauuauuuuuacaaacagggucucacugucacccaggcuagagccagcacaguggcaccauccuagcucacugcagccucaaucuccugggcucaagugauccucccaccuuagccucccaaguagcucagacuacagacaucugccagcuaauuuuuuuuuuuuuuuuuuuuuuuuggaagauggagucucacucugccgcacaggcuggagugcaguggugugaucucagcuaacugcaaccuccaccuacuggauuccagugauucucccaucucagccucccaaguagcugggacuacaggcgcaagccgccaugccuaauuuucuguauuuuaguagagacagggguucaccauuuugcccgggcuggucucaaacuccugagcucaggcaauccgcccaucuuggccuccuaaagugcuaggauuacagaugugagccaccaccccaugccuaguuuuuuuacuauuuuuuucuuagagacagggucuugcuuuuugcccaagcuggucucgaccuccugggcucaagcaauccuccugccuuggccucccaaagugcugggauuacagguauaagccacggcaccagugaggaugguccacuuuaaucaauguuccuugagccuucagguccagagacuuucucugagccugcgguaacccuucacauuucuacccgcucucuuucauuuugaaguauauucugcauauggcaucacugucgcuguagcacuaggacuauagcuagagcagcuuucuuaugguuaauguuuaccuagugucuuguuuccaacuccuaacuuucaaccuuucgacaccauuauguuuuggaugugucucuuauacaccacauagccaaauuaaagaaaaaaaaauuccucgaaucucacauucuuucgagcuggugaguucuguuuacugacaacugcugcugccauguuauuuuaugauuuuuaguuacagcucugguucccuugccccucccccagccuucuaugccuuugauuaaagcuggacaaggugguuuucuuuuuuuuuuuuuuuuuuucuugagacggagucucguucugcugcccaggcuggagugcaguggcaccaucucggcucacugcaagcuccgccucccggguucacgccauucuccugccucagccucccgaguagcugggacuacaggcgcccgccaccacgcccggcuaauuuuuuguauuuuuauuagagacgggguuucaccauguuagccaggauggucucgaucuccugaccucgugauccacucgccuuggccucccaaagugcugggauuacaggcgugagccaccgcgcccggccuggacaaggugguuuucagaaaguauucuuucuaccugguauuuauuuggaagauuugcaaccuguuucuacacuuugggaacccuuaaguuuucaacacucacaucugcugcagugaagucugaaguuaacacuucuucuuaauaauaauauagagaucugaacgccuugacuguccagcuucacccugggcuguguuacuucugguaguuucuucuuuuauauacccuauauaaaucaugaucaccacugauuaacauaaccaacgcuuauuccuuuucuuuccuuuuuuuuuuuugauuaagucucacucuguugcccaagcuggaaugcaaugaugcagucuuggcucacugcaaccuccaccucccggguucaagugauucuccugucucagccucucgaguagcugagacuacagguacgcaccaccaugccuggcuaauuuuuguauuuuuuuuaguagagauggggucucacuauguuggccaggcuggucgugaacuccugaccucgugauccacccaccuuggccucccaaaguguugggauuacaggugugagccaccgcaccugacccaccaacacuuauuucauuuucaccacauauuuaccaguuucuuugcuuaccuuugguuuuuuuuuuuuuuuuuuuuuuuuuuuuuuuuuuuuuuuuuugagacagagucugguuuuguugcccaggcuggagugcaguggugggaucucggcucacugcaagcuccgucuccuggguucacgccauucuccugccucagccuccuaaguagcugggacuacaggcgcccgccaccacgcccgucuaauuuuuuguauuuuuaguagagacgagguuucacuguguuagccaggauggucuugaucuccugaccucgugaucugcccgccucggccucccaaagugcugggauuacaggcgugagccacugugcccgucauuuuuuuuuuuuuuuuuuuugagauggagucuuguucuguugcccaggcuggagugcagcggcgcgaucucagcucauuccaacuugugccucccggguucacacgauucuugugccucggccuccugaguagcugggauuacaggcgccugcccucaugcccggcuaauuuuuguguuuucaguagagacagcguuucaccauguuggccaggcuggacucaaacuccugaccucaagugauccaccugccucagccucgcaaagugcuggaauuagaagugugagccagcacccggcccccuuugcuuuuugaaauccacuccuguguuucgagcucaacuccaccucucugaagaauaaccuucaguauuuauuucuaaaagagccuuugcacagugagccucaagcuucggcagaaguggagccagucacacggcucucaagugcucaucagacagagaccucagcccacgucggccuccccucagcccacgucggccuccccacagcccacgucggccuccccucagcccacgucggccuccccacagcccacgucggccuccccucagcccacgucggccuccccucagccacagguuugcugcgagcuggucaccaguccacugcaugcuccucucagggaagucuuuuuguucugguugcaucuaagauguuuacuuuuuaauguuuugaaaauuuccaaugauguaucuagcuguggauguuuuuaaacucuggacuucuuggaguuuccuguauuucaugaacucuggaaaguccucagucuucccuuucuccuuucuugcucucuucuccuucuggaacuuguacuggacaugggcuggcaucgccuccucccugggccgcacaucucuucccaacacugcuccucucuucagcugaguuagugcugcuucucgugcugcuucuccugcugcugacugauuuaacguuaaugacuauguuuuucauuucuagagguuuucauucuguuucuuuuucaaacauaaacugucugcucaugguuuuuuguauuuauaauugacauaauaauugcacauaucaugggcauacagucuugacuagucuuaagauugcuuccuuuuacaucuuuaucaauuuuaacauacauuuguuuucuauuaucuucacauuuugagaaugaagagucuuauuuucucucccuugaaaugaaauuuacuccuuuuaaaagcuaauuacccauauacacaccuacuauauggccacaaacucuuuuuuaaaaaagcuaauuacaagaaauccuguaacaucagaaauaaggcaaguaaaauaaucugauuuaauuauuuuaaaaaauuacccccccccccuuuuuuuugagacagagucucacucugucacccaggcuggagugcaguggcgcgaucucgacccacugcaaccuccaccucccaggcucaagcaauucuccugccuccgccuccugaguagcugggauuacaggcaugugcccaucacacccagcuaauuuuuguuauuuuuaguagagacaggguuuugccauguuggccaggcuggucucaaacuccugaccucaagugauccaccaaccucggccucccaaagugcugggauuacaggagugaggcaccaugcccaacuuaaccucuacuuuuaaguuaaaaaguuaggcuggucgcaguggcucucuccuguaaugccagcacuuugggaggccaaggcagauggaucgcuugggcccaggaguuugagaccagccugggcaacauggugaaacacugucucuacaaaaauuacaaaacucagccaggcaugguggcgugcaccuguagucccagcuacucaggaggcugaggugggaagauugcuugagccagggaggugaaggcugcagugagucaagauugcgccacugcacuccaguucaggcgaaagagcaagacccuaaauaaauaaaaucaauuucagaaucuuuuuuuucuccugcuggucccuugaucuuggguuuucuuuuuuucugcuuaacuucagaaucuuaaauguuggcugcaauaagcuaagugauucuccuggaaaaccuuuaggauucauccaagaaacgcuaagaagcccuguacuuaccuguacuuaaccucaugguaaaccugcucuuuuacuaaacgggaugugaacacgaccucuguucuaagcuuguuuuagaagauacaaugcagaaaacacagagcucuauuugaggcccugagccuuucuuacccugauucaauuuaacuccuucacauuccugcagcuuuccugcaaaauauggaauaauuuucuuacauuuucauaccaagaagagcuuaugauuuaucucagaugcaugaagguuuaacuccuaaccaggcccucucacagugccagcagcaucuccugggcccauuacaagggcccagccaccuccccacccugacagccugugcugcagcuggugucagccacaccuugcuccucucccacucugcacccugcaaagauuucccauccucagcagcuucagacuacuuggugucgaggcagguaaaaaccaaggugaccccaagaaaauggcugcucccccaaaggaggcagaaggaggaagugaagaugaggaaaugucagaagaugaagaagaugacagcuguggagaagagacugucacaccucaggagaaaggcaagaaggcugcugcaaccccagccaagaaggugacaguuucccgaacaaaaaaggcugcaggugccacacccaccaagaaagcaacugucacuccaggcaaagcagucgccacaccugccaagaagggagccauagcaggcaaagcacuggcagcagcuccuggcaagaagggacaccccagccaagggggcaaagaacggcaagaacgccaagaaggaagacagcgaugaggaggaggaugacucugaaccagcagugaugaaggcagcagcgggugccccugccucaggggaugaggacgaggacgaugaggacgaugcugaggaagauggcucugaagcagcaccuauggaaacaacaccagccaaaggaaagaaagcuucuacaaaugcuguuccugggaaagccaagaggauggcugggaaugaagaugaagaggaugaugaggacaaggacgagggugacgaugaugaagaggaugaagugaugaagacgacaaagaggaggaagggucugucaaagaagcaccuggaaaaugaaggaaaugaccaaacagcagcuucugaagccaagaaacacaaaguggagagugagaagcacagaaccaacugugccuuuuuuuuuuuuuuaagacagggucucacucucucgcccagguuggacugcaguggcgcaaucuuggcucacugcaaccuucaccugccaggcucaagugauucuccugcuucagccuccugaguagcugggauuacaggcguguaccacuaccacccggcuaauuuuuguauuuuuaguagagacgggguuucaccauguuggccaggcuggaacgucuuucaaucuuuguuggaaaccugaacuuuaacaagucugcuccugaguuaaaaacuaguauccaugggccaggccugguggcucacgccuguaaucccagcacuuugggaggcugagguggacagaucacaaggucaggaguuugagaccagccuggccaacauaaugaaacccugucucuacuaaaaauacaaaaauuagccgggcguaguggugcgugccuguagucccagcuacuggggaggcugaggcaggagaaucacuugaacccgggagguggaagcugcagugagcaccauugcacuccagccuggguaacagagcaagacccugucucgaaaaagaaagaaaaacaaaaacuaguauccaugauauuuuugcuaaaaaugaucuugcuguuguggaugucagaauggguaugacaaggaaaucugacuauguggauuuucaagcugcugaagaccuggaaagagccuuggaacucgcugguuugaaagacuuuggcaaugaaauuaaacuagagaaaccaaaaggaaaagacaguaagaaagagcaagaugugagaauacuuuuggcuacaaaucucccuuacaaagucacucaggaugaauuacaaguguuuuggcugggcgcaguggcgcaguggcucacaccuguaaucccagcacuuugggaggccaaggcaggcagaucacgaggucaggagaucaagaccauccuggcuaacacggugaaacccugucucuacuaaaaauacaaaaaauuagcuggguguggugacgggugccuguagucccagcuacucgggaggcugaggcaggaaaauggcgcaaacuugggagguggagcuugcagugagcugagaucacggccacugcacuccagccugggcaacagagcgagacucuggcucaaaaaacaaaaaaguguuugaagaugcuguggagauuggauuagucagcaaggaugggaagaguaaagggacugcuuauauugagguuaagacagaagcuaaugcagagaaaacuucugaagaaacgcagggaacagagauggauggccgaucuauuucccugcacuaucauggagagaaaggucuaaaucaagacuagagagaccacuuggaggggugaaucaaaaacucugguuuaagcaaccucuccuacagugcaacagaagaaacucuucagaaagaaucugagacaaggcaacuuuuaucaaagugccccagaaccaaaauggcaaaucuaaagggugugcaugcacuuacaguucgcuucauuugaagaugauaaagcagcuuuaaauuccuguaauaaaagggaaacugggggcagggcaaucaggcuggaguugcaaggaccaccugaugccaggagccagccaucuaaaacugucugucaaaggccugucugaggacaccacugaagaggcuuuagucauucgacagcuuuguugggcaaggguagucaccaaccaggaaaccgggugccccaaaggcuuuggcucuguagauggcaacagugaggaggaugccaaaagcgccaaggaggccgcggaagauggugaaauugagggaaacaaagguaacuuggacugggccaaaccuaagggcgaagguggcuuugggguugugauggagguagaggaagcuuuggaggaugaggugguggcagaagccaggaaggcuuuggugggcgaggcagcuucuggggaggcagaggugaccacaagccacaaggaaagaagacaaaguuugaacggcuucugucccuuugucuuucccucucccauuugaaagaaaggacgcugggguuuuuauuccguuaccugaucaaugacagagcucucugaggacauuccaagacagucuacaguccuguggucuccuuggaaauucguauagacaacauuucaaggguaauaccuuccuuguuuguuuugacuggauauucauauaaacuuuucuuucuuuucuuuuuuuuuuaagacgaagucucacucugucgcccaggcuggagcgcaguggugugaucuuggcucacggcaaccucugccucccggguucaagcgauucuccugccucagccucccgaguagcugggauuacaggcauacgccaccacaccuggcuaauuuucauauuuucaguagagaugaguuucaucauguuggccagguuggucuugaacuccugaccucauguaauccgcccaccucagccucccaaagugcugggauuacaggugugagccaccgugcccggccugcuaagucccauuucuaaauucgcaccagugucuacucagagaggacucugguuguccgagcuccugggccaggccaguaucagagcugcacaauaaugcucacucaggagcaacuccacagaaaaauucugcaccaaauacaacugauauuuuguguccagucacaguagaaagggacagaccaacucaggcaacaaucuuucuuccaaauaauuucaaauaauuuuccuaauaauuuuauaugcaaauaauuucaaaauuguguaaaccaaaauuaaaaucccaaggccugccaaccaucugaauggacuuccucuucuaggccagggccauccaaauuucaucugaaagacugguucaggccauuaugggaagaggggagucagacaggccucauuguggccuccucccuucuggaauucaggaaaagcucaccagcauuuaacaucaacacugacuuuaagucugauaagaaacauaaucuggccaggcgcgguggcucacgccuguaaucccagcacuuugggaggccaagggguucggacugcuugaguagaggggucugagcccagcugggcaacguggugaaacccugucucucuaaaaaauaccaaaauuagcugggugugguggugcaauuguuuuuuuuuuuuuuuuugagacagggucugacucugucacccaggcuggagugcaguggcacaaucucagcucacuguaacuucugccacuugggcucaagcgauucucccgccucagccuccugaguagcugggauuacaggcacccaccaucacacccgguuaauuuuuauaguuuuaguagagacgggguuucgacauguuggccaggcuggucuugaacuccuggccucagguuguccgccugccucggccucucaaugugcugagauuacaggcgugagccaccgcgcccggcaaaaaaacacaauuuuuuuaaacuaccuccgaccuggaagcccccacuucaaguugucccgccuuuguggaccaaaucaacauauaucuuaaauguauuugauuacugucucaugucuaaaauguauaaaaccaagcugugcccuccaccuugggcacauguccucagggucaccugagggcuaugucacgagccauggucacucauauucagcucaaaaauaaaucucuucaaauauuugacagaguuugacuuuuucauccauuaugguccaaugucucauucgaguuuuuauucuaaaaccagugggugucccacacgucuaccgggaccacuagcaacuccgagcaaaugcagggcccaggaggagagcccagacuccuggaaacccgcagcaguucccagaaacucucacccccaaaacccucgacucugucuugaucacauugcuggucuguuacgcucuguaaaauauuugagaaaauaaauaccagaaagccgggcaugguggcuuacgccuguaaucccagcacuuugagaggcugaggcgggcagaucacgaggucaggagauugagaccauccuggcuaacacggugaaauccugccucuacuaaaaauacaaaaaauuagccgggcgugguggccggugccuauagucccagcuacucgggaggcugaagcaggagaauggugugaacccgggaggaggagcuugcagugagcugagaucacgccacugcacuccagccugggagacacagcaaaacgcaaaacucugucucaaaaaagaaaagaaaagaaaagaaauacuagaaacuuucuauucuaacacagaaacucaaaaguuuuaaaauugcauguuauucagcuauaaagauaacaucuuucuaaaauguaauuuagguacaaauucaaauuucucucugucucaccaccuuucauucaguucuaggagaucauaaccuguucuccaaguacuggagacuggcuuuucuccucuggaaggaccccauugcccuuuuuagucacacucgcccaggaccacacaggggugguccuggugcaugagguggaccuugcccaggacccucggggagccuuuucagaaggugaacaguuuccagguccaggccugauuucccagggacuaauacugagcuuagccaauacuguaagcaauaaaauuaaauaaaggauccaaacgcagagucuaaaaacuggcguaaacucaguuauuuugacucaauauucucuucuccgaaugccagcuauguauaaaguuucaauuauaacacauuuaaaaucagcuuuuauuuuuauucaaaaugcaccacuuuauuuuccuuaccagacagccaagcauuaagcacguuccagucacgugacuucuucagcgagcccccaggcuuccacuccacgggagucugggagcuccuggacagaggaguccugagauuucaaauagucaagccuucuccccagccacaaguuccuuugaugcuuggguuacugaacacaaacgcaauggauuguuugucuucaacauaauccguuucuguuccuaaacguguuggcugcgcuuucuuucugaugagcacgcugacucuaauuugaacuucaucaaaaucuucuuugucgucguauguucuagaguauaagaaaagccaauacggcccuugguucggacaucaacuuucuuuuaaauuuuuuuuucguauuuuuaguagagacgguguuucacuauguuggccaggcuggucucgaauuccugaccucgugaucugcccgccuuggccucccaaagugcugggauuacaggcaugagccaccgugcccggcccggacaccaacuuucauaccuagaugcucagacuuaucuuuaagaaguuguuuuaucuugcuuacugcuaaaggugucugggugaggguggcccgaguggucugcagcuuccucuugcucacaggccgggggacuaaggaaggcgacaucuucacuguccuccuggacuagcuccagccccaggaacuacggccucucuccgugcacacggcacgcgaauucaugaacuugcuuuuaaaccugcacaagagucuuucugaucauuaguucuuaaaauucuacauuaccauggaaauaucacggaggcucuaaggcuccccuuaaagugaccaaaaaacuggauaggcguagcguccuaaaaccucauagaaacauacggaaauggcuaagagggaagcaaugucaaaacagggaaccacauaaaagcuuucaaaaacuacugggaaagagcccgcaagauggaaaaacucauaagaggucgaggacaauuuacacaauuuauaacaaaggaauggagcgucccaggcacucaggaguccguaaaugacuccuccuuccuacgagaaaugggaugucuccuacagucgcaagucagcccgugccuucuggagcuuuucuagauacgucucuuacaaacgcuucuuuuaaaaaaaaaggcgagaauguguggcguagcuaauauucugucuucaaacucaguaggaagucaacaaagaaaaaucccgcugaaagcgccaaggccggcuggguuccccgcaccuccugcaggugaguggugcccggggcugggcaccguggagcgucgggggcgcggcgccccgggccggcgggcccugcuuggcauuauguaaucacccccgggccgggcagccgggccaaccccgccgccgccgacccgcuccacugcacagcgcggcgggagcgacacgcggcaggcgagugcggcugggaaacgacccgcggcucgggggccgcgaggacccggcccuggccuggccucuccucgcguccccuggcccgcgcccccgcucccggagcgcccggcgggcccagcgcaccccacaaccggcaagcaggugagaccgacacccaccaccgcgcggcgcccggggccuggguucggagacccgcgcggcgcucccgcgcccccccggcccgccgcacucacuguuguacugcacccccuuggcgaagcgccucugcaacgccugguucauggacugcagcccggcggggauguucuugucccggcccggggccugguccgaccccaccagcuucuucagggcggaaaacaucuucccgcucggacgucccagcccgggcgcggccggcgagcucagcggcggcggggaaggggugcgacuggcaccaugucccggcggccccggcccccccggaggccggagccggcgcggccagaggccggggucccggcggcggagcgcagccccgagcggcgacucgggaaccucagccgcggcugcuccgcuccggcccccgcggccuccggcgcgaccgcucuccaggagucagcgccgccaucuuggcgccggcucggcgggacgggagg

SEQ ID NO: 191185 - RNA, 98673 nt, Homo sapiens
augguggacgcgagcggccgcgccgccgccgagggcuggaggaagauggaggccccgccggacggcgccgccgaccucgugccccuggaccgcuacgacgcggcgcgcgccaagaucgccgccaaccugcaguggaucugcgccaaggccuacggccgaggugggccgggugaggggcgcggggcgggggccaggggcgcgggccggggccgggggacgcggccgggguccggccgggucgggguccgcgcgccgcgccuuugugccgcguccgcacagggucggggcugggccggccgccuccgagguccuggcggcgcccgggcaacgcggagcguggggacgcggucaccuggcgagugggcgucccugcggcggagggcggcgugggucggggcuuccgcuccuauuucgggagugcccccagccucccguuggcggcggcggcggcgggaaggagcugcccgguucugggcgcagggagggaccauggggacgcggggccgccgucugaggcgccgcuucccggcgcgccgggcaucguccagugcuggaccugugauuccgagccuugcacuuguuaugaauuuugaugcuuacaagcugucagcuguugaauuccccaacuagaaauugcguauuccgcgcauugugcuuaaucauaaugauccccuuugguuaauuccuguuuggaagaacuagguaaccuuguuacucaguccaguuuguuaggcccuaaugugcuuaguggauuaagacgcuucuguuucgugcccugggaacaggacagaccuagugauucucgucaguggcugacuucuuuauuaauuucaggugcuuuguuucagguacaauuaaagguuaauauuucugcaauccucuuuucauuugaagcauucuuaaaauauuugccuuuauucuggugaaaaauuacccuuuuuagaguaagacuaaaggagacagcccuuccagagaagaguucaguugaccaguuuggaaaacgcugaguaggcguugcccuguuugacaguggccugugccccagcuagacucgaguuagucauaaggacaaacgcguuuuguaaguuuuagggauuaaauaacucgccuuauuucaaacugguuuuuguacuguguaaguaguaauugggaaagaguuuuuccuuugacaguuuucaguuuuacaguucuuguuuacuggcucaguggaaccuuaguuucuguguuguaaugaggaagaaacacugcuacauccaagacuucacaugaguuuuugagaacggaauugguaagauguagguaugaaacuugagucaggugcaaagaacagcccgagagcggacgccuggguaucuugcagucacugccggcugcgugggcucaccugccucacaccuuguguuagucacuguuuugcuuuucuuuguauuuugccgcaugugcuuacaccacgaacuaguuuuuacaccuuugccaaugaugucucuuucugagacuggcuuuuguuauucccuuaucccacguuacguucuuagguucuucuugacuucaucuucacuuuuccacauuuccgcugcuguggagugucucacugaggacuguucaccgcagcugcucgugggcgcuggcugggcucccguaggugcuguggagcccagugcauucuugggcauggcuccugggauccgagcacaaaguuuuacuccugcauguuuuuuaagauuuuauauguggagagggcugagggcucaggcagcggauguuagacaaauugcuauaaaaagaacuuucacgaucugcuuuccaauuucuuuagcaaggugcaugcauuuuuuauuucauugcauuuagcuuuggcauucagcaugggauuugucagccauccagaaauaaguacgcgugucucuguguuaguauuggguucgucuaguuucacuuccgguaccaggucacucuuuaauccuuguugacucaucggaugaugaauucacaaucugauacuaacaugggcuuuugaguucuggaauuauuaaaaggugggcauuuaaagaaaagaaacaugaacaggagcuggagaagacuggacaccaucuuaggagcugagacuggagugccccuuacuggugggugacagugccuucgcacaucagacuccgauuuuaggaggucugguuuccacuuuuuuuuuuuuuuuugagacggagucucgcucuaucguccagccuggagugcagugacgcgaccucagcucaccgcaaccgccaccuccuggguucaagcgauucuucugccucagccucccaaguagcugggauuacaggcgugcgcccccacucccggccaguuuuuguauuuuucguagagacggguuacuccauauugccaggcuggucucgaacuccugaccucacgauccgccugccuuggccucccaaagugcugggauuacaggugugagccaccacgccuggcugguuuccacuucuuuuugccgagagagggcuuuuacauucuauaguuugcuucacagggggagcauauguaauuacaaaaaaaaaaguuuuuaagccaggugugguaauuuauacuuacaauucuagugacucggaggcagagguaggaugaucacuugaggccagguguuugagauggagucugccuguguuucccaggcuggucuccaacuccugggcuccagugauccuccugcuucagccucguguguaauuuucuuuuuuccuuuuuuuuuuuuuuuuuguggaggacagggucucgcucugucggccaggcuggagugcaguggugugaccucgguucacugcaaccuccgccugccgggcucaagugaucuucccuccucagccucccgaguaguugggacuacaggugcaccaccacgccuggcuaacuuuuguauuuuuuguagagauggggguuuucuuuaaacaguuuuuauuuuuguaaaaauggggucuguuugcccaggcuaguuucgaacuccugggcucaggugaucugcccgccucggccucccaaagugcuaggauuacaggcaugaggcaccgcacuuagaccuccuguguaaaacuguguaaaaauugagacucucuuuaaauuuacagguuggagagaucguaauucagaugaccgaaauacuugccucagcucagcugaagugauuuacguuguuggggucacagccuaggugugagauucgcugcuacccaguguggcuguaucuuguaagagacugaguggggaggggguuuugguaggacaguguggguccccccaacacuucuucuaauccagcagcauuugcuuuguuucuucuuuugaaugucuccauguaccucuccagcuuaguuuucaguuaaucagacaugguucuuucaauauggauguuuuaauuggaaaucgcuuuuggggguaugauggugaaaguggcuucaauauuuaacuuguuaaaggcuuguucauuagguugcuaacuaaagcccauccuccauuuguguaaagauugaaagcauugaaagccugcugaaacuccagggcuggcugcugucuuguuuugcauuagccuuuugagauuuuugguguccuggggccaccagucugccauuguaguaagugggugggcucaggagagcuugcccuuggcgaggccuuguggcauauggcugugcagaaacacuuccuucaguuucauucguuccuggggccacagccaagaauuguggccgccuugggcuuuuauuuuuaggucccccucccuuucuuuugguaacucucuuguuucauugacaguguuugcauuuuuuaaagaaauaauguauuggacauguugaaaauuguccgcuuaaaaaugucuauaagaaggugcagaaccugacuagucaucacauuuuguggugauguuugagugaaaguuguaauaaauugguggaaaguugaggcgguggcugaaguucccuuuauuuuaccgcauagcacgcuggacuagagcagugcaguccuggcguugaucucggccacugugcguuuuguacaugcccuuaggaaacucagagguaucuaggccuugguuucaggggacaauguggagagcaagcuuuuauuaucucucaaggacaauguuaaaaaacaacccagggcaaguacuagcaugcacucaauucuuugcaaggaugucggcgguguagcucaguggaaaccagguuuuccuuuugcuugcagagccaagcugcccugaacccuagggcacuggaugggagcuuaggguucgccaguucauccccucuccuuacugacagcacguggcccugugcagaagccacauggccugcccagaggcacacuguugggaggaauugucugauccccuccuuuuuuucucuugcuagaguaauucgaacuacugauuuggaaaccauguuauggaauaagaaaucagugugaggaugcuguggccugugaagccuggguuuuaguccccaucucagggaccagcaguuucaugauauaggcaacaagaagaguuuacacuccgguuugcuaacuugacaugaugagcaaaaucccuuuauaaucaacuccagagggucgccauauuguuuccuuguagugacuuuucguuaaaaugaaaucugugcucagagccccuuuccaccuccagaacuugcccuccuguguaaaacuguguaaaaauugagacucuuuauuuaaauuuacaggugaaaccacugcgugucuuccucccuguguuggcaggagggcaacagugguuggagucuuggugugaagaggcugcucuugauggcagcacacuuguaagcacauugccacauuucugaaggugaugacuuguucagauuauugguuuaugaguuuagauuguauauuuaaaucgucuuugguuguucuugacaagggauuuggguguuucugacauggggguuacagagcaucuucaaaugcuuccugagcaccuguuaggugguacuaaauacugugggaguugcuaguugguccagcuagcaugaccuuuccucugcagagguguccugagaaccaccugcugccuaguuaugugugcaucucugugaggccagggauuaugguugucccacuuacugcuguguccacaguacagagugcucaaauacuuguugaaugguuagccccuaagagcagaggggagggcagcuggcuacagcccugugcagaggagaggugucuucggguguacugaguagauuaaccuuguugaggcggaggauuuguggacugaaauaguaagugauuaguuuggaaaauagucuggggccagauuguuuauggugcucagguuggcuggggauuucuuugaugauguucgccugggaggguuuuuaaguagggggaugucgugccgagagagcgagccugggaagauguuuuuagcagguuugaguggguagaggccauagacagguguucuaccugagaguugaugucguuaggcuggaaaugccaaagacuugccuguucuuguuuuuauuuuuuugagacagggucuugcucuguugcccaggcuggaguacaguggcaugaucacagcuuacugcagccuugaccuccuugagcucaagugauccucccaccucagccucccgaguugcuaggaucacagcuaggaccacaggccugcaccuccugguccgguuaauuauuauuuuuuguagagguggaguuuuccuguguugcccaggcuucucaaacuccugggcucaagcagugcuccuacccaccuuggccucccaaagugcugggaucacagguaugagugagugaguuaguccacugugcccagauggacuugccugucugucggcagagggaauaggaaggguagauagagccaacagauauacaagcugaaucuauggagcuggacugauugacaguggcugugggagguggcuaagggugaguuacagucagcugaacugccauggggagcccagacacaggaacgauggugcccuugacaggaauauuuagucauuauuucauagcauuuuucuacuuucauaacuuuuguugucacuacagaaaagaucuuugaggcuaggcgugguggcucaugccuguaaucccagcacuuugggacguugaggugggcagaucaccugaggucgggaguuugagaccagcccggccaacauggugaaaccccgucucuacuaaaaauacaaaauuagcugggugugguggcaugcgccuguaaucccagcuacucaggaggcugaggcagacgaaucgcuuaaacccaggaggcggaggcugcggugagccgagacuacgccacugcacuccagccugggcaacagagugaaacccugucucaaagaaaagaaagaucuuugaguuuuuuuuauuucuggcuuuccugagcucccaccuaguccucucuuucuuuuuuuugagacggaaucucgcucugucgcccaggcuggagugcaguggcaugaucuuggcucacugcaagcucugucuccuggguucacaccauucuccugccucggccuccugaguagcugggacuacaggcgcuugccacaacgcccggcuaauuuuuuguauuguuuuaauagagacgggguuucaccauguuagccgggauggucucgaucuccugaccucgugaucugcccaccucagccucccaaagugcugggauuacaggcgugagccaccgugcccggcccucuuuuucuuagagugguuuauuauuccccagucacucucgucccaucacuucaaacucaacuagucaaaauuaaacuuauaucuggggguggagugugguggcugacaccugaaaucucagcacuuugggaggcugaggucgaggauugcuugagcccaggagauugagaccagccugggcaacagagugagacugucucuacaaagaacauaaaaauuaguugggcaugguggugcacgccuguugucccaguugcuugggaggcugaggugggaagaucaguugagcccaggagauugagccugcagagagccauaauugugacacugcacuucggcuuggguaacagagcaagauccugucucaaaaaagguuaaacuuacaugaguucaguugggcauuacauugugaacuguggggcccuucguauccuuuucaggccuccuguagcaauggaagugucugcauauacagagacccauaaugacgggcuugaggaggcuggcucucuaaagggcagaugcuacuggcagaacaggggaguagagggagggagacuccccugagggaaucuggaauguuccauuagagugaaaacugaguuuguagucuaggugugugagaaucagauggagguaagggaacgaauuaagagaagcaaagacaauagggggaaguggaggggagugcgugaugugcacaccgugugggaaaggcugguggccucauggggguaguggcugcagaguuggaaggcgaaauuagacuggaaaaagugcugaggccagagcgcagaaugcuuugaguggcugauucguagauuggggauuugcucugugggaauuggggaaccacugaagguuucugaggaggggagagauguaugaaaucugagcuuuucagagaagucccugcuaggauacaaugguuaaugcccauuguaagguauaaagugaagacuuuuguuuuggacuuuuuuuuuuuuuuuuuuaauagagacaaguucugucagggauggucucgaacuccugggcucaagagauccuccugucucggccucccaaaguucugggauuacaggugugagccaccgcgcccggccauuuuggaccuuugagagaaccacuuuuaucgaggugugauuuacaucugguaaagcacacauguuuuaagaguguaguuugaggaauuuaaaccacugugaccacaaccacaaucaagacagcauucucauuacuucccgaguuuccuuugugccccugcccggcaggacccacccagggcuucacugcucugcucuguuauuguagaugaguuuccucugugcaucuaaucugacuucuuucacuuagcguaguauuuuugaaauucauguuguguagaucuuuuuugcuuaguaauaauauuccaugguauggcuagcucacguuuuagaacuccauucaucuguuggugauuaucugggggcauuuccagcuuuuggcuauuaugaauagagcuucugugaacauucaucuauguggacagauguuuucauuuaucuuaaacagcugugcuugggauuacugggugauaauaagauacauauguguaacuuuguaagaaagugcccaguuguuuuccaaagugacauauuuauuuggccagcagcuuaugugaauuccaguugcuuugcauccuugccaacacuugaugaugucagucuuuuugauuuuaguuauguaaguagguggguuguaucucaccgugguuuuuguaugcauuucccugaugacuuaugaugagcauuuuuauaugcuuauuggccauucgaguaccuuuuucuaugaaguaucuuaaaauccuuggcuaauguaaaaaaauuaaauuuuaguuuugaguuaauuguguauauauauauauuuuucuuuaaacaauuuuuauuuuuguagaaaugggcucucacuguguugcccagacuaguuuggaacuucuggacucaagugauucuuccaucucagccucccaaagugcuaggauuacaggcgggagccaccacgccuggccaguuggagacaguuguauauuaacaugcauuuuaaagaaauacuauacagagauccuugguacccuuuacucaguuucccuaaugaugacuucuucuaaaauuguagcauaauauuacaccaggauauugaccuuuaucuaauccagguacagaucauuccaucccaggaggaccucuacuguugcccuuuucuagccacaccugucuccuucccuucugcuuccuucggguuuauuuuggucuucuuuuucuaguuucuugagcuaggaacuuguauuaaugauuugagaccuuuccucuuuucugauguaagacucuagugcuguaaauuucccacuuaguacugccacagcugcaucucacauauauguuguuuuuucauuuucauucaguucuagguauuuuuuaaaaauuuccuuugauaacuacuucuuugacucauugucuuaguucauuugggcugcuauaacgaaauauaguaguccccuguuaucaguaaccuuuggucaacuguggccugaauauauuacauggaaaauuuagaaauaauucauaaguuuuaaaucgcaugcuguucugaguagcaugaugaagucuuacgccaucuugccugguacgugacuuaucccuuuguccagcauguccacacuguauaugcuguucucguaagucauugauaucaucugcuccugacaucccaccauggacgucaucauggcuugaugacccaggaucucuccaagcagauaguucucugucugaccuauugucagaagguugggaguagccuaaagcuaggucacuacuaugccuaaugucauucaacucacuucaucucaucauguaggcauuuucucaucucacauccucaugagaagugugaguauaguacaguaaguuguuuugagggccaggcguggugguucacacccguaauccaagcacuuugggaagcugagguaggaggauagcuugagucuaggaguuugagaccagccugggcaacauagcaagaccuaggauccacauuaaaaaaaagaauuagcugggugugguggcugugugccuguagucccagcuacucaggaggcugaggugggaggaucguuugaguugggauuugagauuacaaugagcuguaauuguaccacugcacuccagccugggcaacagagugagaccgugucucaaaaaaacuuucguguguaggaaaguauaguacugagcccuauauguauauauuuuguuucuggaauccucugagggucuuggagcuuaucccuuggggauaagaggggacugcuguacuuuugaguaauuuauaaaugacagaaauugauuguucaugguucuggaggcuaagaaguccaagauuaaggugccaacagauuuggugucuggugagggccuguuccucauagauggcaccuucugaguguccuuauauggcagaagaggacaggcucccucaagccuccuuagucucauucaugaggguagggcccuugugaccuauucacccccgaaaggccccaccucucaccacugccacauuggggauuagguugccgugugaauuuugcaggggcagaaaacacucagaccacagcacuccucaaugauuucaaacuuuuaauuuucaaguguucagagauuuuccuguuuugucuuauguauuucccauaugauuucauuaagauaaccuaguuugauuucuuuuauacuuguuaagguuugucuuguggccuaggauauguucucuuuuagugaauguuucaugggcauuuggaaaaaaaugaguauucugcuguaacuugguggaguguucuaucaguuguauucugcuaguugguuguguucugauuuauaucuuuguugauuuuaugucuaguaauucugucuaggggguguugaagucccuagcuauacuuguagauuugucuguuccucuuuuuagcugugucaacuuuuuucauguacuuugaggcuuuauaguuuggugcguggacuuucaggauuuuuaggucuuucugguagauugauccuuuuaucauuauguaaugucccuuuuugccucucguaauuuuucuacuuuauuaauguaguucugcuuuuuuuaaaaaaguguuugaauggcguaucuuuuuucccuccuuuuaguuuuuaaccuacuuaaguuguugaauuugaaguguauuucuuguaaagagcauguaaugauguuauguuuuuuaaucuacccucuaccagucugucuuuugauugguguauuuagaguguuuacauuuacuaauaacauuauauuguuaacaauuacuauuuauaacguuaggacuugagucugacauuuuauaguuuguuuucuguuuguuuccucuguuucuuguuccuguuucucuucucuugacuucuuauugguuaauugaccauuuuuuaggauuuucucuagauuuauuuauauuguuuuuggguguaucucuguauaauuucuuagugacugcucuggguauuacgguauacuuaugugacuuacaacaguuuacugauauccuuauuuuacuguuuucagugaaauguggaaaccuuuuuuccauuuagccgcccuugcucucuccacuuuuaaauaccacugucuugaccaucugacaguguuaaaauuuuugucaucguauguaauuuaaaaaacucauaaggaggguagucuguuguauuuacucauuacucaugucucugcauuuuucuuccugguccuccaagauuccuuauuuucuugcucuuuggacagcuuccuuuagccauucuuuaagguuugacagauuauuuuauuuuucuucaccagaaaacaucuuuauuuccucuucauuuuuuuaaggauagucuugcuggauauggaauuugugguugauugacaguucuuuuccuucagcacuugaaaacugugccacuucccucuggccuccauagcuucagaugagaagucuuuggagcugguguucccuuguauguaucguaccauuccccuuuggcugcuugaaaauauuuuguuuuuaguuuuagaaguuuagucaugauguguccugguguggauuucguuagguuuaucuuuuuuggaguucacucaguuucuuaaaacauuucauucauuccugucauucaacauguuugggaagauuuucucucuuucuguugcuguuucuccucuuugaucugggcuccggugauagaacccuuggaucuuuuguuauucucccgcaggucuuggaggcucuguucuucuuuucuccauugcaguuucugccuguuguucagauuggguagauucucuugaucugaccucaaggucaaugauucugucuucugucaucucaacuauugcugagcccauccagugaguuuuaaaaugucuguuacuguauuuuccaguucuucauuuggcucucauuaccagaauuuucuaauuuuguuucaggagaauuugugauuacuugggagugauuucaugccaguugcuuuaaaauccuugucagauaguuccaacauuugauuuaucaugguguuugugccaguucaucauccucugauuaaagucauuucugauggcuuccugaucauuuugucuauuuuguuaggaaacucuggguacugguuuuauuuuagcaguagucaccuuguucagguuuagcaugcaggccuguccuacuuuugugacugugguucuggugauagucugaccuuccuagccuuuguggugcuguuuuggucgcuugacuuagccucuccccuggggcuuccauggguccccacugauguugcucgagggcagcaggagcuccuuaggcugggcagcgugcugccucuggauggacaugggagucucugcgcacaggaccaagagcuucccaggcuggguguuuguuuuacaccccugccucugagggguggaacauuucagcaucaccgucaggugcguggaguguggcuccugugccgguguccgccccuccccucggauggcuucccucaguggggagaggagucccgugaccaguggggaaggagagugccuccuaggccaggugcuggugaugguggucccacuugcuggauucccuuggugcagggugugucuaguuugugggaggggugucucagguccgccugauggggaaggagagugcuucugggcugagggaucucuugcugaugucccuaccugcugauuguuaguagggcuugggcucgccuggugugguagguggaacuccuacucaauccagggcagaauaaguguaccuggguugccucuguugcuaggcagggagucaggaagcaucaggccugugucaccucccguuggguggggggucguaagaacacccuguugcuguguugguccuccaguccugaggcccuaagccaguuugcuuuccucuuccaccuuucagaguccuccuuugucucuaggguucucuccaggguuuaugguugugcuuagaggagaggaacagggagagacaagugugugccauuuuguccuggccagaaauuccuucuggcugcuugaaaaaucuucucuuugucuuuggauuucgucaguauuacugugaguucuuuggucuguagaugucuuuuuuugaauccugcuggcauuuuguagugcuucuugagacuaugguuucaugagcuucacaaguauuggaagauucucauccauuauauguuuacuguuucugccccauuuuuucuucuccuuccugggccuccaauuacaugucaguggcacaguguauguuauuucugucucauuguucuucacucaggaugcuuuaauucucuuaucuguaucuaaucuauucaucagcccauuguauaaaguuaaauuuaguuacuauguuuuucuguucuacaaccuuucuuuuguuuuguuuuccuuuucuucuuucuuuuccucuuuuuuuccuuucuccuuuccuuuccuucucuuuucuuucuuccugccuuuccugccuuuucuuuuucuuuuuuguuuuuuccuuucuccuuuucuuuucuuucuuccugccuuuccugccuuuuuucuuuuuuucuuuucuuucuuucaucucucuccuucucgucucucuucucuucuccuuuucuucuuucacuguccuccucucuccuucucuucucucuucucuucuuuucuucuuucaacaggaucucauucugucucccaggcuggagugcaguggugcauucauggcucacuguagccuugaacuccugggcucaagugauccuccagcugcagcuucuugaggagcagggacuacaggcagguucuacuuugcccgccuaauuuuuaaaacuuuuuguagagauagggucucaucauguugccuaggcuggucucaaacugcugaacucaaaugauccuccuaccuuggccucucaaaguguugagauuauagaugugagccacugugcccagccuauaauuucugauuaguucuuuuuuuuuuuuuuuuuuugagacagucuugcucuguugcccaggcuggagugcaauguugugaucuuggauuacugcaaccucugcuuccuggguucaagagauucuccugccucagccucccgaauagcugggauuacaggcgcaugccaccaugccuggcuaauuuuuguguuuuuaguagagacgggguuucaccacguuggccaggauggucuccaacuccugaccucgugauccacccgccuuggccucccaaagugcugggauuacaggaaugagccacugcaccuggccaugauuuguuguuuucugaaaaaauuuguuuauagagaugggaucuugcuauguugcccaggcuggucuccugggcucaagugaugcacugcaccugacuuagcuuuccaaagugcugggauuccaggugugagccaccacacccagccuauuuuguucuuuuucuaaucugucaaguucuuuuuucuucuucuuuugauuuuuuguaauuuccacuuuucuguccaaaauuuuaaucgugucuuuuuuguugcuauuguuugaagcaugguaacugaaagucuguggcugguaccucaaguugugggguccugcgggccuguuucgucaccuuuggucuucagcaguuuauuaugaaccaugucugcacacgguuuucuuugaguuuauucuguuugggguuuucuaggcuuccugagccuguaaauuggugucuuucaccagauuuggggagauuugggccauauuuauucauauacuuuuuugcaucaaccuuuucucuaccgacaguguuggaacuuuugacaucgucucauacuucaagacuugccauuuuaucccaucaguuucuucucucuguucuucagauuggauucuuucuauugaucuauuuucauauucacugacuccucugucguugccauucuguugagcgcauccagugaauuuuauguugccauuguacuuuuuaguccugaaauuuucguucuaguuuuuaauuucucugcugagaucucuauuuuuucauauauuuuaagagaguguagcuuuaccucauggaacuuauaauagcuguuuuagagucuuugauaacuaacaucugggucauuuugggguuggccucuguugguugucucuuccuuugaaaauuggucacauuuuccugguucuuuguugaauaauuauggauugggcucugugaacauugggcucugugaacaucaugcugugagacugguuucuggguccuguuaaaguccuuuggauaacguugauuuuguuuugcagcuggguugcaauaaaccccauuggguucagcccaggaguccguuuugcugucaugggugguggcugcaguguugguucagcuuccacagcuuuugccuguggccccgggccugcccaaggcacacacagcucaggaguaagcccagaucuugcaggcucauacacgucucuggggaucccucuccagcucuccuuuugugaauuccuuacacacuuucuggcuccgaggaaccuucuuccucagccucugccuagaaagaugggcuuuccuccuuccuuaccccgugccuaggcuucccuguuucugcugcucaugcugccacugcacagcucugugacugcagccagcugggucaggcugggagagaaaagugggagcccucaggauucccccuccagcuuguaggggccccuuuuccucguccucuagccagagaaagacaggguuucucucugagccuggcugucuggggcugcccucagguccagccagggcagaaaagagaaaacgaaccugaggaguccccuguuuuggguuccuucuucaggauggacccuccuccccagugugccugcugcagcuuacuuuccagaguccuuagguagguguuugucuuuuguccagaguuuuuagcuguugucagcgggagagaggggcugucuuggacugucuucaucuuggcaggcuucaggagucugggagcuugcuucuguuacuguuucugcuggcuuuugcucaugaugucuugucauuuugcuuaacugaccauuguaugugaaagauuuuggaaacagucugaggccuaagauauaaucuuuucccagggggaguuuccguuggcuuccagcggucccuuggagacaggaacagaucuggucaccccacgcgaggcccugguggaggugccucagagccgugcucuaguccccugaggcugggcugcuucacguuugcuccugcuccugggugcagcccuucagguuacccacccagaguaugugguaggcgucauugggcaggcccuagaguccagauuuuguccuuagaaaggugcggugccagaaacacagccugccgucuuuaccaccucuccuggcacggacagcuccucccaggcgcccucagggggaaaccgcgguccaggaagagggacggguucucuggauugcgucuucugccugaacuuggccuggugauuccucaccacccaguuggccggccagagccucccgcaggugugaauuguguguguggagccucuguggcugugaguuguguguguauagccuccugcagguguggauugugugugcagaggcucugugggugugagcuguauguguguggagcauuccacaggugugaguuguacaugcggagccuccauggguguggguugggcaugcggagccucugcgggugugagcugugugcacuguccuacugugucugccacgggggcuuacuggccuagcacaggguccaccgugccuggaaggaggcucccucccaucccaccccgaggggccucccaugcuccuuugcccaccuuugcuccaugccuccuuuccaggcucaggcugugcaguuuguguuucgguugcagugguuguggcccuugggggccucgagauuucuucgugagcucaggggagcgagcuacgggugggagcuuacggggagaggaccuggugccagcaccuuuccugcuggguuucugaggugugaaugaggguggccggccgggccucaggugcagagccucuggccuuagaguuugugcuccacucuaaccaucccaugcgcucccacggccucucagaagagcucaggggaaggaggaggaggggcuaugaggguugccccuuagugucugccuccuggcccagugaggucucugucacugcgcucaugagauggcccagggcagcugcuagcaggcaggcucugcagccccuccagccucuccucaccagcacguggccucugcuccgggcuuggucuuuucuccacacuggggcuucucuuugcugggaguucucugaguuucugugagaguuuuuguuucguucgggcuucugccugugcuucuuggagcauuguuccauggucacuuugaauuccuugucagacagucccaaccuugggacauugccuuuucuccuggaaguugcagguuuuccugugggucuuucuuuuuuguuaaggagcuuuggguuguguguugggcauuugcaauauuguauuuggaggccguggguccuguuggaggccugagguguugguuuugguuuguucuagcagguaguccacccaguuacgucgagacugcaggcccugaccugcuccugggggcuacauacaguugagcguagguuucauuuucggucuucguccugccgcucuggcugggcugugggcuguggcccucagaguggcugcugugccacuguaguugcuucaggaguggccaggaugugacacagauuuagagggucucccuauccagcccccucuucucugggauccucuccccucucugaggguucccgagggucucccuugcuggccuucuggcuggaagccaagucugcaccugagccugguguggcaugcccgggccagcgcccuguggggugugugcuugucugugcaccuggcgcuccgcugucaaggugcaguuuguuacugguugucccugggugggggucagguggucuuggcccuguggggaccauuacaucagcuuuucuuacccuugugucuggccucuccaggauggagcuggggcguggacuacuggucgcuuuuaccuugaguuggaauuauuuccguugacuccuuauauccaaacaggaagaguauccacguuuuccagguggagacacucaccuuuggggccucugcagaggugacuuucucagugucaaaugcagauagccaggccgcccacggggacauucugggagagcuggucucagcucccagguggcucagacaagcaacagagcagagacucacuguccugcacgucucugggcugugccuggcacugcaguggccuggucuuuuuuccuggggcugaguuggaggcuacgggaguagcuggcuuuagguugggcaguggccacaguuguagcaccugccagaggggucuuugccgugugcugccguggaagagcuggcgguugguguggacaccuccucccgagccccgugcaggugccgcgggagggcugcagucgacagauggccacuuccugaccugccuuuucauccucauugcaguaauagcgacggaaggaauaacagcugagacucccgugugcauccacagagcuuaugcucagcuggcgcagggcaggagauagacccuuucguuguucggaacggacagguagggggccaggguucagagggauccaguaagaggccaagcugggacucugggccagguggcugugcugggcccugcccuugggagaccccagcgcuccaacuccugcucuccgucaguugccaccccucugaguuccuccugcacuuaguguugaccucacuuccacugcagacugguuagagucuucugaccccuucccagggccuuucuguguggcucccgccgaggccugccccacagcaguccagcagccacugcgaaugcguugcucauggguacugacguagcaguccgaggagugacagugcugccacccugacagugccguugccgacucuugucuccagucuccaugggccccugcccugcccguguccuuguuugacuuucacucugcccccuguagccgcacuucuccccacuuccuccaggcugggcccucccacucagcagaugcccugccuccugcuuaacauaguaagacaaacugcaggugcugaugggccgcccaccccuucccugcgucuguacccugacccagugaaagacacugcccuaccugggcccugcaucccuccccuccgccucccgaggggccuccuuucucaggagcagccuccuccucuucagccucucccauugauuggguuuucuuucgucaccguuucuccaauccuuaaagcagacacaucuuuuuuggccacacuuuccccucagagcagaggcacaguucccgcuguucucacuuccuuccuucugugccugcggcugucucuucaccaguucucagaaugcucuucccgaggcugccagcugaguccggcgggcucuguggucuucaugcaugcauccuucucagccuuccuuggugcacacugccccuucaaaaccuccucuggccuuggcagcaccauguucuggccccgccccguucucuguucacuuguccguuucuuuggcuucucucccgacaucugucccgugggcuugguguccucagguugccuugaccagcuucucccacugcgcccggcucucacuggaugacucgucccccugggcaucgauggcuguguauauguaauggguuccaaagcacgucuccagcuggucccuuuacucuugcgcuuccagucucuacaccucuccauugcaaagcuccccuugggucccacaggcucaucucuccuguccccgacugcccuccuccuccacacuacugguuuccugucuuaggaaaagggaccguccugcuccaggcuggcaggaauuauaaguuugguguuuuugucguacugcaucaggcacaggccugcugcucacgccuccugggcagugguuccccuucccggggcugccugccugugucagccuccauugucucuccuggcggugaccacagcagccuccuggguccacgcucauucuccacucuuguuuacggggagcuccagcagaugggaucuccucguccucuggcuugucugacccccuuacuugauguggucucauugcauuccuugugugcccgccuaagccugucucgcucugcugacagaucccgcagggcccagguccucccagcgcaggcacgcacaagagccuggugagcuaaugaaugaaacauccaguuugccucuuccgcgcaauucugaacugcugucacuugcugaaauucucuuaacagggucauuuucauguuuuccucucgcuccuacccaccccccuacuggcugcuuccuucccuaagaaacuucuccaccugcacaucccacugccccacugccccacuccucagugcgggacuggugucuccugcaccccagucccccagcacucauccugugugacacccuccacauugcguggaaauuaccuguugacuuuucaguugucuuacgaggcucagccugagaacagugacuuuaucucuuccuguuugacucccuggcauuuuuguacauuuucuggcucacauggguacuuaauaauugucgaaugaauguguauuaauucuaacagucuuacugguuuguagaaaaaacaacaagaaacuauuagaaauacauugaaggcaucacaaaguuuuuuuuuuuuuuuaaguagguauugauuuugauagaacguuaaacguucuagaacugugcacauccagcucucgcaguaguugcuuucacugaagccaguuacucauggacaagugcagugucugagggcagaacugccacagcagggccauggaggaguguggccacugucacccaguugggggucuggccagggucuuccuuaggccggauggaaaggaguaacauacaguuaggagggcuucaccacagucugaagcuuguaucuuuaguaagugcgucauuuuccuuuaacucucauuuuccugcaucugaaauuuaugugaauuaguuguguuaugcauauucauauaugauucaaaaaggugauuauaugaaucacuuuauauugauuaauuuuaaaagugggucacccuauggcaaacguuucuacuugguagauuguaaaagagaaacuuaaaucagagccaugguugcuuuuuccugucuggccagguuucugcaucugugagguaggcucugccauucucccuggggcucacccugcuuccaucuaaugccagcccuccacuuacgugccugucccgucucccacucugcacagagccaucacucugagggguccccuggggccuuucuccucagcugugccaguuucugcucuccuagggggacugcaucacaguugucuaagugggaggagaggguggcuuggaccaggccgguuaggcucgaggugcccccagacaucuacauggagaugucagauaggcaguucagggaagugaucagggccagaaauguacauuuggggaugacugugugucugugguauuucuagccaugagacugaauuaggucauuagggaggagugagauaggaagugccccuuccaauauuuggagaagugaggggcagcuggccuaggagauggggauggagcaggcagcgagaugggaggaagaggccagguaccccgaaaggagaaaggcagcucccuccaagagcccugacuaggugggcugcugguguggucaguugaauaagaggaaggcugagagugacugucgcaucuuuccccgcagccggugugaacugcugcaaacguuuucagguuaugggaucccuugcucagugcccuccccugacuucccuccacggcccauggguggagggaacuuggacaaacaugggcccacaggccgccuguuugucccuggccaccuugcucuuguuuccugggacgucucacuccggcgugugcgggguggcucugugcucaccucugcaggucagcuuuccuugagcaguuuguaaggacagcagaagucuucccguugugcuuggcauuggggccuguuccuuguguuacugcugugcucuguuguauuucaaaaguuccaaugauuucagauuagggggcuacucgauguggucagcaaguauaggauuugagucuguuaacauccacuaagccagccuuccauagcuggagcccuggcugcccuuggguugccgugaugaccuaaucauuguguacaaccaugcuuaaaacaaaaaugcuguguaaacggugacugcugccguuuagaaguaaaccagcuaugaggugcucagauuguggggaaaugaccagacuccaugggaccauaaugaagugacucagggcucaggaaaauagugaaggaagccagaagagauggcagcagagagagaggggugcuguggggaaccaucgccacagcugguucuuccccuggggaagagcuuaggagagcuuggcucggaacacaagacagguuuguuaguguccccaugaaugucucuaguguuacugguugucugaacgcuaggagucagugggguuucuucaugagcuguucuguggaggugguaguccuuucuaaacucuguggaggugggaguaucugcaccuccuagcagaguguugggcgcggggcacauuaaagaccugggggucacguguuuccgaaaugugucugacugcagacaucccucguccuccgucuuuagugggacagccguugaugucuugugagacagugugaggggcauaguggcaaggcuagaaaagugggugaggccagcugugacacauucggugucccguguguaugcugcuccugcgcuguuugugugggaggcggcguauguugcagccggaaguauacaguaggcucucuggaucagauuguguggguucaggcuggucucugccuccuguggccuugagcacuuacuuucucugugccucaauuucucauuuguaaugugcagaugguaguccucauuugagggaacugcaguggcaagauuaaguagcgugguucaugucaagaguuugaugcugccugguccaaaaauggauaaaggcugauugcugcugcugcugcugugucgucaugguuacaguggcaccacgccugccuggcucccucuucuguaaagaccauggguguucacccucuguuaucacuucugauuuucaugucagaaagaggaugcugggcucccuccccgggcugaugccagcccugcccacaugcugucuccgcugguguccccaggcacuacaugguccuagccugugcugguuuccccucagccccauuaacacacucagggcucccaugucuaccuucuuacugcuguuaaguuaggacagucauccuuugaggucacgguggaggucacgaaaugauuucaguugucuguguucacagaguagucugagaugcuacaguuaguugccuuuguaaguacagaagacaguagaauuauugaaaagccuagagccuuuucacguuguuaguugcucauuuaaucaaucaaucaauuauuuuuuuugacacuuggucucccuguguugcccaggcuggaguacaguggcacagucauaguucacugcagccuugaacuccuuccuuugggucuuguguguggcacucaccuggucauccccucccugucuuagauaacaucccugaggaccucagagacccuuucuacguugaccaguaugagcaggagcacauuaagccgccuguuaucaagcuucuccuguccagcgagcuguacugccgugucugcagccucauccugaaaggggaccagguggccgccuuacagggacaccagucugucauccaggcccugucccggaaagggaucuaugugauggagagugaugacacccccgugacagaguccgaccucagucgcgcacccauaaaaauggugaguggucugcgguggccgcccccaggggccauccucuggagccgugggcucucguguggcgcaccuggugcauggauggugugaacacggugugcggcgaggugguggagacccgugcuuuugcacacuggcguuccuuaggaaacugcauaucuuuuaaagcacaugacuguuguggagaauggggaaaagagagcuuucauugagcucuuuuucucauugggaaugcucugugaaugcugagauuggagugaggccuguuaauaaaaauacuugaagcagacuuuuuacagaugagaaauguaauuguugcacccauucuguuagguuguuucaugcauacuuugugcuaaaauaacucagucugccuuuuucucccccaaguaucccacccccaucuuucucugaagccuugcuacuggugugccuuuuccagagcguucugggucagggccauucucggugccuccugcacugccuuuguuugguugcucccauggcguucccggugagacugcgggugccgugcggugguugaagagagugucauuccugucgaaugaggaagcugcacuaaggcguggugcagcuguagcagguagagcucuggacuaggagccagaggccucuggugggcaguuggccuggggcaggucuccugucugccuucccacaaccacgaccugggagcugcaccgccuuuccugggagucccacagggcuguugaggagauaagaaaggacagugugagacagugcacugugggccacagggcuggccugccugccugagaacggacuccugguuccagacggucuugaggcuugaccagaaaugccaggcuuggaacagugauggugcgggggaggcaggucucaaaucugaguaucucuucagacggaaagggcgagggaugaagaaauuaggccagaaugcugaguaugagcagguucccugcaucagaaccugguaagagggguggguuugagggauuauagcugcugccucugccccuagagugcccacauggcaaugguggaugcccugaugauggccuacacuguggagaugaucagcaucgagaaggugguggccagugucaagcgcuucucaacguucagugccucgaaagaacuuccguacgaccucgaggaugccaugguguucuggaucaacaaggugagugcccugccuagauguggugugugacucugcuucuguggccggucuccuuuucacuugagagcagcacaccuugucugucacgcugagacccagcccuucauuugggaccagucauauuuuguguccagaaaugugucugcuguaguuaaaaagaagcaaagcaagcagguguuucucccgcaggccgagaguagagggugaugaauuuauaucugaaaaugcagcacaugucgguacuuugagugccuuuaaauuuuuuuuuuuuuuuugagacagggucucacuuugucccccaggcuggaguacaguggcacgaucauggcuuacugcagccuugaccucccaggcuccaagugauccuccugccucagccuccugaguagcugggaucacaggcacgugcuacuaugcuuggcuaauuaauuuuuuuauuuuuuuuaauuuuuaguagagagggagucucacuguguugcccaggcuggucucgaacuccugggcccaaacaguccucccuccuugaccuccugaagugcugggauuacaggaaugagccaccacaccuggccagugaauaauuucuuuuuauuuucauaguaugcaccuauaugcaauaaaggaguuuaucaaaaugccuucagaagcauuuugauuauuaaggaaaaaaaauggcauuuucccaaaugcuguuuucuccuuuuacauuuagaagcucauaguguaauuuuaaauacaauauauguaaagaauguuuacuuuuaguagugucuaaugauuuauaagguuaccuuaccggagccuuugguuaguaagcauccugauaugcaaaaagguguuuaaguuugcgcauuaacacagcaaaggaacuagaagguuguguggccccaugugaggcuguauuagcgcgccugaauaagaggcucacgcaggaugguucuggaguuacugauaguuagcuugcacaugcagagccaggccggugcuccaucugcuggcucccuggaagaccccuccgucgcugugaaaggcgggucuuugucaggaguuggcagacguuuguguuucgacuuuuucuaagacaguugcccugcucuugagcuguuuuccuacccaagcuugggguuggugaaccagguggaugggcagacuccuuacauuuccuuauccugcggugagguagggacagaaagccacaggguuuucuaggacucaguggagccuccgggcccuaguucagauuugggugucagccaguagcaucucugccccacucugccucuacccaugaggacgccucuugguggugagcgccaugucucacucaucccuggcucucaccuggcggcgugcaugugggaagugcuugcaagaauucuguggaaaaugguguucaggccuaguucacauuuccagaggagccugagcuucggggacgcuccuguaaugcuaguggaagcuuccugugaucaaaagucaaauuuuagcuuuucuuuaauaucuuuuauugauuuuuccucguauuagaaaugacauaguuauagaaaauguagaaacuauggaugaacaaaaagaauaaaauguaaauuacccguaaucuuaucaccuaugaaaaugguuaacauuuugguaaaaauucugauaguuuuucuugauuuguauguguuauauaggccuacaacacaguggggagccuacugugcuuucugucguaagccacguuucugcuugguacgguacugugcagugaguuucugcucauuggccagauaucugauuucagccguuccagugacuccccuguggcccuucugugaucucaguguugcuggaggucaaguugucuccucuccaucugugcaguagucuccguccagccacgaugauuucccucaggccacguuccugcgaggggaaugguuguucauauuuaaggacuuuguuuuuuguuugcuuguuuuuuuuuggccaaaucugaaccuaaagauuguaacauuuuccuuucuauuaguuuguguaggugucuuuucccaugucuucccauaucuugggcauuauuaaaaauuacuugcccauuugaaaggugaaaaauagugucuuuuucuaugguaaagacauagaaaaacuuaauucuggguaaaauugcagauucuggguaagagcaucugucccuuacucuccuucucuggugaaucacuuguuuguuaucuuugcccguauuuuuuugggcaagaggguauguuucuuuuuccccugcuuggucacguuucucauuugcugugcauuuguaagugacuuuucaggcuguugcuggccucuguguuucuguggacuuggcagauaaauagaagguggucuccuuguaaccagagacaucauuuuccuuccaugcuauucucguuucuaccucuguauuuuaaagaaauacauuguauuuccggcuccugacuccucauuuguggacaugaucuacugagguaggauugugacaaauggcaauuacagugauuacaguuuccauggcccuccacuccccuccuccucauuccccugcgguugcauugacagcuuuggacacguucacagucagacuugauguuccuguggucaggcgcccauuuucacaacucauguuccuuuccuuguauuaugcuuuguuuuuccuggaguuaauacuugguuuaguuuucaugaccuuuucuuuuuucucaugcauuauuuacauuuguauucaguguuuuccauauuuuacuguuuucuugccauuuccauaugaauuuaaguuccuuacguuagugguuucuccuuaugugacuuucucccgggugcgaguccucacugcaggaugcgauaccggcugaaugcuuccaaagcaccuuuugcagugugaaugcccggguguguaggaagugcgaguuccccgagcaaacucucucacccgcgcuguguuccuaggcccucuccgguguggguucucagaugcuucacuggcuucgagcugugccccaaagcuuucacucuacaggugggguuucuccccauuggaaauugcugcauguuuaauaagcuuggggcuguugguacgauuuccauaagggugaguuuuuucuccagcaucaauucuuugaugcauaaggucugaauucccuuugggcauagauaccauguuuccaagaugccugcugugcgcaggugcauuugagugcagauuucagcuucucacacccacaccuggguaaucccuccuuggguuuggcucugugucguccucugcagcaucugugggggaauggccauguucugagucucuccuccucuguggcaucccucugggacucuguccugccccugccugcaugguugcugccccagccaccugcaugucugccauccuggacuuucccucccuucaccucugcuccaggccgcucacccgucuccuccuggccggggucccuaccugggugcaggagccucccugccgucugaggaaaggcuaaugcugugcauuuccgggaccauuucugagacagcuucugaaggggccuuccuccaccuuucccuggugauuguguaacuagauggaagcgcuuuccccagcuugaggggguugcccagcugucuucucucuuccaggcugaggaaucugcugccaugcggguuucccauccuguaugugacccagaugaccucacucagguuuuccuccuucccgggugcucugaaguuucaccaugaaucaccuugcaggggcucuuuuuauuuuuuauugaugcccagccaguuguuguuguugucucuuucucucuuuuuguuuuuuuggagacagagucucguuuuguggcccaggcuggagugcaguugugucauugcggcucacugcagccugaccucccaggcucaagcaauuaucccuccccagccuccugaguagcugggacuacaggcaugcaccaccgugccuggcugauuaaaaaaaauuuuuuuuaauuagagauggggucuuacuauacugcccaggcuaguuuugaauuacugggcucaagcaauucuccugccuuggccucccaaaaugguaggauuacagaugugagccaccacuccuggccuguuuuuuucuuuuuuuuuuuuuuuuuaagacagcucuacugagauguauuuuauaugaagucaguggaucuuuuuccuugaguuuugauaagcagucauuuguuuagcauucaccacaaucaagguaauguuuccaucacccuaaacaagcucuuucauggugcuuugcaguuaauccucuaccccaaugcagguaacuacucaucugccaucuucacgguggauuaguuuugcuuuuuuuuuuagguuuugauaaaagugaaguugugcggugugugcucuucuuguguuuggcuucuuucagugaacaaaguguuucugagauugaccuguggcauugcaucugucagaaguucugucggugcuugguagaguuccaucgugugcauauaccaugguucguuuaucuguccaccuguugauggacacuuggguuguuuccaguuuuugccuguuuugaauaaagcuacuagggacauuugugugcagauauauuuuuauuucuuucuuuuuuuagauguagucucacucugccacccaggcuagaggguaguggcaaggucucggcucacugcaaccuuagccuccuggguucaagcgauucucuugccucagccucccaaguagcugagauuacaggcgccugccaccacaccuggcuaauuuuuguauuuuuaguagggacgggguuucaucauguuggccaggcuagucuugaacuccugaccucagaugauccacccaucucagccucccaaagugcugggauuacaggugucagcuacugugcccagcaauauuuuuauuucuuuaaguaaaaauuuaggaguagaaucucugggucaugugauaaguauauauaacuuaauacaaguauguguaaguucagucauuagaauaaacugccaaaauguuuuccagugauuguaccauuuagaacucccgcuagcaagauaggauuccgguugcucuacacuuguuacaguccgucuuuucucuuuagccauuugaguggauguguaacugucgcucauugucguuuuaauguuuuccuaauggguaaagaugcuugucuacauucuuuuaugaggugcugcuucaaauauuuugccgaauuuuuaacuggguugucuuaccaaguugcaagaguuuuuagaaauguauguauuugggaaucaagggccuugucagauguauguaucaugaagaucuucucccaggccggccaccuuuuuguuuucuuaacagugucugucaaaaagcaaagguuggcugggugugguggcucacaccuguaaucacagcacuuugggaggccgaggugggcagauugccugaggucaggaguucaagaccagcuuggccaaaaguggugaaaccgugucucuacugaaaauacaaaaauuaggcgugauggcgggcgccuguaaucccagcuacucaggaggcugaggcaggagaaucacuugaaccagggagguggagguugcagugagcugagaucaugccacugcacucuagucugggugacagagcaagacuguuucaaaaaacaagcaaaggcuuuuaaaguuuucuuuguagcccaauuuaucaguauuuccuuuuaugguuuguccuuuugugucuuauagaagacaucuuuacuuacuccaagguugugaggaguuucuccuauguuuucuucuagacguuuuuuuguuuuagcucuuacauuugccucugugacccacuuugaguucauuuuuaugaaugauaugagggaaggguugagguucauuuuuuucuucauauagauagcaguucugaaaccauuuauggaagagauuuuccuuuccuuauugaauuacuuugacaucuuuguugacaaucaguaaaccacauauaugugagucuguuucuggauucuauucgguuccaccgaucuuugugucugguuuauaggaauacuugaaauuggacaauguuaagucuuccagccauauccuuuguguuaaaaaauaauuguuuuuggcugggcgugguggcucaugccuguaaucucagcacuuugggaggcugaggcgggugggucacuugaggucaggaguucgagaccagccugccuaacauggugaaaccucaucucuacuuaaaauacaaaaaacuagccaggcaugguggcacaugccuguaaucccagcugcuugggaggcugagacaggagaauugcuugaaccugggaagcagagguugcagugagcugagaucaugccacugcacuccagccugggcgacaagaguaaaacuccgugucaaaaaaaaaaaaaaauuguuuucacuauucuagguccuuugcaugccuacccuuaauuuuagagucagcuugucagcuucuauaagaauacuugcugggauuuugauugggaaugcauugaagcuagaugaauuucgggagaauugauguguuauuaguauugcauauuccagcccacagacaugcuuaucucucuccguucuguguagaccuaacagcuucacagcuucucucagccauguuuuaugguuuuucaggguaacauuuuguauauaguuuaacuuuauucuguaucuuuuguguuuuggauucuauuauaaaugguguucuccuaauuucauuuuccaguuguuuguuacuaguccguagaaacguaauuaauaauuuguauauuaacuuuauauuuugugaccuugcuaaacuuauuuauucuaguggcauugagaaaauuccuuaagauuuucuacauacaagaucauguugucuguguauaaagucauuuguauuacuauuuaauauguaugcucuuuuuuaauuauaaagguuuuuuuuuugccuuacuguacuguuuaguaccucagauagaauauugaauagaauuggugaaagaagacauuuuugcuuguauuucaucuuagggaauaaacauuuacuguauuaaccauugaaaugaugaauguugguuguaauuuuuuuuucauagaugcccuuuauuaggaguucccggccccuguggccccccccccccuuuuuugagacagggucucacccugugucccaggcuggaguacaggugguacgaucauagcucauuguagccucauucuccugggcucaagcaauccuucugccucagccugcugaauagcugggacuacagcacacagcaccacgccuggcuaauuaaaaaaaaauuuuuguagaggggauuuugccacguugcccaggcugaucuugaacuccugagcucaaaggauccgccugccuuggccuccgacgccuggccaggaguucccuucuauuuuaaguuugcuuaggguauuuuuuucaugaauacauauugaauuuugucagaugccuuuucuguauuuauugagaugauuauaugacuuuucauuuuuagucuguugauacaaugaauuacaguaauugauuuucagauguugaaccagcccuuucauccccaggacaaacacaaauugguuguguuuauuauuuauuuuauauauugacggauucgauuugcuaauauauuguugaugauuuuugugucaaugcucucggcagauacuggucucuaguuuuuuuucucaugauguauuucucuuguuuugguguugggguaauguugggcuaaaaaagugaguugggaaguauuaagguaaaaggaaauuaaauauuaaauucacugguaaagcaaucugggaguggaguuuucuuagacgauuuuaauuaugaauuuaauuucuuuaauauacauaugauaauagauuuucuauuuagcauugugcuagcuuugguaauuugugacuuucaagggauuugucaguuuuauuuaaguaguugaauuuauuggcauaagguuuauauuucuuuauuuuccuuuuaauauaccugcgaucuguagugacaguguccuguuuguuuccugagguuggcaauuucuuucauuuuucuuuaccuugauuaguccgauuuaucaacuucauuaaucuucuaaaaaaucuuuuaguuuuuauuuucucuauuuaauacuuaauuuccuuuuaccuuuauuauuauuuuguauuuuggguuuaauuuguucuccuugucuaguuuuuuaaggggggaguuaguuauugaagucuuuuuucauuuugaaggcagguauuuaaagcugucgauuccucucuaagcggcacuucagccgugcauuauauauuuuuauaggccaugucuuucaucauucucuuuaaaauauuuuguuuccccuguggauucuuguuuucucacuggguuaucuagaagucagauguuuaauuuucagauacuuaaagagagguucuagauagcuuuuuguguugugguuucugguuuaauucuguugucagggaacauacucugugauuuucauccuuuuaaguuuauugggacuuaggguccgugacaugccuuaccuugcagaauguuuaauaugcauuugaaaagaauauucugcuguuugaagguagagugucuucagugucaguucagauugguuguuggugguguuugugucuccuuuaccguuuuccugucuuuaguccuauuacuagguuaaucugagaggaggguggaagguccugagcugugcacuuguaacccgccauuugguucugucaguuuuuacuuuguguauuuucaaagucuguuacguuuacacauauucaaguuuucgauauuaguugaugaauuaacccuuuugucauuaugagauguugcuuuucaucacuggugguaauccuugucccagaagucuacuucauuuaauguggauguggauucaagagugcuugugaauaguggcugcacgguguauguuucauuccuuuaacuuuuaaccucuuguugucuuucucuuuaaagugaauuuuuugcagaugcuguguaguugcucuugcuuuuuuauucaucugacaaucucuuagaguguuuaaaccaauugcauuuaaugugauuauccauaaggcuugguuuuaccaucuggucuguuucuguuuaucucuuuucuuuuucuucccucuuuuaaggguuauuuuggauuuuuuuuuaaguacucccuuuuauccuccuguauuuugucgggguugcuuuaggguuccugugugcaucuuuagaccgucacaggcugccugcaagucaaagugaugccauugcacaaauagcagaagaugcaucuuuuccucgcugaccuuuguguugucauucauucuaccccagcugugcuguuuuggcuuucuuuuaucuuuuaaaguauuuaaaaauugagaacaaaagucauuaauauuuauccacauaauuuccauuuuuguuguucuuaauuccuuugcauacaucaagaguuucacacaguuuggucucaggaucucuuccguuuuuuuuuugagaugggaguuucgcucuuguuacccagguuggagugcaauggcgugaucucgguucacugcagccucccucuccuggguucaggugauucuccugccagccucccgaguaucugggauuacaggcgccugccacuaugcccggcuaauuuuauauuuuuaguagagaugggguuucuccauguugcuuaggcuggucucgaauucccgaccucaggugaucugcccaccucggccuccuaaagugcugggauuacaggcgugagccaccacgccuggccaggaccucuuuauaaauugcuguggaccucagauaacuuaccuuuuuuuuuuuugauagagcuggggccuugcuguguugcccaggcuguucucaaacaccugaccucaagcgagcuuccugccuuggucucccaaugugcugggauuacaggugugagccaguguguccugcugaacuuguaaagaaaauuuuaaucuaucaauguuugccauacuagaaguuaaaaaucagaaaguuuaaaaauauuuauuuaaaaauaacaguaaguugauuucauguuaauacuaacaauguuuuagugaaaaaugacuauuuuucaaaacaaauuagaaggggcuguguguggcucacaucuggaaucucagcacuuugguaggcugaggugggaggauuucuugagccagggaguucaagaccauccccgacaacauagugagaccccaucuacaaaaauuauuaaaaauuagccaagcauggugguguguacuuguagucccagcuacuugggagaccgaagcaggaggauugcuugagccugggagauugaggcugcaaugagccgugauuaugccacugcacuucagccugggugacagggugagaccccaucucaaaauaaagaaauaaauaaggaagauggcaguuauuuuacaauuuugcaagugucuuacuaucuggcuugcuagaggauagcugauucuccuaucuacuuuugcauuuaaucugucacaauauguuguuguuauugaaguucaugaacaaaaucuggcuucauguagauauauaauuggaagaggggauaguauuuucacagucuuuucugagaaguaugcaaaucuguuuuugcuauuacaccaaaauuugacaaacaauaguuucucaaagauuaauuauguggaauuugaaacuaucaucaauuaauguuuuuaagaaauugagauauaauuuacaugccauaaacuucacuauuguuaaaauguacuagucaguggauuuuuaaauuuuuuuauuuuuauuuuuuggagagagagacucuggcucugucaccuaggcuggagugccauggugugaucuuggcucacugccaccucugccuccuggguuuaagggauucuucugccuuagccucccaaguaacugggauuacaggugugugguacugugccuggguaauuuuuuuauuuuuuguagagauaagguuuugccauguuggccaggcuugccuugauauccucgccuucaagugauccaucugccucgggcucccaaagugcugggauuacaggugugagccacugugccuggccuagucaguaguuuuuaauauauucauaaggguguuguauuaaucuguuuucacacugccuaaagaacuguccaagacuggguaauuuauaaagaaaagagguuuaauugacucaguuccacauggcugggguggccuugggaaacuuacaaucauggcggaaggggaagaggcacgucuuacauggaggcaggcgugagagagcaagcaagaguggggaaaacugccuuauaaaaccaucacaucuugugagagcccacucacuaucacaagaacagcauggagaaaaccuucccaugauccagucaccucccaccucgucccucccucaacaugugggaauuauggggauuagaguuugagauaagauuuggguggggacacagagccaaaccauaucagcuuuauagucaucaucacuggcuaauuccagaacauuuuuaucauuccaaaaaaacucugaaccuauuagcagccagacgucauucucuccucagccccuggcaacuagcagucuacucuguauccauggguuugcucagucuggacaguuuuuaugaaugguaucauacaguaugugaucuuccgugccuggcaucuuucacagagcauguuuccaggguucuucuguguuguagcgggugucagcguuucauuccuuuuuaugccugaauaauauuccacugugugcuuacgccucguuuuguuuauucauuuaucaguugaugggcauuugugguguuucugcaucuugacuauugugaauaaugcugauuucaugcacaaguuuccugugugaauacauguuuucauuuuucuuggguauguaccugggguggaauugcugggucauguauucauucuguguuuagcuuuuugaggaacuuccagacugucuuccacagcagcugugccauuuugcauucccacuggcugcaucugaggguucuaguuuuccccauccuugcuaacauuuguuauuuucuggcuguuuuuuuuuuuuuuuguuugagacugagucucgcccuuuugcccaagcgggagugcaguggugcggucguggcucacugcaaccucugccuccuggguucaagugauucuccugccucagccucucaaguagcuaggauuacaggugugagccaccacaccugacuaauuuuuguauuuuuuguagagacaggguuucgucauguugcccaggcuggucuugaacuccugagcucaagagcuccaucugcuucagccucccaaagugcugggauuacaggugugagccaccgugccugacuguauaucuucuuuggaggaauucauacccuuugccuauuuaaaaauuggauugucuuuuuaugguuguauuguucuuuuauagauucuggguacuagaucagugaguuuuuauacucuguuauuacuauauaguaaccauuucuaguucuugcauucuuccuggaccuuuuacccacccaggguuuugcagcuucaugcuuuggucauucggaaaauuguuucacugaguuauguagaucuuccaaauguugucacauuucaugacacaguaucaaaacuuacauucauugauauugccaaucuuggcugggcgugguggcucacaccuguaaucccagcacuuugggaggcugaggcagguggaucacgaggucaggauaucgagaucauccuggcuaacacggugaaauccugucucugcuaaaaacacaaaaaauuagccaggcgugguggugggcgccuguagucccaacuauucaggaggcugacgcaggagaauggcgagacaugggaggcggagcuugcagugagccgagaucaugccaccgcacuucagccugggcgacagagcaagacaccaucucaaaaaaaaaaaaaaaaaaaaaaaaaauugccaaucucaucagaaaagccuuuacauguuaggaaguuaucuagcuuuugguggcagaaacaaguuuuccaaaauuuaaauuuuuucugaaauucaaauuuuauuacuggaaaaaaguaguuuucuuuuagugacagacauucauuuaaaaaaaaacaaaaaacacuucuuugguuuugagaugaugucuuaacauguuugcaaaugugaauaacugguuuguuaauggcucagcuuguaacucagucaggugcacaggugcaugucccgaggucacugaugucauuuggaccacaggagaggugcuuugugccugcugaccauguggucauggaauacaaaagaaguuguacuauaagguagagauuuaauaaaauauuuuccaucuguaucguuuccuucagccuaaaaaacuucuuuuagcauuuuuuuuuuuuacaagcaguucuacugaauucucucagcuuuuuuguuuuuuuuucugaaaaagacauuuugcuuucauuuuccaaauauacggcuggauauaaaauuuuagguugacugaauuuucuuucaggugaaaauauggcuccauucuguuaugcugcugggguuacuuugugggaugaggugggacuggguucuugcuccaacuuuuuaagacacugacuuucaaccguugucuugucugcagccuugucucuggucugaggaugggaggcgucuugggguuguuugcagggccccugccuggcaucucuucuccagcacuggggcugcacuggcucugcucuguguagguuucccuugcuuacaggguuccccucuugccuuguuuguccuguggauuuucagcuuuuaaauuaucuuuucuguauuauuuucacagggaucagaguuacaagcaaauguuugauuuacucuguuuagucuucuugauuuuuugguaauuuauauuuuccuuuaaaauguuaguuucauuaaaaauuucaaauuaauuuacauuuuaagaaggauguguuuuuacguggugcuuuuuuaguggcuucgacuuuccuccaaaaauaugacuguuucauguuauguauugguauuuucauucauuuucuugauuagcuuuacagacuuuuuuuuuaaaaaaaaaaaagaggggggucuugcuguguugccuaggcuggcgugcgguuuuuggacucaagugaucuucgugccucagccuuccaaguggcugggaugauacgugugagcugccacacucguccuuugcaaaggacucuuuuaaucaugcauacaaaacuugguuguggauuuaaauauccuuucuucuacuuucucauugauugaauuuuacauuaucuauauuuuuuuugucuuuauuuuuaaaaacaguuuuucguacuccugauuugaugugcaugguggacuccuuugucuguguuguuugaugacgaagcauucagcucugugucuuuuugucugaucauggcuuuuaccuagccccuuuaagcacugcugaguguuuuucuccauacuuuaugauugcaauuuugauauugaguuaguaauuacaggagagaauacuuaaauuucuaagaaguugaauuaauuuuuaagggguguauaguuaaacuuuuauaauuagauuugguuugguaugauuuuugcauggucugggaugugugacccauccugucacaaguuaggcucuuuagugaggugucuccaccagauuguuuuguaaguggcauuugcuguugguguuggagaagcuuagcuguuugacaguacuuguguggugagugaccacugccaagauguagugacucugccccgcagugacgggggagcacugcgcuggcauuggggugggggucgggggcaggugguuuccuggugguagcaggcggaccuuguuguggaucauguggaauccguguacuucuguaucuguguaauuggccuaaacaauaccuaugucuaggagucagaggugaaucaggugaagugggggucucugggggauaauuguggagauacaauugugcgggacagcaauuaccucuuuaaugcauuucucuucuacuuuagguaaaucuuaaaaugagagagauaacagagaaagaaguuaaauuaaaacaacaguuauuggaaaguccagcucaucaaaagguaaaggguaaauuuaauuuuucuggaaugcacuaaguuaauguuggucccaauuuuaaagaauucuguuaguucccacuauuugcuuauucucuauuuuuacucaccaaagaagcagcuagucucuuggauucaccuggugggcugauucuccacaccucagugagaugugaccacggcagccugccccgccucuccugggaagggguguuuuguauugcacuuuauggugcgugaggguauuugggggaauugggaagcuugagugagggacguagggcccaccugggugcuagcuuccacaagucaacaaacaagggggaaauugccuguugcuaaagaugcccucgaaaaguccuuaaguggcucaugagguacagcguagcuggugguguaccugugugccugugccaugauucugcuggaugaacccuacgugccuacugaaguagcacgauggcugggcugcaccuuccagccauuagccuuuuucuuccucugacguuauuuucucuuuugcaagcacaugugugacugaauucacucaguucagugcacacaagaugcagcccgaccaucuauaaggucucgccuuugaagggcagugugcugccuuccccuguuccuucuucccccuccaguggcaccagccccuggccaugcauuuguuagcugggugggugggugagucaggccgccugguaugccucccucaucuggaucuuaagcauugagcuuccucccuguuccucagauggucauguuuaacacauggguacagacuaagcacuagacccuucccgcgucagagcugacuucuugccuuuugguacccagcccauaccaaguuuccgaaguuuucuuugcuacugcaaagaauaguguuguggaggugacucgugaucuuccacuuuaaucaucugcuaauacaacaugacuauggccacguacacuuagaagacuuugcuuaccagaggcucucccgccucugccguguaaacgccguggggaaguguguguuaccucguccacacguggaccugcucugcugaugcuccucuccugccuuccuucucucgcuuccugagcagucucccuccaagugguauuggaaguuagugccuguaagugaaccccaagccgccagcugccaucuacagagccauccugucgcgaucacuugcuuccauuaaaaacugcucgcacccaaaacuguuuuuuuguuguuguuguuuaaaugucccaccuuggaguuauuuauauaguacaagaauuggccugauucugagccgaauaggccuuguaauauggcacuuuggaacucuuaaguuacauuucgcccaguuuccuaguuacuucuuuaagugaucaacgugcacguaaugagagggcauuuuugugauagauacagagggaaugagaaguggucuaguugcccaaguuacucuguauauuuuguucuuucugauguuaccuugccugacugugguauguaaugugacaucuguuaggagccaucagcugggugguccagguaugcgggugaugcaccugguggacuagggcuggagggcugcagagaggggcucucaccagcaugucagauuccucuguucuccuccucggguguugcagccauuccugcugccucggccugcauggaguggggaaggggcguuuccuuauucccaggcaagggucugaguuaggucagccuggccacaggcuuucuggaguuaagugugaauuuucacauaaaaagaaaggugaaaacagcauuugguuuuccaacccuaguugugcuccaccugguggcccauucuggaagcggagccaguuuguuaccaggccccuggggagagaguacuuggugccaguggugccuuucucgggaacuuuuggauggagaucuugcagagggcuuuaugcauacuccauuaacugccuguguccuucagugucauuauugggccccuauuuuccuuugaaguccauccucgaggcgauagcagcgggaguaagcugggauacagggcuccuuugagcagcgguagauucugcugcagagcucacagaucauuuugccucucuugaaauauauuaauaagaagaaagaggaaagcauucuaaaucaauauagaucuuuuaacuuuuugaauccugaagacugaagagcuaaauaucaaagcacuuacgugauuuagucaagggcucacagacuucgucuguccugcaggaagugaggucacaugagaguuuuauaaaaacagaaacauguuaccaaggguggugggucccuuaaugcuuuuuuauuagauaguucauaacccuaacuuuccgaccccaguguucaguaaauaggucagugaggagaaguguggaaaggccugggaaagacggacagauuuagaggucuaaccucaacacuguacagccuagagguucacagcaccugauuugcaaggcagcuauacaaguuccuggacucuuguaguuccggaguguuucaccugaccuuaagcccaccccauccaucuuuaaucaagaaaccaugugcuuucccgcaugccuguguuccccccucacgugucugcugucuguguggaagccuggccuggcgcaugcuguggugcacugcaugcuggaacccguggaguuugcacgcgugguacaguaugaggcgggucacguuuuguagugugugccgugggcucccgagaaacaaguuaaagugugugcugaaauagauuuuauugacauaaaauaagccuuauugcuaaauuuaagagaauguguuacaaauguuuuuugcuaaacaucaguauugauuauucuacaugauguacuuauugacauaacaaccugaaauucuugauuuuagacaauuucuccucaaguugauucagcugcaugacucucagaaaucagucauuuuuuauuguagauugcugguuuucuuccucuaguuuguaucguguauuuuccuccuguggagaaaaugugguuggcaagaaaugccauauuuuaaagcuguaucguggcuguuaaugcagaaaacaccaguguacugcaggcuguuuggcaguggggcuggggcugaguguccugcccucaguggccugugucugugcucuuguucgcugacaugcagauacaggggcagaucugaggguuugauggagugcagaaggccacacguguggcuuucuguaaaugcagaaacauggaauccuugagcagacacuugucuucuggagcaccuugcauggauuucgccuccugaugcuucauugccguuaauagagugguggugguuguguuaugagaaauuuugucuaaccuggcuucugaaauuucucaaacuaaauauucaugcuguuuuguguuuuucuuaaugacugaggcuagugauauuacucagaaaaguaacaguaacuugggucuucugagcgucaggauguucaccauuuaacuuguuucucguuagugucuaguacgucggcuuucgguaguguagguguguguucuguguccuuucccgugugugccugcacuaguggcagccucugcuuccaggucaguuuagaguagacuggcucugguauugcuagcaaguaguugcuguuacccaguguagccaugaagcccagcuccuuggaucuugacauauauguuccaggcaaaguacguaauccagacguuucuaacucuuucuagauuauugcaauuguucuccauguugucuguuaggcguuauguuaauucucgaucuaacagugugccuguaacauauaugguagugaagagacaucacaugcagagaccguuuuccuuuuaucaacuacagguccgcuaucgacgagagcaccuuucugcuaggcagucacccuacuucccguuguuggaggauuugaugagagacggcagugauggugcugcucucuuagcugugauucacuauuauugcccagagcagaugaaacuggauggugaguggagaaugcuucccugaaacagauccgaaaaggcuuaaaggaaaauuauaguguacauugauccacauauauauuaaaaaaaaaaaagagaaagaaaauggaauccuuaauauaaauugggauguuagccuauagaugaaaaaauugggggaugaugugcucauacuuaaccugcauuuuaucugaugacaaaacugcacuuugaaauuagcugggugugguggcacacgccuguggucccagccacucgggaggcuaaggugagaggaucaccuuagcccgggguggggugggcggggggugguggagagggagagagaaaugguacuucaaaguaucugaguaaugugugaaaguauuugugacuuuaucuaugucucagaauggguagcuuuuguaaauccuuccucaauugauuuaaaucaccuagaacuuaguuugaggaugggaaaauuaaugcaaaauugaaucuguuuaugaaccauuuaugaacaacugccacacgcuucguguuggggacguuccgaugacaguguaucucccuccagguguuuacacccuaacaacgaggagagagagagagugacugucaccagcacgacagugggugucuggacaggggcugggggagcaugaauucugauuuagguuuugcuaagccccauucauucugaaguaggcagauacaaggccaagaggugccccccaaacuaauauggaaacauuugugucagacuucaggugcuggguggauugagcuggcauugaucuuguuccuacugggcguaaaaaugcuagaaaauauaguuucuuagauaaaauaguuucacaaauauauagcugcacuuaaaggaacaggcuggauaugguggcucaugccuguaaucccagcacuuuggaaggccgaggcgguagaucaccugagguuaggaguuagagaccagccugaccaacauggcgaaacccugucucuacuaaaaauuagccaggugugguggcgcgugccuguagucccagcuacuugggaggcugaaacaggagaauugucugaaccugggaggcagacauuguggugagccgagauugcaccagagaauuccagccugggcaacagagcgagacucugucucggggggaaaaaaaaaaaaaaaggaagaaggagagagccucagguaccaggagacggucucugucauugagugaaaacucaugaguggaggacagguaggugcccuggggccccuugggccugaguuuccauguucguuuggcccugggccuaugugcugucaggagcugugacugggaccuuuugggaagaggacuagaaaacuccaccuacugcccaggagugaacugaggaggccugacagaugcccuuggcucuggggauguggaggagaagcucuuuaaggaggaaaugcagcucuuggguacacgguggaucagagggagguugagauguguaucacccauguggcgugggaauacugguugaauguuagugcaacaaguagucuagaacuagugaaacucauggucccuggcagggauaaagcacagcuuggcugugcagggacauuuccaugagccagggcaugcuggcugcccacugaggagaaccccugcuggaagacaaacucuuugaaaaaucagaaaccacgcagggaaagcaggcacugcagcugauuuggcaccaagacaugggugaaagauaacaggauauuuaaaaugauggacauuaaaaagagaacuagacaccuuaaagaagacggcggagggguuggggucuucagaugugcugugauuuucuucauccuccaggucuugucuuggcacuuuuuuuuuuuuuuuuuuuuuuuugaggcagagucuugcucugucacccaggcuggaaugcaacugcgugaucuuggcucacugcaaccuccacuucccagguucaagcgauucucccaccucagccucccgaguagcugggauuacagguguccaccaccacacccagcuaauuuuuguacuuuuaguagagaugggguuucaccauguuggccaggccggucuggaacuccugaccucaggugauccaccugccuuggccucccaaagugcugggauuacaggugugagccaccgcgccuggccaugggaccuucuuuuauguguucaucucuuacauucucccugcugaguucuggaugcuuuuuauuuuauuuauuuauuuuuuauggagacaaggucucacucugucacccaggcuggagugcaguggugugaucaugguucacugcagccuugacuucucuggacuucucaggcucaggugauuaucccaucucaaccuccugaguagcugggacuacaggcacguacgaccaugccuggcuaacuuuuguauuuuuuuauuuuuuuuuuuuuuguggagauaggguuuugccauguugccugggcuggucucgaacuccuggguucaagcgaucugcuugccuuggccucccaaagugcugggauuccauacgugagccaccgcaccuggcccuggaugcuuucugaaguccaccuucuaguucguaaauuugacuuuuccuucauugugugcagccugcccuguaugucuguuggggaucuuaagacagagugaauugcuaaggauacagggucauugccaauuaugaucaugugaacaguuuacaggaaggugugacuguauugaagcucauuaucuaagagcagaacaucaaaauggauuuuaaaaaauggcagaguuacggccaggcgcgguggcucaccccuguaaucccagcacuuugggaggccgagguggguagaucacgagguugggagaucaagaccauccuggcuaacauggugaaaccccgucucuacuaaaaacacaagaaauuagcuggaugugguggcgggcaccuguagucucagcuacucgggaggcugaggcaggagaauggcgugaacccaggagguggagcuugcagugagccgagaucgugccacugcacuccagccugggugacagagcgagacugucucaaacaaacaaacaaacaaaauggcagaguuacaaggagaaauggacagagccacauugcugacuuauguaacagaaacugauugauaaagcagaucauuuaguaaggccauagaggacuucaggcuucauccagugcaccagccacuguggaaucugcucacuuacagacaguaaagacaaacaugggagccuuuauaaaacgugcagucgauuaaggccacaggugagacugcagcagaucccaaagaaucaguacauucuccacagugcaguaaagugagaacucaccaacuagaagaugcagcuucuuuuccugccugugaauuaaugaugguucauuucaggugugaauuugacuggauugagagaagccuaggugacuggugaagcauuguuucugggugugucucugaggguguuuccaggggagaugggugugagucaguggcuugagaagggaagaccugccuucaaugugggcagaagagggggacucucccucucugcucucugcucucucucccuuacugaguggggcaccuucucucuuccuguccuuggacaucagacuccagguuuuuuggguuuuagacucugggacuugcaccauggcuuccugggggauuuuaggccuuuggccuuggccugggggcugcaccaucagcuuugcuggcucugaggcuuccagacuuggacccaggcaugcugccaccucugauucacuagcuugcagauggccuguugugggauuucucugucuuugugaucaugugagcagauuucucugauuaaaucccuucucguauguccuacugguucugucugucuggagaacccugacaaaugcacaguuauucuaaaaucuuaaagauugagugccuggaagccagagaaggcauuuaaauauuucauggaucauaggggaaagaguagugggacuugcuagugugagcucaacaggggcaggguuuuaccuguuuugcucacugauguaucccagucaucugaaauagugucuggggccaguugguguugaguagguauuuguuacuagaaaaagaacguagaaguaaacccaaaaaaaguugaaggaaggagaaaugaagggcaguuuucuauccauuucuguuagucagaagucacucccaaacaaggagaauaaggaacugaauuacagauuccauuuuggaugaaacuaagauauaucuggacucugaacaaguccucuaauggagaaguaauuaaaaaaaaaaaaaaggcaaaguggaggaggggugggugucaagcuggggacgcaaagaggcucauccuauaggacccuggacagcagaacggagcaccaaggaugcugguggacagcagugccugaggguggauuccuugaaaguuggucuccagcaaugagagcucagguucacuuugcuucugaugccuuucuccucacaugcccucaguagaugcgggacacucuugaggagaacugagccagauaggcucuagccucagaccccaggugcagguagggaugaggugacacugaaaucagggcuuuuguguaaaauucuucauacccgaaggugagacugguucuccuccuggugcacccugccccagaagccaccgucucucucacuugacuccauaaugcagaccugccccacaugcaacacagggaaggauucuucucugcagaaaucggccucaggaaaaagacucacagugacucacucuuuacuaggagcagcagccaaagauuccugacauuugaggaaagccacugaccugaaugagaacccaaaucaacagagauggugcaggugagcaggagaaaauguuagagaugagaggguuuggaccucagaaccaacaacaggacucugggaaacaaugucugcaagauaguggcacauaacuguguacagaaucaucagacucagaacagcuguuggagugcuacagcuuguuuagaauucucuggcaaauucuaaagagccgccaaaaaccaguucuugggaaggaaauauuugguugcuaagaugggagagccacugaacugcuagaggacaguugaagaaaucucccagaaaguagaaccagaaaagcaaagagaugggaaauaagggaaaaaagauggaaaaaucaggaucagucuacgaagaaagagaagagaaaauaggagaaaagaacuuagucaacacaaaauguagaaaaaugucccaaggacaugcgugguaaguaggaaggacccaguggguggccagcaggauuccugaagaagggccauggcaaagccuaccaugaugagcuccggaaccccugggaaagaggagaucccaaauaacuguggagagaccaagcagguuacacacaagcaggcagccccaaugacaccagauuccucagccacaguccuggaaggaagaugacugggaggugccuucccagugcuggggagugugugcacgcacaccauccugaagaggagguggagggaggcucaggcugaaauccacagugccagccuucccauggaugggccaggagcgugggacaaaggcacagaccaggaggaggcaguuggccuguccggcucagaggcaauaacaggugaauaacugagccaaguauuaaauccaggagaaaugaagaguugugcaaggaguguaaguagagacacuguguaacccagcuguggaagaugguuacauaguuaugguguauagagacucagucuggguuuaaucacacauccugcuguguggccacuggggagagaggcuggggaggcacacagaggaccaccugcacugugcuugucuguugugacagugggcuguagccucuuagucauaggguaggggauggggcugcguguucucuuaccgaggccacaggcagaaggaguggaaugggcagugauaagguuuggcucugugucccuaccuaaaucucuucuugaauuguacucccauaauucccaugugcugugggagggaccuggugggagauaauugaaucacaggggcaguuucccccauacuguucucgugguagugaauaaaucucaugagaucugaugguuuaauaaggggaaacccauuuagcuuggcucucauucucucucuugccgccgucaugugacacgugcuuuucaucuuccgccaugauggugaggccuccccagccauguggaacuguaaguccaauaaacugcuuucuuuuguaaauugcccagucucagguaugucuuuaucagcagugugaagauggacuaauauaggcagagaccuaguucucuuaagcuuuucaaaacaaauaguuuggcuuuuuuguuuuuguuuuauuuuuuuguguuuuuugagacuggagucucacucucuugccuaugcuggagugcagugguacgaucucggcucacugcaagcuccaccucccagguucacgccauucuccugccucagccuaccgaguagcugggaccacaggcgcccgccaccgcgcccggcuaauuuuuuguauuuuuaguagagacaggguuucaccguguuagccaggauggucuugaucuccugaccuugugauccgcccgccucggccucccaaagugcugggauuacaggcgugagccaccgcacccggccuuuuuuuuuuuuuuuuuuuuuuaaauugagaugaagucucccuuagucacccaggcuggagugcaguggcccgaucucugcucacugcagccucugccaccaccuggauucaagcaauucuugugucucagccucccaaguagcugggacuacagucacgcaccaucacaccuggccaauuuuuuaauauuuuuaguagagaugggguuucgccauguuggccaggcuggucucgaacuccugaccucagguaaucugcccgccuuggccucugaaagugcugggauuacaggcaugagcccagccagcuucuuaaaguaaaauacaaauuuuaaaauuuuggcaugcagcaauagaaaaggaugagaucaugucuuuugcaggaauguggauggagcuggaagccauuauccuuagcaaacuaacagaggaacagaaaaccaaauacugcguguucucacuuaacaagugggagcuaagaccgggcgcaguggcucacgccuguaaucccagcccuuugggaggccaagguggguggaucaccagaggucaggaguucaagacuagccuggccaacaaggugaaacccugucucuacuaaaaauacaaaaauuggccgggggugguggugcacaccuguagucucagcuacucgggaggcucaggcaggaaaauugcuucaacccaggagguggagguugcagugagcugagaucacgccacugcacuccagccugggugacagagugaagcuccaucucaaaaaaaaaaagugggagcuaaaugauaagaacuuaagaacacaaagaaggaaacacagacacuggggucuccuugaggguggagggugggaggagggagaggagcagaaaagauaacuguuggguacuggacuuaauuccugggugaugaaauaauuuguacaacaaacccccguggcaugagguuaccuauguaacaaggcuucacguguacccucccaaaccuaaaauaaaaguuaacaaaaauuggcaaauuugcugggugugguagcucaugccuguaauucuagcacuuugggaggcugaggcggggggaucauuugagcccaggaguucaagaccagccugggcaaccuaaugagaccccaaaaauuaaaaaguuagcuuggccuggugaugugcaccuguagucccagauacucaggaagcugagacaggaggaucacuugagcucaggaggcugaggccacaaugagcugugauugugccacugcacuccagaugacagagugagaccugcucucaaaaaaaaaaaaguuuuggcaaauuuaacagcaaaaagugaauaaaguagaaaaaauuccaaaguucuagagaauauguaaaacuaaaagcuuauuguuuuaaagaauuaauaaaauagauaaucuggaaagacugaucaagaauucagguauagcagcuacugaaauaaaaauacugagaauauuugugugccauauguguuugaaauguuagacaaaaugagcaaucuucuuugaagccaaaaguggugggcagucuaaauagacccauaacuacaaaggaaacggacucaggagucaacacauacauccacagggaccaacuucuuccuggggcauuucaccagacucucaaggaauugucagcuccuguguuaugucaagugucccagauaauaggaaaagauggaguggcccaaaaggggauuauucccugacacugaguaggcuaugagaggaaauucuaggcuggcuuuccauguuaguauggauugaaaauccuauguaaaauauuagcgcaaauugaacagauucucuacagucaucucaguaagggcagggaaucacuugugggcagucacugcccccuucugaucguggcucugggccucauagggacuugauuggaccucauaggcuguugaccccaccuguggcaggugcaguuccauugaaggcccaggagaagcggugccuuuguguccugacggagcggguucucugagccuggcaagaggaagguagugggagccguagccagggcugcccugugccccugcccugcacugcagugcccacucccuaugagcauucucuugucaugugagaacugggaggcauuugggaguaagugcagcagaagagaggcgaagaaaauccaucggcuuuucuauuucucuugggagaagacugaaacaaguguacuuagauccccagucaguauuaaaacuugugauuucuccagauuguucugaaaacuugucgccaguccaguaaauacuuuugucuucacagauauuaacaaggcaaugcagaaauucucuuggauuguguuauuucugugucucucucaaccauuugagaguaacacagcaaaaguugggaaagcuaacguuggcacacagauccccagccugguccugacucgcucaacuacccaggagcaccugcuuggcccagcguccccucauaguuucccuucaucuggagucguuuccagccuuuaccucucuugacucuugauguuuucgaagaguaagguugugaguaguggcccuugguguguuugucuggaguuuccuugcgguguguccucccagcgugucaccucaggggcaagguacugggacaucuccguauuggugacuccagcuucaccccuuggugcagguggcaugugcuggccuuccccacuucuaagcuugcuguuuuugcuuuagaaugcauuaguaauuuguggggagaggcuuuggacugugaauacguuucucaucagacucucaccugcuggucucuccacguguggauggcuuccagccucagugcaucuuuccauuuugucagcguuugccccacuugcuugcuucuuuauucauguguuuguuuauauccggauggccucauggaucuuacuuuauucaauaggucauaauucauuacuuucauuauuuauuuuguugcuuaaauugucccagauuuuagcugaguaguuuugaagaauaagaaugugcaggguaugugcccuacaaauaccaaauuuugcuuaacuuugcauuaccaaaaacagugugguuuugguuccggggcagucacauggaccagaugaauaaaccacauguagaacugagaaaagagaugcuuugcagggaaucuggugccuuugggguggccucaccgagggagccgcgcuggcuggucaagaacauggcggcauagacaucucuaugggaaagugccguaaaaccucaccccaccugagccagaaauaccccuuccucggaguaaagaugcaaaccugaaaaguaaaauuuaagaauuuugagaagauaaaggcaaauacuuuuaugauguucguguagagauggauugccaaaauuauaaaaagcacaaauagaaaagauuguuaaauguaaccauaucaaaauguaaaacuuuccugugacaaaagaacaucauaaacaaaaugaaaugauaaacuguacccauugaaaauauuugcagcacacgugaccugaugaaggacugucauccaguccuuucguaaccacaauccagaaagaauucuagaaucgguaagaaaaagaugcacagcccaaggcagauauggacaggguccacaggagaggacccuucaugaccaguaaccaugaaaaaguaaagccacagcagucaucagaggcaugcuguuugagaaggagguguucacgccccuccgccuggcagacauggacaggucggucaugcugcggugcaggugggaaggagcaagcuguggagugcugugggugggacuggagcgaggcacaaccaggcagaagggcguugccaggugacacaggagggcgugccuagcucguggcccagcgaguccccucucagaguaugccugggcaacacccgucuguacacgcauagacagcacacgcaagcuuugugauggcagcauuugucauaauugugagaaaucguggaggaccauauagcggucaagaugagugacggaaaucucuccguaucaacauagaucuguuugaaaacaucauacugaguuuuggggcaaaaacuggcugcuaaaaugaggcauagcuugauaccaugaauguaaguuucucaaggcugagacaacacuguuuguguuacuuguggaugcagacaguguguagaauacucaggaggaguggaaaggguuuguggcaguguugggagaaugguucccuuuggagauggagaugacuucggcuguuuuauuucuaaaaaagaaaagaucugaagccuauaagacguuaacauuugauggucagaacuguacaaaaggaaacauccuuagcagugugagugugcacaguuccucagcuuuaaaguuuucuuuugagaaugaaugcugcuuaggugacuguggagggcaguucaugaacgacucuggaugcuguggcuccaguuuguacguacuucuaaacccuugaaaaugguuuuuuccuuagaaauaaaauuuauguaaaaaguuauuucugaaauucuauuuuuucucuauguauauauuuacaggcaaaauaaagucaagucacuucucacggaguccugagcugcaccgugcucuccgcagggcucuuugucugagggccaccccccacuccacaccagggugccuagacuagggggaggccugcucuuugguccugugacuuguugcccauacuggugcuuccuccauggagggucugcaaagucacgugcaauggaaaguugcccugcagaugcuauagccaccagucuccaccucuucauggaaagagacuugggcuaugcauugucacuugaucuuugugauuagucacauuccuguguuaucacugagugggcguggaugagccugaugcuuuacguuuuauucauuucccuucccccugcccuuuacaaacacggaaaccuugugcagaggguuucugaugggcggaagaaacucggcucaacauuuacucgcuacgugcagcauggcucugcuguaaagugaaaggugauuguugcuguuuguuuuggaagcccacucuugagaucugagcgauuucuauuaugcuuucuggauguucaccaucaaauucagacuugagagguuccuggaguugucuugaguguuuucuuuuuauacuuaguguuacuuguuguacauccuauacucccuacaucucucaaugucauuaucuucauuacuaccuuuauguaaaaugguuuucauuuuagaaugcuucucucucucucgaagcagaauaccuuuacaauaaauugugauuuucuuuuugucuauuagauauaugcuuaaaggagguaacgucgauggccgacagucuguauaauauucggcuucugagagaauucuccaaugaauaucuuaauaaauguuuuuaucucaccuuggaagauaugcuguaugcgccauuaguguugaagguaauaacgaauuauuuggcaugcaguuuuaaaaccaugugugaauaaacugcuuaucauacuuugguuuuuuguuuuugucuuuuagccgaauguuaugguuuuuauugcggagcuuuuuuggugguucgagaaugucaagccagauuuuguucagcccagggauguucaggagcugaaagacggugagugacagauauuccccagguuggcaaugguuuccuugagagccuagaguaucagaaagcacucuccagugguuccauguuucucgcacagcagaguucuuggaagagccuguggagucagaaucccagggacgggcgugagaguuuggggaaaggcuuucuaagugauuuugaugaacuauucgguuacgaaucacagcucuaaaaauugcacaacucuaaaaguuccaggauggcuguucucaccuccagaaugaacaaacugaaaaaaaaaaaauguuuacuacagauuaaaauaaucugucaggcuugacaaucuagaaaguuuuaaggagauaauauagaggaauaucuucauaaccuuggauuaagaaauuauuucuuacaaagaauaugaaaauauuagccacaaaggaaaagauugcaaauucagcaacauuaaaguuuggaccuucuuuuccuugaaagaugauaaagauaauuuuaaaaaaccccaacuauuaauaacuauagagggggaaaagguacuugcaauguaugugguagauaaauaacuaguauccagaauauauaaagagcucauucauagccauaagaaaaaagaagagccaacaggaaaaaaaggcaaaagaacagauucuugaugagagugggaccccaugugccuaacugauuugugaaaagcugcuuggccucagucaucaaggauaugcaaauuaaagaugacacccagacggccugcagcuugcaaugcuuaagauuuuucagcuucaccguggugcaaaagcgaugcacguucaguggaaaccguguuuccugugcccuacaaccauuuuguuuuucacugucaguacagcauucaguaaauuacacgagauacucagcacuuuauucuaaaacaggcuguguguuagauuucgcccggcuguaggcuaguguaaguguucugagcacacugaaggcgccuaggcuaagcugugauguuugcuagguuaaguguauucaguguguuuucuacuuacugauauuuucaguuuacgauggguuuauuggggcaugaccccauuguaagcugaggagcaucugugcggguauauauccuccagauauauuuguggcaaaacguuggaacgggcccagguguggggcagugucugagagugcaccuuucaccacugcuggcgagaguguuacuuggagucacuguuuuacuuggagcagccucugaagcucuucaguguuacccaguccuguggguugccugcccuuuggcucagcaagcccauuccugugguguauccucagggaaacuugguacuugugcaucaggacacagggaaaggaugcucagagcagcucugcucauaacagcuaaaaagaagcucccagaugugccucugcagucagaguggugcaguguucuauguccaugccacaagaugcugugcagcccugggugugugugagccacagccacgagcagcuacaaggaagauucuccugauaaugaaggcacagaaucacauggacaggcuggagagcaggcagagcuccacuguguuuuccaggggguguguaugugugugcaugcgugugugugcaugugugagcgugugugugugugugugucuggggcuaaaaggcagugguucauugggcacguugggugcuccuggcagacccgugacuuucucuucuggacccgaguggugguuaccucgauuuugcuuuauaauuauuugucaagcucuauguacguuuuaugcaguuucucucucugugugugcgugcacuauuuuacaauaagaaagaauaacgacaaaaagcuuagaacuggguuaccuugcuguuagaauguucuuaagucaccucgcuuccucacgggugaccuugaacuaauuuuucaucccuggacuuaacuuuccuucccaacucuucuucugugguaacuauuccaucuuacagccagaaacacuguagugcugugaaacuugcuuccuucaucuuaacugagguuagcccuaagucaaggcuauugcugacuccuguuuucagauucguuucuauucuucuugcauuuaagguagaauaggcuuuccuuguuugaugccuucaugacugcagcacccucuccacugcccuguccuuucuggcuucccuucccuucacuccucccccuccccccccacucccaucuccccacuccccucccccacuccccuccccuucccccacuccccuccccccacuccccuccccuucccugcccccuccccccacuccccuccccuucccuguucugggauacuugugcacaaccugcagguuuguuacauagguauacacgugccauggugguuugcugcacccaucaacccauccucuacauuaggcguuuucccuaaugcucucccucuccuagcccucccaccccccgacaggugugugauguuccccucccuguguccguguguucucauuguucaacucccacuuaugaguaagaacaugcgguguuugguuuucuguuccuguguuaguuugcugagaaugauggcuuccagcuucauccauguccuugcaaaggauaugaacucauccuuuuuuuuaauggcugcauaguauuccaugguguauaugugccacauuuucuuuauccagaugggcauuuagguugguuccaagucuuugccauugugaauagugcugcaguaaacauacgugugcaugugucuuuauaguaggaugauuuacuuuuuuuuauuuuauuauuuuuuucgagacagagucucacucugcugcccaggcuggagugcaguggcacagucucagcucacugcaagcuccaccucccggguucacaccauucuccugccucagccucccaaguagcugggacuacaggugcccaccaccaugcccagcuaauuuuuuuguauuuuuuuuuuuuaguagagacgggguuucaccguguuagccaggauggucucgaucucuugaccucaugauccacccgccucagccucccaaagugcugggauuacaguugugagccaccgugcccggccuauaguaggaugauuuauaauccuuuggguauauacccaguaaugggauugcugggucaaaugguauuucaguuuauagauccuugaggaaucgccacacugucuuccacaaugguugaacuaauuaacacucccaccagcuguguaaaaguguuccauuucuccauauccucucuagcaucuguuguugccugacuuuaaugaucgccauucuaacugucaugagaugguaucucauugugguuuugauuuucauuucucuaaugaccagugaugaugagcuuuuuuucuuauguuugucggccgcauauaugucuucuuuugagaagugcguccauucaaauccuuugcccacuuuuugauuuuuuuuuuuuuuuuuuuuugguaaauuuguuuuaaguuccuuguagauucuggauauuagcccuuugucaguuggauagauugcaaaaauuuucuucccuucuguagguugccuguucacucugaugauaguuucuuuugcugugcagaagcucuuuauuuuaauuagauccauuugucaguuuuggcuuuuguugccauugcuuuugcucuuuuagucuugaagucuuugcccaugccuguguccugaaugguacugccuagguuuucuucuagguuuuuaugguuuuaggucuuacauuuaauuaagucuuuaaucugucuugaguuaauuuuuguauaagguguaaggaagggauccaaauucaguuuuccgcauauggcuagacaguuuucccaacacuguuaaauagggaauccuuuccccauugcuuguuuuugucagauuugucaaagaucagaugguuguagguguguggcauuauuucugaggccucuguucuguuccauuggucuauauaucuguuuugguaccaguaccaugcuguuuugguuacuauagccuuguaguauaguuugaagucagguagcaugaugccuccagcuucguuuuuuuuuuuuuuuuuuuuugcuuaggguugucuuggcuaugagggcucuuuuuugguuccauaugaaauuuaaaguaguuuuuuuaaaauucugugaagaaagucaaugguaguuugauggggauagcauugaaucuauaaauuacuuugggaaguauggccauuuucacaauauugauucuuccuauccaugagcauggaauguuuuuccauuuguuuguuuccucucuuauuucuuugagcagugguuuguaguucuccuugaagagguccuucacagcccuuguaaguuguauuccuagguauuuuauuuucuuuguagcaguugugaaugagaguucacucaugauuuggcucucucuuaaucuguuauugguguauaggaaugcuugugauuuuugcacauugauuuuguauccugagacuugcugaaguugcuuaucagcuuaaggagauuuuggguugagacgaugggguuuucugaauauacaaucaugucaucugcaaacagagacaauuugacuuccuuucuuccuauuugaauacucuuuauuucuuucucuugccugauugcccuggccagaacuuccaauacuguguugaauaggaguggugagagagggcauccuugucuuguaccgguuuucaaagggaauacuuccagcuuuugcccauucaguaugauguuggcugucgguuugucuaaauagcuguuauuauuuugagauacgucccaucaauaccuaguuuauugagaguuuuuaguaugaagggguguugaauuuuaucgaaggccuuuucugaaucuauugagauaaucaugugguuuuuugucauuggcucuguuuaugugauggauuacguuuauugauuugcauauguugaaccagccuugcaucccugguaugaagccaacuugaucgugguggauaaacuuuuugaugugcugcuggauucaguuugccaguauuuuauugaggauuuuugcaucgauguucaucagggauauuggccugaaauuuuuuuuuguugugucucugccggguuuugguaucacgaugaugcuggccucauaaaaugaguuagggaagagucccucuuuuucuguuguuuggaauaguuucagaaggaaugguaccagcuccucuuuguaccucugguagaauucaacugugaauccgucuguuccugggcuuuuuucgguugggaggcuguuaauuacugccuuaauuucagaacuuguuauuggucuauucagggauuugacuuuuuccugguuuagucuugggaggguauauguguccaggaauuuaucuguuucuucuagauuuucuaguuuuauuugcacugaguuguuuauaguauucucugaugguaguuuguauuucugcgggaucaaugaugauauccccuuuaucauuuuuuauugugucuauuugauucuucucucuuuucuucuuuauuaguguggcuagcagucuaguuuguuaaucguuucaaaaaaccagcuccuggauucauuuugaauuucguugcucuugcuucucugguucuuucaauugugauguuugagcaucaauuucagaucuuuccagcuuucuguuaugggcauuuagugcuauaaauuucccucuaaacacugcuuuagcugugucccagagauucugguacauuaccucuuuguucccauuuguuucaaagaacuucuuuauuucugccuuaauuucguaauuuacccaguagucauucaggagcagguuguugaguuuccauguaguugugcgguuuugagugaguuucuucauccugaguucuaauuugauugcacuuuggucugagagauuguuuguuaugauuuccguucuuuggcauuugcugaggaguguuuuacuuccaauuauguggucaauuuuagaguaagugcuacguggugcugagaagaauguguauucuguugauuugggguggagaguucucuugaugucuauuaggucugccugguccagagcugaauucaaguccugaguauuguuaauuuucugucccgaucugucuaauauugacagugggguguuaaagucucccacuauuauuguguggcaguguaagucucuuucuaggucucuaagaacuugcuuuaugaaucugggugcuccucuauugggggcauacagauuuaggauaguuagcgcuucuuuuuuuuuuuuuuuuuuuuuuugagacggagucuugcucugucgcccagguuggagagcaguggcgcgaucuuggcugacugcaagcuccgccucccagguucacgccauuguccugccucagccucccaaguagcugggacuacaggugcccgccaccacgcccagccaauuuuuuuuguauuuuuuaguagagacgggguuucagcguguuagccaggauggucucgaucuccugaccucgugauccaccugucucggccucccagagugcugggauuacaggcaugaaccacugcgcccugccagcucuucuuauugcauugaucccuuuaccauuauguaaugcccuucuuugucuuuuuugaucuuuguugguuuaaagucuguuuuaucagagacuaggauugcacccccugcuucuuuuuugcuuuccauuugcuugguaaauguuccuccaucccuuuauuuugagucuuuguacaugagauggguuugcugaauacagcacacugaugggucuugacucuuuauccaauuugcagucugucuuuuuauuuauuuauuuugagauggaguuucgcucuuguuguccaggcuggagugcaaugguguggucuuggcucacugcagccucugccucccggguucaagcgauucuccugccucagccucccgaguagcugggauuacaggccugugccaccacaccuggcuaauuuuguauuuuuaguagagacgggguuucuccauguuggucaggcuggucucgaacucccgaccucagguaauucaccugccacggccuuccaaggugcugggauuacaggugcgagccaccacacccggcccagucugugucuuuuaacugggggcauuuagcccauuuacauuuaagguuaauauuguuaugugugaauuugauccugucauuaugaugcuagcugcuuauuuugcccguuaguugaugcaguuucuucauagauaguguugauggucuuuacaauuuggcaucuuuuugcaguggcugguaccaguuuuuccuuuccauguuuagugcuuccuucaggagcucuuguaaggccugguggugacaaaaucucucagcauuugcuugucuguaaaggauuuuguuucuccuucgcuuaugaagcuuaguuuggcuggauaugaaauucuggguugaaaauucuuuucuuuaagaauguugaauauuggcccucacucucuucuggcuuuuaggguaucugcagagagaucugcuguuaguuugaugggcuucccuuuguggguaaccugaccuuucucucuggcugcacuuaacauuuuuuccuucauuucaaccuuggugaaucugaugauugcgucuugggguugcucuucucguggagugugcuguucuccguauuuccugaauuugaauguuggccugucuugcuagguuggggaaguucuccuggauaauauccugaaguuuguuuuccaacuugguuccauucuccccgucacuuuagguacaucagucaaacguagguuugggcuuuucacauagucccauauuucuuggaggcuuuguuuguuccuuuucauucuuuuuucucuaaucuugucuucaugcuuuauuucauuaaguugaucuucaaucucugauauccuuucuuccacuugaucgauucagcuacugauacuuguguauauuucaugaaguucucgugcuguguuuuucagcuccgucaagucauuuguguucuucucuaagcugguuauucuaguuagcaauuccucuaaccuuuuuucaagguucuuagcuuccuugcauuaaguuagaacaugcuccuuuagcucagaggaauuuguuauuccccaccuucugaagccuacuucugucaguuugucaaacacauucuucguccagcuuuguucccuugcuggcaaggaguugugauccuuuggaggagaggaggcauucugguuuuuggaauuuucagccuuuuugcacugguuauuccucaucuuuguggauuuaucuaccuuugguuuuugauguuggugaccuuuggaugggguuuuuguguggauguccuuuuuguugauguugaugcuauuccuuucuguuacuuuuccuucuaaaagccaggucccucugcugcaggucugcuggaguuugcuggagguccacuccaaacccuguuugccuggauaucaccagcagagguugcagaacagcaaagauugcugccuguuccuuccucuggaagcuuugucccagaagggcacccuccggaugucaaccggagcucuccuguaugaggugucuguugaccccugcugggagguaaacacccagucaggaggcacgggagucagggaccuacuugaaggcagucugucccuuagcagagcuugagcgcugugcugggagagccacugaucucuucagagccagcaggcggugauguuuaagucugcugaggcuaugcccauagccaccccuuccccuaggugcucugucccagggagaugggaguuuuauguauaagccccugacuagggcuaauacuuuucuuucagagaugcccugcucagagaggaggaaucuagagaggcagucuggcuacagcggcuuugcccagcucuggagggcuccacccaguuuaaacuuccuggcggcuuuguuuacacugugagggaaaaacccaccuacucaagccucaguaaugguggacgucccuccucccaccaagcucgagcaccccaggucgacuucagacuacugugcuggcagcgagaauuucaagccaguggaucuuagcuuccugggcucuguggggguuggauccacugagcuagaccacuugccucccugacuucagcacccuuuccaggggaaugaacaguucugccucgcuggcguuccaggcaccacuaggguaugaaaaaaaacuccugcaacuagcucggugucugcccaaauggucgcccaguuuugugcuggaaacccagggcccuggugguguaagcacugaagggaaucuccuggucuguggguugcgaagacugugggaaaagcauaguauuuggaccagaaugcaccauuccucacggcuucccuuggcuggaagagggaguuccccgacccauugugcuuccugggugaggugauuccccaccgugcuugcccucugugggcugcacccacugucuaaucagccccaaugaaaugagcuggguaccucaguaggaaauguagaaaucacccgccuucuguguugaucuugcugggagcugcagauuggagcuguuugaucuugccagccaccuuccuccugccuuucuucacccuuuucaugauacuguccagcucaagaaggaagucuuguuuuuccugcugcuugugaggugguuucaccuguucugccuggugggaaaggccucuucccaucggaccccgucgugagucauggcuggagcccccuucuucuugcggggcuccucuucuugccugcugguccuuaggaaugaggagucaggaaugcuaggaagcagcuaagcuucaguucacucugggaugagacauagcgggggagggggaccucagagucaugggcccgcucugcaccuccgaggcuggggagugucucuggucugauacaguauuauguggggcccugugcaguggguccuacugccaaccguuggguagugaugccugcugaaacccuauggccaggagaggccaacacucaggugcagaaugcacggcugcucuuggaaaagugaacugcuggcccuuccaggcugcaagggguccauuguaguuaccuugcugccuagugauugguuggucuucuccaggacggugccauauuaggagucagcacuggucuuggcaggugguagucugugcucuuagucuccauaccugccuaccucuggcugcuucaugugugugucuguuguccuggccugagaguggcugauggcagaguuugucugcauucccaguugacccacuguuaacugugcccaggcuuuccccuuuuccaucuguggucgucaggggcccuuguguggcuguagagaggggcucggugggcugcuggugcccuggcaguagcucgugagggucugggcuguguaugccugcagcucgugccccugcuccugugcaggcucggucccaaggcacaacuccgucuuaugggugcacucggccuuagcccuggagugaguggguggcagaacccagcuugugaugggcaguucugaacacacugucagcaggcguacaguacccugugcacaucaggggcuguuguuaaugucgcgugauucucuguggcucuacagucccgggaucuugcauugugcucucccagcugacuugccagagacuccuguggcauguucucccuccacugauaccuguaggccaugggaugugaugaccccucccuuucccagugcauacucaucugggaacguagcugguggucccuuugggaaugacuggggaaccauugccaugcaugcucaccuuaguguugcuggucccagagacugggcauuguugggaggaaauacggacacaaacagacucauagcuauucauaugcauguggcaggcacagaaacaguggcuugcugaguagcuagaaauagggacucauacacucugcaucagcagggaggcagggagagaagaagcuuguaugggaaggaugaaucaguuuccucaggaaagacagauaggcucauacaggagcagaaccgaagggcgccgaaccaaguagaaaguguguagcgaagugugucugcagaacggguagaaagugugugaugaugugugucuugagaauggaguagaaagugcguaacaaugugugucuauagaacaggguagaaagugcguggugacgugugucugcagaacggauauaaaguguguggugauaugucucugaagaauggguagaaagugcguggugacgugugucuguagaacaggguagaagguacguggcgaacguguggcuacagaauggguagaaacugcuugaugacgugugucuguagaacgggguagaaagugcgugaugacaugucuguagaauggguggaaagugcgugaugacgugugucuguagaacagguggaaagugcaugaugaugugugucuguagaacggguggaaagugcgugaugacgugugucuguagaacggguggaaagugcgugaugaugugugucuguagaacggguggaaagugcgugaugaugugugucuguagaacggguagaaagugcgugaugaugugugucuguagaagggguggaaagugcaugaugaugugugucuguagaauggguggaaagugcgugaugacgugugucuguagaagggguagaaagugcaugaugugugucuguagaacagguggaaagugcgugaugaugugugucuguagaacggguggaaagugcgugaugaugugugucuguagaacggguggaaagugcgugaugacaugugucuguagaacggguggaaagugcgugaugacgugugucuguagaagggguagaaagugcgugaugaugugugucuguacaguggguagaaagugcgugaugacaugucuguagaauggguggaaagugcgugaugacgugugucuguagaacggguggaaagugugugaugacgugugucuguagaacggguggaaagugcgugaugacgugugucuguagaacggguagaaagugugugaugacgugucuguagaaugggugggaagugcgugaugacgugugucuguagaauggguggaaagugcgugaugacgugugucuguacaggggguagaaagugcgugaugacgugugucuguagaagggguagaaagcgugugaugaugugugucuguagaagggguagaaagcgugugaugaugugugucuguagaacagguggaaagugcgugauaacgugugucuguagaacggguagaaagugcgugaugacgugugucuguagaagggguagaaagugcgugaugacgugugucuguacaacgggcagaaagugcgugaugacgugucuguagaaccgguagaaagugcgugaugauguguaucuguagaagggguagaaagugcaugaugaugugugucuguagaacgugcguggugacgugugucucuagaauggguagaaagugcgugaugacgugugucuguagaagggguagaaagugcgugaugacgugugucuguacaacaggcagaaagugcggaugacaugugucuguagaaccgguagaaagugcgugaugaugugugucuguagaacugguagaaagugcgugaugaugugugucuguagaaccgguagaaagugcaugaugaugugugucuguagaagggguagaaagcgcgugaugacgugugucuguagaagggguagaaagcgcgugaugacgugugucuguacaacgggcagaaagugcgugaugacgugucuguagaaccgguagaaagugcgugaugaugugugucuguagaacugguagaaagugcgugaugaugugugucuguagaagggguagaaagugcgugaugauguguaucuguagaagggguagaaagugcaugaugugugucuguagaauguccguggugacgugugucucuggaauggguagaaagugcgugaugauguguaucuguagaagggguagaaagugcaugaugaugugugucuguagaacguccguggugacgugugucucuggaauggguagaaagugcgugaugaugugugucuguagaacgggcaugaugaugugugucucuagaacauguguggugacgugugucucuagaacagguagaaagugcgugaugaugugugucuguagaauggguagaaaguguguggugacgugugucuguagaacggguagaaaguguguggugacgugugucuguagaauggguagcaaguguggugacguguuuguagaauggguagaaagugcaugaugugugucgguagaaguguguggugacaugucuguagaacgggguagaaagugcaugaugaugugugucuguagaacaggguagaagguacgugacaauguguggcuguggaauggguagaaagugcguggugaugugugucuguagaacaggguagaagugcguggugacgugugucuguagaacgggguagaaagugcgugaugaugugugucuguagaacaggguagaagguacguggcgauguguggcugcagaauggguagaaaguguguggugaugugugucuguagaacgggguagaagguacaugacuguguggcugcggaauggguggaaagugcguggugaugugugucuguagaacaggguagaaaguguguggugacgugucuguagaacaggguagaaaguguguggugacgugucuguagaacggaguagaaaaagcgugguaacgugugucuguagaacaggguagaagguauguggugauguguggcugcggaauggguagaaggcgcguggugacgugugucuguagaacaggguagaagguacguggugauguguggcugcggaauggguaaagguagguggugacguguuucuguagaacaggguagaagguacuuggcgauguguggcugcggaacggguaaagguauguggugaugugcgucuguagaugcacaugggcuucucugggugcuuuugggcaggaagucugccccagaggggauuuuggcagcucucuuuccgaaguuucugccccuggucggauaagagaagcucugaaaaagcuguuuuuugagucuguuggauagcaaaugucagaauaauuuuuuuguuguuuuuguuuuuuguuuugagacagggucuugcucugucacccaggcuggagagcaguggcacaaucucaccucacugcagccuccaccuccuggguucaagugauucuccugccucaaucucccaaguagcugggauuacaggugcgcaccaccaugccuggcuaauuuuugcauuuuuuaguagagacgggguuuugccauguuggccaggcuggucuagaacuccugacuucaggugaucugccuuuuccggcuucccaaagugcugggcuuacaggcgugagccaccgugcccagccaucaaaauaauuuuuaugccacuaggguguaauuuggauccguccagcauggcauacugaauuccagugggggcacagcugcucuuagcaaccagucauccuuucuugguuucuucucaugggauaagcucaccagugcccuuguuggcucugcguuuugugccuagugaagcagggcccuguucucaauucugugacucugcugaccaggccccauggccgccccuccagccuugccauucaccauaaucacuaaggccaccugguuucugauaccuccgugaagccucucacuuuggaacucugucuuccccuugccauggugauugcuuccccgccaaucguugcuucagacagcccugguguacugaagggggcgaccacggggcugccuggugcugcuguggguacccgucugaccggcacacuccccaugcuucugcugugugugugggggcgggagggguccuagccccuccuuugcugucccuuggcaguuaugguacuucucccuuacuugguaagggccuccuguuaguacacgugcaucaucacccaauuccugccaaauccugugcuuggggguccucccaaauggacacauuuugccucagccagcucccuugacaagggcccucagaguccagcacuucacagccuccccuggcugcugaaacuggcuggcuacaccccgcagcuccacgggguguguggguauguggcccuuuucucccaggcaagggcuuuguuggaugucacccugguuauaggccuggugaccgcgagggaagaugggggcagguccuauugaagauuaaaaguguauauaaacagcaugauguuuugauacacguauacauagugaacugguuaccagggucaagcuaguuaacauccaucucuucacaucgcuaccuuuguauguggugagaacacuuaaaaucuuucagcagaucucaaacggacaacauaguauugcuaacuauagucccaugcugccuuacuuaccuuaaaauggaaacuuggugcccuuugaccaucaucucccuguuccccucacccuccagccccuggcaaacacuucucugcuuaaguucuacuuuuuagauuccacauacaagugugaucaagcaguauuuuucuuucugugucuggcuuauucacuguacauaauaucuuccagguccaucuguguugucacaaaugacaagacuuccuucuuuuuugagguugaguaauauuccauuguaugucucuguauaucacaauuucuuuauucaucuguugacaagcagauugauucuauaucugggcaauuaugaaaugugccgcaguaaacaugggagugcacauaacucuuagcgacgcagauuucauuuccuuuggauauauacccagaagagggauugcuggaucauaugguaauucuguuuucaguuuuuugaguaaccuccauacuguuuuucagaauggcuauaccaauuuguguucccaccaacaguaugcaaagguucaccuuuucuccacauucuccucaauacucaucucuugucuuuuugauaauagccauccugacaggugugugaugccuuauugugguuuugauuugcacucccugaugacuggccauguugagcaacucuucacauaccuguuggccaccuguaugucuucuuuggaaaaaaaugccuauuuaagaccuuagccugcuuuuuauuuggguuauuuguauuuuugcgauugaguugcguuacuuauguauuuuggauguuaaccucuuaucagccauauaguuuguaaauaguuucucagucuguaggcugccaucucguuuuguuuguuuccuuugcuuugcagaaccuuuuucauuugguguaguuccugugguuuauuuuuguuuuuguuaguugugcuuuuggugugauaaccaaaucaucaccaaggcuaaugucaaggagcuuauuucccuagaguuuuacaguuucaggccuuaauuaaauuaauuagucuuaguuuaagucuucaguccauuuugaguugauuuuuguauauggugugaaauaaggguccaguuucauucuucuacaucugguuauccaguuuucccaacaacauuuauugaagguacuauccuuuccccaugguguauuuuuggcaccuuugucaaagauuaguuaaccguauaccucaauucuguuucauuggcuugugucuguuuuuaugccaguaugauaguguuuuacuauagcuuuguaguauaauuugaaaucagggagugugauguuuuugccuuuguuguucuuuuucaagauuacuggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaagagaauggcgugaauccgggaggcggagcuugcagugagccgagaucgcgccacugcacuccagccugggcgacagagcgagacuccgucucaaaaaaaaaaaaaaaaaaaaagauuacuguggcuauuuugggucuuuugugguuccauacagauuuuagguuuguuuuucuguuuugguggaaaaugccauugggauuuugauaggcauugcagugaauuuguaggucauuuuugguaguauggacauuuugacaauauuaugucaauccgugaauaugggauaucuuuacacuaauuuuguugucuucaauuucuuucaucaguguucuauuguuuucaguguacagaucuuuuacucauugguuauauuuauuccuaaguauuuguucuuuuugaugcuauuauaaauuggauuguuuucuugauuucuuuuuuagauaauuaauuguuaguguauagaaaugcuacaguuuuuucauguugauuuuguauccugcaacuugacugaauucguugauuaguucuagcacuuauuuuauggagccuuuaggauuuucuauguguaggaccuuggaucugcagugagacaguuuuauuuauuuauuuauuuugacuaauuuaucugacuagaauuuccaguacuguguugaauaaaagaggugagagugggcauccuugucuuguuccagaucuuagaggaaaagcuuucaguuuucccccacuaauuaugguacuggcugugggcuuuucauaaaugguuuuuauugugaggagguaagcuccuucuauaccuguucuguguagaguuguuuuuuuuaaaucaugaauggauguugaacuuagaugcuuuucugcauauuguugagaugaucaugugguauuuaucugugauucuguuaauguguucugcauugauuugucuuuguugaaccaaccuggcauuucagggaggaauuccacuuaaucaugguguauaaucuuuuugauguaauguugaauuugguuuauuaguauuuuauugaggauuuuuacaucuguguuaaucagagauauuggccuguaguuuucuuuccuucuggugucuaugucugccuuugguaucagggugaugcugucuucauaaaaugaguuuagaaguguuucuucuucuguuuuuuggaaggauuuaagaagaauugguagaauucaguagugaagccaucugguccuggacuuuuucuuuguugggagguuugugauuacugcuucaaucucuuuauuuauuacugucuguuuaggcuuuagauaucuucuuuguucagucuucauagauuguauauuucuagagauuuauccauuucuucugcauuauucaguuuguuggcauauaaguguuuguaauaggcccuugugaucauuuuuauuucugaggcaucuauuauaauaucuccucuuuuauuucugauuuuauuugagucuuuuucuucauuaguuugucgauuuuaucuucacaaaaccaacuuaguuuuguugauuuuuucuauuguuuuucucuauuugaucuauuucugcucugaucuuuauuauaauuuccuuucuucugcuaacuuugagcuuaguuuguucuuccuuuccuagucuuugaggugugaaguuagguuguuauuuaaaguccugcuucuucguuaauggaaguguugauugcuacagaauuccuuuuuuuuuuuuuaauuaaaaaaagagagauggggucucgcuauguuggccagauuugucuugaacuccuggccucaagcaguccucccacuucagucuccuaaagugcugggauuacaggucugcgccaccacaucuggccccagacuuccuuguuaacacugcaucaugcaaguuuugguauguuguauuccgcuucauucagcuuaagauacuuuuaaaauucccuuuugauuuccuuuuuuacucaaugguagcuuaagaauguguuguuuaguuuccacguauuugucaaucauccuguuuucuugccguuacuuuuuuauuuuuuugagacggagucucacucugucacacaggcuggagcgaucucggcucacugcagccuccgccucccagguucaagcgauucuccugccucagccucccaaguagcugggauuacaggcgcccgccaccacgcucagcuaauuuuucguauuuuuaguagagacgguguuucaguguguuggccaggcuggucuugaacuccugaccucaggugaucugccccccucagccucccaaagugcugggauuacaggcgugagccacugcgccuggccuucuugcuguaauuaauuuuagguucauuccauugugguuugaaaagauacaugacaugauuuugaucuuaaauauuuuaagacuuguuuuaugacuuaacauaugaucuguucuggagaaugggucccaugugcuugagaaaaauacguauucugcugcuguugggugaaaaguguguauaugucucugugaggucauuuagucuggaauguuguguaagccugcuguucuuuguuuuuauuacuguuaaauauccugucuggauauucuauccaguauuuaaagugggguauugaagccuucugcuauuacuguauuucuguuucuccuuugagaucugucaauauugcuuuauauauuuaggucugauguggguacauagauguuuacaguuguuacagcuuucuguugaauugacccuugucucuagagacaguuuucgauguaaagucucuuuugucugagguaaguauagccaugccugcuuucuuuggguuaccauuugcaugcguggaauaucuuuucaucccuucacuuucagccuguguguucuucacucaaaaguggguuuccuguaggcaguauacuguugaaucuugguguuuaguucauuuagcuacucucuaucuuuugauuagugaguugaauccauuuuuguuugaaguaauuauugauaggaaaggauuuccuuuuuccauuuuguuaacuguuuugucuaacaguucuuuugcaugucuuugucucuugcuaucuucauuuguguuuuguuguugcuuuuuguguuaaugguuuuugcuuucccuucuuuuuuucuuuuguguaacuucaguagucauuaccuagggcuuacauaagauacaguugucuguuuuaagaugaugacaacucaccuucacuuauaugcaagaccucucagcuuuuaccucccuccucuacaugaugugcaguuaaugccaccauacauaacuauuuauguaauuguuaacauaacuuauuguuauuuauuuauuuauuuauuuauuuauuuauuuauuuaugacagagucucgcucugucgcccaggcuggagugcaguggcacaaucucagcucgcugcaaccuccgccucacggguucaagugauucuccugccucagccuccugaguagcugggacuacagguauccgccaccacgccuggcuaauuuuuguuuuuucgguagacauggaguuucaccauguggccaggcuggucuugaacucccaaccucgggugauccaccagcuucggccucgaaaaguacugggauuacaggugugagccacugugccuggccaauuuauuguuauuuuaacuauuuuugucuuuuaccuuuuuuucuucuuugagacaaggucuugcucuguuguccaggcuggacugaagugcaguggcuugaucauugcucacugcagccucagacuccugggcucaagcaauccuccuaccucagccucccaaguagcugggacuacaggcuacaggcaugugccaccaugccuagcuacuuuaauuuuuuuuuuuuuuucaguagagaugaggucuugcuguguugcccaggcuagucuagaacuccugagcugaaguggucuucccaccucagccuuccaaaauguugggauuacaggcaugggccaccgugccuggccucuuuuaacuuuuauaauggaauuaaaagcgauguaucuaccacuguuaugguaauacaguauuauguuugugucuguauauuucccuuuaccaauacguuucauacuuuuuauguuuuuguguugcuauuuaguguucuguugauucaauaugaagaauuccuuuuagccauucuuggaaggcaggugcaguggugaugaacucccucaacuuuuguuuguccgggaauguuuuuauuuccucuguguuucugaaguauugcuucgccagauaaaauguucuugguugggguuuuuucccguccuuucagcguuuugaauauaucaucccauuucucucuggccugcagguuucagcugagaaaccuacugauagucuaauggggguucccauguaugugaugaaucacuuuucucuugcugcuuucaaaauucuuuuugucuuugacaauuugauuauaaugugccugggggagcacaugucaucuugagagagagaucuguaucaucuaagcguggggccagcagggauacuggccuuuaacagggagggaagcccuccucuguaggcucaaagaauuucagguaaucugagaauuugagguucuccaggccuagaaguuuguaugccaugagucauagucucuuuccuucccaucuagggccucaccuuggccuugcagccuucuuggguuggggguuuagcuucuccggcagccauucauuucugguccuggccccuggcuguaggagagcacagcuuggugcccuuggcuuuuggucacauguugcugccucuuagcccucuuuaucuuuucccuagaccgucugcagagcucagugcagccgccacccgcucguccuuacuucccuccuccauguucacaacacaucaccuagugggugcccucccacugguccccaccauauggccccaccucuugccuucuugagcugcuccuggcaccaccucccauagguuaguucucugggaagcagccuuagauacagagucacuguuuggggcugacccuuugggagagaggcgggugagcaggcgugggccaagaaagggaauggcgccccagccaggcucagcaccucaccugacccccaggggcuggagcugaagggacccaccagagcagcugcccacaugcugggucuagagaagcgcccuucugacccugccucggucccucacuggcugggcugagcgagguggcucucuggagcugagccccaagccuucucccaggagccuggguggugggcaucuugucuaggaccaggcuuggugaagguggcacgugguuuuggaagcagcccaccaguggagggcuuuugugcgggugcuagacggugaccaagacagagcccaucagcugggcuuacauuuccucucaguucuucuucucaucuguguugugucuuuuaauguuaguauuuacuucgguauaauauuuguaguacuuguuauuacagaauacauuuguuaaacuugaaaccaguuuuuuuuggcagaaguuugguuucaauaaaagguugaguuagugcuuauaaaagcugcagguuagguuuucugugcuuccaguuaguguuguaaguaacgaugcaaaaacgcuauuucugcagcgaaaacaguguuacaccagaagagcagccggccuccuguaccgaucuccaacgcgaccaaacgcaguuuccuaggcagcccugcugcagggacccuggcugagcugcagccccccgugcagcugccggcggaaggcugucacaggcacuaccugcacccggaagaaccugaauaccuguaagucugucuuucugcuuucagaaucaguucaccaucuugugucccuuuuuguguuaguuuaaaauauuaauugaaguuaccuuuuuuaaaauaagcaauuuguauucgcuuaugaaagauuuuccuucugucccugcccuucuggccauucgguccccuuuccagaggccgggaaugauacuagcaggaaguuccuucagggauguguaccuaauucugacauuguuuauggaacagguguuuuucuguucucuuuuccaccauguguuacacuguuuaagaaacgaucuaaagauuagaaaguugaauugacaguuuaggugugcucuuuauggucugauagacauaaagagugaaauccucuugcauuucaaguauugugaagucuucaaagaagagaauuuguuugcucuuuggggaagaauuaauuugauucgagugaaaaaguguauagagcugcuuaaaggcuaaacuacucuagaaaaagaguuguuuaaaaaacguuuuuucuaaaaugaauuuucaucaugaagaccuaauuuggauaaccauaucugggguagaauugacugugccagaauugggggagggggugaaggaagcuucccuuggaguaagagugagcuuugugcugugugugguaggaggacccacagcugaugccagccuggagccaguuagcacaccgaaaguggagaaacauuuuuaacauguggcgauuuaaguugggauuuaagaugaagacgcuauuuaaaagugguuuuaaauaauucacauaagugaaugguucagugagacagcauggcauagaacgaacucaguuguuucagguuguuugagaggagcuaaaaccggugaccauguugagggaugggaugcgggggcugccggagucaggaggaaggaguugagaggcccuugugauacaggcagugguggggggguacacacccagggguggggcauagcugagggagggguuuggauguguucuguguugggcggcuuugagacuggggugucuguccccagagcucagagcagagguggggcgguaacuccaugcccgcgggcacaggcggggucacugagugaggagaauggcucgaggcugagccgucccucacauggggccagcguggacacuuggcguccucccuucggucuuugcgugucuguuguugagccgugugugugugugugugugugcuggugcccguguacacgcugcucugugaccugcugucugcacccuguugucugcacccagcagccuguggugagaauuuucccacucggugcauccucgucugccacaguuucaacagcuacccagucugucacgucaugggcgugccgugauggguccacuguccccacgguguccaggcugcaggguuugcauuguggcccugacacaggucccugugccauuccugcucugcccagcuuccccccgggcucccugccuugagccccucucuccgcaacccuuucgcuugugugcuccugcacaccugcucucacugugucucuuuggugucuguguccugacucugguguccucugcccgucuuugccucuucaggccuaggugugcugacucuggccuagggugccgagcuguccccugugaucuccccagccugucugcaccuggcgaauuaucccuuuaccaaauucuccccaaagugaaacaagcaagauagcugcccugcagugugagcgcgcuuguuucucggggagcuggugccuguggaguggcagaggcugcugggugccggucucauggguguugcucugucagaacugugcgauccgcacacgugugacuuccgccuuuccugcaugugccguucuucccgggagugaggccuucacacccaugcuucugugugcaccucucaucguucuuucucuuaagcuauaauccaaggagugguaaaggugugagugauuuuagagguuuuuauggauauugccauauuguccucuaaaaauguacauuuuuacccucccaccagcagugugggaauguucaugcugccgucugugauggguuuaauuacucaucaauaucuucacagugguggcuuaguacauugggcaucauccuuguggucucuuuuaucucugaaguucucucucuuuuuuuuaauugaagcaguaaugugcauuuuugaaaacuguugcuugucagaggaucacuuuuucuuuuuacuuuugcuuaucucagaaaaucacucuaauugcacgcuuggguuuugcuuuucccgugggaagcugguuguguuguagacacaucggggagucagugugcccguuugcaguguguggauguucaucccagguuggaaguuccugauacucuuggcucauuuuuauugucauuuuuuucccaaacaguccgaguuucucaaaacuuggugugaauucaggaugguccuguacacuugugcauuugcuguugaccuugaaguuugauaaaggaaugauuuucccuguaauucuuuuuccauuuagcgggaaaggaacugcugccuucagcccaucccauccuuuauugccacugagacagaaacagcagaaauccauacagggagaggacaucccugguaagaauguuguuuccuccuuuuuuccuuaauuucuccuuacuauagauuaguaaaaucauauuucucaaaauuaaaucauuuuaucugauguagugauuuuuuuguuuguuuguuuguuuuuugagauggagucuugcucugucaccaggcugaagugcuguggcgcgaucucggcucacugcagccucugacucccugguucaagcaauucuccugccucagccucccacauagcugggauuauaggcgcaugccaccaugcucaguuaauuuuuguauuuuuaguagagacaggguuucaucaugucggccaggauggucucgaucuccuagccucaugaucugcccaccucggccucccagagugcuggaauuacaggugugagccacugugcccggcugauguagugauuuuaguuaagacuguagccaaauaaauuuuaacuuguguugucaaaauguauagucuugcagugaaaauaucguugagagcaauuaccuucuguguaguagacacagaguaacugcgacauaagcagggcucacacaugcugaagcucucucacaguucugaacuguguguuaccaucaaaaugugggacaacuguaugguuuugccucucugcuuuccaugcggcccuucugguguacugacuugagaggcauuuuucuggacaaauggucauauugaaagaauuucaagugauagaaaauugguuacuuaacacuaucuaauuccucuguacugcagaucagcgacaucgaucgaauucuuugacccgaguugauggucagccucgaggagcagcaauagccuggccagaaaaaaaaaccaggugagucuguguuucagcaguguuucuguuuggaauguuuuuuauacuaaacagcaguucuuaagaugucaccccaacccccugaggaucaccgagacccuuuuauagggagugccugaaaucagaauuauuuuuauaacaacacuaggaaguuacugccucucugcagccucacucuugcgagugugccgugggauuuuucagaggcugcauaccaugugguguggcagcagguggagucagguaugaggguccagccagaucccagaacuauacaggugucaaauagugccugcccuuaacacuaggaacuucuuccguucuggcgaauauagucauuugucauggagugggcuaauuacuguaauuuuaaucaguguuuagaaaaugucugagcuuuaauuuguaggaugauaaauagagauuaauacugauaaauagaaacaaaagcucuuugagguccucaguaauuuugaaggguaucaagagguccugggacuagaguguuugagaaucacaaagcugaaauuaucucugauuuucuucugcucuguggaagagugaguuuaaaucuccugcauaugagaggcguauucucuuuguguggccggcauucucacccccugguccauguugggggucuuugguguauaccgcagcgcacccagugggccuucccuguguuucaggccugcgucccagccaacaccuuuugcucuacaucacgcugcgaguugugaaguggaucccagcucuggcgacagcaucagcuuggcccgcuccaucagcaaagacaguuuggcauccaacauuguuaaucugaccccacagaaccagccacaccccacggccacgaagagccacgggaagagccuccugagcaaugucaguauugaggaugaggaagaggagcuuguggcuauuguuagagcagacgugguuccccagcaggcugacccggaguuccccagggccucaccccgggccuuaggccuuacagcaaaugcccggucuccccaaggacagcuggacaccucggaaaguaagccugacaguuuuuucuuggagccuuugaugccagcaguucuuaagccagcgaaagagaagcaggugaucaccaaggaggaugaacggggggaagggagaccgaggagcaucgugucuaggaggcccagcgagggcccccagccuuugguacgaaggaaaaugacuggcagucgcgacuugaauaggacuuuuaccccgauuccaugcucagaauuccccaugggcaucgaccccaccgagacaggaccacugucaguggaaaccgcaggagaggucuguggugggccucuggcccuuggcggauucgauccguucccccagggaccauccacggauggcuucuuccuucauguaggcagggccgaugaagacaccgagggaagguuauauguuaguuguucaaaaagccccaacucccacgauucagagccguggacucuccucaggcaggauucugacucggaugugguggacauagaggaagccgagcacgauuucaugggugaggcccauccugugguuuucagcagauacauuggggaggaagagucggccaaacugcaggaggacaugaaggugaaggaacaugaagacaaagaugacgccagcggccgcucgagccccugccugagcacagccucucagaugagcagugucuccauggcgagugggagcgugaagaugaccagcuuugcggagaggaagcuccagagacucaacagcugugagaccaaguccagcaccagcagcucccagaagaccacgccagaugcgucugagagcugcccagccccucugacgacguggaggcagaagagggagcagaguccgagccagcauggcaaggaucccgccagccuccuggcaucugagcugguacagcugcacaugcagcuggaggagaagcgcagggccaucgaggcccagaagaagaagauggaggcgcugucggcaaggcagcgccugaagcucggcaaggcugcauuccugcauguggugaagaagggcaaggccgaggcugccccaccccucaggccggagcacuuugcaaaggaguacucucagcacaacggggaggacuguggggacgcuguuuccaaaaccgaagacuuucucgugaaggaggagcagagagaggagcuccuucacgagccacaggauguggacaaagagagccuggccuuugcucagcaacauaaagcaaaagacccuguggcucugcacgagcuggagagaaauaaggugaucuccgcugcccuccuggaggacacuguuggggagguugucgacgugaaugaaugugaccuuuccaucgagaagcuuaacgaaaccaucaguacgcugcagcaggccauccugaaaaucucucagcagcaagagcagcuucugaugaagucccccacagucccagugccaggcucuaagaauaacucgcaggaccacaaagugaaggcaccaguccacuucguggagccacucucucccacgggcguggcuggccaccgcaaagccccccggcugggucaaggccggaauucccguuccggaaggccggcggagcugaaggucccaaaagacaggccacagggcuccucccgaaguaaaaccccaacgcccaguguagagacgcucccgcacuugagacccuucccugccagcagccacccucggacgcccacggacccuggccuggacagugcccuggagcccaguggugacccacaugggaagugucucuucgacaguuacaggcuccaugaugaaagcaaucagcggacacuuacucuguccucuuccaaagaugccaacauucuuucggagcagaugagccucaaagaaguucuggaugcgagugugaaggaggugggguccagcuccucagaugucucgggaaaagagagcguccccguggaggagccucugaggagcagggccagccucauugaaguggaccucuccgaccugaaggcccccgacgaggauggggagcugguaagccucgauggcucggcggaccuugucagcgaaggcgaccagaagccgggggucggcuucuucuucaagguaagggauugguagcaucuguuucaggcacucgugauguguugccaccccacgugauagugaguuagagaacacagaucugcaccaggcuggccagccgcuccuguaagaggccaggggauguguguguuuagcuuugugggccacagagucucugucccgaggacuccacuuggccagaagcagucccgggcaauacgcaugcaagugagcgugguguggcugagacgacuuuguuaugagcccugaaacuggaauuucaugugauuuucaacauaguuuuuuuuuuuuugcugguuuuccagucaaaacccugucaucucccuguccugccccaaagcguaaaaagcguucgucguuagaaugcucuggagguggccaggccuggccugugggcugaaguuugccaaccucugauauagcaacuucaaaaaacauuuuuuguauguuuuucuuguaauuuuuuccuuagauaugaagggaagcguaaacugaacuguuuuaauagucagugcgucacaugauguuugcugugacguucguugucuccuaagaugauaagaccauauaucgucgucuccuaagaugauaagaccauguuuucgugguaguuuuucaauguuuagauagauuuugauacacaguuacuuacaguauuggguacaguaaugugcugugcaggucuguagucuaggagcaguggcugauguagccgaggccuguggggggcgcugccauccaggugugcgcacacuccgucaugcucacacagcagcagagucaccugaggaccuauuucucagaacguuuucucucggcaagcgacacgcaacuguuucugcuuugccuccaggcaguuaugaauuugagaggauaccaaaucaucagguggaucuuagcaaaagaggcaagcuuuauuuggugguugcacuuuugaaauguaaacaaauucgugaccaacuucaguauucacuuuuucgcuuuuuuuuuuuuggacagagucuggcucugucgcccaggcuggaguaaaagggcaugaucuuggcucacugcaaccucugccucccgaguucaagcgauucuucugccucaggcuccugaguagcugggauuacaggcgugugccaccaugcccggcuaauuuuuuuuuuuuuuuuuuuuuuuuuaaguggagacaggguuucgccaugucggccaggcuggucuugaacuccugaccucaggugauccacucuccuuggccucccaaagugcuaggauuacaggcgugagccaccacaucuagccaauuuuuguauuuuuaauagagacaggguuucgccauguugggcaggcuggucuugaacuccugaccucaagugauucacccaccucagccucccaaagugcugggauuacaggaaugagccauucugcccagccucgcucuuauuuuggaaauauacguguacuuuuuaaggcaaacuggaucucgugagauguuugggaaauugggugaugccgagcgccuuugaaaugcccugguuugucuucauucguauuucagagucuguaacgguuagagaaaagcauagaagucuuuaugcguuaaacuuuuaaaagcguaguggaagucggcugcugggucgagugcggccguguccggcgucugaggggguuccugucaugcucuguguggccucugucuugcaggaugaacagaaagcggaagaugagcucgccaagaagcgggcggccuuccuccugaagcagcagcgcaaggccgaggaggcccgcgugcgcaagcagcagcuggaagcggagguggagcucaagcgugacgaagcccgguaagcgucccgccgggggggaaagcagacugagcaggagccuggugggucccuggcggccccggucccguugcuggcacugagcauggaccauggcaaugagugccugugacggucuuacuccucccauggaccaccuccccgaacuuucacggccccugcugaucuucagugaggacgugcguugccgguggccagggaggcuguguggccucggugggucaucugcaggacugccuuugcagccucugugucccgcuuguggaggcuggccacucuuggucccagcggccggggagaacccgagaaacgcgccuggacagagcgccgcggcgcaggcgucguggaagaagccccgugaccgagcagugucugggcguguguuucucucaggcgcaaagcugaggaagaccgggugcggaaggaggaggagaaggcgcggcgcgagcucaucaagcaggaguaccugcggaggaagcagcagcagauccuagaggagcaggggcucggcaagcccaagucaaagccgaagaagccgcggccgaagucggugcaccgggaagagucgugcagcgacuccggcaccaagugcuccuccacccguaagcagccccggcccucacgcgggcagcgcuuccuuccgcgggcggcggccucacguucuucagcucauuucaauuuugucaucaagaguggugugaggcgggaaggguggagaugauuauccccguuucauggaugacaauguugagaccagaugcucugagaugugcggcacauccaggcgcagcccggcuccccgggaugggguggggacgcggccuguguggccgagcucugcagggcgaggugaggggaacagguacaggggacagguacuugucugucggaauccguucaugaaccgucgucuguuucugucucuggcagcugauaacuugagccggacucagucaggcuccagccuguccuuggccucugcggcgacgacagaacccgagagcguucauuccgggggcacacccucucagcgguaaggggccugagacggccgccggcacggggcuggaggacguucggaggggcagggugggacuuccugauuaaacacggugagagaggcuuuuguaacuuuaauuuugauauaauuucacauuuacagaauaguugcaaucaugucaucaggaauaccagugcccuucacacgggcuccccagcugguuaaacguggcagccuucaccuuaucacccuccccugucccccaccccacacgugcacaccugcuucuucaucguuuugaguccguuggaguccaagcgugguggcucacacccaugauuccaggacuuugggaggcugaggcaggaggaucacuugggccuuggaguuccagaccagccugggcaacagagugagacccccccaucucuacaaaaaauacaaaaaaaaguuagcugggugugggggcaugcaccuauagucccagcuacuugggaggcugaggugguaguaucgcuugagcccaggaaguugaggcugcagugagcugugcucaggcuacugcacuccagccugggcaacagagugagacgcugccagaaaacccccaaaagcaaaaauaaacagaaaaaaaccacuccguuggagaugucuggccuuuuaugcuuaaauacuuaaguguguauuuccuagaacgagaauguuuucucguguuaccaguuaccaaggcagcacuuucauccgauuugcgguccccauucagcuguccucaguuaucccaagagugucccugacaacuguguuguuuccgaguccaggaucugguuuggggcgaugaauggccuugaaaugccaugucccuguagucuccuucgauccagagcaguuccuuagccuuucuguguuuuucuggaccuugacuuuugguaaccacaggucaguuauccuucuggcugccucucaguaucggcuuccugugaugagacugaggccucgcgcugcugauugagcagcccagaagugagugugcgucuuucucaacgcagccucucaggugggccccgggaccgcuccugugaugagaaaguaacuucaggagagaggcuggggacuggucuggaccucacggaacugucccgcaggggcuuuagugaccaccauggagcuccugcucaccgcuuccuccacgcguguugucagcucucgugggagcaagggcuucccuugcccaugugucccuuuauuuuuauaugcacagcguguggcuccugcucugugugcaccugugggccguguuuucuugucucuucacccgucucauggcuccuuguugucucugggcuuuguggcagaucccuccgagggacugcagauucuguuuggguuuuuguucugguggucaguuacccuggcuggauucagacuccagcucugucugccucccuugugagagcagcagccgacaucucugagcagcuguguccagccuuucggcaucuguugugcucaguggagacuucccugcaggguggagcucaggccuuccagggaucagcgucacugggacccaaguuuucagacucggccugcuguggccccuccuucccuaggucucaucccuggcugggcagcagcacagguggcccaaacuucauccucuggcuuccugagccagcagcacugugcccugugcugugccugugcccugcucacgggggcagugccuggagcaagggcuucguggaggugaaccccuucggugaagggcugacuccccucugucugucuucaucacucccuagugccugaaguguuugcuuuuguauuuugcucggagugucuguacugugugggaguuguggcaacucgagcccccaccgucaccgaaagccuccuccccugcugaugugcuuccuguccugguugcgggccagccccuugccagcaguggugagaggaagccagcgcuucaccugccugucucuugucuguuucugccugcagaguggaaucgauggaagcccugcccauacugagccguaacccaagcaggagcacagaccgagacugggagaccgcgucggcggcaucuucccuggccucaguggccgaguacacaggugacggcguucgcccuccuuagaggucaucgugggcauggccauacgccuuugcguggcucuuucaauaucuguucucuauuuuggucuaaaaaguauuuuucuaacaaagauguuugauguagugaaagagagcuaauuugagcucuuuggugcugaaaugggcaugugguuuaguagaagcucuuaggccugccuugcccuccuggucaucugcccugcugucugcugugcagggggcagcggaccugggggcagcagagcccgggagugguggaagugcuuggcucucaccagcugcccuuggagcaggcgugggcucagggcacagugaacuggaggugcugcuguggcugagguguaugucccggggccuuugaacuuuagacuuuuuacaaguuauuuaccugguuuugucuuuuuuuuauaguuaagacacugaauuuagaaaggggauaaauuauugauuacuuugucuuuaguugucuaaaaauuuauaacuuaaaauucuuuugaauaaauuuaagugguuuuuacuucccauuuuuaaauaaucauaaauaucuguaauucagccuacccauugcuugcuucuaagacauugcugguuuucuuuuuuguguguguucgugccuuaaaauaauaauuuuaccaacccuggccucguuucuuaggucccaagcucuuuaaggagcccaguaguaaaucaaacaagccgauuauucacaaugccauaucccauugcugccuggcuggaaaagugaacgaaccccacaagaauuccauauuggaggcaaguaucauguuucaaccucaguuuuuauguggaauaaaaaguguuuauaaauuaaggguucuuuuuaaaagaaaacaccccuaaucuuugaugcaugagaguuacuagggagaaugcagauuucaaggaagaggccguuccaggcaggugggagugaggagugccaagguccaggggcugcagugagccugugcuggaggaacacccaggaggacggggcaggguucagaggcuacauccucauguggugccucugggcugaggaaagacauaguucuacucagugagauaguggaugcaggugugggcagaggagagccaggaacccaccugcccuucccaguagaucagagcagucagcagggaagccagggaggcagccuggaggugaaugaggaacaggggccagggcuggagcgguggguuggggaggaccgaggacggaggacggagugguggguuggggaagauggaguggggagggagggaagaggcgcgcacccgcugagcguguggacuccggagcacccagugugcaugcccagggaggggcuuggaagcaggaaucugaggguccugcacggggucuaggcuggccccugaggggcaggacugggauuccaggggagaggaggcagagccacuggacccugccccagauugaggcugguguguggccuuaaguugcuggccuugggauacaacggcuugugaaugagugaaugaaaauuaugcaacaaucugucauccaccagaaauucugcuuuuuaauaauuaagacuaaccccugguccuuaguugguuuaguuguaaaaauuaaagugacauacggaauuucugacccacuuuaaaacggauguguucuuuucuugauagugaagaucaucuagacuaagaauggccccgaccuaggcaggucucguggcacuggggacagaagaggccauggucaugcccuuccugcuuagauuuccacacggagaggugguuggcccccuguaucaguggcccccaggaucacccugcaugcggagaugcacuggaaggacucguggcccucaguguggagucgacccagggcuuagauuuauuccagcacuguggagggagccacagccacugggugaagagggagaagacagaggcggggcuaggccuugugcagcucccucugcucucguucuuccagcaguggauccacagcagccugugggccauggaaagcccuuuugagacuggaugcccugagcucuccuugggggcuggucacaaggcacacucccugcccagugugcagcagugugccugacgccugggaggaaaccagcgucagcgugcagaccagcaguucaggcucaggaggcccuccugucuugccagugagugacugggagcgagcucugcagauagcaaguucccaggugcccaccaagggccgcccagcaggcaggccuuucuaggacagcagcccucucagcugugccacauaagcugugggcaccacacgcuuccuuaucgugcaggcagcaauaaguaaauaagaugaaccccacuccccacagucccgcugucgcuacaaauuaaauguuucuuucuuuuuggcaucuaauucuguucauauuuaaacacagugaguaggguugaaaucaguauuauauagacaguuuuggauucuuuuaaaaaauacguauuauuuaaaauaauaaaccccauuauaugcugauacauugcauauuuaugaaaaguaacuuuucuaaagccaaauaaauagaagaguggcauugacauaagagggcuggcaucucagccgcucgggcccuccguccauuacaaccacacagcccagggccuugggaagguucugccgcacacuugggagaggcgaugaggccuuagccuuucgaggucgagggcuugacccugagauuccugggaaggccucaggaugccugggccgcauguggagaacugugagggcagacccaggugcacucccauucccaggcguguggaggguuuguuuuuaaaaguuaccaaaacacuugaagauacguuuuaaacuuuaaaauacaaucaacaaacgcggcgacaggcaucagcaguuugucauacuucagauucuucuuuuuuuuuuuuuugagauggagucucacucugucgcccagacuggaguacaguggugcaaucucagcucacugcaaccuccaccccuccagacucaagcgauucucugaguagcucggacuacaggcaugugccaccacgccuggcuaauuuuuguauccuuaguagagaugggguuucaccauauuggccaggcuggucuugaacuccugaccucaagugauucgcccaccucagcuucccaaaguguugggauuacaggcgugagccacagcgcccggcccaaacagcuuuaugagauaucauucacauaccguaaaauucacccuuuuaaguuauaccauucagugguuuuuaguacauuaauagaguagcacaaccaucaccaccgccuaauuucagagcauuuucauccucauaaaaagaaacuccacgcccgugaacagucaccccccuaagucuucccgcgcccaagcucuuggcggucgccagucugucuccauggauuugccuguucugggcauuuacauaacuggcaucauaauuauauggccuuuugggucaggcuucuuucacuuagcgugaugcucugagguuucucaguguaguguguaccggaccuccauuccuuuuuguagcuggguaaugcuccauugcaugcuccgaccccaugcuguucaucucgucaucugcugaugcacacuuggguugauucuucuucaaacauuuuuuauugauagggaacagaugugcaugcuuuuggggguacaugugauauuuucguuucuacuuuuugccugugaagggauagugcuguuauuuauaugcaguguuuuguauggaugcguguuuucauuucccuugaguacauaugugagagaggaauugcugggucccacgguaacugccugaugguuuggagaagagccaaguuguuuuucacagcagcugcugugcucuguauccuucuggcagugaaagagccccauggcucgccagcacucguuaccgcccugcuucuggguuccagccguccuugugggcaugacgcgacgucucuuucugacuggcauuucucugguggcugaugaugagcaucuuuucauaugcuuuuccauuuaaucguaaaagcauucuuuucccccuugcuugcuuagacuucuuaaguaaagucucaauggcauauaaugcucccguacaggggucugcuguaauuguuuacaacaggcaggccguagcugacgggugggagagcuucccacggagcggugcugguugagccgcugugggagcccaacucguggcaauuggaguggcccugaaguguuugucucuuccccuuuucucucucugcacaggagcuggagaagugugaugccaaucacuacaucauacuguuucgugaugcuggcugccaguucagggcgcuuuacugcuacuauccugauacugaggaaaucuacaaacucacuggcacggggccaaagaacaucaccaagaaaaugaucgacaaacuguauaaauacagcucagaccgaaaacaguuuaacuugaucccagccaaaaccaugucugucaguguggacgcacucacaauccacaaccaccuguggcagcccaagcggccugcagugccaaagaaggcccagacucguaaaugaccccggugcagcuggcguccaaagggugacccagacucguaaaugaugcccuuguggcuggcauccagagggugccacgggguccuuauuuauuguuuucaucuauuuggguacgaagugugcaaagucacagaccuuuugcaaagagguuucuagacagcagaagaaaaccccucucucagcgcucaucucacgcagaggaugccaggcagggugaggaugggggaguagaugccgcuuuugcaguggcucgcacugcuguggccacugcugaccacugaggcucccagcggaggguguucacagccaggucccgggccacggagcucccuuacuugaaguucuccuucagcauagauuagacgugauccacuuugcuuucuugcuucucaccucgcccccuugcacauugccugacacccucauauuggccagcuguaaucucgugacuaugggacugaggcucaaucuuggcuugggguguuugaaugucuauagcaaaggaauucauaaugggaaaucuuuuucauuugagaaauuguaugauauuuauugguugugucuacugccaacauuuauauccaauucuaagauuucugaaaaaaaauucuuaucccuugcugcucagaaaaaguuuacggaaaacaccaguucacuaaaagcaccgaaaucugcaaagccugucuuccgcuagaacaacgucuacaaaugugaagaugaugacuucuggcacgcggucaugaggguggggaauggcacuaggagcugauguuugccucauuuaaaguaggcaagccgagccaacugcagccaucauucauuaaguuuuggguagugcucuaaugguuuguucacuuuaauaaagacagauuuugguaaaguagaauauuuuucauucugagcauguuugucccaaaaggugaugcacuuaagcugacagucccuucagugguuuuguuaggucacggcuuguccugucuggauucugcaucuggaagcgcugcaugcucucagaggagcgugccguuuccccuguagauggauacuuuuguuuuguugccuauuuaaaaacaauuaagugguuauuugcaguuauuucagaacuccaaguaaguggauggcuuuggguucuuucugccuuggucccaaugguguugaugcuucuguggagcgcggacauucccaggagcaggugcgugccagccauggcugccagacacugcugcaacugaccagcugccggaagauucuggagccacuaacauuaguuuugcacauauuuucuugggaguguuacuugaaucuaucucaaacugcagaaaaaaucaaaagaucaauaauugggagaaaaagagacaaauuuaacuguuacauaauuuuagauagacaaaaaacaugagugagucguguacauaaggagggaacaugguacagaaggcuagaaggaauuauaggucuuauuccccuuuccucaguccuuugaagagaaguacagucucuugcgauuuuguauauaucguguucgacacagccgcucucuguccuguaaauagggaacuaaaggcuguaugauuucucaagugcugaguuacacaguccugagugagcuuucuguuaccauacuuucacacgugggcuuuauuucucacuguauguuugauaugauauuacuguauuuauuuuaagaaagcacuaagauguaauaaagugaugaacuaauuugcuuuacauugaaucguaugugugagguugcuguggcucauuucgcugaccaggcgacaccaacuccuugcuuuauaggaguuucacauuguucuuuaccauggcccuaucgaagucaguggaauuggauucuuuuuaaugaagagcuagaaaauaucuggcauagagcuggaaaauugcauucccaugggacgucugaaucaauucuggauuuucuccauggaaugagucaguguguggaacauccugaaacuuguccuuaagcguguaguuuucacuguucguugcgaguaagcacuaauguggcauggacauuccugaugucccaaguccccaggccaguguucgccuaaugauugacagaagcgucccugcguucuucaugcuuggacacagcaacccuuuuaauuagucuugaaaaguuucagacacaggauuaauuuucgugguggugcuuuugggccuuucuggcuuggguggugguaaagucaugauuuugcaguugauaacacugacuuauaacucuguuuaucaaugucuccuauauucaaagccccugcagugguauuugugucucguugcaaauuucuuucagcggaaagcuugcacaacuuucguugugucucagaauucuaaccuuguuauuuaagacaagcugcucuacccauuuaggauauaacuuuguaaagaaaguguaaaccaaaugauucaauguaugaugaaguuuauguguaaauccuugguaaugcuagaauucugggagcccagaaggguugaaagagaaaugaaacuugcgugagucccauuauuuuacgcauguaugugcagauacguucuacccacacgugugcgugcacauggcugugugcgugcaccaaagauggacugcuuuccauguguccuuuugacuuucugcacgugucacugcggugcagucucuuagcagacuucaggcccaaacuguauucuucacucaggcaaaauugaaaaguggaauaauucuaaauuacuucuagguuauacuuuuaccucccugaaauuguaguugucacuuggagggcaaaauauuuauugaaauaaaauuuucuguuaaaaauuca

SEQ ID NO: 191186 - RNA, 14317 nt, Homo sapiens
ccagccccgccgcccucgcaauaaggggccugagcgcgcgggggagaagcgggagcgggagcgggagcgagcuggcggcgccgucgggcgccgggccgggccauggagcuguggccgugucuggccgcggcgcugcuguugcugcugcugcuggugcagcugagccgcgcggccgaguucuacgccaaggucgcccuguacugcgcgcugugcuucacgguguccgccguggccucgcucgucugccugcugcgccacggcggccggacgguggagaacaugaggcaaggccgggggccgccgggaggggccggggaaccgccgcgccgcuuccgcuucccuaacuuucuucugggcuucccuccuuccugccccgcccgucccgccccgcuccggggcuccggggagagcgcgccugggccggcggcaggcacaggagggggucccggagucagggggucccggagucacggggucaaggagccggcgucacagugcccagcaccccaccccccgcccuggccccgggcgucuacaccgguuucggccuccgccgcgucccugcagcccggcgugggguuccggggguggagcagcuuucggagagaaagggggccgguccgcgcugggagaggcucagcccugcuuccugagcggggaaaccgaggccggggcggcggggacuugccccagggcuauugaucagggcgcacgacggcgugggggcaccccucggccucccuccgacccccuccugacuguccgcccggugaugggcgcaccuguggggcggguuccccuuucucucccuuuccucuucgcagggaggugggggacccggaggggaccugcuuccgugcuggggagcgcgccccuggccuacagcuccgggggcccagcuuccaagcgaagggaaggaagaguuaggacuaggguucggcggggcugaaauuuuccccuggacgccuuccagaaggugggagcuugguuuugccaggcugggguugggggccagaggucagacugggcugccaaagacggcgggggcugccugcuccugggcgggguggcugcuggagaaggcucuugccugcccccucucccuguuagccguccccaggcuguugcuacauuucucccugcccuguuuggacugcccagccaguggcuuuugcaauggccuggggugggggcauuguggccccagaggcccccuuccccgugguuccaggggcagugggugaggguuugcuagcucccugcacucgcuguccuugccagcccugggagggcacugaggcugcuggaacgggccuacagucauggcuuccaacggagccccagaagcuccaggaauaugaaggaggacccugggccugauggugagcauggagaguccgagaagggccugcuggcugcucagccagacgugugugaccaguggugaugugggccagguggcccaggccggggucccggggagcgcacacuccagggcuggcccagguggugacuggcgcugacguccccaguggagcacccuucagcgaggaaggcaguuugcagaaacagggaguuccugggggcugggcucugggcaccugugcuggaaucugugaaggccucaccugugguucuggcccugggauccccuguaggcaggggucucugugaggggccccccucagccccuggggugcuucagaguaggggcgagggugcggcuuucccagcugaggaggggccagucuguggguuccuuggggugccccccaccccgaggaaauggcuugugugguucugaugccugcagggcauccugugcugggcguguccugggguguggacaggggacgggguccuguucuuuuggcagaaaugauggggcaccugacuuaggagacccuggagcagaccccacuacugagccaggccacaggccacgggccucuucaucggcggccuccucgugugagaaagccuggcuuguucugcaggggccucugccuggacuuccuagcuguuuuccagggaccaaaucacaguucaccugcugcccuuucuauggaccuggcaggcuggguuggcuggcacuggcccugcugccccacugggcccuguccccaucucagcuuggagauucuggcuaaccuggguguccucgggaccuggggccucugauggugcuuggaugggacccuccugccgcccucaccucuccagggcagcacccaggcucaggccuguggaguaguggcuuccgggacacuggcuacuaacagcaggugcuuuguuccugcuuuggucccugaagagaagggagggccagagggcagggcagucuggaggagaggccuggggcuccauggcuaccuucccccacaccucugcacgugcuccccaggccccagggucccugaugacuuccaagacucccagcaauggcuaagaguggggcuguugcgaacgugcguucccuccgugggggccgucgggaggggugagaaaggcagaugaagagcaggcgcuuugucacuccagggaagggacccggggggcuggaagggaaggaggggauacucggccucuguuccugcuguacgccacgggugccuccagccucaggaacagggauucgcgugugcucuguguuacaaauaaggacacugaggcugagauaagcaacuugaaacuggggcaggguccccaagccaggaugggguggaacugggguucgaacccacugacagugacuccagaguaccugcuuuucccuuuccccuuguucccagcccagcgcuuggggcuggugaggcagcccugcggcaggccugagcucugggaggggcgcuccaucuugccccugagcaauggcugcccuggcugaggcccagccccuccccacgggguuccaggcggcacccaagagacccccaccgucuacaccguaguucugagcgugugagggacagugaugggacuagaaccucugaggcagccuucguucccaccgggcuuggggcugagaccacggaccccuuccaggcaggggguguccccugagcccuucccugugugcgcaguuacgguggagcugcaggggacguuuccucaccaggggccgaugcccugguacauccauucgacagaggaaagcaaagcccagagcggcuccguguccuacagcuggguucagcuacaggaucagaaaacccucaagacagcagcuuaauccacagagaaguuuacuuuuucauacagcaaaggagaccagaugggcagccuagggaaacagcaguuaguuuccggcuccuuugaccucuauucccaccauuuucagggucccagacagaaaaggggugcucuuccucuuaaggaugcuccccgaauugaaccccacgcucugcugguaucuggaggccgggaccuagugguuguggcagcuccuggcugcagggcaggcuccuguccccauggagcacgugcccacaccacacgcccaguguggggagaacgcacaggggacuugggaugucgggcaagguuugacccagauuugccggccagugcauggucccggguccucugacagauguccggugaugacagaugccaucgggggcccugugucaccacagcacuggggucuuagucccaagggagaccgugaccuugguccuccagagcgcuccaggugucucugugcaggcccagaaauuggagcuguccugacugagggaugggagggcuucucuggccccaccuccuucccgcccgccacaccugcacuccuacacauccgcuuugaggagucacggggaccccccacauccggguguuugugugggcuggaccccgcaccccuauggacccaucccgccuugugcugcagcuuggaugacacuugucggaaaacaccagauuccucacuggggucccuguccccgguggccccagcgagccccagcagagggggagggggcugcccugaaugagcucacgcagcugaagaugggcaaguccuggcucagagagcugcugggucuccugggagugucccagcccaggaccaaggcaagggucagcgaguggccuuccacgaggacagccuggccaguggccugggcccugaccuagaaccgccucccagcugccugagccaggugcuggugggauugggggcuuaggcacauugaggggccuuuugcuucgauuuacuuuggacuuuuuuuuuuauuuuuugagacaaggucucgcucuguugcccagguuggucuuaaaccccugagcucaagugauccgucugccucagccucccaaagugcuggggucacaggcaugagccaccgugcccggccccacccauuuuggauucuucccccccucccccccacccccuagucauccccaucacagccacuguugguggagguccugcccuggcccgauggugccccgggugucuccgccucauagaauguaagccugcacacccuuccacaagagccugggaggucaaaugcuuugcccgaggccauagcugggaagaagggaaaugggauccaaauccccgucaggcccagagccugagugugggagcagcccaggugccugggggcugagcucaggcggucugaggaggcuggguuccugcagaccccagaggggucucuuacggggcuucgcucgaggccaguggacuccagucugagggcuccugaaaaagacugaggcagcaccugggcuuucccucagcaggagcccacugcuccgaugccaccagaagggcccagucugggcucagccucacuuaguuuugggugcugggcugcucccugggccuccugccuugcugggcaaagcuggcacaagucacccgccuggcaguggccagcagggcucccugagcuccaggcuuccggcaaccuuggcuuugccccugcuccccggggaggcaaggaguccaggaccuggauuugggguccgugugacuguguccuggucuggcacagcgacaccugccccaggcuuugaggaaaggacagggcagccccucguccgccugugguuggugggaggggaguuugagugaggcaggguguuuggcacaggacagggacugggcugggcaagcuggugggggaagccuggggacaguggcugcucugagcuuccugcugggggaggccggagcaagcucccagcccugcugagggguugaggggacugcggagcccgggggagggagggagccucaggaugagcuccuagaguccuacugggggcccgcgccgccccagcacgacucugccagcuccgaagcaggguuccgaggggggcucaggccuguucuggcuucccugcuguguggccuuggggaagucacuuaacuuugcugaaccuugaaccucgcauuccucaucugaagagggggguuaugaucguaccuacccugggggguuacugucagaacaaaaggaggugacucauguagagcccuugucucgaggcuuugcacacaggaggugcagggggccucugugcuuagaaggcgauuuuucucugcuuggguucccggggguguccucggccgcaggagccucugcagggcuuaguucagucccuuccucucugaggaaacacuuuuuuugugugugugagaugaagucuugcucugucacccaggcuggaguacaauggcaccaucucggcucaacgcaaccuccuccucccugguucgggugauucucccgccucagccucccgaguagcugggauuacaggcagcugccaccacgucuggcugauuuuuguauuguuaauagagacgggauuucaccaugguggccaggcuggucuugaacuccugaccucaggugaucugcccgccuuggccucccaaaguccugggauuacaggcgugagccacccgcccauccaggaaccgcuuguaaagugagucuagacuuucccaccagcuuucagaaagcucugaacuauguacgggacaccgcgggggaagugcgguggccucacguggcuggugcagauggcccuuuguccccuugaggacaucaacuucaacuuucuuccacccccaggguauaccuuucucccccagccacacugugggcugcagaguucuagagagccacagccucccgcuggccuggggcagccuccguccguccaucugucuggccugaggaccaggggccgguggugggcggcgggacacagcgccugcucagcaccgccugcugggcggggguuuguaccccgugucuuucacagcugagagaaguaucagugcacgauccaaccccuaagcagcuuagauuaaaaaaaaaaaaaaaaggaaaaguuuuggagcuagaggguggugcuggccacacggcagugaaugcgccgagugccacggaaccgugugcugagaaauggguacaauuauauuguuuagguggugcguguuauaccacaaucaaaacagaggagggcucggcgcgcuggcuccuuccugucaucccagcacuuugggaggccgaggcgggcggaucaugaggucaggaguuugagaccagccuggccgacauggugaaaccccgucucuacuaaaaauacaaaaauuagccgggugugguggcgcacaccaguagucccaacuacuugcuaggcugaggcaggagaaucgcuugccgggagguggaaauggcagugagcugagaucucgccacugcacuccagccuaggugacagcaagacuccgucucaaaaaaaauaaaaaauaaaugaagaucuuauuuuuuaauaauuucagauuuacagagaaguugcaaagauauuacgggggaccccauguggcccucaccaguuuccucccuuguuaacaucuuacaucaccaagaugcaguuguuaacacuaagaaacuagcuggccgggcgcgguggcucacaccuguaaucccagcacuuugggaggccgaggugggaggaucaccugaggucaggaguucgagaccagccuggccaacauggugaaaccccgucucuacuaaaaauacaaaaacuagccaggccugguggcaggcaccuguaaucccagcuacucaggaggcugaggcaggagaauugcuugaacccgggaggcagagguugcagugagcugagaucacaccacugcacuccagucugggugacagagugagacccugucucaaaaauaaaaaaguaaauaaaagauggaacuggccaaugucacuaccagagggaaccaaugucccuuucagauguggcccgagccuccugcaggcagcuagcuuuggaauugcaggugugucuuggcugcugcuagaaaucauacacauguccuucacaggagaugaguguggaccuguccuguucuuuccccgcgccccagcugucugugaaauggacccuaauuuacuuucccucuuucuacugguggcuauuuaagcauuuucagguuuuccuaauucacugcacacuucagcaccacaggcuucucacuccagccgucgggcgaauuccuggaagauucugagaggggaggggccagguuuccucagggcucuggccgggccugccaaccugcccuccacagaaguaucuugucugugcgacuccucacuccugccagccgcugggccuguucccaacacccuggcuggcaccuccuguuaucaggcguuuuaaucugugccagggggaaggaugaggacagucucuuguuuccauuugcgcuucuuugauuggcgacacggccgucuugcuagcaccagacaguucuguguuuccuguuggugaacugccggcuuuugccuccucgucuucuuggagcgucacagggguccgggaagcuggauugcgcaaaugaguguggaggcaaaacagcccugcaguuccccugagugugcgggugcuaccagcccgggugugccuucugggugggaggggacgguggccggcgcggccuggagaggagauaucuagaguuggcugaggaaggcagaucugaggaggccccaggcuuccaaguccagggacggacggcuggacucaucaccagaauuaaccauuaggccccccuugacucaguuuccccaucugcaacagggggucaugagcauugccccaucagccugagguggugcugccgcaggccugggcucacacauggaagggcagagugccagggcuggggaggggacagggguuugugucgcaugggaacagacgucagccagagaagguggagaguucuggagauagagggaggagauggcugcuagacaccgaaugugcccagcgcccaugaacugugcacccggaaaaggccaaggagauacauuuuauguuacguguauuuuaccacaauuuuuuuuuaaaggccgggcgaguuggcucaggccuguaagcccagcacuuugggaggccgaggucggcagguuguuugagccuaggaguucgagaccagccuggccagagauggugaaagcccaucuguaccaaaaauacaaaaacuagcgaggugugguggcucacgucuguggucccagcuagucaggagccugaggugggaggagcccaggagguggaggcuggagugagcccagauugugacacugcacaaugugacacauugugucacagagcaagacagagcaaggggagccugggugacagagcaagacccuguuaaaacaacaaaaauccccaccaguauggcuuugagagaaggccccggcuuugaaucucugcucuguggccuggggcaguuacucagacucaucuguagaaaguguggggcccuuaggacugcugggggaucaaaugguggggggcacuagucugcauggagaggggagcagcacuggcagccccccagucagcgcuggcacagccuugccccggccauccaccccugcuggagcuucggaguggagcuccguccuccuggcuccauccccgccggcugcccugugauggggugcccuaucuggggugugcccagagcuuccuggcagcacagcagggcagagguugggacgcucggagcuggucagagucuucggguaccccuuggacaucccuggucccaaccaugacgggcugcuuggacaaggccaccucacauuugcaggugcuccaagggcagcccccagugggcugggccccugccagagugggggcugcuguggccagggcucagguggcccagacccuggcucugcugcugcuccuggugugaccucagacaagccccgagccccucgccgccucuucacggggaaagggaaccggccugauucuguaggguaggggugagagagggucucggucucggcucuuuucuggaagaaccuuucggaggucguuucagaggucuccacuggcgccgacacuuucuuccugauguggcccugccuugaggggccagugaccuuccccaggguguguggggccccauuuccucugcuggggugcagaggcugcucuccccgacguggguccuucauagcggacgugagagccagugccaguuccuuuccggcuggguccccugugggguggaugagggcugggugggcccuggauguggauuuggaagugggcgccuucccaugcuccuagcauccgaguuccagaggcucuggguuuuccucuguugcuggggagacggaggcagggcagccguccaggugggugagccgggcccgggacucuguccgcuucaggggcucccuccccugugucucccggucuccugccccgugccaggagggccccuccccagccuccuccacaccccacccccaggccuucgcgccccagccucggcugcgggaucugugggacccguguucaugguggccuccccugcagcaucaucggcugguucgugcgaagcuucaaguacuuuuacgggcuccgcuucgaggugcgggacccgcgcaggcugcaggaggcccgucccugugucaucgucuccaaccaccagagcauccuggacaugauggguaggccgggccucggggguggcuucugggguuugaguggggccggcugagcuggggcuguguggggcugggucccggggacgaggacacagggcugccugugccugggcgagcucggccucaguaccucccucagggccagacacagaggcucggaggccacacgacccguccagguagccagggagaaggcagggugccaggcaggccugugggugcucagcagcugucuuccagcgcacgcugucucccccucucucucugucucugucucucugucucccaggccucauggagguccuuccggagcgcugcgugcagaucgccaagcgggagcugcucuuccuggggcccgugggccucaucauguaccucgggggcgucuucuucaucaaccggcagcgcucuagcacugccaugacagugauggccgaccugggcgagcgcauggucagggagaacgugagugugcagggccgggcucggugggguugggguggggccugggcggggccaggcaggggccagcuugugacuugguuuuggcagaaaaaacaagacccccacaucauccaugcuccgcagguggggucccacgccagaccccuacaucauccaugcuccgcagauggggucccaugccagcugcuuugcgaaguggggcuucuuaggaggcgaggcggcguggccuuucugggguggccugggcgugaggucaguccaggcucuccucucccugcagcucaaaguguggaucuaucccgaggguacucgcaacgacaauggggaccugcugccuuuuaagaagggcgccuucuaccuggcaguccaggcacagguaggcugagcccagcccucccugggugggugcaggcuggggaggcggggucaggcuggcuuaaggcagcaggugaccaccagccgagcugaggacccuugacacacaagggacuccucccacugaguuggggacagggccuccuugccccuuccugcacuugcccccugaccgaccagggagggcagccccuugggccuuuugcccacacagagcccagagugaccagcugcccuuggugggcacccagugcuuggccugcgaggcugggcagguagagggguggggagccgggccgcucgccucugcugcagagcucucaggaggcucauuucugggccugugccuggcuggggugggcuucagggcaugggcagugggucuggacaagccaggcuuuugguguaguaucaggccagaccagagcucaggguggguggagcucauuguaagcagcgccuccagacucuggacuuccugguccccagccuccaggggugcagugcauccuagggugucugggagaggccaggguauagccauucccccagcaccuguccugccucugccgcugugcugggaagaguugcgucaggagaaggagcuuuuacccaucuggguggggucucgcucagggcaggggucucagcuccuucccucacacuggccacuaguggcccccagugccuggcccugugcaaggugguggggagggggcccuccuuccagaggcucccagcuaaggccgugaggccuggggagccccggaggcgcugggcugggugagcauccuugggcucugaucccagcccugcccaggugcggggcacaccugcccagccuggggcugaugucacuucccuuugggggcagagugagggcuggaucagcucugggagagcagaggggagacgggcggcugugaugggguggcuggggguggccgcagugcagcuucagccaggagacccacagcuuuuccgucccugcucccgguccccagccuaccugcuggcccccucccucccugcugccaguccccagccuaccugcuggcccccucccucccugcucccaguccccagccuaccugcuggccuccucccucccugcugccaguccccagccuaccugcuggccuccucccuuccugcugccaguccccagccuaccugcuggcccccucccucccugcucccaguccccagccuaccugcuggcccccucccuuccugcugccaguccccagccuaccugcuggcccccuggagguucccuggcugccucggguuaaugaucacccccaagugcccuuggauuugaccccggugacuuccaggaacaccagcaggcuccaccccucccccgggcuagggcugccucccucacuggcuuccugagauggagaggacugggagagaggcgugggcagggaagagugccauaaucuccuccuaaaccggacagggcccugccccccuggcuagcugcagacccaauauggggacaggugugaaccaggcaaacacgugcuagcucaggagggcuuccuagaggagaugaguaaaaauuugcaggaugagcuuauggaacucugggccaaccagagcaggacacauaucccaggucccaggggcaggacagccacaaggacccauggcagcagcgaaggcaggggugggugggccgcaggacagggcuccccaaccacaugcagccuggggugugccuggccuguccccagggcugccucagcugugcgucucccugccugcaggugcccaucguccccgugguguacucuuccuucuccuccuucuacaacaccaagaagaaguucuucacuucagguacccccacaugugugcacccgggguguaggccccgccugacccuacagucacggagccccgggccccucaucguucccauuuccggguggcacccguggcguggccacacggugaccauguggcgaaugagugacucaggcuggagucccagcugugggcuucauggccucauggcccugugagauggguggugcugggcccauuuuucagaugagaaaacugaggcuccaagagacuucacacggauggaccccagcugugcacacagcuugggggccuggagggcggccucugagcccauguguccaggcugaugcccgcauaggguagauggaacccaggcagcccaggggcacaggcugcggggcucaugaccucuugccccuuccagccaguucccagaacgugggcaccuggugcccaggcaggacaguggggucaaaguuggagagcagugggggaacccagcuccaucucucccacagccccucgccccguauggagggcagaggccaggcagugagguaggggcugaucaggaaguggggcuuucugggggcaguaacaggggagcgcagacuugucgaaaaugcggcgugaaggccaggcagccaugggguuuacugcagcaacguuacugcaauuaaaauaacccaccacggcuagggaguccaggggaagagcccggccucgggcuucccagggaggggcuguggggggcuggggagaggcgaggccagggcagcaggcugaggugggccccagcuccccacaggccacugaggucuguugcuucccccacaggaacagucacagugcaggugcuggaagccauccccaccagcggccucacugcggcggacgucccugcgcucguggacaccugccaccgggccaugaggaccaccuuccuccacaucuccaagaccccccaggagaacggggccacugcggggucuggcgugcagccggcccaguagcccagaccacggcagggcaugaccuggggagggcagguggaagccgauggcuggaggaugggcagaggggacuccucccggcuuccaaauaccacucuguccggcucccccagcucucacucagcccgggaagcaggaagccccuucugucacuggccucagacacaggccccugguguccccugcagggggcucagcuggacccuccccgggcucgagggcagggacucgcgcccacggcaccucugggagcugggaugauaaagaugaggcuugcggcuguggcccgcuggugggcugagccacaaggcccccgauggcccaggagcagaugggaggaccccgaggccagacgcacacuguccgagcccucugcucagccgccugggacccaccagggugcagcugggcuccaggguccagcccacaagcugcaucaggcucucugggagaggaggggccuggagggccaggagucccagacucacgcacccugggccacagggagccgggaaucggggccugcugcuccugcuggccuggaagacucuguggggucagcacuguacuccguugcuguuuuuuuauaaacacacucuuggaaguggc

SEQ ID NO: 191187 - RNA, 23885 nt, Homo sapiens
uaaauuagaagacaugaaaauuuuuauuuucaaaaagaauguauuuuuacauaaaucuacaacagaauucaaauguagaaaaaauaaacuauauucagggauacagcgcucagcacagcacacccccuccccggagugggccguccccccagaacaagacugaaggggccucgccggccccaggacccccacagcagggcagccacaggcuggcacgcggagcuccccgugucugucacaacagacugcaaaugcgaggcgcccagacccugagcgucgaagacaaaaaccaacccauuuucacuguggcaacucacuucuuagugcaggucacucauccguacaccucaucggaaacagaggggcaggggaaaccacaggauauacaucuccagaugccucagauaauccccuccucaccccugccacucgaggaccuccaggagagcccaccugacaaaccccccgcuuccucccugggccggugcaaccaaaaaccugcaggauucauccaggacuccaggcccugagaaaggcagagcuggcugagcucccccaggacuccaggcccugagagaggcagagcuggcugggcuccggggccagggcccucuguagacccaggacccaagcuggcuucccagagcaucacagccccaaagcccugccccgugggacagacccaggcaccugugcccucagccacccugcuccgcccucacuguguguggcaacccucaccacaacugucuccaugggcagguucagguuucagccucgcuccccagaggcucccgcucggccucugcuguuaacugcugugcaggugagcaccgggaagccacacugccaggagcacaggcagaggggcaggcaggcgagggcuccagcagggacggcgaggcucgcgcuuagcacccaaccccucgaggaguccgaggggcagcacuggcccugcagcccucauagggcgcaugagucccacuggcaucugaccuggaguaagggacucagggagccuuaccaugccacaggugucccccacaucccaacgcaaguccaucaggagcuuggcuccuucgcaacuaagaaccuccccacccccguuccccgcccccagcaacacugaacaaugaaccuagagaggaaggcgucuucagagagcaggugcagccagccucagcaccuccuguccaaagaaaccuuccacccucuugccccaggggagccuuucuccaagaaagccacauggagacgagcuucacaaggacgcacuugccacaaccauucacaaaaccccaccuuuuauuacagucugcggugcugcuuguugcagggacacugagacaaacgggagagucaugugcgaugaccgugcuaucggcaugugggccacaaacucccaagacacaaacggcucuuuacacagaaaacaaccacucaaugcuguuuuccagaaagacgaaaauacacuaggaacagcuacuggcgggaauggaggagucagggcccugggccagggcaucuacgcagcagagaaugggggcggccggcgugggccaaaggggaggccagcuggcggggccacgguggcggugacaggccacagcgugcacugggucauggaauaucaaaaagauacagaacguuuacugaaaaaacacaacgcauguuaaauugaacuucacccuucuguaauaaaaaauuaaaaacuuuuguugacucuguuugaacacaauagacuaggaacucuucccuagacaguguuagaauuggcaagaaaugucaccagcaacuuuuaagaacuuuccggugguccacaccuuccgcucggccaaaucaucuucagagaggaggcucaaaucaggcccuguccugacccccaggcgcagaucugggggaccaccuccaagacacccuguuucuugccaauccgggucaacuucccgacagucucucgcgggcaggagcaaagggacuuagcagucacucuuccacaguuuaauuguuuugucauuuucuagcgcagcagaggcgaugauguuuucuguugggugacaagcuguugagaucacgacaucugaaaacaaagacacagucagaaccagagccaucccugcgccugggucggggacgccaucccagacugagcuccaccuuucuccagaaacgcggguagcgccugcccgccaccugggaggucacaggacaagcacccacugcccaccuucgacacagggagcccaggggaggggagcgaggggacagcagccgguaccagggcgacacagccgguugggggacaggggcaggaggccacagggagugccagcccugccugcagaccaggagccccacacgcccccaccaacagcagcucggcgcccacaaggaggagcgcggcagcaggacuggcucagaggcuggcgcgcacaaggacugcagucagaccccucacaguccucaguccuuuaucgacaaugucccucuucuccucggacccugagccgcccacucccaccgccuccccccaaugcuaagccccagagcaccccacagggcuggcucugucacagcaaggacaaguccaccacccaagcagggaggucagaacuaacagacugguggugcaaggucggccacaucaaaguguuuacagcuucuacguaaaccaaagaaccccagaacgccggcgaggacccaggggaaggcccaggcccgccguggagcguaagcacugaccccaggcugggugaagcugcucacagggagggagaagcagugccuccccagauuuccacaagggcucgaacccccugcucucguuggcuccaugagacguggaaaugcagggccagagggugaggaaguagcggcggcugcagagggcagccgggacccacagagguggcaaccccagguagccugggaaccagcuccgccguggagcccacuaggccugcaugcagcuggggggucucucugggagagggaacagguacccgaaaggagccagagccuccaggauggggcagcgaugaccucacuguccccagcccaggaaacagagcucgccgugacgugggacgggcugcacccaccuaaagucccacagccacacacaccuuccggaccagcaugccuggcagaacagggagaaacaggguucaagccaggagcccgggucugagucggcagcacagugaccagcuccaugccuugggcaagagcucuuagcagcgguuccucagcggggccagcggagggcugaggugggaaggggaagacgacggcacccuacgggcacaccacgcuucaccugcaggaacuguccucacaucaacaggcagccagugacugcaggagcgcaggcccucaccuguguggccuuguaguuucuguacaaucucuuucgucugaagguuccagauguaaacaagguuauccucugagccagacacaauccacuacguaacaacaagcagggaaaacagggcaaggaaaagcaggucagagcucaugcaugugaaagggagagaaucuccaguuaugcccugccccacgcccacccugcugguggcugccucgcugaacucaaccaaaaagcccugccugcccuccagccaggccugaggcuuccucucccaauggggacagccccgccugcucuaucccagcaccggccucgcucacagaagccaggcaccugccugccccaggagaggcuuccaggauggaagaugcuucucaggucacccuuuucugagucugugugucacacacauguugcccgagucaccccggucuaagacaggagcaucgagaccagugugggugggcgggaaaacacacuccccucccugcuggggccgguggacgacagccccggagccagcgcacccacccagggacacccugagcacacagagcuccaccuguugggucccagcgcccucggaaggugucaaccaagcacugccagcaaagcccgacaacaggcugccugccuccguuaaggagauggaccuagaaacaaacgggacaagguguccccgguacuuggcgcagugcgcuuugguugaaauggaaauucauuuugugggcacagaaaagugucucugaguauaaagcaaccuguaacaggugugaccucucgggagaguaagcugggaacaggugagacgcuucaagguuaugagacucaccuucccaccaguaacagagaaauuggcaaauaugcaguauuucucauucuuguggccaguguacgucuucaggcacugaaacaggaggggacaggcuggucacagagucaugguuccccuugauuuuguguaauucuacguucuaagcaaggcguuucacuacucacuucacuuauuucugaaaaguacaaguaccaaacccacacaaucgaagauuuaacuugcagacugccacccuacaaauacccaggucuuucaggaauucgcaccaaacccagcggagauggcucucugagcuccucuccuuugucaucaccggggccagcucuguccccaccagaggccaugacccagggauggugcaccaugggggcccaagccugcgggggcucaccuuccccuugcuguagucccagagcuucagagugcugcaagacagagagaggggugaggcggcaugucuggaggcauccuucuguccccacacccaacucugcagccacuacgucacagccaccaucagcgccaggugcaaaagccagcggggcuggaacccccuuccccaucaggguaaggagccccucaggcucaaaguccagugacuuggcgucugagagcacagugugacagccgcaaguauuuguaguuccaagagagacuuuaacaggaagcugauggguguuaucgucccugacucgggucauccucaaaagggugaggaaguccucuugguucuggaaacauccagaacagguuuuaccacccaaccacacagcccucagaggaucagggcccaggcucggacccacagggcugagggugcacgcaugggaaagcuggagcuuagagaacagcccaggagggcaguggcuuugugagagguaaaaucaagaugcucagaggucagaaccagaaagggccuuggaggcccccggaccgccgacuccuucaugcgggauggcuaggccugcccuggccacaguugcucaaccagaaaacggacccuaaauccuccuauagucggaccugagguucagccucgggaagggauggacgggggccugcccuccgaccuaacaggccacugcccagaagccgaagcuccaccaggagccuggaucccgugccaagcccacaacacgcucuccaaaggcucacgcuggcacgcaggugucucuggcuggggaggccacaugcccgcccccacagucccacgcaguacucacuuguccagcguggcggccaggauguauuugccguucggggagaacuucacaaaagacacggggggguugucgucaucugcaauaaaaacggacaggugacacacggcgggcgcugacagccaggcagggacaggaggugggacccgcuccccaucccccacgugcgacaucugagugaggucggccaccaccaucagugccagcaccaccaccccucgccgccccgaaggguggccuagccacgcacaccagccgugagcagguucuugacaccucaagcccauaggcccgggggccccuugacaccaggacuuuacgaauacaggccuccuggggcaccaggccaugggcacucucaggaaucaccugccucacaggggauggauaaggcuggcgaaugcccaacucaacagagggacaacuccaccagcagcaaagagggcuggggaaucaccucggaaauucuccuuuaagaauuuaucgacgcaaggggcaucugcacccacagaacccaucuguuuguugucacauccacagcuaaugccccaggccuaucagcuggacucugcagcccugagggcagagcagagccgcugcuucucacacagcugaaaaagagucaagguucccagaagcugucgauguacaggucagaguuuucaggacauggcaaccccacgacccucagaaguggaggaaggcaucuccucucaccugagugaggaggagggaaucucaaggaagguguguccuggugcaggccccaccccugggccccaccagagacccccaccgacccccaagcacgugcacgcgcuggugugucccgagcaccgggaaggacacggcccucagcauuaccaccacggggacgccuggccucgccaggcaccuggcgucuccgcucccucagcccggucacauacacugaaaaggcacgggagacgcugugaggccaugcggucccucccucaggggcacaccacgucacaccgccaggcaggccgaggucacagugagggccggggggccgggcucccuuaacacagcugauggcaagcguguccgcaugccuaacccaggcugccugggcagagccucacagagaugaacgcaucagccaaccugucucagugaaguccagaagggucuaacucgcuagaccugaggagacgccgaugggaaaacugcuaugcagcgaccccuccguccccacccugggcucaggggcgcccaggcuggaaucccagucccugcaccugcuugcuguggagcuuugggcuagugaaugagccucuaugcaggaugaggacaaccccccuccucagagguggccgugaggguuacgugugcucacacaacagcggcgcacacaacugagcacagguggcccguccaggggacaccaagugcggugugaucucaaucaggagagaugcauggcaaaaggcuggccccacaaggcaggaagcuauaaagaccgcuguggcaaggggacucaugcugaagcccaagccuccagagccucagaggcgaguguacuggagacagggccuucaaagagggcgacagagugaaaaugaggcccaagggugguguccuuacaagaggacauuuggacacacggaggcaccagggacacuggugugaagccaggguaaggcagcgucuauaagccaagaagaggccuccucaauccugaccacagccuccuggacugcggggagacacauuccugccacagauagccucccagccuguggggcuuggucucagcuaggccagcaggcuaugacagacuagagggaagaagggcgcaaacggggugccuccccacacggggguccauccccccauccucaccacccagcucccuccucaaggugcgccccaucccacacaucuagccuaggcuucuuaaacacgaacacuccccggaugaaaacccuuccgcuccuuucugcaggcucugcaaggggcagcugggaaccccgggccgucacagacccucaggccacacccugcccagcaccuggccuucccauccaggccacgccacgucccuccuuccucuccucaggccuguccuccgugcccccaggacaccuccauccaccucggcagcacccccagcagaugggcaggcacucagccggucacucaaggaaugauccaagaggcuggcacgacagcaggggcccgaagccaggaggcaauggggcugcccagaggacuccagugagcagccggagugaggccgacagcacagguggaggagccccaggcuggcccaagagaaaggccauggcaggaaaacugcaccagaaggagcaacagagccagcgggcggucagggggagcuggcggaacggucggacacggaggaagguuccuccugcaggggcggacccagggcagaggagggaggaggagcuggugaagaacaggggcagugaacccagcaggggaggcccuccccacagacccagcccccacacagagccacacucaccgaugagcgucuucaggcacuggccugaggcggugucccagaugcgacuucgaagcaaagagaacaaaaaagcguaagcagacaaguuaugaucucacgcgggcugcugggagucagauauaaauuuuaggacuagcacgcuuuucccuaucuuuuuuuaaaaguuaugcuucaccuguuuaacagucauucucuuauauucuagggacaaagacuaaacacuguccauacaaacaucaacaguccacacaugcuacacacgugcagaccaugugugggguaccucuggaucucuccuacacaagccacaguugacccccaacacagagcgggaagccuguugcucucuccacucucccuggccaaggagaggggcagcagcagcccagugcuucucgcaggcucugcccacgcucaugcaaacacaugcaagcaaugagagggcuucuuucaaaacaaaaauuuaagaguauuguaagcagucuucuggacuauucccagaagguacaagccaggcauuuacauuguuccaauuucaggguuucugugauuucugccaauacagacgcauucuggaagcagagcccacuguguuagcacccacaauucuacugcacagaugccagcagcggggaacaggcucgggucacacguggacaaaucauuccccaagcacgagaccccauggccgccaugcacggucccucccaucucucacccauggagaagccgccucugggagggccccgaagcucucugcucugcacacccaccuccuguucugcccacacuucaauaauccagggacgagaccacacuggaccucagacacuucacccaggguuuucaaacccagaagcagcaacucuccucccaacucugcaucuucucaauucucucagcaacagcuccauccugcugccccauggaucucaaauucauguccucuagcuccgcaaucacugcgggagggccucuccggagccgccucaucuccuaacccucaagaccuaacccccguguguccuuucaguuccauuucucauuuccugcauugguccugcuccuucucacuagccgcauuccuaaacaucuuagcauuuuugucacuguuaaaauggaaacauuuuccccaucuucuaacuggcaauuccuaguauacagaaaaaaguccauuuucaagcacugauggcacuaaacgcgagaucacaccacguagcuagcagggcaggggguuccaggcccagacuccagagcugacacggguucugguccugcacugagcaacugagagaccgugguaacugucccugccugaaaagcaaggcugacaguacccacgucacaggguuaaauggguauuugaaaagcaguguugguggcuuuuaaauauuuuaaaacaugcaaacauaucuacaaagauguguaucucuauucaauuuucauaggacuauuuuuucauuuucuuacacuaacuagaaacucccaacaaugcugaguaacaugggaaccaagcacaccugucccacuucugauuuucauagaaagaguuucagcaugucgccacaugugaaaauuauuaguuaccaguaaguggucaacaauacugcucuaucuugcugaaggguuggcugcuggauauuaucaaucaggcgccuuuuugaccccuacuaauuaauaacagacagagacauuuaacgccuuuaaucuguugguagaauuagauaauagguuuccugauguuuacguuauaauccuuucauuauccaauaaugaaugaauuccuuggcuaugggaauuccuuucugugcacgguaggcucaggaggcugcuacuuccucuggaauccuggcaucaacauucaccagugaguugcccucuguggucuuccucugggaccagcaaucaaggcuuagguagcaagcucaugcuaaaaccaaagacaugaaccagggagcucccucccgccuguggucucgaaucguugggauaagcuucaaaguucacuauugaacuggauucagauacaaagucacaggggacauguucuuuucaggccuucaauccccuuuuccagccucuucagcggugacugcuccuuaaggcaccauacccagggccccuuuaggagcuguggccgagcucgcugcuggagccgaggcacugcucaggcuggacggaggcuucugacucccgcuuccucccgcugcggugcuuccaaccaccuccuaguucucaucuugcuuauuuugcuuuuuccauuaugggacuuaaaaggcuuucauuacuagccucaucaaagaagacaucuuauaucaucuauguucucauuuguuucccauuucccuccuaauuuccuugguauacuuuuucugauuucuuuagaaaguucuuagagccagguccaugaguaauucugagacugucccgugcucacuucccuguuggugacacacacacagaggggccgggaggguggcaccagagaggcccuggcagcuccacgcucgcccauagcucacccugugcaccccuccccucuggcuguuccugaaguguauccuuuauaauaagcugguaaauggucaaguguaaacgauggcuuuaaccguggagacuacuggccaauguggggcuccggaugaccucauuuuugccacagcacaucccagugaccucagccccaaacgccaucacagugcugcaaccgcagcuugaaccuugcgaggcgauggcccggaagugugugcugugaagcccaugggaggccggugguugggugcaacucgacuacgacccucucccaccagacccgucuucucaagaccgaaggggggucaugcauggcgacuacagacugugacccccuggggauccccacgccaacagucacuggggagucagacugggaaacagauuucgagugugcguguccaccugaggguucccugcaggaaguccuaguaagaucuucaauucugccaguggcugccaccguccuccuccuccccagugaccaaucugaacagcuuaugauguguccgccccacauccaaaacacaacccaaacacuccacucccccaacucgcucccaucagacauuucgcugaguuaaccucuacuucuccacuucccuugugucuccugaggagugcuggacacagauuaccaaguccaagcacuacaaacaccugcugagaccuaggugggcuuucugcaggagacccugucacucuuccuccugcccuucucuaugcugccaucugcuuggguucaccugcccgggauggugacgcauccucacagggcaagacggcaucacucagcauccucccagagcagcacagcuuucaccucaagggguccaaacacccauuuuccacgagcgugugaacagcacacgucagcgucuacacggagcugaagucugauggaggaggcccucccugacccacccuaacaacaaggacaucuucccaggcaugccgccccaccaccugugcugccaaccccgaaacugcacugccuaucugcuaacaugucugcagcguggccagaagagaagcuucggaaauuaaggacuugggucuuuugucacugcuguacccccagaugcaggaacagugcaagagcuggcccuuaguuaagcacucaucgcuucaugaaguaaaauguuuucacuuaccagagaccaucauagcuacuugaaacuaucaaggauccaucacgauuaaaaugaaccuaggaauuaaggagaggaagaagagacaaaaacuuacuuucaagucagggacacaacugcuucuuaccugaucucaaaaaaaaaaaaaaaaaaaaaaaaagacugaguuauguuuuuuuguuuguuuguuuucagaaagagucucgcucugucacccaggcuggggugcgaucucagcucacugcaaccuccaccucccagguucaagcaauucucgugccucagccucccaaguaacugggauuacaggcaugcaccaccacgcccagcuaauuuuuauauauauauauuuuuaggagagacgggguuucaccauauuggccagccuggucuugaacuccugaccgcaagugauccacccgccuuggcuucccaaacugcgggauuacaggugugaggcaccgcgcccacccuuuuuuuuuucuucauaagagaaacagggucucccuaucuugcccaggcuggucucgaacuccugagcucacacgauccucccaccuuggucuuccgaagugcugggaguacaggcaugagccacugcacccagccaaggauaagccuucucacaaucaaacagcaccuuuggaaacuaucuugucucaggcuaugggugcugaaacauuuccugggugaaaucaagccacacaaggaagccgugguuuaaugauucggggaugggacugagguugucugcuucuacugucuaguagaagcaguuucccagccuuggcaccacugacauuuuagaccagacucuuccgggggggacagggugguacugccccugugcaguggcaaccuuguccuuugcucacuagaugccuauagcucugacaaccaaaaaugucuccagacauugccauguguccccagaggcaaauccacaugcaucaaaggcaccggugagcuacuauggcagagacugcuaggccccauccccagggcuucugauuugaccaguccaggagggggaguccaagaacauaaauuucgaacagguccccggggcaugcugccugcugcugcacgcccagagaagcacuaggcuagacucugcaagagccugccagccacacguguaauuuuaauuguucuagaagcuacauuagaaaagcuuaaaagacaagugaaauuacuuugguaacauguaacccaauguaucuaaaauauuauuucaacauaaucaacacaaaaaguuauuacaagacacuuuacuuucuuuuuuugugccaggucucugaaaucugcagguaccucacacagcccugagcucugggccaucaugcggcuggcagccucuaugcugggcaugcuggguacugcagcccuagauguucuccagcagacacagaggggugaguaccuguuucugcuccaacagggugcucucaccgugccagcugcuucacugcaaccaucuggccggcagccucucaaaguacuuuucuaacucacagugauccaucuaaccacauucaucccuaccuuuaaaugugcaaaacagucucuuauugagacuauuacgauggauguaacaguaacaagacaaaacaaguccccaaaacucacaaggccaacuccaugcuuugcuuuguucagcuucuuaaccacauccaaauacuacccacuggcaaacauggccuggcucuaccauuccacccacauucaggugcaaggggcaauacagcccauccacugcacuccagcagaaggcugccagaaaaguuaacuucgaggagguagauaagggaggccgggcgcgguggcuuacgccuguaaucccagcauuuuaggaaaucaaggugggcggaucacuugaggccaggaauucgagaccagccuggccaacauggugaaaccuugucucuacaaaaaaauacaaaacuuaaccaggcgugguggcaugaaccuguagucccagcuacuuggggggcugaggcaggagaaucacuuuaacccaggaggcggagguugcagugagccaagaucgcgucacuguauuccagcuugggcaacagagugagacccugucucaaaaaaaaaaaaagacccagcacuucaggaggccgaggugggcggauuaugaggucaggagaucgagaccaucccggcuaacacggugaaaccccaucucuacuaaaaauauaaaaaaaaauuagccgggcaugguggagggcgccuguagucccagcuacucaggaggcugaggcaggagaauggcgugaacccgggagguggagcuugcagugagcugagaucacaccacugcacuccagccugggcaacaaagugagacucugucucaaaauaaauaaauaaauaaauauuaaaaaacaaaaaaaaaaaaaagaaagaaagaaacagagaagguaaucagccagaacccagcaggggauggcaaggccccuagccaaggagcacuccaagugcucugcggagucgacuugggcagacaagcaguagcagaagcuccagggcaggaaaaacacaggucccgggugcaaggagggcgcgagggcuguggaugaugggggucggcagcggcccucagccgaggagcccuagccagagagggcaaacccuggccagagaggggacagggaugggaggcagugagcagggggccacaugccucuaagucucuaaagcuccaaaauguaccugucaaaaagcuaaacacauauccugacuacugcauuuccccuccaaagccaucccgcacaaacggccacagaugcaaacaggaugcucacugcacuccuuuuugucaaagugagaauuacacauaagcacucacugagaggcgacuggcagaguccuugcucacacagcaggcccacaccagcaauccaagggcauagaugugcgcagacaucaaaggugccccaggccaggcgcagcggcucacgccuguaaucccagcacuuugggaggaccaggcgggcggaucacuugagguuaggagauugagaccagccuggccaacauggugaaacccugucucuacuaaaaauacaaaaauuagccagucgugguagugggcaccuguaaucccagguacuugggaggcugaggcaggagaaccccuugaacccaggaggcagagcuugcagugggccaagaucgcaccaccgcacuccagccugggcaacagagugagauucuguuucaaaaaaaaaaaaaaaaaaaacaaagccccacaaaccucucugcaguggagacagcuacagagcagcagcuguggaguggagacagcuacggagcagcagcugugaugugguaccaguuauuuaaaggacaggagugagcuacccuggaaaauaugcaccuaaaaaagcaaaguagaagaccacagagggaccgacuccaccuccuggcagcugaccccagggguggcucagggaauucauuuucuacuuccuacauuugcucaccuuugugguuuuuuuaagacauggggucucacucugucacccaggcuggagugcagugguaccaucuugcucacugcagccucaaacuccugggcccaagcaauccucccaccguccuccaaguagcugggaccacacgugcgcaucacuacgcccggcuaauuuuugcuuuuuguauagagacaggaucucacuauguuguccaggauggucucaaacuccuagucucaugggauccuccugccucagccacccaaagugcuggaauuacaggugggagacauggcacccaaccuguuuuuguguuuuuuuaugagcaaacgugacuuucguaagaaaaaaagacuuuuaaaauccuaccuaucaaccgcgagucccaccugcgcuaucuuuggccucuaggaugcucacagaauucuuucuuccaacucaaaggccaccagcgaaccccuuucucagguuacuucacaagcguucauuugucagccccagucugaaggucagcucugcugacuaugacccaagguguccuggagggcagcggacuggcaccaaggggcugggcccgcaagcacacagccacaagcacagggccacauggugccauccccacagcaaacggccuccccgcagcagugacacugggcccgcgagggucuuguggcccagcuaugugcggggcucagaccccgcagccccgcccaggccugacacacuguccguccgggcaguaucagggcuucgccugccaucucacucgggcaaagccuuccaaggguaaaaaugcuuaaacccauucaccgccaagauggcacaaagugaaaggcacacgggcaggcagcaugggacaaaugcugcauccacccuuccuuccgcuucucaacgaagggcaggauuggccaagaaacuaccucaugcacuuuguuaacaaaagaacuuucuggccacuuugugaaauggagcgguuuaugauacuguguaguuuaacucuuggccauuuguucuugauuuuuuuuuuuuuuuuaaagacagaguuuuggccgggcgcagugacucacacuuguaaucccagcauuuugggaggccaaggcgggaggaucacgagcucaggagaucgaaaccacggugaaaccccgucucuacuaaaaauacaaaaaauuagccaggcaugguggugggcgccuguagucucaacuacucggagaggcugaggcaggagaauggcaugaacccgggaggcggagcuugcagugagccgagaucgcaacacugcacuccagccugggcaacagagcgagacucagucucaaaaaaaaaaaaagacagaguuucgcucucgucacccaggcaguggugcgaucucggcucacugcaaccuccgcuucccagguucaagugauucucuggccucagccuccccaggagcugggauuccaggcacgcgccaccacguccagcugauuuuuguauuuuuaguagagacgggguuucaccauguuggccaggcuggucucaaacuucugaccucaagugauccacccgccucggccucccaaagugcugggauugcaggcgugagccgccacgcccggccucucggccguuugguuugcacaguggcaacagcaaaauggcaggacgugucccugugcaaggcccgcucuccggagagcuccagccuccaacacuucccaccaggacugggccauccccacccagcccgcccaucaaagcuaacuccacucaaaacucacacuucaccugugcucccaccacucccagugcccuucccagccuggccgcccuuccugucccgugcaucaguucaggguacacuaccuccugaacgccuguggccacugcccccaagucugcacaaacggccccuuggugcucaucacagggcaccccacugacaccucaccacccccucgccaucccuccacugcacacaggacucauuucucaagucccagccuccaaccugauugcucuagacuguggcaugacagcaggaaucagcuaggcacaggccauggccaggcuuacgccccucagggagacagcuggccacauccgaugucagagaaacguagugcuggacaccaccccauccgugucagagggacuuacggccgagacuggauccgagugagcuggcaaagucuugaggcacuucccuguuuucacaucccauauccucacgcuuucgucaaacugaacacaaaagagaugacagugauuuuacaggaaggagaggggacaaaccuccccagaaccuaagaccugcuaucagcccauccuccccacaaacagcacagaaaggacucagggcccaccugccuucuccacaguggcuacaagcaaauucaacagccuucccacauccgacaccaccucccccagggaagacaccccagccacacuuacggauccugagacaauaagguuggacuggggauugaaguugcagcaaaagacauaauuacugugucccuucaggguuuucagacacuugcccuauaacagaguauuauuaggauuauuccagugcuuauuuccccaaacguaagagucaggucacauucaucaaugucugacaucccaaagcaugccugaugccccgccagugacuugcuguuccccgaagucaacucggccucccccacccacccccgccccaugccccugcagccagucuucccuggagaggagcgcugaguguugcuuacugagcagucaacucagucccccgcaccugccccgugcccugcagccggucuccccuggagagaagcacugagugucacuuaccgagcucacgucccauaucuucaagguuuugucaucugaggcagaaacaagaagguuagaaucugacgaccaggcuacaucggauauucccuuggggagaaaaaacagggucaguaacuugacaggacaaaauaggaccaucggcaaaaggucaaaaucccaaacauccccauugcccucaggaaaucuucucacuaguguuaaccuuacaaaagacacacggcccaggagaaaaacagcaggcuuucugcagcucugccagccucacagacacuccuccauggaagucaaauguuauuuggguuaaaaguucaagaugcaaauaacuauaaaaaaauuaaaaaacggggaaaacuuaaaaccugaacccacagcucucgaagcagcccugaccccuugaucacuagagccacccuguucaacagucaacuucaccgcacagggcugaaaccuaccagcuugugaccagauaugguuuucucaaauuucccaucauacgcgccccaaauuuuaauaaguuuaucagcagcugaaagaaaacaaaaggaucugaggcuaagagcaggacacaauugucuagucauccagaguccaaagucugagcuuuucccacaugagucccaggugaucagcaugaaccacauggcucagaacccauucagcacggccacaugccugagaggaccaguccccuuccccucccucccaggguccacgggcaauuucuuuucuuucuucuucuuuuguuuuucugagacggugucuggcucugucgcccaggcuggagugcaguggcaugaucucagcucacugcaacuucugccucccagguucaagcgauucuccugccucaaccuccugaguagcugggacuacaggcaugugccaccaugcccggcuaaucuuuuuuuguauuuuuaauagagacaggguuucaccauauuggccaggcugcucucgaacuccugaccucgugauccgccugccucugccucccaaagugcugagauuacaggcaugagccaccacgccuggccccccacgggcaauuucaaccagcacugagcucacaguuccaggaggagacacacccgccugcuacgugccccccagcggccugcuacgucuccccagcgguaggugaggaagcaagccauccccucgccagcuuuuugucugcagcucagaccgccucucccagcagcuaagggccucagugcuacguacaugaacuugccagccacucuccauucgggcugaauuucacggaggacacugcuuugguguggccagcaagggugaacuuuagagcauaguuuggcuucacagguguaggcugcaggaaagaccaguuagcaaaaagucaccaccacuguacguuccacccgugaccaguuuggauuuugacucccaccauuuaauuucagcucagaucuuuagagcuccaaauccacaugcccagugccuuccaccaaucucuauguggacaguaccuuucaaguggaacacaucugaaucugagcccacuacuuccccacaagaccuccucuucuguagucuccaaacucagcaccaacagcaccagccgagccagaaacgugaggccccccucaauccaccucauccccccaccucaaucccaccugugauccugcuacagcacaggaggcccccaccagcucuggccuugguccagcgccccacccuccgaccccgaacacugaagcccugcucccuuugcuaaaggucuacgggagggcuugcagaacugccugugcgucaggaucgcagccagggugggggcaacuauaaagagauguuuucugguuccuacagagacucuuacaaucagaaccaagaaucuguauuuuugauaaaaggcucucuccuccaggugacagauuugggaucccugacacagcaggcaacaagcauucgccagauaugcggucaguaaauaaaaauuagcagugacauuuaacugaguagggaagacuaggcuuaugagcuugagauguuuccgagacucucuaagcguauuugcccccggaagguguccaaggggccccugggcacgcaccuugcucugaguggcggaugacgaagggguuggcugugcucuggcggccucggucucgggcuucuucuccuccgucgccauggcucugacgcuggccgcacaggagacaaggguggagggacccggugacagaggcagucuguugagcgagaugcagaacagggagccaagaaacaaacuauauuuuaaaaaauugauuuccaagaaaaaggaugaaaagaaaaacauuugacuaccauauugagcccuguagcaaacaaaccauuccaaauugaggacccuauuaauuccccuaaguccuugcuaauacuuuccagcugcuccgcugacaccccugcgcucuccccuuuugucaucauaaugaaagaccccacccucaagcgugcuucuuauuuuguuauccagaagucuguaagaaugcagcaguuugugcaaacaaaaugcaguuuucuucaaagagcccuggacacauuaaaaaaagaacagcaaaagguuuccugacagaaagcuaacacgccaaaugacagaagacugagcuucaggguguagaaauuugggaucacauccaaauccuaaaaugcaccccaagugacgcaaucacguucacagccacguuugaaaacacaagcacgggcacccaguggucuacgccucaugggggggcuccagugccuccaugcacaggcugcuggcccgaggcugccuuccagcaugcuaacagcucacagggcucgcgcacucagugaggagccacaaaacacagagaugagagcaagccagaggcagcucugccugcuggaauuuccacauccugccuucuggaaaagcagccucaaguacaccaacgauauucuacgagcaggacucacacugcaggggaacgaaaaaagacugcaguucaaucgguuucaccuugacaaugaaaauuaucccaaaucuguacaguaagcagcuaguuuccucuaccaugggaauagauucauuacuucaauacaucucauaaaagcacaacagguuacuuggaaaggagggacagcauuuuuaaaagggaaagccacugagacaugcuugcaaauaccacuggccaucggaaucccagaagcuagcacuaccaucaaucuaaugaguuuacacacuguaaauucuagcuuggagcuuggaacugaaaucuugcacaggcugauuguaacacuaacgcgaaauggaaggcauuaaaaagcaugucucaaagucuucauccaagaggaaggcagagaaauuacaacacccacuuugcagagaacagguguggccaccgcuccauuucaccugcagcaaagauucccugcgcaaagauggaucacgcugcaucuagggccgaguacaguacaagagagggggagaggaggggcaggcccuguagcgcugcccaggggacaaagugccaguacaaaaccgguccucgguaaaugccagcuacgugguacuugucauuagugcaaccuagccaugccaauuuaacccaacugcugcauuuuccuuggcaggcuggacaaauacagggagagagaggaacuaaggaaauccaagcaaaaagcugcaaaguccacuauaacaguccuagcguuagacagccaggccagggccagagcugagugaacugugcccaugcccuacccaagcgaaacaccagaggaacagaaggcgaaauaggcagcucagaaggccgagcagcuccugucagcaucaacucaccugggugagucuagacgccuggaaacacccucagaggaggaacaacagauaggcggucuuacaaaaaagguguccagccccucccagcucaagcccaaccugccccaaccuuugggcucaaaaaacaugaacauguaaaagaaacaaacaaaacaaccuuaacuugacuuuuaagaauaugauggcugggcacaguggcugacgccuguaaucucagcacuuugggaggcugaggugggcagaucacgaggucaggaaguucaagaccagccugaccagcauggagaaacccccucccuacuaaaaauacagaaauuagccgggugugguggucggucccuguaaucccagcuacucgggaggcugaggcaggagaaucacuugaaaccagaaggcagaaccaagauugcgccacugcacuccagccugggccaaacagugaaacuccgucgggggguggcggggaaugcaauuucuugacccaacacacccaccaaguuucuacgucgguggggucuaggcuuggcguguuuuuuuuuuguuuuuguuuuuuuuuugagacacaguccaaagaguccaggugcacgaucugggcucacuacaaccuccaccuuccggguucaaguaauucuugcgccucagccuccaguuuagccgggauuacaggcgcguaccacuacgcccggccaaucuuuuguauuuuuaguagagacggaguuucgccauguugcccaggcuagucucgaacuccugaccucaggcaauccgcccgccucagccucccaaagugcuaggauuacaggcgugagccaccgcgccgggccaaggcuuggcauuuucaugaacacucaggugucucuguggaacaauccuuuugagagaacaggaagguuggagacuugaucuugaggaaagcgggggccaagguuacgggaacggugaugaauuggcggccccuagaccagaugcugccuggcuccuccuagcagccacugcuuuucauccagguaagccugaccaccugaagccgagcaaccaaaccucagugugcccuccuggacugcaugccacaggccgauuccugagucccucagucccugagguggagcccaggaaucugccugugacaugcagucagaaaagcauacugugugcaaagacaggaauuaaucugcaucuuaaacaccagccggguggccggcccaacagagguggggaccuggcucucccuaucugagauccuggacaggcuccccgccuggguccuucgcuuuccugucuuccccaccggcuaggacagcaccugcccaggucacagauuaaacuagcauuugaggagauggguaaacggaccggggugaguggaaacuugcaagcgagacagcagggagugucguuagcgauguaacaggccgaccucuguuugguccgggaacguaaccgcucaaaauggcucucgcagaccggccaggacaggucugcggccccgcgcgaggaggcacggugggccuaccguucaggaccgaggacccgcaccccaggaccccaccuagcgagcugcagccuggcugccucggguuggggugagcggcgggagcgggcugggggcguuucuacgaggaggggaagcgcaccucguccagggacugaguggcuuggugggucugggguccuucccugaaggggcaguggagggagaggggcgaugugaggccgggcacgcugccugcgggaaagaggacccagugccggcgcucuggccuugucagcgguccgccggggaggcggaggugggggcgcgagugggggcggaccggguggagggaacugcgcgcgcggccguccaccgaggggccggggcgggggucccgggcggggccgcugcagcgggagcagcgcccggggcugggccuggcccgaggcccggcggggaacacgugcggcggccgggugcgguuuggaagcuucuggcgccgccccgcugcccgccuuguguuccccgggccgggcggcugcccgcuuaccugccgggccgcggcggcggggccgggcgcucggggcgucgcgucggccgccgccugggcgggagcgcggacucagcucgacaaggcggcagcucgggcgggcgccaggcggc

SEQ ID NO: 191188 - RNA, 10962 nt, Homo sapiens
uugagcacacgcccccuuuauuauaaacugccccaaacccucuuaagaaggagguggcuaguccccugagagugcggcucacuuuggggugcaggaaaccgagggagccuagaccuguuccauuucaaaggcucacucugggggccugagugaggaauuggcuacaugugguugggagacaucaaaggacccaggaccccugugaccagagaaaaggggucuagggcgccuucacaccaggguauuagaaaugcuacguuaagggcaauaugcaauaaacgggggacuggcgcggcaggguucaggcacucugagucgggcugaggcuucagagccugccccgcaaaggcacggcugcagaacguggcaagccugccgggcccugccuuuguaacugcgccuccccucccccugucucacuguucccaugccgcguuacugugagauccugugugcuacugugugcacagcccucugcaguucacaguggccuuuccacgucccuuuuccgguugaauucgccugacugacagggaggcgggacagggcuggucugcacgcuagugaagcacugguggcugcaggucuuuggguccccauccauggcaacccccagcuccguggucagcuccucaggcagcugauauccuuguccaguguagaaaagcggaucagcuucaggcuggguggcuggggcuuccugucgucccagagguacucgggggacagcaccuuggacggcuuguuugagaugaagugacgguucagguggcuuuccucccgccaggcagccaugaugccauuggccuuguccgccaggauggccauguggcagccccuaguaaacucauauacccuggccaccugccccccgaagacugccccaccauaauagaaguccccuucgcugucugccacaaaggcaguggaaacacgccugcgcucauaggggaacugcuggcggggaacggcguaguagcuugggugaauggcagccaccaggucucccaaggucucagggccccacggguuccgaaacaccauguccacaucaaggcagaagagguaguccaccucccggugagcccucuuagcaaugugcuggcugauggucuccauccggcgcauggaugucuccucccagugggagugacccuggauggggauggagcugagaagccgguggggacccagcgggaccccgggaacggcugcaggguugucagugaagauguaguagugcacccgguacccacgcaugaagaacuccucggcugacuccaggaaggacuggaugaaaugaguguaccuagugaugaucacccggucacccacugcuacaccagcagccugccaggguccccacugugugcuggggucagccaggcugggguccacuuaccagcuccccaucucaagaugucacucugcucuggcccucuggguccucauuuguccaauucccaaaaugcuaguaccagccucuuacggcuguuguaagcauguuccugguagagauucuuaugcuccuaggccaggugaacuuuuacugagcaauuucuaagugcccagcgacguucuaagaauucuuaugaucuuugaucugcauaagcaugcccauuuuacaggcaggaacauugaggaucacagagaagaaaguagugaagaagcagguaaguggacgaaucaagggaaggcaaguugagcuagaugcugggggcauggaggggggugugguugacacagcccugcccccaggccaaaacucauuggacaagggggucaccugacccuagguggaccauucaucaucuggucaugcuuuagggccccaggaaguuccaggaaggagucccagaggcccagaggaaggcugccaagcggcagcuccuaaaggaaggccagguggggucaugggagagacaagggcagaggaggggucuagaugaaacagggaggggcaagggggccuccugacaaaggcuccugcuguccccucaccuggacucugcauccugucuaugcuagagccagauccccuacuccaggaagcucccaucccacuaucacacccuacacuguacuuucuaucugcuuggcaccugguuccgagccucccgggugcccagcaggguccugugugcacgucuggucuggucucuucccaacuauaaacuccuguggcucagggagaccucccuccccuuccccagcccacuacucacuuccccacggcaaacaccgugaccccaauggucagguucaguggcugguagaugugcugcagaagcucuggguugaagguucccucggagacgaugggcgccaaccagggugugagugucagcagcugugugggccuggcagcaggggggccgugggcacugagacccuccccugugaaagccuaagucucaucccagcccuggcucucacacugugugacccggggcagcuucguccccaucucugggccucccuuuccucauauggaaaguggggauaaugauagccaccucccagcaggguugggaguaccaggaguuaacgcacaccaaggagaagccuggcauuauucauaugugccaagccccuaauaaaugagggucauuaaaaagggcaagaccacguuguuaugaacaauggccugagcaccuccugagugcaagcacggugcagauguuacaauaccucucaucugcuccuccaaacuccagugagcuaggcacuacuauccaccugcacagaaaaagcucagagcaguuggguacgcugcccagggucacacagcccaggucccugacucccagcccugugucuuuccacagucccuaacucucugggccccaaggccacccugauguuagcaccuccacuaccccaccuuauaaaucagagcucuuuuguccuuuucccccgcccccaucaggccucuccaugacaccuaccugugcuccagcagcuugggcugaggguacugugaccugcaaccaagaaggaccagugauggaggagagccaccacccucacggccacaaaagaggaaaugccagucuccuuaccauaccacgggcuggaguggcuucucccucuuguagugcagcuucauguugcugguggcagaggcaagaaagagccaucaucaugggucuggggacagagacacucagcacaggaagaaggaggagucagaggccccugcgggugggcacccaggguccaugcaggcucccucugaccuucccccacagccccacccgacucuacagaggagcuggggaccccuacagaagugaucuguccagggucacugagagaguaaguggcagggcagugauucgaacccagugccgcuugcucccaaggcugaugcuuuuccaaccaugucgcucucguugucggaaagaagaugugaaaaccugcaaagggccaggcgcgguggcucacgccuguaaucccagcacuuugggaggcggaggcggguggaucacaaggccaggaguucaagaccagccuggccaagauggugaaaccucgucucuacuaaaaauacaaaaauuagcugggcaugguggcgggcgccuguaaucccagcuacucgggaggcugaggcaggagaauugcuugaacccaggaggcagagguugcagugagccgagaucgcaccauugcacuacagccugugugacagagcaagauuccaucucaaaaaaaaaaaggaagaaaagcugcaaaggccuggugacugggaccucgggugagcuaagagcuaauuaaccugagcccacuguaauggucaguuguaggcaauccuccugccuuagccuccugaguagcuggaccugccaggcacucauuaccacccccggcugauuuuuuaaaauuuuguagagauggggucuuacuaugucgcccaggcuggucugugaaaguauuuuguagaugugauuaacauucuauaucaguugauuuuacauaaaagagaguauccuagacaaccugggugggaccgauccaauugguugaaaggccuuaagaacagaacugguggccagcccagguggcucacaccuguagucccagcacuuugggggcccaacgcgggcaaagcgcuugagcccaguaguucaagaccagccugggcaacauggcaagaccucaucucuacaaaaacaacaaaaauuagcuggguaugguggugugcaccugugguccuggcuacuugggaggcugaagcaggaggauggcuugagcccaggagguggaggcuguagugagcuguaaucacacuacugcacuccagccugggccacccacaaagugagacccugucucaaaaaaaaaaaaaaaaaaaagaacuucaccugugggcuguggugucugcuccuaucugaguuucagcugcuuagccagccucaccaucacauaagucaauuuuccuagguauguuggccaucugucuaccuuccuaccucuuacugguucuguuucucuaguggaacacugacugccauuucucugcaucugcaaaaugggcaaaaccauccuuagccuuagcgauguggugagaguuacacaaggugugugaggggcucuugaccauguccagcauggagcaagugcucaguaaggugagggauccugggcaagucuuggcaggcagccuccauggucaguuucaaggucaaacugguuggagaagaaagaaggggguccaugaaggaggugccagggcuguagggucagaccccugggcucaccucuggcucugccacuaacuggcccagggaccuggagccagacaguugacccugugaacuuuaguuuccucauccacaaaauggggacaauaaaaccauccacuuagaguguuuccagcagguggaagcgaggugcagagaagggaaagaccggccgggcgugguggcucaugccuguaaucccagcacuuugggaggccaaagcgggcagaucacaaggucgagagaucgagaccauccugggcaacauggugaaaccccauuucuacuaaaaauacaaaaauuagcugggcgugguggugggcaccuguagucccagcuacuugggaggcugagggaggagaaucgcuugaacccgggaggcugagggugcagugagccgagaucccgccacugcacuccagccuggcgacagagcaagacugcaucucaaaaaaaagggaaaggccacccagccagcagcagcaacaaaaggcccgaggccgacuguccccaggcagaagcucauaaggaucccacccacugaugacacaguagucugccagguccuuguaaguuucuuuucuuucuuucuuuucuuuuuugagguggggucuaucuguguugcccaggcuggagugcaguggcacaaucucggcuaacugcagucuugacugccugagcucaagcgguccucccacaccagcacccugaggagcugagaccacaggugcccaccaccacacccagcuguuuuuguauuaauauuuuuuguacagacuggguuucaccauguugcccaggcuggucuugaacuccugagcucaagugaucugccugucuuggcuucccaaagugcugggauuacaggcaugagcugccuugccugguccccugugaguuucaauacaucauguaugaugggguggcugaagccuccuugaacucuuccaccucuaggcuaugcucuuuuauuugugguaaaguauacaaaacacaagauuuacuacuuuagccaucuuuaaguguacaauucaguggcauuagguacauucacauugucaugcaaccauccaacauuuguguccagaacuuuuucaucaucccaaaaggaagcucgguccucauuaaacaacagcuugccguugccccgcccccagccccugggaaccauaauucuacuucugccucuaugaacuugaguauggaaaguacuuccuauaaguggaauaauaaaguuuuuguccuuuugugauuaguagcuacuuuuuuuuuucuuuuuuuagauggagucucaguaaccuugucaucccagcuggagugcaguggugugaucuuggcucacuguaaccuuagccuccugggaucaagugauucuccugccucagccucccaaguagcugggacuacaggugugugccaccacaccccgccaauuuuuguauuuuuauuagagaugggguuucaucauguuggccaggcuggucuugaacuccugagcucaagugauccaccagccucggccucccaaagugcugggauuacaggcauaagccgcuacacccagccaaguugcuacucuugaaucaacaauuuuuuaaagucaguucgucaaauuggcccucugcccuaguuuccuacaagaaagcauguuucagggcccugcucagaaagcccugggauuccaagaagcggucaggaguuagaagggguaccaaacagcccagcauucugugccucccuggcagcgagcuccucuuuucucuccacaagcccagacacacuccagcugcagugaagaguuacauacaagaauacaaaagcaggccggugugguggcucaugcccgcaaucccggcaggggcgaguugggacgaccccuugaggccaggaguuccagaccagccugggcaacauagugagacccugucucuacaaacaaauaaaaaaaaauuagcuaggaggugugguggugaguaucugugguccuagcuacucaggaggcuaaagugugaggaucacuugagcccaggaggucaaggcuguagugagcugugaucgugccacugcacuccagccugggcaacagagccagaccuuaucucccuccgccacgcacacacacaagauagacaaacuggaaagaaaaaaaaaaguuguagguauacuuagccaagagugaugauagagaacccacaaacggaccaaacagagaagguggggaagaagcacuucacacaagaaaaauuucaauuaacgggaagacguagggaaaugagagucucacuaguaauaauaaaaaaaaaaaaaaauuaaggccagggguggugguucacgccuuuaaucccagcacuuugggaggccgaugagggggcgaagccuggccgaagggggcaaagaccaaccuggccaacaugaugaaaugcuguuucuacuaaaaauacaaaaauuagcgugugugccuguaaucccagcuauucagguggcugaggcaugacaauugcuugaacccgggagguggagguugcaaugagcugagaucacgccacgguacuccagccuggguggcaaagcgagacucugucucaauauaauaauaauaauaauaauaauaauaauaaauaaaauuuauaccaaagaggauagcauuuucccucucccaaucagcaagguagguucauuuuuguuuucauaaccucugguauucccagcaguagcccagguguacuacacgguggcuuugcuggguacugcuugggcagggcacaugaaugagugacugaugugcugugguccuucuggaaauaacccaaugaguuggaucagaaccuauccacauccuccggccacuaagggaacauaucugaacaaaaugaucuuugaaauggagaaaggguuaugcugcucaucacaaacuaacugagagcccugggaaauugggagcaaccuaaaucccgagagcaauugguggugggaaagagagagaggcucaaaaauuaugugucagucccuggguggaauaagaugauggugaccggaccgaugcaguagcucaugccuguaaucucagcacuuugggaggcugaggcagguggaacacuugaggucaggaguuugagaccagccuggccaacauggugaaacgccaucucaaauaaaaauacaaaaauuagccagguaugguggcgggugccuguaaucccagcuacuugggaggcugagacaggacaaucucuugaacuggggagguggagguugcugugagccaagaucacgccacugcacuccagccagggcgacagagugagacucugacucaagaaaaaaaaaaaaaagacuccuuaguugaggaggacuuuggucacauguucauuuguuccuugaauccauggaacacaaaauugagcaacaaggucaaguccuaaaagcacugaacacaaccccugcuggucaccgggagcaacagcaggcuguuuaugggcaucuuugcacucuguguucucaguggccagacacagcaagcaaggcucacagcugugcaacauguggacggucagaccaugcagggggcugcaaggaugcuggaagaccgaaaugggaauuucacuucacgcuugucacagcccuuaaauuacauaaauacuauugcauuuaucagaaacaugaacuuaggaaucaggaaccggcagaugaagugaacuuaaauacucuccugucuccccaacugugagcagcccucagggcccccaguucuccuagccacacccauacuuacaagaucucugggcaggggagauaauaggggacauaggagacuggcagccaguucucaagauacacccugugaauaaaaaaaagaaaaaaaaucuguugauccacucugcaccagaggcugaaaacgcaccucaugcacgucauugggagugcaggucucccacagugcauuaggaggccagguccccugucauucuguaggucuggcugaccuuggaggacaaagccugcugguauuccuggcaugugucacagggccugccaugcagucauucauucacccauagagucauucauuccuagggaguguauauucuugaugccaggccccccacacaaacagcagggugaggggcagccccaggagcuucauggaaggacagaaacagagggugaauuugggagcgugaacggggauuccccaucaacauugguugaaggaugauccaggcagagaaaagagcaagucaaaggccaggaggccaguacaaggcagaauucagaagccggagacacuaguugggucuuguuggggcugggguuggagaacaggugagucaggagggguuggugggaucuggaauccuaugaggagaucaagguuuugggguugaucugcagagacagggggaguccuggguggggauagagacagggagaguccuggguggggauagagacaggggaaguccuggguggggauagagacagggggaguccuggguggggauagagacagggggaguccuggguggggauagagacagggggaguccuggguggggauagagacagggggaguccuggguggggauagagacagggggaguccuggguggggauagagacagggggagcuccguggggcagacucaccacaggacacugaggcuugugcccgccaacaggcagaaccccagacccagggccagucuccggcgaugcauugcugggggcugcaccugagccugggcacuuguagagacccccacuggccugggcggaugaggcuguccccucgcagggaugucaggcucugagccuggucucugaggucccaggaacaccugcaaaggaacacuuuuguuguuuugagauagaguuucacucuugucaacugggcuggagugcaguggcgcaaucuccauucacugcaaccucuucucuuggguucaagcgauucucuugucucagccuccugaguagcugggauuacaggcacaagccaccaugcccagcuaauuuuuguauuuuuaguagagaagagguuucuccauguuggucaggcugguguccugaccucaggugauccacccgccucggccucccaaagugcugggaugacaggcuugagccacugcaccgggccaggaaugcucuuuauggggagacggugaccccagcccugcagcccugcccucccucggucacccacugcggucauguggacucuaggucccgcuggaccccgggcucagcucuggcagcucugggaggcgcacgguggcaguggcucggugcucagcuguugcuuccagcuguccuuugggagaggggcugggaccgacuucgcagaggccgcgaaggcggaucccugccuuggcucccgcgucuccguacuagguccauugucagaggugagccgaggccgccgggaggggugcaugggccaguccaccguccgcuggaaaucaagcaccgaggcacagcgaggacacaugcagucccagcgcaggaugcgcgggaaggggcgcccaggauuccccgaggggagcgagguggccgcuguccaccucuccgggaggcagggcccggguucuccacggaacgaugggaacgcgccucaacucgcuggcucguugaccuugggccagucauccccugcucccggccucaguggauggggggcggcacgcggcgcccggggggaggacacgcgggaacggcuguaaaacgcugggcgcagcccgggccacagugagcggagagccgggguccuggggauuaggccgcugccacucgggaguguccggcaagcccucucccucucucuuccucuggggccucaguuuccccacucgggccuccaagccccgucucgcccccgccucccgcgaacgcagagcccagccccgagcgccgccggccccaguccguggucgggacccgggacccuggguccgagaugcgcaccuccugggcucagggcccuccuccuuggccccuugcguggcagggacuggguggggccaagggagcgcgacugucccuacggggugcagacuuacuccuugcugccggcccggcguuaggacgguuggaggggcgccaccccggcgcggaaaacggacucagcuggccugggcccccgcgauacccgggcgaucggcggcgcagguggagccuggagcagggcaggcagcggggccgcgggccagacagaaaagag

SEQ ID NO: 191189 - RNA, 59398 nt, Homo sapiens
uagggcgagcgggcgcgcgaagauggcggcggccgccggcgggccgugugugaggugcggagcgggucgaauggaccgggguggcugugaagcgcggugucaaagccgagcggaagcggggcgggaauuggaggcgggauguggcgacaguggcagggccaaccccggcuggauggacgggcaccgagacgggaggcgguuacguccaaacgguccccgcgcgcggggaucugaagagucuucuucaggaggggggccggcucuucaccccuucccuccgcgcucggccucccaucuccucacccagggcccuuugccuuccuccucucucaccuccgacgcgucucuuggcgccccacccgcgcuuccuucuccggccgugacgcucccucgagccacggggagcuuugcggucuccugggguaccccccacccacgucccugcugcaggcucccaguguccugccccggcgucgagugcgcccugcuggcuccccgaccucucccgcgaucuguucuuguuaggauuuuguuucgcguugagcggagccacgcuugcggcuucuguccucuccgcgccucguaucguucuuuucuugcacugaaucaagucagccagcauguccaaauccuccaagagauuucagggauugaacuaggcuuuagggacaagaagaugaaauauuauauacgaaaacuacaauucugacaaagugcuuucuagcgucagacccugguggagcgcuucccaggaguuaucucauucaauucucgcaacuccgagaggcgccuucuauuucacagaugacucagaaguccggcucagagcuagccaagugauaaagagagccuucaagcugaagucugcguaccuccagugcuauaaccagaccaccacgccuccuucugucuuccacauugcagcucgaaggucuucguucuucccaccacccucccucaaaguuaaacauccccgucucuuauccuucccugugccagcaguguuuuccccacuuuuuuuuuuuuuuuuuuuuuuuuuuuuuuuugagacggagucucgcucugucgcccaggcuggagugcaauggcacgaucucggcucacugcaagcucugucucccggguucaugccauucuccugccucagccucccaaguagcuggggauacaggcacccgccacaacgccuggcuaauuuuuuguauuuucaguagagacaggguuucacuguguuagccaggauggucucgaucuucugaccucaugauccgcccgccucgaccucccaaagugcugggauuacaggcaugagccaccgugcccggcccuaacaauauuauuauauaacaagauuacuuuccaaaaauuuaacaaaucguuuuguauauugagauuuuuugcuuuuagagagcagacaaaauggcuaugaggcaguguacaaguuuguaugaucagaaagagcaaaauuaccucuguucucucauuuugcaggagcaguagagaacuguggacuauucugcuuggaaggucagcucugagagagcugguaaguggugguguucuugaguggguucucuggguucuuuguguagcuuuuguuaccaaaaaaaaccuuuuuuuaaauguaggaaguaaacacauuuauuuauuuagagacagaguuucgcucuuguuucccaggcuggagugcaauggcgugaucucggcucaccgcaaccuccgccucccagguucaagcgauucuccugccucagcuucucgaguagcugggauuacaggcaugcaccaccacgcccgacuaauuuuguauuuuuaguagagaugggguuuuuccauuuuggucaggcuggucuccaacucccgaccuuaggugaucugcccuccuuggccucccaaauugcugugauuauaggcgugagccaccacaccuggccuauuuauuuauuuugagauggaguuucacucuuguuacccaggcuggaguguaacagcaugaucccagcucacugcaaccuccgccucccgaguucaagcgauuuuccugccacagccucccgaguagcugagauuacaggugcaugccaccacaccuggcuaauuuuuguauuuuuaguggagacaggguuucaccauguuggccaggcugguguugaacuccugaccucaggugaucuacuugccuuggcaucucaaaguccugggauaacaggcgugacggccacuuuuuuuuuuuuuuuuuuuuuuuuugaggggggugucuugcucccaggcuggaguguaaguagcucgaucuuggcucacuucaaccucugccaccuggguucaagugauucuccugccucagccuccccaguagcugggauuagaggugcccaccaccacgcccugcugauuuuuauauuuuuaguagagacaggguuuugccauguuggccaggucggucuugaacucccgaccucaggugaucugccugccucagccucccaaagugcugggauuacaggcaugagccaccacacccggcuacguuuuuuuguuguuguugagacagagucuggcucucgcccagguuggagugcaguggcacgaucuuggcucacugcaaccucugucuccuggguucaagugauuccugccuuagccucucaaggagcuggggauuacagaugcaugccaccacgcccggcuaauuuuuguauuuuuaguagagaugggguuucaccauguuggccaggcuggucuugaauuccuggccucaggugaucugcccaccucagucucccaaagugcuuggauugcaggcaugagccacugugccugguauaaacacuuuuuuuuuguuccuaaaacuuuauaaacguggucagaugcaguggcucaugccuguaaccccagcacuuuggaaggccaaggcagaaggaucaauugagugcacaagcucaaggccaacccuggcaagauagcaagaccccgucucuacaaaaaauuuuuuaaaaaauuagccaggcaugguggugcaugucuguagucccagcuacuuaggaguccaaggugggaggauugcuugauccugggagguugaggcugcagugaacucuagccugggagacacaucgagaccccagcucaaaaaagcaaaaagcuuuauaaacauuacgcauucccuacuucuuugcugaaaugagacuaccuagccuagcugcugaagucuuuuaaaucuaccuuuguauuucauugauuccuuuuaugaaaagauaccuguguucauugcuuggcugcugagaguaggggugcaaauaccauucuucuaccucaaccuaagaaagauucuuggccaggcaugguggcucacgccuguaaucccagcacuuugggaggccgaggcgggcggaucaccugaggucaggaguucgugaccagccucaacauggagaaaccccgucucuacuaaaaauacaaaauuagcccggugugguggugcaugccuguaaucccagcuacucgggaggcugaggcaggagauucgcuugaacccggaaguggagguugcagugagucgagaucgcgcaacuguacuccagccugggugacaaagcgagacuccaucucaaaaaaaaaaaaaaaaaaaagucaggcuugguggcauaugcuuguauuaguaguuccagcuacucaggaggcugugguggaaagaucgcuuaagcucaggauaucaagccugcagugagccaugauugcaucacugcacuccagccugggugacagaacaggacccugucucaaaaaacaacaaagaaaacuucaccacaacaucauuuauauuauuaaauaauuacagucagcuuaaguauaucaaacauuagaggaaugguaaaugaauuaugaucuaccaacuugauacaaguauuaugcagcaacuugaaaguauguuuaucaagacuuucauaauaagguuaagucauuauguuauaauguuaagcaaagaaaagaagguuacagaauucuguauucaaaaugauuucaacucuggggaaaaaugcauauuaaaaacacucaaaggaauguguaauacuuagugugauucuggaaucugauuuuuuuuuuuuuuuuuugagacggaguuucgugcuuguuguccuggcuagagugcauuggugcaaucucggcucaccacaaccucugccucccagguucaagugauucuccugccucagccucccgaguagcugggauuacaggcauacaccaccacgcccagcuaauuuuguauuuuuuaguagagacaggguuucuccauguuggucaggcuggucuccaacucccaacccuaggggauccgcccgcuucggccucccaaagugcuaggauuacaggccugagccaccaugccuggccgagucugauuauuaauaaaacugcauuugggccgggcgcaguggcucacaccuguaaucccugcacuuugcugacaugggcagaucacgaguucaggaguucaagaccagcuuggacaauauggugaaaccccaucucuacuaaaaauacaaaaaaaacugacuggcaugguggcgugcgccuguagucccaucugcucaggaggcugagguaggagaauugcuugaacccaggaggcggagguugcagugagccaagauugcgccacugcacuccauccuggguaacagagugagacuccgucucaaaaaaaaaaaaaaaaaagaaagcacaaaaaacugcauuugcggucgggugccuuggcucacgccuguaaucccagcacuuugggaggccaaggcaggcagaucacuugagguggggaguucgagaucagccuagccaacauggugaaacuccaucucuacuaaaaauacaauaauuagcugggugugguggcuggcaccuguaauuccagcuacucgggaggcugaggcucgagaaucacuugaaccugggaggcggagguugcagucagccaaguuggugccacugcacuccagccugggugauagagugagacucugucucaaaaaaaaaaaaaaauacugcauuuguauaauuaccuuguucuuuuccagagucagauugaggcagaacugaauaaacauuggcggcgauuguuagaggggcuuucuuacuacaaaccucccagguauggcaguuccgggugucugguuaaaguaauuguccuaaggaagcugacauggauaaaaccauccuucuaugugcuuugaugauauuguaggguuauguauaccagagauaauacaauuuaguuuaccaguggaaaacaguaggguacauuuguuuuuuuguugaccgaaagaaaaggaaauuccuucuagaaauacaguauuguagaauauaauuaugaccuauguguggggaugagaauuuauuaaacauucaacgaauuuucuaauauuuauucagaguccacagugucugugugaguacuaauuggugggagauagcagugaaggaugaugcuaacaacugacacuuguguaguguuaacuauguaacaauuaauacucuaagcaccugacuuaucaaaaguuauuuaauccccacaacaccccuuugagauaguuacuacuuuuauucuuugggugaauauauagaucuuuuuauuggguaguggaaaacauaguaauaaaauauaaaguaguugcaaauaaagagaaugcagcuuguagggcugggcuuauuugaucuugauuccuaguccagaucucauucuauuaugcguuauagucuaagucacccucauuucccuucuacuuuuguacugcuuuugaauguauuacaucuuuaccuuccauuuucauucucuuagguuaacgaugaacuuuuccuuguuauucaucugucuguuaauucuuccccuguaauuaccuuaaaguaaaucccagauaccuuguuauuuuaucugcaaauacuugacuauguaucuaaaauacauggacuuuuuaaaaagauaaucucuauauuaucacauuuagguacccuuaucauuguuuccauuuuaccaguggggaaacugaggcacaaagagguuaagcaacuugucauggucacacagcuacuaagugauagaaccaggauuugacccugguggucucauuccagugucuguucuuuuuuuuuuuuugagaugggguuuugcucugucgcccagacuggagugcagugucacaucucagcuuacugcaaccuccaccucccggguucaagugauucgcuugccuuggccucccgaguggcugggauuacaggugcccgccaccacgcccagcuaauuuuuguauuuuuaguagagaugggguuucaccauguuggccaggcuggccuugaacuccugaucucaagugaucugcucaccucggccucccaaagugcugagauuacaggcgugagccgucauacccagccuauuguuuucuuuacuaucuuuuuucuguuccaggauccaaccuaguugucaagugccuguagucuccucuuagcugugacaaugucuuagucuuuuuuuuuugagauggagucucgcuuuguggcccaggcuggagugcaguggcacgaucucggcucacugcaagcucugccucccggguucacgccauucuccugccucagccucccgaguagcugggacuacaggcgcccgcugugacaaugucuuagucuuuuuuuuuuuuuuuuuuugagauggagucucgcucuguggcccaggcuggagugcaguggcacgaucucggcucacugcaagcucugccucccggguucacgccauucuccugccucagccucccgaguagcagggacuacaggcgcccgccaccacgccuggcuaauuuuuuguauuuuuaguagagacaggguuucacuguguucgccaggauggucucaaucuccugaccucaugauccgcccgccucggccucccaaagugcugggauuacaggcgugagccaccgcggccggugacaaugucgacaaugucuuagucuuaccuugauuuucaugaccuugaacaaguuugaggacuggucaguuauuuuguaguaugcccccaauuuggguuugucugauguuuuccuuauuauuagacugggguugugaguuuuugggaaaaauacacagaggugaggugcucuucuuuuuuuuuuuuuugagauggaguuucgcucuuguugcccaugcucgcgugcaauggugcgauuucagcucacugcaaccuuugccuccuggguucaagcaauucugucucagccucccgaguagcugggacuacaggugcaugccaccaugccuggcuaauuuuuguauuuuuaguagagacaggguuucaccauauuggucaggcuggucuugaacuccugaccucaggugauccgcccgccucagccucccaaagugcugggauuacaggcgugagccaccacgccuggccaagcuacccuucuuaccacaucauagcagagaguacaugcuguccacaugaaaucacugguaauguuaaucuuggucacucaguuaaggaggcauuugccaaguuucuccucuguaaaguuacuuuuuucucuuuuccuauuuuauuuuuuggaagugaguacuaaauauagccauguccagcuaauuuuuuucacuuuugguggagaugagggucucacuuuguugucuaggcuggucucaaacuccuggccucaagcuacacuccugccuuggccucccaaagugcugggauuacaggcaugagccauuguucuggccccucccuauccuauuuauuuauucauuaguuuauaucaguauagacucaaauauauuuauuuuauuuaucuuauacuuuguuuauaccuuguuucagcuuuggcuauugggcauucuuuuagguuggccucuguccuuugggcguguccuuccuuuuuucuuuuuuucuuuucuuuuuuuucuauuaugucaucuccuaccgaaaggacuuugguuucuuaagcccuuuuguacuucuuuucacuauaagaugcuucaagauuuucuuguauuuuccuugcccugacucuagaaucaaccaauucuccaaggaauccuguuauuagagaaugguauuauaaagcaggaucugggugcugcauguaccuccugcuguuggaguauuauaaauucuaggccuucucgguggacagagcuauuacagauaauauauuaauauauguauguaugccacagaccugguuuuaaauuuuagcaacuguuuaugagcugugggauuuuugguaaguuauuuacccuaagugcuggcaauuccauuuguaaaaggagaauaguaauauuugccuuuuagggcaguaguaaggaucaaaaauaauguaacuuaauguguuuacaaauaacauuguuauaacuguaauuuaaccacuuuuuuuuuguuuuguuuuguuaggcauaaccaguucugcguuaugaaguuuguagaggugaaugggugugugugugugugugugugugugugugcguguguguguuuguguguguguuuauaggcaucugaagggcagaaaauagucuguaggaaaaauauuuuaaaauauuuuuauuuuaaacucagugggcuauugagaaugaagaaaugauucacuguucuuuuuguaguccaaguucagcugaaaaagugaaagcuaauaaagauguagcuucaccauugaaggaacuggguuuaagaaucagcaaguuuuuggugaguaaaaauuagcacucgcucaauuuauuacuugcaguguggaugugcgugguuauauugcuagugauagugaaaauucaguuucuuuuuguuuuggggauuaaauuguuuuauaaauacccagguugcaacucuucucccuaaaaguuacaagucaaaguugccugauccauucacugcauaucauaggguuuucuucaccagacaugugguggucuuuaaggugacuaaguuugucauuuuggaagcucacaucaugccuacugcuguauuaaugugcuuagugaauaagcaucguuguuucuggcauguacauuuaauuguaauaaaaauuguaugucagugacuggcucuugucuucuauuagagucagaauuguuauguuuuaugaaucuuugagaagcauuuuuguuuauucaaguccuguguucauuguagaagacaaaucuuuaaauucucugcauccugugugcgauuucugagcuguuccuuacuuaaaaucucuguguuucagggucuugaugaagaacagagugugcaguuacuccaguguuaccugcaagaggacuacagggguacucgggacucaguaaagguuugugguuuaugucagcuccuuucuucugccuuuauccuuuuucccuguugguuuuagauaauguaggauuuuggcaccaauucuuuuaucggugguaggugaucagguaccgucaucuucagggaagaccuacuaaaggcuuuaaaaaaaacaugaccugggugcaauggcuugugccuguacucccagcuucuugggaggcugaggcaggaggaucacuugaguccaggaguuugaggcugcagugaacugugaucgcacuacugcacuccagccuaggcaaaagagugagacccuaucucuuuaaaaaguaaagaauauauaugcauauaagcugagaucugucuucauacuuggaggaguggagaggucaaagacugacauguuaaucauagaaucuugggcuauuagaggugauaaggauuugguagaguuucuuuuuuuuuugagauggaguuucgcucugucucccaggcuggagugcaauggcgugaucuuggcucacuggaagcucugucucccggguucacgccauucuccugccucagccucccaaguagcugggacuauaggcgccugccaccacgcccggcuaauuuuuuguguuuuuaguagagacaggauuucaccguguuagccaggauggucucaaucuccugaccucgugauccccccgccucagccucccaaaguacuuggauuacaggcgugagccaccgcacccggccaggauuugguagaauuucuagccugcccagccccucauuuuacauaagaggauugaggccagaggagaaggggagggauuugagcacagguuuggguacauuuggguaaaaaguaagguggaaaguauauguagaaacaaaugugcaauuauaaucuugaaggaugaagugaagguaucuaucuuuuuuuauuacuugaguuuugccuaaaagauggccucuuaacugcucuguuuuucuuuucagacaguacugcaagaugagaggcagagccaggccuuaauccugaaggucaguaguagucaccauuucuauucuuugauguaaaauugagugacagcuucuugaccucauuuuccugagcauugcuggcuuuugacucuuuguuggguaagcauggaggucuuuaugaagaagcauauuaacucauuuaugaaaagaugcuuuuauccacuggacccaguagagaaguuucucccaaggagauucuucagcuacugguggugagaacaaguucauggauauuuuuucuuuagguguaaguccaacaggauuaauuuguauuucuuuauuucuuuauucuucagucccuuuccagcaaccuucucacuuaggaucucguguuaaaauguaauuugugacuucugaagaaguuuccuauuuuauauuuagugagaauaaguacauuaguuacaagcaauuaggaccuauaucaguggaauuuguuuuuauguguuuggccugccuguugauagcauugugugcuacaugaaugcucugagaaaucaugcuagaaaacauuuuuggaaacuuguguauauuguuaaacaauuaauuccuuucauccuguauauucugguuuaugaaugucuuuuccuuuauuuuggccuaauucaguauguuugcauuucugugauuccuuauuuauauaaauugaacuuuuccauccacaucuuuaagugaaauuaucacuaaauuuaaacuugaguuuccuaugugcaaaggugaguaacugauuuugaauuuuggguuccucagauugcagauuauuauuaugaagaaagaaccuguauucuucguugugucuuacaccuucucacuuacuuccaagaugaaagacaccccuauaggguaagcuuguuuaguccucuugcuucucuuuauacuguaucaucuuaauaauuuuauuaauauuuauuugaauauuuaccuuuuauucuagguauaauuuacucuuuugauuuuuuaaagguugaauaugcagacuguguugauaaauuggagaaggaacuaguuucaaaauacagacagcaguucgaagagcuuuauaaaacugaagcaccaacuugggagacacauggaaaucucaugguaugugguuacugugcucuccuguaacuuuuuuuuuuuaagauggaguuucccucugucacccaggcuggagugcaguggcaugaucucggcucacugcaaccuccaucuccugguuuuaagcaauucuccuaccucaguggauuacaggcacccgucgucacgcccagccaauuuuugcauuuuuaguagagacaggguuucaccauguuggccaggcuggucucgaacuccugaccucaggugauccgcccaccucagccucccaaagugcugggauuacaagugugagcgacuacaccuggccuauaacucuuaggagaauuguauacccuugcuuauagagcugcaaguuaaauuauuuauucauucauuuaaaacauacagauuaucuuuuuuuuuuuuuuuuuuuuggugagauggaguuucccuguguugcucaagcuggagugcaauggcacaaucucagcucacugcaaccuccaccucccggguucaagugauucuacugccccagccucccaaguagcugggauuacaggcaccugccaccacgcccagcuaauuuuuuguauuuuuaguagagauagagauaggguuucaccauguuggccaggcuggucucgaacucccgaccucaggugauccaccugcuuuggccuccaaguguugggguuaugggcaugagccacugugccugaccuagguuaucauucuugagaaaaguuuaaacaugucauauaaaucaaaauauugaugacauuaauuaauaguacuuaauucugacuuugacuuuuuuucaaucccauuaguuuacuuucauuucuuaccuaaaauuuguuuagugguuaauagaauucugaaccuaauauaucaucuuauuauuuucugcucaauguguaacacuagucugauuauuuuauucuuuuuuuuuuuuuuuuuuuuuugagacagagucucacucuguugcacaggcuggaaugcaguggugagaucuccacucacugcaggcuccaccucccggguucacgccauucuccugccucagccucccgaguagcugggacuacaggugcccgccaccacgcccagcuaauuuuuuguuuuuguuuuuuuuguuuuuuguuuuuuuuuaguagagacaggguuucaccguguuagccaggauggucucuaucuccccgccucagccucccaaagugcugggauuacaggcgugagccaccgcgccuggcuauuuuauccuaauuucuaaaccaauuugcaucuaucgauuauagcaugaccuuguuuguuuuaaaaauaauacauucuuauuaaaacacaucaaaaacacagcuacuuaaaaaauauuuaauagaugaaaagggccuauuuauacauaugacauuucugucucagaaaguuugcagucagaagcaugaaauagcaauaaaagcauaaaauucccaggaauaaguuuaggacaauauaaaauuuaagugaagagaacuuuaaaaaugcuauaaaagguguaaaagaagacauaacugaggcugggcacaguggcucaugccuguaauccuagcacggugggaggccaaggcaggcagauuacuuuaggucaggaguucgagacaagccuggccaauaugguaaaacccuguuucuacuaaaaauacaaaaauugguggggcacgguggcucaggccuauaaucccagcacuuugggaggccaaggugggcggaucgcuugaggucaggaguucaaaaccagccuggccaacauggugaaaccucgucucuacuaaaaauacaaaaauuaggcgagugugguggcacccaucuguagucucagcuacucaggaggcuggagugggagauucacuugagccuaggaggcagagguugcagugagccaagauugcgccacuguacuccagccuggggugacagagcaagacuccgucucaaaaaaaaaaaaaaaaaaccauaaaaaaugaaaaugcaagucuggccaauauggugaagcccugucucuaguaaaaaaauauacaaaaaaaaaaauuagcugagcaugguggugcgugccuguaaucccagcuacucgggaggcuaaggcaggagaauugcuugaauccaggaggcagagguugcagugagccgagauugcaccacugcacuccagccuaggcgacagagcaagacucugucucagaaaaauaaaaauaaaaauaaaaauauaaaaguuagcugagcgugguggcacgugccuguacucccagcuacucaggaggcugaggcaggagaaaugcuugaauccaggugguggagguugcagugagccgagaugacgccagugcacucuggccugugcaacagagcaaucucugucucaaaaauaaauaaauaaauaaauaaauaaccaaagggaaagacacacuauauauaucuauaucuauaucuaucuaucuaucuagauagauagauagauagauagauagauagauuuuuuuuuuuuuuuugagacggaguuucgcucuuguugcccaggcuggaguucgauggcgugaucuuggcucaccacaaccuccgccucccagguucaagugauucuccugccucagcuuccugaguagcugggauuacaggcaugugcuaccacgcccggcuaauuuuguauuuuuaguagauacaggguuucuccauguuggucaggcuggucuagaacucccgaccucaggugaucugccugccuuggccuccaaagcgcugggauuacaggcgugagccagccaccaugcccggccuaggacauaccauacucuuuuuuuuuuuuuuggacggaguuuuacucuuguugcccaggcuggagugcaauggcaugaucuuggcucaccacagucuccaccuccugggucaagcaauucuccugccucagccuccugaguaggugggauuaaaggcaugcgccaccacacccagcuaauuuuguauuuugaguagagaugggguuucuccauguuggucaggcuggucuggaacuccugaccucaggugaucugccuaccucaacccaucaaagugcugggauuacgguggugagccauugcaccugaccaacacaccauacucuuuuuuuuuuuuuuuuuugagacggagucucgcucugucacccaggcuagagugcaguggcacgaucucggcucucugcaagcuccaccucucggguucacgccguucuccugccucagucucccaaguagcugggacugcaggcgcccaccaccacgcccaauuaauuuuuuuguauuuuuaguagagacaggguuucaccguguuagccaggaugguguuggucuccugaccuccugacccacccaccucugccucccaaagugcugggacuacaggcgugagccacugugcccggcacaccauauucuugaguauaaaaacuuacaccgggaugggcauggagguuguggugagccaagaucacaccacuugcaccccauccugggccacagagcgagacucugucucaaaaaaaauucauaugcaaaauaagaauagccggcugggcucaagcaguccucccgccucagccucucaaagugcugggauuauaggugugagccauuauucgcaacuaaauugauauacuuuuuaaugggaagcauuuugauaauaucuaaaaauuuacaaaguacauauuucuugauucagcaguuuuuuguuuaauuaugauuuuuuaaauugugauaaaauagacauagcauaaaauuuaccauuuuaacuauuuuuaaguaacugugacuauacuuuuacuuuuucuggaauuacauauaaauagaaccacacaauauguagaauuuucuguuuggcuucuuucaguuaaugucauguuuuugagauucauccauguuauaucauauacuaguacuucauucuuauuuaugguugaguaguaaacauuccauuguguggauauaccauauuuuguuuauccauuucucaguugauagccagccauuugucauuuuuguuuuuugacuauuaggaauaaugugcuaugaacauuagcauauggguuuuuugacauaaguuuucauuuauccuggguaaauaaauaccugagagugagauugcugagucguaaauguaaauuuuuuuuuuuuuuuuuuuuugagacggagucucgcucugucgcccaggcuggaguucaguggcgcgauuucgacucacugcaaccucugccuccugaguucaagcgauuguccugccucagccuccugaguagcugggauuacaggcaugcaucaccacaccuggcuaauuuuuguauuuuuaauacugggauuacaggcaugagccaccaugcccagccguaaaugaaauuuuuauaaagaauugauaaauuguuuauccauaguggcuauaccguuuugcauucccaccagaaauguaugagaauucuuuuuguuugacauugucaccaacacuugguauggcuguuaauuuuaaacauccuaaauaaguauauaguaauaucucauugugguuuguuuguuuugagauagggucuugcuauuuugcccaaauuggccuugaacuccuggauucaagugauccuucugcuuggccucuugaguaggcugggauuacaggcauaugccaccaugccugucuuauuguggguuuuuuuuuuuuuuauuuuugagacggagucucacacugucgcccaggguggagugcaguggcacgaucuuggcucacugcaaccucugccuccugaguucaagcgauucuccugccucagccucccgaguagcugggacuacaggcaugccaccacguccggcuaauuuuuuguauuuuuaguagagacaggguuucaccguguuagccaggauggucucaaucuccugaccuugugauccacccgccuaggccucccaaagugcugggauuacuggugugagccaccacaccuggucucacugugguuuuaauuugcauuucccugaugacuagugauguugaacaucuuuucacgugcuuauuuacuuacaccuucuucagucaagugucuguucacauuuuuaucccauuguuuuuuguggauguuugucuuaucaaauugucagaguucuuuauauacaguauuguaaauauaagcuauuuaccagauagauguuuuacaacuuuuuucuuccaccuaguggcuugucuuuucccaccuuaauucuuuuuuuuuuuuuuugagacaaggucucgguuugucacucagacuggaauccaguggugggaacaugguucacugcagccucgaccucccugacucaagugacccuccugucacagccccacaaguagcugggacuacaagcggguaccaccauaccuggcuaauuuuuguauuuuuuuuuuuuuuuuuguagagaugguuuugccauguugcccaggcuggucuuaagcuccugagcucaaaugauuuaucugccuuggcgccucccaaagugcugggaugacaggcaugagccacugcuccuagacuguaucuuuccaagagccaacauuuuaauuuuaauuuuuuuuuuuuuuuuuuugagacgcucucacucagucacccaggcuggagugcaguggcacgauguuggcuaaguguaaucucugccucccggguucaagggauucugcugccuccagccucccgaguagcugggauuacaggcaugugccaccacgccuuccuaauuuguguuauuuuuaguagagaugggguuucgccauguuggccaggcuagucucacuccugaccucaggucauccacccgucucggccucccagagugcuaggauuacaggcaugagccuccucacccggccaaaauuuuaaguuuugauaaauguuuuugucaguuuugucuauuauggcuccugccuuuuggagcuuguccuuaaauguuugauagaauuuaccagugaagccaucugggucuggaguuuucuuugugggaagguuuuuaauucuuuuauuuauugauuaaaauuuuuuuaucucuuuuuaaaauuuucaucaaguuucuaacaaaguuuuaaauacugaauuguuuuccuugauugauacagagcuauucaaguuuccuguuucuauuugggacaguuuugguaauuuguaucuuuuaaggaauuuguucauuucauuucauuggugaaaucuauuuacauaaggcuguucauauuauuuucuuaugcuuuuacucucuuuagagucuagugcugugcucuuacucauuucugauaaugguaguuuuugucuucaauuuucuuuauuaaaaaaaauuuuuuuuugagacagagucucacucuauagcccaaacuggagugcaguggcgcauucuuggcucacugcaacauccacuucuagggcucaagugauucuugugccucagcaucccaaguagaugggaguacaggugugcacuauuaagcucagcuaauuuuuuguauuuuaguagagacaggguuucaccauguugcccaggguggucucgaacuccugagcucaggugauccggcccccucagccucccaaagugcugggauuauagacgugagccaccacgucuggccaguuuucuuuauuguaaugucuguuuuauauuuaauugauuucuguuguguauuuuuuuuuuuuuuuaaauuuucacucuuguugcccaggcuggagugcaauggugugaucuuggcucaccgcaaccucugccuccuggguucaaaugauucuccugccucagccucccaaauagcugggauuacaggcgcccaccaccacgcccagcuuuuuuuguauuuuuaguagagauggggucucaccauguuggccaggcuggucucgaacuccugaccucaugaucugccugccucggccuccuaaagugcugagauuacaggcgugaaccaccgcgcccggacucucucucuuuuuuuaaaauagauuucugccuccgugugugugugugugugugugugugugugugugugugugugcgugugcccagccuuguucuuuaguuuuuauauauguauauguuuuuucucccuuuuuaaauggauuucugucucugucugucucugugucuguguguguguguguguguguguguguuuguguguguguauguguuagaagucucacugucacgcagagugagacucucuggauuuaauguccaaauauuggauguuuuuuguaaauaucuggguuuuuuuuuugagacagguucuuucucuguugcccaggcuggaguuuaguggcacaaucacggcucacugcagccuugaccuccugggcucagguaauccuccuaccucagccucccaacuagcuaggacuacaagaugcugcagguuuugccauguugcccaggcuagucuuggacucccgggcugaagggaucugaccaccuuggccucccaaagugcugggauuacaggugugaaguacuauagcagacgaaacaucuuauuguucucaauguuuuuauuugauucuguuaucagagaacacauucuuugucauuuuagucuucuaaaauuuacugucucauguuuuauggccuaccuuaugaucuuucuuggugauuguaccuguacaccuggaaagaaugucuaguuguuuuuucaguugaauaguaugaguuuauuagcaagggauugguaguaaccuaaaugcucauccauccaagugagcagguaaaaucaaugauggcauuuaugugcaguggaauacuauguaguguuaaaaauauugaguguauugguugaauaaucuauggcauauccacauaaugaauuauuaugcaaauaaaaggauuaaaaauagggaggguuuuugugugugugugugacagagucucacugugucacccaggcugggguacaggggcaugauuguagccuacugcagccucaaccuccccagcucaagugacucuccugccuuaggcuccaguguagcugggacuacaggcaugcaccucuaugccuggcucauuuuuaaaaacuuuuucuagagauggagucucacuguguuucccagacuagucuugaacuccaggccucaaacaguccucccacuuuggccucccaaaguauucaaguauuaggcuuauagacgugagccacccugcuaguccagaaaauuuuuacuauaccuuuauaggagauaauuuuuaagauacauuguugcagcuggguguaugguggcucaggccuguaaucccaccacuuugugaggugaaggugggaagauugguugagcccaggaauucaagaccagcccuggcaacauagcaagaccuugcuucuacaaaaaauuuaaaaaauuggcugggcgcgguggcucacgccuguaaucccagcacucgggaggccaaggugggcggaucaccugaggucaggaguuugaaaccagucuggccaacauagugaaacccugucucuacuaaaaagaaaaaaaucagccgggcgugguggcaggcgccuguaaucccagcuacucgggaggcugaggcaggagaauugcuugaaccugggaggcggagguugcagugagccaagaucgcgccauugcacuccagccugggggauaagagugagacuucgucucaaaaaaaaaaaaaaauuaaaagaauuagcuagacauggugcuaaccuguaguuccagcuacuuggguggcugaggcaggaggauugcuugagcccggugggucaaagcugcagugagcuguggguguacucuggguguacucugggugacagagcgagacccucucucaaaagaaaagauacauugguuggcugggcacaguggcuuacgccuuuaaucccagugcuuuggccucccaggaggaucgauugaggcuaggaauucaaaaccagccugugcaacauagcaagaccuguucucuuccaaaaauuuaaaaaaagaaaaaaugagcugggcauguuugugcucacuuuuaguccuaacuacucgagaggcucaggugagagggcagcugccauaagcuauaauuguacugcugcacuccagccugggugauagagucagacccugucucuuaaaaaaaaagcaaaaaaucugucucuuaaaaaaaaaaauuaaauacggaccaggugcaguggcuugcgccuguagucucagcuauuuaggaggcugagguaggaggaucaguugcguguagcaguuugagcagccauaaucugccacugcacuguauccugggugacagauugagacccuuucuuuaaaaaauguucuuuaaguacuguuuuuaaucucauguuauuucucucccauuuuguuuucauugguuguacagacagagcgccaagugucucgcugguuuguucagugccuucgggaacaguccaugcugcuagaaauuauuuuccuuuauuaugcauacuuugagauggcacccagugacuuacuuguauuaaccaagauguuuaaagagcaaggauuugguaguaggcagaccaauaggcaccugguggaugagacuauggauccuuuuguagaucggauuggguaagucagugaauugaacaucauggaacuugcaguguuuagagcauugauacuauagugguauguaagcagguaggggguagguguacuuuucacuuaaucgguggggaaauaggucuacugccacguucccuuucaugcagggaguaaagacugggauugagagaggacucucaaaaugaguauuguaaucugcucuuuuacuuacugucuucauuuaagggguucauucauucauugaacaaaaauucguugaacaacuauuguaggccaagcacuaugcaaaugcuaacaagauagugauaaauaaggcauauaugcuugcucuucucuuucaggugauagucuauggacuuuaaauuucuuguuuuuucucuauuuaugaccguggauauauccauaacugggggccuggucacucugugagcaaagauauauaccaguuaauuuugugugugugugguauagauggggugucacuuuguuguccaagauagucuugaacuccuggccucaagugauccucccaccucugccucucaaaguguuaggauuauaggcguuagccacuaugccuggcccaauagguuuuuuugauaucgcagugucuuauaucucaccuuugucucuagugaguuucagaacgggauauauaacauggugauacuauuuuucuuucuagcuacuucagugcccucauccugguggagggcauggauaucgaguccuugcauaagugugcuuuggaugacagaagagaacugcaucaguuugcgcaggaugggcuuauuugucaggugacuuggaauagccucuuuuuuuucagaggguuuauaaguuaguaguagcuuucaauuauugaacugcugcauaaaauuuucaguguuguggaacuacauuguucagugaugcagagguucuacaauguuuucguuuuguuuuguuuugguuuuuugagaugaagucuagcucugucaccaugcuggaaugcaguggcguggucuuggcucacugcaacuuccaccuccuggguucaagugauucuucugccucagccucccaaguagcugggaucacagcuaauuuuuguauuuuuaguagagacuggguuucaccauuuuggccaagaggucucaaucuccugacuucgugauccucccgccuaagccuccuaaagugcugggacuacaggcgugagccaccaugcccagucuguuuuguuuuuuuugagacagagucuuccucuaucacccaggcuggagugcaguggugccaucucggcucacugcaaccuccaccuccuggguucaagagauucuugugccucagccucuggaauagcugggauuacaggcacaugccaccacguccaguuaauuuuuauauuuuuaauagagaugggguuucacuauguuggccaggcuagucuugaaccccugaccucaagugauccaccugccucagccucccaaagugcuggaauuacaggcuugagccaccgugcccggccucuacaauguuaaacaguugauuagaccuggaggaaaucucagguucgucagucaucuauaccaaggugauaauugagucugugagagugauucauucauggagaugguacaaggacaaaagaggcccaaggagaaaacccuggggauugacugcauuuaaggagccugugaaagaagaggaaaggggaaaaacauugagaugagaugguuaggaagauagaaaaugaagauagagcauagaaaguuugagaaggaucaggauaaaauuucuaaggaauguaucguaacaugcauuuuauaaucuuaagacuacauaaaauuaguagacaaauuuuguggguaaaggaagaguaauuguaauugagggguuuauuagugaggugacuggggguuugagaagagugaaauaucagaaugagagagugaggccacucuuuauggcuugcuuauugagcgugaugaagaaucuggucgagggauauuaacacuuucuguucggagauguagauguguuuucuucucucacuaggauauggacuguuuaauguugaccuuuggggacauuccacaucaugccccagugcuuuuggccugggcucuccuccgucacacucugaacccagaagagacaagcagugugguccggaagauagguggcacagccauccagcugaauguguuucaguacuugacccgauugcuccagucccuugccagugggggaaaugaugugaguuuaaggcucuggguggugagcaugggagugagccggcagaagcauuauaauaauguaauaguuauaauggugguguggauaaugggaucauguuguaacuaaccuuuugagagcauuuagacaucaucaggcauuauuuauaauguuuaugaacauuaucuuuuugaauccuuguaacacuucuucguguuaaagauuaucauucuguuuuauacauuaggaaauugagacucagagagauguaauuugcccaaagcaacaaaaaugccaguaaaugguagauaacgguuugaacucuuugccaguaaaguaugucuuaagaagauagcuuuggccauauugacuggagaagucacuuucaggggacuuaaucaacuguaacaagaugaauuagaaauucucuugagucuuauguugggguuugaguggcaugguuuagagagcuuguuuguuuguuuguuuguuuguuuuugagacagagucuugcucugucacccaggcuggagugcaguggcacgaucuuggcucacugcaaccucugccucccaaguucaagcgauucuccugccucagccucccaaguagcugggacuacgggugccugccacaacgccuagcuaauuuuuuguauuuuuaguagagacgggguuuuaccaucuuggccaagcuagucuugaacuccugaccucgugauccacccgccucggccucccaaagugcugggauuacaggcgugagccaccgugcccagcuagugagcucguuuugacauggugaaaugaaaccucagguucagcaauuauuuuuuccuuuccuuuuucuuuuuuuugagacugagucuugcucuauugcccaggcuggaguacaguggaucucagcucacugcaaccucugccucccggguucaagugauucucgugccucagccucccaaguagcugggauuacaggcaccugccaccaugcccggcuauuuuuuguauuuguaguagggaugggguuucaccauguuggcaaggcuggucucaaacuacugaucucaagugaucugcccaccucagccucccaaaguucugggauuacaggugugagccaccgugcccggccaaaucagcaauuauacuccuugguugguacgcauuugcccaaaggcguugaaaacauauccacacaaaaacauacacacagaccuuuauagcagcuuuauucguaauuacuaaaacucgaaagcaacuaaaagguccuucaguaaguauaacuaaacuguuguacaucuagaugauggaauauuuauauacugcuaaaugagccaucaaaccaugaaaagacauggagaagacauuaaaugcauauuaguaaaugaagccaaucuaaaaaggcuucauaguauaugauuccaacuacgugacauucuggagaaggcaaaaccuuggagacauuaaagagaauaguggguugccaacggucuaguggagcaggaggucugaauuagguagaacacagaggauuucacagaggauuuuuagggcagugaagcuauuccaugugauacuacaaugguggauacaugucauacuuguccaaaaauccauacaauguacaacacaagagugacccuuaguguaaacuguggacuuugggugauaauaauaaugccaauugaaguuauucaguuguaacaauuguacuguuuuggugggaugcuauuuauguguggaggcagaggauauaugggaaaucuuuguacuuuucugcucaguuuugcuaugaaccuaaaacugcucuacaaaacaaagccuauuuaaaaggaagaaaacucagccagcaggcccuacucguugucacugguuggcuuaucuugguggccauucaggugcuauaucaauucccauuaccacaugcagacuguuuacuguaggcuggauaugguuuucuuuuuccccacacaaacuuugaugauuuuggcaauaauucccuucugauuuuauucuugacuuuguuguaauauuugugguuccugcuuucucuuuucucccuuggucuuccugaucuuguaacuaaauuaggaaaauuaugaagcuucagauuuccuucccauuuguuuacaaagaauauaugaaugcgauaggauuaugccgaaccuggggaagaguuguauuacucagaaugauucacugacuccuuugucauuccagugcaccaccagcacugcaugcaugugugucuauggacugcucucuuucguucugaccucguuggagcugcacacccugggcaaucagcaggucagugucuggcuuucaugaagcugucucuacugcccagcuuugcaaucaagucccaaaaauauacccccauuggaucugauauuauuuaccucauguguuaauuuguuuacuggcacucauuuuuuuauuuacuuuuuucuuuuuuuuugagauggaguccugcucugucccccaggcuggagugugguggcacgaucuuggcucacugcagcguccgccuccuggguucgagcgauucuccugucucagucuccuaaguagcuggaauuacaggcguccgccaccuugcccaguuaauuucuguauuuuugguagagacgggcuuucaccaugucgaccaggcuggucuuaaacuccugacaucaggcgauccgccugccucggccucccaaagugcugggauaacaggcaugagccacugcacccggccuugucuucauuuacuguuauauaggugauaaauguuaauuguagaaaaaacagaaaaugcuguaaaaagaaaaaaguauaguccuaucacauagauaacuugauaacauuuugauguauucccuuccauuuuccaaauacguauauacaugaaaauauaguaauucuucucuagaaauugaacaacaauggauuuacuauuuuuaaaauuucuguuuauuuauuuauuuaugcauuuauuuuuuuugaggcggagucuugcucuguugcucaggcuagagugcagugacgcgaucucggcucacugcaaccucugccuccuggguucaagcgauucuucugccucagccucuuaaauagcugggauuagaggugccugccaccgcgcccggcuaauuuuuuuauuuuugguagagacgggguuucaccaucuuggccagcuggucccaaacuccugaccucgugauccaccugccuuggcuucccaaaaugcugggauuacaggugugagccacugcaccuggcccuguuuguuuauuuuuuaagaaaccaggucucaguauauugcccaggcuggucucaaacuccaggacuucucaccucggcuucccaaauauauaccguuuuguaaccucauuuuuuuuacucuguaguacaucugucccagacauuuguuggugcuaguaagucuucugcagcagguuguuguuuuuuuuuuuuuuuuuuuugagacagggucucacuguguugcccaggcuggucuugaacuccugggcuuaagcuguccaucccugucagccucccacagugcugggauuacaggugugagcuauggcaccuagccuaaaauguuuuuuaagaugaaacauuucaaacuuauaccagagaagacaaaauuacauaaugaaccccaugagcccaucaccagcuucuaccaguuaucaucucauggauaauccuuuuucugccccuucccuccuugauuauuucaaagcaaaugucagauacuauuuaacuuaaucuacagacauuucaacaaaacuuaacauuacaaccguuaucacacaaaagccccccagaaaacauugucucuuuuuuuuuuuuuuuggagacaggcuggagugcagaauacaguggcgcgaucucgucccacuucaaccugcacccccugggcuuagaugauccauucaccuuaaccuccugaguagcugggacuacaggcgugugccaccaugcucagcuaauuuuuguguuuuucuugaagagauggaguuuugccauguuggccaggcuggucccgaacuccugaccucaggugaucccacugccuccaccucccagagugcugggauuauaggugugagccacuaugccuggcugaaguuauuuuuuuuaugcucagucccauauuuggccuguaacagcuuucuaaaucuguuugacacuacccuuauauauuuugauagcucuguugcuuucuugucuuuuuuauuuucuccguugcuuacuuuuuaaauuuaauuaauuaauuucuuuuucuuuuccuuuuuuuuuuuuuuuuugagacggagucuugcccuuguccaggcuggagugcgguggcaugaucuuggcucacugcaagcucugccuccugaguucaugccauucuccugccucagccucccgaguagcugggacaacaggcgccugccaccaugccuggcuuuuuuuuguauuuuuaguagagaugggguuucaccguguuagccaggaugaucucgauuuccugaccucgugauccgcccgccucagccucccaaagugcuaggauuacaggcgugagccaccgcgccuggccuuauuuauuuuucuuuaagacggagucucgcucugucgcccaggcuggagaguaaguagcgugaucuccacucacuucaagucugccuccuggguucaagcaauucuccugccucagucuccugaguaacugaguuuacagguguacgccaccacgucuggcgaauuuuuguauuuucaguagacgggguuuugccauguuggccaggcuggccucaaacuccugaccucaagugauccgccugccucagccucccaaagugcugggauuacaggcauuagccacugcaccaggccuauguuuauuuuuuauuguuuugaaacggagucucacucugucgcccaggcuggaguacaguggcgugauuucagaucgcugcaaacucuugucuccuggguucaagugauuuuccugccucauccccuugaguagcugggauuacaggugugcgccaccaugucuggcuaguuuuuguaauuuuaguagagacaguguuuccccuuguuggccaggcugaucucaaacuacugaccucaagugaucugccugccuuggccugucagagugcuuggguuauaggugugagccacugugccuugccucuuuucucuguugcuuucugguacaagauguuacaggauuaucuuguaagauucuuguguaagaccugaaaucugcuuauucuaauagccuugguuauuuuuagugggaaaugauauuugaugaguauccugaaaacuaaaucacucuguucauuuuuagugacuaggaacuuguuuuguaaauugacuaacuuggugaaaauuaaaauuuuuuaucauuagagagaaaugaguuuguguugaauugaaagacucaauuucuagaggcugggugugguggcuuacuccuguaaucccagcacuuugggagaccaaagagggcagaucaucugaggucaggaguuugagauuagccuggccaacauggugaaaccccaucuuuacuaaaaauacaaaaauuagcuggacaugguggcaggcgccuguaaucccagcuacuugggaggcugaggcaggagaauugcuugaacccggggggcggagguugcagugagcugagacugugacauugcacuccagccugggcaacaagagcaaaacuuugucuccaaaaaaaaaaaagacucaauuucuaaaggucaugggcauagaacaagguuuguguacuuugggagaauucugguuacuuuugaccugaccuuacaccuggaggauugguauuaacauauuagggccaagcacuguggcccacaccuguaaucccagcacuuuccgaggccaagguggguagaacaccugagcucaggaguucaggaccagccugggcaacaugaugaagcccugucucuaccaaaaauacaaaaaguuaacugagugugguggcgcgcacguguagucccagcuacucaggaggcugagguaggaucacuugccugggagacacagguuucagugugcugagauggcgucgcugcacuccaaccugggagacagagugagaccccaucucaacaacaaccaaaaaaacagaguugcaggaguccugguacuuggauuuuuuuuuuuuuuuuuuuuuagacggagucucgcucugucacccaggcuggagugcaguggcgcgaucucggcucacugcaagcuccgccucccguguucacgccauucuccugccucagccuccccagcagcagggacuacaggcgcccgccgccauacccagcuaauuuuuuuguauuuuuaguagagacggguuucaccaugguagccaggauggucucgaucuccugaccuugugaucugccugccucggccucccaaaguguuggcauuauaggcaugagccaccgugcccgaccagguacuuggauuuuaaagaaaucauucagugagcauuuauuagauucccuguguaugcuaagcucugugcuaagcgcuaaggauaaaacaauuaaagacauuguucuuggccaggcacaguggcucaugucuguaaucccagcacuuugggaggccaaggcaggcgggccaccugaggucaggaguuugagaccagcccagccaacauggugaaacuaaaauggcagagaugagcugggcgugguggugggcaccuauaaucccaguuacucgggaugcugaggcaggagaauugcuuaaaccggggaggcggagguugcagugagccgagauugugcuauuacacuccagucugggugaaagaccgaaacuucaucuaaaaaaaagaaagacauuguuuuugcccucuaggagagcaguuuagcugagccuaguaauaacuuacauuuauguggcauuuuugaauuuacagucuacuuccucauacauuaucucauuuaauccuuauuuauaauccuuacuuauaauccuacuuugaagcagaaauuacuguccccauuuuacagauaaagcauuucuggcucagagagaugaauuugucuaacauuguacagcagacacaacacacccuggacaggauauaaucuuacuuuuuaaacccagaguucuuggcugggcauggugguacacuucuguaacccagugcuuugggaggcggaggcgagaagaucacuuaaacccaggaguuaaaggcugcagugagcuaugauggugccacugcacuccagucuuggcaacagagcaagacccugucucuaaaaauagauaacauaccuacuuacauacuuauauacaaaaacgguaaaaagaggcuggucucacaccuguaaucccagcacuuugggaggcugaggcgggcggaucacgaggucaggagaucgagaccauccuggcuaacauggugaaaccccgucucuacuaaaaauacaaaaaauuagcugggcgugguggcaggcgccuguagucccagcuacucaggaggcugaggcaggagaauggcgugaaccugggaggcggagcuugcagugagccaagaucgcgccacugcacuccagccugggcgacagagugagacucaaaaaaaaaaaaaaaaaaaaaaagguaaaaaggaagaaacaaacccacucacccagaauucuugcacucuagucugggugauagagcaugaccuugucuuuaaauauaaauaaauaaauaagucaaccaacccauccacccuuaagcaguuuuuuuguuuguuuguuuuuugagacagagccucacuuuguugcccaggcuagaguacaguggcaugaucucggcucacugcuaccuccauugccuggguucaagugauucucaugccucagccacucaaguagcugggauuauaaggugugcgccaccacaccuggcuaacuuucguauuuuuaguagacaugggguuucaccauguuggccaggcuggucucgaacuccugaccucaagugaucugccggccuugccucccaaaguguuaggauuauagggguggcccccacacccagccaaccaaccaauucuuaaccaguuuuuucugacuuucuauauuaagguguuuauuuuauuuuauuuauuuauuuguuuucaagaagaggauuuacuauguuccccaggcugcucuggaacuccuggauugaaguggucuucccacuuuaguguuuauugguguuuugguguuuuuauuucaacagaauacaauaauaaagauagacugguucagcuagggaaaaugauccauuuuucuucccuuccucaaacaggauauaauugauacagcaugugaaguauuggccgacccuucucuuccggaacuguucuggggaacaguaaguaugucagagagagucacugcauagcaaaagaauuguucaaacacuuguuuucuuacagguuuuguacuaagcauucaugugcauuuucucauuuaaucuucauaaaaacguaugaaguagauacuauuacugucccucuuuuaaugugaugacacaugacacuuagagaugugaagugauuugcucaaagucacacauagaaagaggcagccagaacccaguucugucugacuugagucugcagcccacguuauuaccagugugcugucuccagcccaccagguuuuuuuuuuuguuuugguuuugucuuguuuuuugagauggagucuugcucuguugcccaggcuggagugcaauggcgcgaucucggcucacugcaaccucugccucccggguucaagcaguucuccugccucagccucccaaguagcugggauuacaggcgcccgccaccaugccuggcuaauuuuuuguauuucuaguagagacgggguuucacuauguuggccaggcuggucucgaucuccugaccucgugaucugccagccucggccucccaaagugcugggguuacaggcgugagccacugagcccggccuuccaacccaccaguuuuuuguuuuuauauauggcaguguuuuagacaccaguguuccugcagcucuugaaagugcuuuuaggagauuguaaccguagccuaugaguugucaggguauuguaacuaguuagagugagaauuuggcuuugaaaagaacaauuucucaccaguacuugcucugagcauugacaacagucucaaaccucaagauccaacugaugaucuaccuguguauuuuacccucuuuuuuguaagaugcugucugauguuauagaaccacagugcuccugggagaaggagaagcugguaugaaacaguaucuagagugaggaucugugguugcugugugguagccaacugcugacauaguuggguaauuugcacuuuaguggaaacauguaaugcacaggugaacaauacugucuucccauagaaaggauggcugggaagaggucacuggauagaauaguaaucuuuuuuuaggucccucacuaaaucaauuauuuuauauccuuuuucaguggaaauaugaaagucuuaaauuauuaaggagggaugauaucugucuaaaaggaaggauuaauucuaaauuuucucaugauugcugggaaauuuggagagauguuaauuuguggauaaugugaagaucagugauuuguccccuuccaccacaggagccaacuucuggccuugggaucauucuggacaguguguguggaauguuuccccaccuucucuccccacuccugcaacugcuccgagcccugguaucagggaaguccacagccaaaaagguaaguugcuuagucagauaaguaaagagaaugggagauucuuuauggagacuuuauuaggaaucuuuuuugcuuuccacauugcaguucuacugccaugacaaaaguuugucugaaggugaaugaaagauaccaaagauagcaccucaauucuaaaaaauuaaauaaucuuuucauuaaguaccuauuguagauacugugggacuaagacuaaguauaaaguuccuuaauaucuaguuggaaguuacuagauauaagaaauaaauagcuaagagccaggugguacagaguaaaugucauuugagcaauaaagaccauacuguucaggagagauaacugcccuuguggagugauggggacuugaguugaguguuaaagcccagugaagauuuggcgaggggcgcagaaggcaguuccaagaacagucacaguggugggcuugcaagaaguuugagagucugguugaaagagcagacugugggaccucuccuugcuuauccuggagggaaaugugugaugguuuuuucuguuuuggcagguguauagcuucuuggauaagaugucuuucuacaaugaacuuuauaaacacaagccucaugaugugaucucccaugaagauggaacucuuuggcggagacaaacacccaaacuccuuuauccccuuggugagauaaagagaucccccuuuuaugacagcuuuuuuuuuuuuugaugucuugcucugucacccaagcuggagugcaguggcaagaucauagcucacugcagccucaaauucuugggcucaagugauucucccaccuuagccucccaaagcacugggauuauagacgugagccaaugcauccaggcaguuacacucugaggcucacaucuguaccaggugcucaaagaggaaaauauacagggaauagccucaccguuuuaauccuggcaucaucaccacugacuucuccagucaucuaggcacuaacaguccuaugagguacuguuguuaucaucauuugaauggaaaacuguucuuugcacucaagugauuuucagacauauagaaagagucacuugucggccagguguaguggcucacgccuguaaucccaacacugggauuacaggccaaggugggcggaucacgugaggucgggaguucgagaccagccugaccaacauggagaaaccccgucucuacuaaaaauauaaaauuagucgggcgugguggugcaugccuguaaucccagcuacucgggaggcuaagacaggagaaucguuugaacuugggaggcagagguugcagugaguugagaucgcgccauugcacuccagccugggcagcaagagcaaaacuccaucucaaaaaaaaaaagacacuugucuacaugacaagaacuuuuuuguguauuuuaguugaaaaagcuuuaggaauguuagcuacuaagaagaaagccugugaaucccagaacuuugggaggccaagacaggcaaaucacuugaagccaggagcucaagaccagccuggucaacauggaaaaccccaucucuacuaaaaauacaaaaauuagccaggagugguggugcgcaccuguagucccagcuacuugggaggcugaagcacgagaaucacuugaacccaggagguggagguugcagcgagccgagaucgcgccacugcacuccagccugggcaagagggagacucugucucaaaaaaaaaaaaugucugugaguuuguguaucucuguguguuuaaaauauugaugucugguagaggaguuacauuuuuuauuuauccucagauauuagacuaauuuaucuuucucucucagggggucaaaccaaccuucgcauaccucaaggcacugugggccaaguaauguuggaugauagggcauaccugguacgcugggaauacuccuauagcagcuggacccucuuuaccugcgagauugaaauguugcuucauguuguuucaacugcagguaaggucagcuuucggaaacaucaccuacgaggaggaaaaguggauaugcuuggaggauuuagaaaauagaauaucuacauaaaauuuagaaccaucaagauugugauuugucugauuuguguaucugggucucagagacuguucagugaucuuaaagggguuguuugccgugaggucacaggcugucuuucuucucagaugugauucagcacugccagcgagucaaacccaucauugaucucguccauaaggucaucaguacagaccugucgauagcagacugucuccugcccaucacaucucgcaucuacaugcugcugcagcggugagucugucuuggcugacccucagcugcccaguagagaucucagcacuugugcccucaguuugcaggaaccuggacacauacccacuggguuaaaguucgcgcauauuccuugguuuuccuguuuuuauaucugugaggguuuuccuguuuuuauaugucugcugaggggagagacuggggagagagaaguggaaaaauguuugugagggaaccaguuguauuauuugcuuuauugaguauaguguauuguucuccaaccagguuaacgacagugaucuccccaccuguggaugucauugcuucuugugucaacugcuuaacuguuuuggcugcccgcaauccagcaaaggugagaugccagaucuucccaagagccaaaaauguagcacuuggcacauaccugaagauaugugggcauuuaacucuuccuuuuccuucucaggucuggacugaucuucgucacacagguuuuuuaccauuuguggcccauccugucuccagccugagucagaugauuaggugagccaaguccuaggguggugggccauauucccuagugagaaccacauaugucucagaucuagccuagguuuauuaauuuuauuuuuauguauuuguuuguuuauuuuuuugagauggagucucacucuguugcccaggcuggagugcaguggugcagccuccgccucccauguucaagcaguuguuguguuucagccucccgaguagcugggauuauaggcucgagccaccacgcccagcuaauuuuuguauuauuuauguauuuauuuacuuuuuuuauuuuuugagauggaguuucgcucuguuaccgaggccagagugcaguggcacgaucuaagcucacugcagccucugccucccggguucaagcaauucucccaccucagccuccccgguagccaggauuacagaugugcggcaccacgcccggcuaauuuuuuguauuuuuaauagagacgaggucuuaccauguuggucugacucgucuggaacuccuggucucaagugaucugcccgccuuagccucucaaagugcugggauuauaggcgugagccaccgcgccuggccugauuuuuuuuuuuuuuuuuuugagauggaguugcgcucuuguugccccggcuggagugcaauggcgugaucuuggcucaccacaaccuccgccucccagguucaagugauucuccugccucagccucccaaguagcugggauuacaggcauucaccaccacgccccgguaauuuugcauuuuugguagagauaguguuucaccguguuggccaggcuggucucgaacuccugaccucaacugauccgccugccuuggccucccaaagugcugggauuacaggcaugagccauggugcccggccgagagcaagagagauuucuuauccaacaucaaucacguuaguaugugagcauuuacuuuccagcccagaaaauccagagguuucuagauucagggacuuggugucccguuauuaagccacaaucacucuguacuuuuucucauuucauggguucucgagcucagccaguagaccacuuaccaguacacaggcuccaucuuacuaccugagcauucucgccuugcugucucuugacaaaaauguuucccugauguuccuuugauuuuuuuacuuucaaucuagguuuuacaucaauaaaacauguucuuaauguuuacccuggguacagaacugucuugauuggauuauuuccacuggagagcuuuucuauuuuauauucaagucaucuagacuauaacaagaaugcucuaugauuaguuucuugaaaccuugaaauuucccuaucauuuuuuuucccucuacuucuuuuuccagugcggaagggaugaaugcuggaggguacggaaaccucuugaugaacagugaacagccucagggcgaguaugggguuacuauugccuuucugcgcuugaucaccacccuugucaagguacagucugauuuuguucacaaagggcagaaaaagaaaagguccagucuugucagaugacucugaaauaguuucccuggccccuggugcuguaaucuucuugucuguaggcagaauagucaucuugaaguuacagugacaacaguuucuauguauugaguaccuaguaugugccaguuauguacucuauuaggugcuuaauuaugugaauuuauuuaaugauuggaagguuuaugaaguagaauggaagaggccaaaaggguauugcaguuacuaucaagcuauuuugacaguaaccugggauaauaucauaucccaguauauauacauguguguauauuccugaagcaaaauuucacaguuuauuucacaacauuuauucuuaccacacaaguuguacccugauauuuucuauucagucuccucccuauuuaagugaauuuugaccauagacugaucucauaaucuacuaauggguuacaacucgguuugaaaaauacugacauagagcauaaauaaugacauagagcauaaauuuuggagucagaauuagguuuacauucagguugacagcuuacuagcugcaugaccuugagcaaguaaagaauaucuuaagagucucuaaaacagaaugcuauauggucucuaccucaugggauugagaagagggucaugcaugaaaaaaacuauacuuccugccugcaggaaucaaugaaugcuuaaaaagaaaugauuguaggcugggugcagugauucaugccuguaaucccagcacuuugggaggccgaggcggauggaucaccugaggcugaucaggaguuugagaccagccuggccaacauggugaaaccucaucucuacuaaaaauacaaaaauuagcugggcguggugguggacgccuguaaucccagcuacucagugggcugaggcaggagaauugcuugaaccugggaggcggagguugcagcgagucgagaucacgccauugcacuccagccuaggugccaagagugaaacuccaucuugggggcgaaaaaaaagauugcauauagagauaggaauauauagauauuuauauauaacuaaagaguccccauuuuuaguagaaggaugcuacaguuaacagauaucauuggguaucagauuuuugcauaucagaucuccuuucuaguauuucagugaugggauugagguuagggacggcuggcaaucaugauagugaaguggcauuguucaucaucagcaauccucuauccuuuauguuuaaggugccucccuucuguccagauuuagccugcaucccuuuucuucguguuggugccuuuugugacauucucuuucaucacuuuuucuauucuagaaaagacccacaacuugggcucaacuauaaaguaggacuuuugauguuucuuuuuuuucauugaugaccaagguuugccuagauuuccuuuggaccuaucuaugguuuuggaauuaaaucucuagguaacuaaaugacuuuuccuuaaaugugcggaaguccucacugcaugguuucuuguaggggcaacuugguaguacccagagccaaggacuuguacccuguguaauguuugugcugaaggagaugcuucccagcuaccauaaguggcgcuacaacucucauggagugagggaacagauugguaaggacagcaugggcagggaagaccuggggauuucuggccccacuggagagcuuuuuucuuucccuuucuugagauaaggggucauuucacaaggccacaucauuccucugucuuuucuggaguccagguugccugaucuuggagcugauucaugcgauacugaaccugugccacgagacagaccugcacagcagguaaugaaggguugauuacuagagcuuggugcucgccaaggcaagacacgggcuuuugcugugcaaagccgucucaguucuuccagagaauuuaccuugcuugagcccagaacucaguaaucuugagguuguuaguugcuuuccauuggccuguuuaucauuucucacuguggacagagaaguaggaaugagagagagagagagagagagagaguguguguguguguguguguguguguguguguguguguguguguauguguauacauacacuaauauauuaaucauucuuuaugaucguuacaaaaguucauuccugacgagacacucuucauauauaucugcaucccagggccaguuacuauguauucuugguuuuuuccucuuucuguauugacuguaacuuucuuuccaugcuacugcuuauagaugucuuauuuuaaugguucuaugcauuccaucauauggauuaauuaugauccuuuucaguagcuguaucuguuacuugauggacauuuagauugcuucucagggugaucuuuaggugaucaagucuguuucaggaaagugaucagagugccuucagcuugcagagagcuggucuccaguguccaguagguuagguuagccacccuagccuaauuggacaaugcccuuccuuccaagauacacugaguggcucccugguaacucagaauaccucugucuuccagucauacucccagccugcaguuucucugcaucugcagccuggcauacacagaagcaggacagacaguuaucaauaucaugggcauuggcguggacaccauugacauggugauggcugcucagccucgaagguagggcuccuucuccacguucccuuugucugucuuuauugugccugcauguuacuaauaacuccaguuuaaguuaacuugcaguagcuuuuagaagacgacauuguucuuccuaggacauagccuuuacauacccuaguggcugcuguauagauuggcguauagcaaagggaguugauuacuccuccucucuccuaguuuggacuggggccucuaacagaagcuguugaacucugggauuauuguuggaaucuaauucaugagagcacauauauugcgaaugaagucauacugucugaaucaucuuugguuuccauuuggcacccuagugauggggcagagggccaggggcagggccagcugcugaucaagacagugaaacuggcauucuccgucaccaacaauguuauucggcugaaaccuccuucuaaugugguguccccccuggaacaggcucucucacaacaugguauguauuucucuuccagucacaacaugguauguauuucucuuccagucauuuuugcucauaaauacguaucuuaggcaguguuuuuggaugucaacaguauuuucugcuucuugaggaaguuugggaaugauuaccagcuccuuuccugaaauuggaaacaaaaggacuagaugguacuuuauuucugccuccuauugaugauagaauaauaguuaagaaugcagauuugaagucagacugccuugguucaaauuuuguauccaaucaacugugugaccuuggguacguuauuaaacaacucugccucugauuucucaucuguaaaauggggauaaugguacagguugaguaucccuuaucugaaaugcuugggaccagaaguguuuuggguuucagauuuuuuuuucauauuuuggaauaguugcaguauacuuaccaguuuagcauaaauccaaaauguuccagugagcauuuccuuugagcuauaguuagagauuuugacacauuccagauuuuuuuuaauuuuuuaauuuuuuuuuuuuuuuuuuuuuuuuuuugagacagucuagcucuguugcccaggcuggagugcaguggcgcaaucucggcuuacugcagcaucugccuccuggguuuaagcaauccuccugccucagcuucccgaguagcugggauuacaggcaucugucccacgcccggcuaauuuuuguuuuguuuuguuuuauuuuguuguuuuguucuguuugguagagacgagcuuucgcuauguuggccaggcuggucucgaacuccugaccucaggugacuugcccucuuuggccucccaaagugcugggauuacaggcaugagccaccgugcucuaauuugagguuuucagauuauggaugccuguaguaucuuccuaauaagauuauaauaaagggcugggcaugguggcucacgucuguaaucccagcacuuugggacggugaggcuggggaggauacuuugaguccaggaguucgagaccagcuugggcaaaauaaggagaccuccaucuauaccaaaacaaacaaaaaaaaguagcugggccugguggcauaugccuguggucccagcuacucaggaggcugagguugggggauuguuugaagcuuggcaggucaaagcugcagugagccaugauuuugccacugcacuccagcuuggacaacauagugaaacccucucucaaaaagaaaaaaagauaggcugggugcaguggcucacgcuuuuaaucccagcacuuugggaggccgaggugggcggaucacgaggucaggaguuugagaccagccuggccaacacagugaaaccccaucucuacuaaaaauacaaaaguuagcuggguaugguggugggugccuguaauccuagcacuuugggaggccgagguggguggaucacuugaggucggguucaagaccagccuggccaacauggugaaacccugucucuauuaaaaauuuuaaaaauuagcuggacgugguggugcacgccaguaaucccagcuacucaggaggcugaggcaggagaauugcuugaaccugggagguggaggugcagugagucgagaucgugccacugcacuucagccugggugacugagugagacucugucucaaaaaaaauuaauaaauaaauaaaaauuaauaaaauaagcaccuauuuuauucaaaauguaucuuugcugucgaugaguuggguugaacuguuuauccccaaauucugacuauucuuuugcuccucaaucaagagaaggauacagccaccuagguuugcuguggcccuccaaguacuugaggguaaauuccuucacauacacacugugggucuuuuuugaacagucagugcucuaaggacuugaauuaggcacacuugauaucuaaacuguuuccugugcugcuuuaggugcucauggaaacaaccucauugcuguucuagccaaauacaucuaccacaaacaugacccugcuuugccacgucuugccauucagcugcugaaacgucuggccacgguaggaucguacuucaugcacacacacuguuuauaugaggguguuuuuuucccccugauuacaaaagacaugcucaggccacgugcagcggcuuaacgccuguauauaauuccagcacuuugggaggccaaggugggaggaucauuugagcccaggaguucaagaccagccugggccacauagugagaccccaucucuaauauagaaaaaaggagaaaaggcugcgugcgguggcucaugccuguaauuccagcacuuugggaggcugagguggguagaucacaaggucaggaguucaagaccaaccuggccaagauggugaaacccuaucucuccuaaaaauacaaaaauuagggggccgggcaugguggcucacgccuguaaucccagcacuuugggaggccgaggcggguguaucacagagucaggagaucaagaccauccuggcuaauacggugaaaccccuucucuacugaaaaauacaaaaaauuagccaggcauuauggcaggcgccuguagucccagcuaauugggaggcugaggcaggagaauggcaugcacuagggaggcggaacuugcagugagcugagaucgcgccacugcacuccagccugggugacagagcaagacuccaucucaaaaauuagccaggcgugguggcaggugccugugaucccagcuacuugggagccugaggcagagaguugcuugaacccgggaggcagaaguugcggugagcugugaucacgccacugcacuccagccugggcgacagagcgagacuccgucucaagauaaaaggagaaaaaagacaugcuuauuguaaaauauuuauuuaaauguuacaaauagauguaacagaaaguuaagaugcccuaugaucuccuuauuccaagaaucccuaugggcagggggauaugccaugcuccagauuucuuuuuuuuuuuuuuuuuuuugaaauagggucuggcuaugucuccaaggcugugcuccacauuucuuaucuguguucuuguauuuuaaaaaguaucggcugggcgcuguggcucacaccuguaaucccaguacuuugggaggcugaagcagguggaucaugaggucagggguucaagaccagcguggccaagauggugaaaccccaccucuacuaaaaauaccaaaauuagcuggguggcaggugccuguaaucccagcuacucaggaggcugaggcaggagaaucgcuugaaacugggcaacagagguugcagugagcugagaucacaucacugcacuccagccugggcgacagagugagacaccgccucaaaaaauaaaauaauaaagguauuuagggcugggcgugguggcucaugccuguaaucccaggacucugggaggcccagguggguggcuugccugagcucaggaguuugaaaccauccugggcaacacggugaaaccccaucucuacuaaaauacaaaaaaauuagccggguguggcugcgugugccuguagucccagguacucaguaggcugaggcaggagaauugcuugaacccgggagguggagguugcagugagccgaguucacaccacugugcuccagccugggcgacagagucaaaaaaaaaaaaaaaaguauuugaguguguacuuuuguucuugauaaaagcagaauuccugguacuguuuuucuuucuuuuuuuuuuuuuuuuuugagacggagucucgcucuguugccuaggcuggagugcaguggcgcgaucucggcucacugcaagcuccgccuccuggguucagccauucuccugccuuagccucccgaguagcugggacuacaggcgccugccacugcacccggcuaauuuuuuguauuuuuuuuaguagagacgggguuucaccguggucucgauuuccugaccucgugaucugcccgcuuggccucccaaagugcugggauuacaggcaugagccaccgcgcccagcccuuccugguacuguuuuuguuuugagacagucccacuccaucacccaggcuggagugcuguggcaugaucucacugcagccuccacucccagguucaugcgauucuccugucuaagccucccagguugcugggauuacaggcgcccacuacaacacccagcugauuuuuuuguauuuuuaguagggacgaaguuuugccauguuggccaggcuagucucgaacuccugaucucaagugaucugccugccucagccucccaacaugcugggauuacaggcgugagccacugugccuggccccugguacuguuuuaugacuggcuuccuuuacuugauaccauaucaggcagucuugaugugcuucaugccacauaggcacauuuggacuuccuucauucuuuuuugucuuuuuuccuuuuuuuaauuuggacuuccuucauucuuuuuaauguuugcauaucacauccuagaauggaugcauccugauuuauuugcgcuacuuucugucuuucacuauuacaagcagugcugcagugaacauuauuaucccuaccacccuguaaacauuuguuuacaguuccaaagauuuauguagguauaaaugaacaugauauuuuuuauuagauauuuccaaauuaccuuccaaaaaacauuguaacaguuuauacuuauaacaccaaguauucuaucguugcugcaaggucuucaucauuguuuagucuuugccaaucuaauaagcaaaaaaauguuucacuuuucaguuuguauuuauuuaaccaugagggaaguugagcauuucuuuauacugauuacugucuuuccugugaauuugcgggcaucucaugcuuguuuguggugaugucccuuuuagcccagagcuguagucuggaugcuucccuuucugccaauuuucugggagcucuucagugcccuucugugggagcccauugagguuuuuguggaagcagagcucuaagccuguguguuccggucuccaccagguggccccaaugucaguguaugcuugucugggcaaugaugcggcugccauucgugaugccuuccugacccgauugcagagcaaaauugaggacaugcgcaucaaagucaugauucuagaguuccucacuguugcaguagagacccagccaggccucaucgaacuguuucugaaccuggaaguuaaggauggcagugauggcucaaagguaagccuguaaccugggaugacacugggaguuggcucacugggaggcagaugcugggcucugcaaguacagcugcuggcaguggcuguggaacugaacucuuaccugucccuucuugcaggaauucagccuugggauguggagcugucuccaugcagugcuggagcugauugauucccaacagcaagaucgauacuggugcccaccccugcugcaucgugccgccauugccuuuuugcaugcucuguggcaggaucggagggacagugccaugcugguccuccgaaccaaguaagucugccucugggaguaguuucauuguucuggucuauaaaaugggaguaauaauagcucuuaucccagagguuuguugugacaguucacugggaauaagagugcuuaguccugguucaauaccugggaguuuuacacuaauucucuuucuaaugcugcugcaaguauuaaggaucuuuaaauauuaagcaccuggaagguucaguugcuuuuguguuccugccuuuugcuaacuagcugcaucaaaacucauuauucuugagaaacaguagauucaggagagaggcgcuugcucaagucacuggauugaaugaaacauuccguucuauuggaccugcuggcacaaagggaaggaguguuaaaaggcuaaauuugggagucugcugucuuauuucccucccuccucuucuguggggcuuuugggaaucuacaguggaaggaaucuugaagaguuuuuauugaucaacucuauaaugcauaagugugauucaugagaggaaaauguaauuuuaucuauggaaaccuuucauuuauacgggaacaacugacuuaucagacacauauuaggauugagacugguaaaauaugaagugaccaccaaagggagcuugagagaggagaaaaugacugugagagggaaaaaguuaugauuucaaacauuuauuuccuuuuuagacccaaguuuugggaaaauuuaaccaguccgcuguuuggaacccuuucuccucccucugaaacaucagagguaagcuguggcagagggcaggaugguggcuacaagucccuuggaggaaaggcugugggcugugagauggggccguagacaaugauaccuccccuaauuaaacaacagaauguucccuucacuagaaacgucuuucucagggaagugccagcuuucugucccuuugaugucuugcuuugggaaggaaagugguuugcgcuacuguguguugguggcucuguggucuucuccauucaguuggagacguuguggaccugacgccucugcucuugcaagucaggacauucacauucaacagggguugugcuaacuuguucugcaaguguugggccccugcucuguucccuguuugauauacugggggagaucagugaucagagaugugauaauugccuguucugcuaucuccacagcccagcauccuggaaaccugugcccuaaucaugaagauaauuugcuuggagauauacuauguaguaaagugaguacuuuccccucuugagauuuuaacugaagguugggggagugggaguugguggccuaccacugggugcauggcuggaagagccaaggcagaggagagaacugguuuggaaccauucauggaaggccagugagcuguguuccuggccaauccaccgauggcauuuaugauugucagaaagaguuauugugaagcaaacuccaugcaacugggauuuuauggaggaggaauccuggaaaggccucagccuaacccacacguuggagguguccuggagccgucugccuuuaagcccaugcaaggucguuuucucugccucaacaagggucuguacccauuauauucccaucugcuuucaaaaucuaacuggagguuuuuucuugacacuguagggguucauuagaccagucauuaaaggauacacugaagaaauuuuccaucgagaaacgcuuugccuacuggucaggguaugucaagucauuggcaguucacguggccgaaacagaaggcagcagcugcaccuccuuguuagaguaccagaugcugguguccgccuggaggaugcuucucaucauugccaccacucauguaagacccuuuuggggagaguuuucacuuugguaccuuagcaaugauguguugacaugagccuagcagauacagcuccuugugcggaagaauuaaucaggguuuaucccugagagcuaaacuguaauagguucuaugcugagagauugggacugugggguauuugaggguguuggguccaggagaccauuaagaggaaugcagagaagugauuugaaauccuuucagaguuccuaaagccuccuguaccucccuuaggccuuggcugggucuuagcugcucccuggcugcaucugccucuugugcaaaggcauaacugucuucucgugcuguguaccuuguagaugcuaggucaauaaauacuuguugacuagucagcagggagcugugacagcugcagcagcacccucucuaaaaagcaguuugucauugguucuagaaacugcauuuccuggucuuagaaaaagaacagaggccauugucucuguacucugucuacugggaguugguuuugagagagagagauaacaucuggaagaaaugcauuguucuuggcuuuuuugugguuugacuccgucacgcuguaucauaaggacuugguauugaaguguucuuucuugggguauccagauuaauuuuuuuuuuuuuuucuugagacggagucuugcuccgucacccaggcuggaaugcaguggugcgaucuuggcuuacugcaaccuccgccuuccggguucaaggaauucuccugucucagccucccagguagcugggauuauaggugccugccaccacgcccagcuaauuuuuguauuuuucguagagaugggguuucaccuuguuggucaggcuggucucgaacuccugaccucaggugauccacccaccucggccucccaaagugcugggauuacaggugugagccaccacgcuuggcccagauuaaucuuuugacuucaugaacaacuucagcuugauagaugccuccuuuuuccaagcaccuccuacaucugugaaauuuguugccuagugccagacugcccacaugcuuggagcuuugagccuaggaggggcagguuuguggcuacucuugcuguggcauggugguuuuggaccccuaaggcuccaaacacacuuaaaggcucaccugucuuugagaaugguugauuccccaggguauaaccuuuaugucaccugccuuuuaggcccuaguuaggcagcaguucuugaauuguagcucugaaaaucccaccauccucuuuccccaaaggaaaccuaucuggcucucugucucaccugucuaccuauacaaaagaaaagaaaaaaaaagagaaagaaaccuaaguccaggauguuggucacccauucauucucuuaauggcauuaguggaacgcuuccaggcauugagaugcagcagugaauaaggcagauaagaucuuugaucgcauagagagugcccuaugauggaggagguaaauuauaaacaaauuuagcaauaaaaaauaugguuucagauagugauaauuugcugugaaggaaauaauuaaagugcugugguaaugaacacaugagauagaaguagucaggguggccuucucugaguggugaugucccagcugagagcugaaugugugaagaagccuuccagguggagcccguggaggagagaagucuaggcagauggacuugcaagugcaaaguuccagcaguggaaaagagcuugauauguucaugaaagaggcaagcaggguuggacuagagugagcacagaugggacugauacuacaucaguuggaccagauccuguggggucuuuggaccauguugaagagcuugguuugcguuucccgggcacugggaagccuuucaaggauucuaagcagagggaggacagagucucaaagaggaggugaaccugggcuugauucugaccauaucuaaggguugacagaagaacagcagggccuucaagcccuauuuuacuuuauuuuuuagggaacaggaucucacuauguugaucagguuggagugcaguggugcaaucauggcucacugcagccucaaccuccagggcucacgugaucuucccaccucagccucccaaguaacuaggacuacaggcaugcaccaccauacccagcuaauuaaacauuuuuuguuguuguugagauagggucucaucauguugcccagacuauaagcccuauuuuauuuuauuuauuuauuuaagacggagucucucucugucgccaggcuggagugcaguggugcgaucucggcucacugcagccuccgcuuccuggguucaagcaauucuccugccucagccucccgaguagcugggacuacaggugcgcgccaccaugccuggcuaauuuuuguauuuuuaguagagacaggguuccaccguguuggccaggauggucuugaucuccugaccucgugauccgcccaccucagccucccaaaguguuaggauuacaggcaugagccaccacgcccggccuauauaagcccuauuuuaaaucagggagacuguuuuaccaaugacuaauugccuagcagaggaccccauguuucuuggccucuaaaaucuggaaaauuuucccagcugaaaccuuuuucuguuccuuugcaggcagauauaaugcaccugacugacucuguggugcgucgccagcucuuucuugacgugcuugauggaaccaaagcauuaguaagugugucugggagauuuuacauuucucccagggagguugucuuugaagucaaauagcagaggucaugagucugccagccagccgcacaaauagucaggucacagggcucacguuggccugggaggccugagacuguagugggucagcagagcucugcugcugccaugccaacccuggcuucucccccuccacuccacuccugugagcucacugcuggggaagaaaggcaaugaggccggaggugcccuguggauggcaugcgaaucuuuccacugacuucugacuggugugcugucuccuuucagcuccuaguuccagccucagugaacugccuucgccuuggcuccaugaagugcacucugcugcuuauccuccuccggcaguggaagaggugaggcugugccaggagaggcaagcccgaggccagagccuucuugucagugccugcuugccuuccugaaagggagaaauaguggguggaagcugggcugguuuuccaucuugaggaaugggagugacauagcagauaggagggugaggcagacugguggauauccugagauggagcaggggcaguguguggccuuuuaugagguauuuugucucacuccccaccccguauucuuuuuuuuuuuuuuuuuugagacggagucucacucugucgcccaggcuggagugcaguggcgcgaucucggcucacugcaaccuccaccucccagguucaagugauucucgugccucaaccucccuaguagcugggauuacgggugcgcgcuaccaugccuaauuuuuguauuuuuaguagagacaggguuucaccauguuggccaggcuggucucgaacuccugaccucaggugauccacccgccuuggccucccaaagugcuaggauuacaggcaugagccaccacgccuggcccacccaguauucuuucuagagaguuagguucuguggaugaaauccuuggacccuugacggagauccuggagggagugcugcaggccgaccagcaacucauggagaagaccaaggccaagguguucucagcauucaucacaguguugcaaaugaaggagaugaaaggugaggggcagaggcagggggagcagcagcugcagucugcccacuccugcugacagccaggcagggcuuccuucagcuuagggccacacauuucuucugggacuuuugaguuuccagucauggaauucuuaccccaagaaagcuauuuuuuucccucaugugucucucccuccucucccacuggacagaugcugucccuccuagcgcccuaguacaucuccagccccuuccuaggaaggaaaccuugguguacagugagaguuggccuggugagcaugacagugucccucccugucuauucuacaguaagugacaucccccaguacucccagcuggugcugaaugucugugagacccuccaagaggaagugauugcacucuucgaccagacccgccacagucuggcauuaggcagugccacagaggacaaggacagcauggagacugacgacuguucucggucccggcacagggaccagcgugauggggugagacagugcccuagaaggccauccguccuuuccacugcccgccagcucugugccugacucuggggauaaguagugaucaagacagauagucgcugcacuucuggaguucacggccuggugggaaagguuaauagaucagacacugcagaaaagcagaagcagcccauuguacugcaggagagaagugcagggagaacuuagucucacuucugacuugaacugggacuuaggugccuuuucagcaaugacuuagagauuguagccgcgggcaaaugcaggauccgaagugaaauaggaaaugauguaaggcuuuuaagcaggggaaaaaguugaucugauuuuuacucuagaaagaucacucuggacuuaaacuccaggccucaagccauccucccaguucagccuuccaaaguguugggauuacaggcgugcccaagaaagaucacucuggaugcaguauugaauaguauuuuucaaauugugggaucaugaccuauuagagagagucuugaaauuagcacauuuuguuacaaccagucucgcucugucgcccaggguggagugcaguggugcgaucuuggcucacugcaagcucugcuucccagauucacgccauucucccaccucagccacccgaguagcuggggcuacaggugucugccaccacgcccggcuaacuuuuuguauuuuucauagagacgggguuucacuguguuagccaggauggccucgaucuccugaccucguaauccgcccgccuugaucucccaaagugcugggauuacaggcgugagccaccacgccuggccacaaccagcauuuuuuuaaaauaaaguagaauaaaguguuuaagaaaauaucacugugcuuugugugacauuaggguagguauuauuagugaaaaacuguaaacguguacaugaggauacagucuaaaaagucuuuaugggccgggcacgguggcuaacgccuguaaucccagcacuuugggaggccgaggcgggcagaucaugaggucaggagauggagaccauccuggcuaacacggugaaacccugucucuaugaaaaauacaaaaaauuagccgggcgugguggcgggcaccuguagucccagcuacucgggaggcugaggcaggaggauggcgugaacccaggagcggagguugcagugagccgagaucgcgccgcugcacuccagccugggggacagagcgaggcuccaucucaaaaaaaaugucuuuaugacucugggucauggccaaaaagaagguugaaaggccacugguacaaggauagauuagagaggauggagcaggauuauuuaggagaugguugcaguagcagagcaggagguggcaucgggcagggucguaggggucccucagacuccauguggcagaguugguuggaguguccaacaugagacgagguggcucugacaagggugguggcagugugggaggugggagggaagaggcggggguagcucuggucaguuuaggguugcucauuagauuggcuggaguugcugcuguucauugagagcuggacauaggagaggggcagggugggagagagugugcauucuguguuacucaagcucacuuagcaauguguguaaccaagcaggucuugggcaaccaggcccaccgcugccugucguccucuuccuccuccucuucuucuucccccuuuuacucaucuuugccucugggcagguguguguccugggccugcaccuggccaaggagcugugugagguagacgaggauggugacuccuggcugcagguaacccgcaggcuccccauccuacccacccuccucaccacucuagaggugagccuucgcaugaagcagaaccugcauuucacugaggccacauugcaucugcuccucacccuggcucgcacucagcagguaggaggccagcccgaaggcaggagggagcguccuugcuugccuggguggguucugacaaucccagaagcugugaucuagccugagagcccuaccuacccuaggcagggcaggggcaggcuccaucucauuuccugucuuucccuccucccagggagccacagcaguggcuggagcuggcaucacccagagcauuuguuugccccuucugaguguguaccagcugagcaccaacggcacagcacaggugagugucaggagcuugccaggaggcccagccugaccacccuacaguuccaguugaaaaguguccuccccuaccuuuccccggaaguugcuuuccucuaaauugccuaauacacugauggugaggaaucuucccugcccccaggcggaucucuagcaagagaaacucaccacuaaaaggcaccgccuggccuuugugcacuaccucugggagaugggauggauucuucccauugcaggugugaggaagacuaaaccagauugauaacacaucccuggaccaggccucuagccaaggcagcuguccucuccugucauucccaaagacagugugucauugugacuucuccaccccugcaccaccagaccaggacugggagaagggaaguggguggucugggggcuugauggggccucagcacccugcccucugugucccuugguuauuucuaguuuaacagauaccuccuaauuucaaaagaguagucuucaccugaaccucucucucucaugagagucgugaaguauuuggucaucuagcccagcuaccccuuagaggaaguauguaggggccagagcagggcagugacauguccagguucgcauagcucgucaguggcagaccugagucuggaacccugggucuugugucucagccuggugcucuuuccuugaaucugcugguguuggccccuuucuggcccugguggccagacaguggcugugucuauucugggagaucuuuuccuuucagcgcagcugggcugccuuaguugcuguacuacaaggagguccugccucucagcaggguuccugagcuugucugcuguuuguaucuuagacaccuagugccucucggaagucccuggaugcccccucuuggccaggagucuaccgccuguccaugucccugauggagcagcugcucaaaacucugcgcuacaacuuccugccugaggcccuggacuucguggguguccaccaggagcggaccuuacaggugaggggcugccugcauugcaggggugggaguuucaggguaaaaaagguacugggccauucauggggcagguggguguggagccugggccucaguagcggaggguugucgaugccuucauuuuugagaugcucuaaguacucugcuggcucacuggccagcuagucugcugaaggacgggaacggucucgggucagaauccugguuguaccacuaagccauuucuuugccaacucagcauuugggggccugggacguugccucuccacaggaggguagguguggguaugucaggucccucagccauccccaucuuucccugaugugugcuuuccucccagugccucaacgcagugaggacagugcagagucuggccugccuggaggaggcggaccacaccguggguuuuauucugcagcucucuaacuucaugaaggaguggcacuuccaccugccucagcucaugcgugauauccaggugggggcccaagauggugucuuggagucugggguaaugcuuggagacagggaggcugugaggucucacuggggcacuccuagugaauugcaggauguuccugaacgggggcuuuucccuuggggagcacaggguuugcugucaugugcuuacucuggcuaaauguuuccuuccauagucaagggcagccauguagguuaagaauuuggacuuuuaucaguuagaucuugguucagaucccuuaagaauacacuuggggccgggcaugguggcucacgccuguaauccuagcacuuugggaggcagucaggaguucgagaucagccuggccaacauggugaaacccugucucuacuaaaaauacaaaaauuagcugggcgugguggcacgugacuguaaucccagcuacucgggaggcugaguugggagaaucgcuugaaccugggaggcggagguugcagugagcuaggaucgaaccauuacacuccagccugggugacagagcgagacuccgucccaaaaagaaaaaaaaaaaaaaauggccgggugcaauaggcucacgccuguaaucccagcacuuugggaauucaaggcgggaggaucaugaggucaggagcucgagaccaggcuggccaacauggugaaaccccaucucuacuaaaaauaacaaaaauuagcugggugugguggcacacgccuguagucccagcuacucaggaucgggaggcugaggcaggagaaucgcuugaacucaggagguggagguugcagugagccgaggucacgccacugcacuccagccuggugacaaagugagacuccgucucaaaaaaaaaaaaaaaaaacuaaacuaaacaaaaccaaaaaaacacacacaacuggagcugggaaccagcuggagaagggaggggugaggaaggaacacaggcuccagagccaggcaggcuucucuuaucugcugguuguaugaccuuggccaagucacuuguuacuuguaaccuuuuauucuuuuccuauaaaauggaaucagccauaauccucaucuuauuuuauuuauuuauuuauuuugagacagaguuuugcucugucgcccaggcuggagugcaguggugccaucucggcucacugcaagcuccgccucccggguucacgccauucuccugccucagccucccgaguagcugggacuacaggcgcccgccaccacgcccggcuaauuuuuuguauuuuuaguagagacaggguuucaccguguuagccaggauggucucgaucugcugaccucgugaugcgccugccucgaccucaaaagugcugggauuacaggcaugagccaccgcacccggccucaucuucuuuacuuuaggaccuuacaauauaccaggcaccuagcugggucucagggagacaguccaguccugagcccugcuggcccaaguuuguagcccugaguacuuaguggcuauaggggcuuuaagcuggaaaguggccaggggagcaugagggaaggagggagagaaggggagcaugagggaaggagggagagaaggggagcaugagggaaggagggagagaagagcagcagcgagugaggagcgcauggguguuacauggagggcuauuggguuggucugguugggugacugggcugcugacaagagaauccgcucaucucuccugugucucucccaggucaaccuggguuacuugugccaggcauguaccucucuccugcacagucgaaagaugcugcagcauuacuuacagguaagcguccuaugccaugagguccuggaauaccucacgcuagcuucccaagcuccaccuucauuucuugacucuccuuagaacaaaaauggggauggccuccccucagcuguugcccagcgaguccagaggccaccgucugcugcuucugcugcccccuccuccucaaagcagcccgcugcugacacagaggcaucagagcagcaggccuugcacacaguccaguauggccuucucaagauccucagcaagacgcuggcagcccugcgccacuucaccccagaugucugccagauucugcuggaucagguacugcccaucaucuguucagcaccaccuccccuaaaggcucugcucugcuguguaccgagagcuaccuggggccuuaauuggguccuggauggcucuugucuuuucucgcagucccuggaccuugcugaauacaacuuccuguuugcccugagcuuuaccacucccaccuuugacuccgaaguggcccccuccuucgggacccuucuggccacagugaauguggcccucaacaugcuuggagagguaaguugguucugucagacacuguccucuccccccggcuccucccccugccugccacuucccagcugaccuugggcauguugggcaugguaccuagccucccaagccugcuccucucuguaaacugaacaugacagcaccucugagaauuacugugaggauuaaaugagguaacugauuaaauuugcuuagugcaggacaugcaaguaggaagcucucaguaagugggagcuguuccuguugucuuaguuuuuuacccuugcuucucuucagcuggacaagaaaaaggagccccucacccaggcaguggggcucagcacacaggcagaagggaccaggacguuaaaguaagugcucuuucugggauuugauaaggggcuggggcagucaugggcccacuguucucaagcuuggccagccuggcccucugcagcaguaccaaaaaccugugucuccucccaggucccuccugauguuuaccauggaaaacugcuucuaccugcucaucucucaggcgaugcgguaccuuagggacccggcugugcacccccgggacaaacagcggaugaagcaggagcucagcucugaguugguacggauggauagggauacggagggcuggaccaauagggccagagcccugugggguccugccuggcaacccccaagggucagaacaguagccagaugugcugagccucaccaagccacuuuuuuucuuguagagcacgcugcuguccagccucucgcgcuacuuccgccggggagcccccagcuccccugccacugguguccuccccucgccgcagggcaaguccaccucucucuccaaagccagcccugagagucaggagccucugauccaguuggugcaggcguuuguccggcauaugcaaagauagggcagugcuguucugcccaccuaccccucuccaccagccuacacugcacccuggcuggcaggggugcugcuggcugcuagggccuauacaauggagggcaccuccugucaccccccucccggaguagccacgacuccagccaccacccacugacguuauuuuuauacuagaugaagaggucaacagcaggcauggggagccgagucuucugugcucagguccucacgcugcagacgcccccuagaggaacuuuccuuccuuuccagcauuccccacagcacugccggccaggggagaggcggcagcccagcagagggcucuaugcacggguuucaaaccuguuuuccacacucugucuuugcaguuuugguaauucuguggucuauuuauacagauauuaaaaucuuguuuauagac

SEQ ID NO: 191190 - RNA, 8009 nt, Homo sapiens
cugccgcgcgccggaagcagccugggccgcugcgcagaggcgcggcggcuguacaacucggccguugucaccaugccggucguccggaagauuuuccgucgccgccggggcgacucggagucagaggaagaugagcaggacucagaggagguucggugcguuuggggcggggcucccauaggcuugguaaagauagacuuguuugggggacucaccaccggcucggcgcuucgcugacauuguuaacugugagcucggguggugguuccuucugcggacgcagaaauugaggcucaaggggugaggccaccgccccaagcucgaacgguugagagagaugccuccgggaugcgcaguggcucugacucccggugggucuaggcacaaggucguccucuggaccacugugcugguggcucaguagcugggcugggaugcccucgaaggugccuuauuggcucuguuagcuuuggauuccgcggggaaucacucagcuuaugcauugcugcuucuucuucuuuuuaaagauuaaaacuggaagagaccagagagguacagaacuugaggaagaggcccaacggggugagguggguaccacgcggggaggaggaggaggcggcggggacgacagacacauccgcguccgggucgcugucacaaauaucuccucagacguagauuuuucucuugacacacuguacaccuuccacugcccaacuuggagaacagcguucuuugcaaauguuuaaccaggacaugcccugagcugugucgucucggggugugcuccagagauacagaaacagaucacuaacucgcguuuuuuauuaaaaccaauuaauugugaaaugcauaucgaucguuaagaguuuguauaauuuagaaaaguauagucaagacgauaaaaagcacccauaauucucccauccggaaaugaucaguguuaacauuuuuuuuccuugcagagccacccaagaaugcacugguauuaauauugaauacucuuuccaaucuguuuuuuuucgucucucucucucagauugugaacaacuuucuauguacuuuuauucccuguucuuuucaacucauuaugacauugugggcauucacccauauuguggaauauuuuucagaaagccuuaauggcugcauaauauuccaccagauguguguauuguaauuuguuaacaaauccccuauuuugggacauguaggugauuuuguaaauuuuuacuaucaaauaaggcugcaguggauauucucuuaaauuuaucuuuagcugcacuuuccaugaugagaauaucuuagaaaugagauuuccaggccaagauaaugccaaauggcuuuacaggaaaguggcaaaguguaccacuucaccaccagcgcacccuucuuccagcaucugcggugcucguugagcccugucuuaugcuuauaggcuuuuccagccggcuugccuacccaccccucaaaucccacccuugcacuaauguugcaauccgcauaccugagaggguuccuccuuaucucugaauuaugccauuucucucucucccccucucuuuuuuuuuugguuuugcucagugcuguggccuugcuggugggagagaagguacaagaggagaccacucuagugguaaguuauggggucuucccugaguaguuauggcagcccucccugcagugcucuucagugagugagcgugcuucacaaaaaaaaaaauuccacuaccauguauuuagaugcuuccucuuaacuguguuugcuuucugcaggaugaucccuuucagaugaagacaggugguaugguggauaugaagaaacugaaggaaaggggcaaagauaaguaaguucaggacaagcuuagaugcaaauucaccuuuagcggcugccugggucuagguucccucagagagcuggggccuguagcagcagcauuaguaggacaucuugaagcagguuuugugcuuugcaaaggguguguuauuuaaaaacaaagaaagcaaaaagucuuuaaaaguuaacuuagagccaaguugguagacuccuuuuguaagaguguauuguaggcgugaugacucaugccuauaaucccaacacuuugggaggcugagguuagcuugaguccaggaguuuaagaccagccugggcaacauagugagaccccugucucuacaaaaaaaaaaaaaaguguguauguauacacacacacacacacacacacauauguacacacauauacacauauguauauacacacauguauauacacauauacacacacacacacacacauauauauauauacacacacgcauauauauauguguguguauauaucugggugugguggcaugugccuguagucccagcuauucaggaaauuaaagugggagaaucacuugagucagggagguugaggcuagagugagccgcgaucacaccacugcacuccagccugggugacagagaaagacccugucucaaaaaaauaaaauaagugaaccuauggggaaguuucauauaaaaacaauuaacaaaaauaauaaauucaggccagcugcgguggcucaugccuguaaugccagcacuucaggaggcugaggcaggcggauuaccugaggucaggaguucgagaccagccugaccaacauggugaaacacugucgcuauuaaaaauacaaaaguuagccgggcauuguggugggcacccguaaucccagcuacucaggagggugaggcaggagaauugcuugaacucgggaggcagagguugcagugagcugagauugcgccacugcacuucagccugggugacagagugagacuccgucucaauaaauuaauaaaucaaacauucaaauaauucaaaaauuaaaaaaauaaaaguuuacuguguacuuuugugacaacuauauagcauuuacauuguauuugguauuauaaguaaucuagagaugauuuaaagcagaugguaguguguguguagguuagaugcagauauuauacuauuuuauguaagggacuucacuaucugcagauuuugguauccuugagggacacuagaaccaaucccccauggauaccuaaggauaaguguauccacucaauccuuggagguaucacuagcagccaacaguuugcuugcauauauuucuagaguuucuuuucuuuacauauacuacggcauuuuuuuuuuuuugccaacuguaaauaggauauuauaaaugcuuaugucuuuguuuucuucuuagaacauaaaacucagccucauugaguugugacuugaaagcucugccucauuguucucucccuccaggaucagugaggaggaggaccugcaccuggggacaucguuuucugcagaaaccaaccgaagggaugaggaugcagacauguaagugucagucuguuuggcugugagcaguuggggcuggacuccagucagaguccaagauauuuagucaacagaugacauuucuagaauuuucuagaagaugucaaaguuggccccucucuuucuacuucccagcuuaagaacuuugaaaaccucuuaaaaggucuuuucaggccgggcacgguagcucucaccuguagucccagcacuuugggaggccgaggcagguggaucaucugagguggggaguucgagaccagacugaccaacauggagaaaccccgucccuacugaaaauacaaaauuagcugggugugguagugggcaccuguaaucccagcuacucgggaggcugaggcaggagaauugcuugaaccugggaggcagagcuugcggcgagccaagaucucgccauugcacuccagccugggcaacaagagugaaacuccgucuccaaaauauaaaaaauaaaaacuuguuuucaaaggugguuucaugacuaguaauauuuccccaaaacauugcagggauaaaacaugggcuugcccacuuuuuauuuugccaacaaagcuauuggcaaacuaucaucuuucugucuucaaagaaccuuguacaucauaacaccaauagauuagugggacauaaccucauagguuggugcuucuuuagaaaauuucuaacuugaugaaaaaacucaaguuauuuuuuuucucguuucuccauggacugucacuggucugcgggccaguguuggggaccacugauuuagaggacaccugguguguguuucccaccccucccugaggccucuggguuucucacuucaggaugaaguacauugagacagagcuaaagaagaggaaagggaucguggaacaugaggaacagaaaguuaagccaaagaaugcagaggacugucuuuaugaacuuccagaaaacauccguguuuccucagcaaagaagaccgaggagaugcuuuccaaccagaugcugaguggcauuccugagguggaccugggcaucgaguauguuugagaccccuaggcagaagacacagugcuuuccaguuaaaaguuaugggggacaggccaggcacgguggcucaugccuguaauccuagcacuuugggaggcugaggcggguggaucacgaggucaggaguucaagaccagcccggccaagauggucgaaccccgucucuacuaaaaauacaaaaauuagcugggcaugguggcaggcaccuguaguccagcuacuugggaggcugaggcaggaaauugcuugaacccugaagguggagguugcagugaggcgagaucaugccacugcacuccagucuggcgacagagcaagacuccaucucaaaaaaaaaggaaaaaaaaauuuaugggggacagguaugguggcugaugccuauaagccuauaaucccaguacuugggaggccaaggcaggaggaucacgugaggccaggagaucagccugagaaauauagucagacuccugucucucaaaaaaauuuaaaaaauuagcugggcugucacuugagcucaggaguugaggcuacagugagccaugauugcaccacugcacaccagucugggugacagaguaagacccuuuaaaaaaaaaaaaaaaaggccagacauggugacuugugccuguuauccuagcucuuugggaggccaaggugggaggaucacuugagcccaggaguucaagaccagccugggcaauguaaugagaccccauguucuuaucuguguccuuagaauccuacaaauacaaaugagauugucccuggcagguuguugcuagaaguuucgcugaaggcuugaucagaguaguaagggccccugacugcuggaagcaaaagugguucuuuagcguguuacagcuguucagcuguaucaggcccuuuauucuucuguuuucuucuagcaggagccauguuaaaggcucacucaccccuucuccccaugauccuucuuaaaauauccacuuuaaaagggaauuguuauggaagagguacaauuguuagaauaaucuucugguacaguagaaagcugggaggcuucugggcucuuuucuggccuuuacaaacuuugagccuuaagcauuuuacuucucugaagcucaauuugcucuugaucagaagagcagaguaacugugguucuccgacagccgugagagucccgugagaaugugacuacaagugugcuugauaaaguggagagcugugccccaggacacaugauuuucuuauguacugcugggcugccagccucaccacucaugucugaguaguaaggugcuaucaucuucuaaguggugugguuucuuucucuccauagugcuaaaauaaaaaauaucauuuccacggaggaugccaaggcccgucugcuggcagagcagcagaacaagaagaaagacagcgagaccuccuucgugccuaccaacauggcugugaauuaugugcagcacaacagauguaagccccucggagagcagucuugcccccauuccccuauuugggcugagaucccuaggaaccucauguucuaacguguccccuggucucuuuggguccaguuuaucaugaggagcucaacgcgcccauacggagaaacaaagaagagcccaaggcccggcccuugagaguaggugacacggagaagccagagccugagcgugagugcaacaaaggccucggggcugccuggagugcucagcaaugugggaacccauggaggcaggaugcagcgggggacaggguggagccuggcauuggagccggggcauauggguuccaguccaugcucuggaccaugacuaugugccuuccccuuucuaagccucaguuuccucauuggaauccuaauagaaccuaccuguuaggauuacucugagaauucauacucucucauauucucacgcacaguagagacucaagaaguuagaaaauuucaguaaggacaaauaaaagcuacucauaagguuagcugggugcagugccucacacuuguagucucagcugcuggggaagcugggacaggaggauugcuugagacuaagaguucaaggcugcagugagcuaugauuggaccacugcacucuagccugcgugacagagugagaccacaucuuuuuuuuaaagaaaagaaaaagguauuggccaugcucgguggcccaugccuguaaucccagcacuuugggaggcagaggcaggcagaucaccuaaggucaggaguucaagacgagccuggccaacauggugaaccccgucucuacuaaaaauacaaaaauuagccaggugagguggcaggugccuguaaucccagcuacucaggaggcugaggcaggagaaucacuugaacucgggaguuggagguugcagugagcugagaucaugccauuacacucuagccugggcaacagggugagacuccaucucaaaaaaaagaaaagaaaagaaaaaaaaaaagacaaauacguaucuacugaggcccuacuguguucacuggguuaggcgcuggggcuccuguggggaaggaaacaggcaguugucuuugccugcauggaguaaagucuagcaguggguuccagcauggcaaaccaccuuuccuguucuuuuccuucucaggguccccuccuaaccgcaagcguccugcuaacgagaaggcaacugaugacuaucauuaugagaaguucaagaaaaugaauaggcgguacugaguugugcagagugggauguaaauaucgccuuccucucccuauaucccucccaugaaaaauggcuuccuggccgggcgugguggcuccugccuguaaucccagcacuuugggaggccgaggugggcggaucaccugaggucgggaguuugagaccagccugaccaacauggagaaacccagucucuacugaaaauacagaaaaguuagccaggcgugguggcacaugccuguaaucccagcugcucaggaggcugaggcaggagaauugcuugaacccaagaggcggagguuguggugagccgagauugcaccuuuguacuccagccugggcaacgagcaaaaaacucugucucaaaaaaaaaaaaaaaaaaaaaaaagaaaaagaaaaauggcuuccaggacagagcaugcucauuugcuggcggacaguuccagaaacagacccuguuaguccuucuacuuaccugcuggauuuuucaagcacuaaauuuauaacuuuuugaaacaaaauaauguguaauuuuccauuugggggcaaacucuauucuugugagcauuauuaaaucuuguuuguaaauauauugucuuucucuuaauauuugcucugggucaggaagaagcuguucacggugugauaauacucuuuagauugugcuuucauuauuauagaugcaucaugucuucugcuuucacgugucugggauggggucagaaaugcauccuccagcugacagaaaaauccaggaugagaucagaaggauacugguguuuucugacuuuuacaaaauuacuuguuuguuuucauuaaaaaaaaagcauaaacuauguuucuuauuacuauuagaauuauuaaauuucaaaaugaauccaaccuua

SEQ ID NO: 191191 - RNA, 70099 nt, Homo sapiens
gcagaucgggagcggugccgagaaaaauuuccuuacuagaugacauuucaucgcaauguccgaucguuuggggcaaauuaccaagggcaaggaugggaaaagcaaguacucgacucucagccuguuugauaaguauaaaggaaaaucaguagacgcgauuagauccucagguaaggcccaggguugaaggccaguuccucaaacuuucuccgagugacauaucccagaaacccagagucccucaccugguuagacagaugugguccgugcacaccaggcuucugggugugcauguagaaucacucucuacuuccuacuugagguaugauuucagagccuugagcauccugacucuuucuguaguggaauuuucuccaucuauuaccuuauugaagcuggggagauauaucuauagauaucuauagauagauagauagauaucuaucuauagauaucuauagguguguguguauguguguguguguguguguguguguguguguguguauauauauguuuuggagacagagucucacucugucacccaggcuggaguucaguggcaugaucucagcucauugcaaccuccaccuucugggcucaagcgagucucuugccucagccucccgaguagcaaggauuacagaugugugccaccacgcccagcuaauuuuuguauuuuuaguagagaugggguuuccccauguuagugaggcuggucucaaacucgugaccucaggugauccacccgccucggccucccaaagugcugggauuacaggugugagccacugugccuggccaaagcuguggauuuuuauccugauggguagaaugggacuuaauaggcauuaguguuauccuuuuuuuuuuuuuuugagacacaguuucgcucuuauugcccaugcuggagugcaauggcgugaucucagcucagugcaaccuucaccuccuagguucaagugauucuccugccucagccuccugaguagcugggauuacaggcaugugccaccacgcccggcuaauuuugcuuuuuguuuuuuguuuuucuuuuuugagacggagucucacucugucaugcaggguggagugcaguggugugaucuuggcucacuguaagcucugccucccggguucacgccauucuccugccucagccucccaaguagcugggacgacaggcgcccaccaucaugccuggcuaauuuuuuguauuuuuaguagagacgggguuucaccguguuagccagaucggucuugaucuccugaccucgugaucggcuugccucggccucccaaagugcugggauuacaggcgugagccaccgugcccagccuaauuuuguauuuuuaauagagaugggguuucuccauguuggucaggcuggucucgaacucccgaccuuaggugauccacccaccucggccucccagggugcugggauuacaggcaugagccacugcgccuggccaguguuauccuuaauaaagaauuuuuuuuuuuuuuugagacggagucucacucuguugcucaggcuggauggagugcaguggcgcaaucucggcucacugcaagcuccaccuccuggguucacgccauucuuccgccucagccuccugaguggcugggacuacaggcgcccgccaucacucccggcuaauuuuuuguauuuuuaguagagacaggguuucaccguguuagcgaggauggucucgaucuccugaccucgugauccgcccgccucggccucccaaagugcugagauuacaggcaugagccaccgcgcccggccauccuuaaagaauuuuuuaaauuuuguuuuaaaauuuauuuauuuauuuagagacuggguuaugagacuggcuaauuuuuguauuuuuaguagagacaggguuuugucacauugcccaggcuggucucgaacuccugggcucaagcgaucuacccaccucggccucccaaagugcugcaauuacacgugugagccaccacgccugguguguuaucagccuuuuuagcuuucaugguucuugauauucuagaacuuguuggaaagguucuuguugauccuuuucacaccccaugaagacuucaugaaugucgaagggcuccuguucagucuuguuuuggaucuaggcagaggcugucccuuuaguccuguaaugagaccagagcugucucaacuugcagagaggugguuccucuguaagcuggagguuccugggccugucuccucacccauguuguaaagucugcgagccuuguccugcccaucagugaaauggaagccuuuuuacagguuuuagcagcuccuuugucccuguagucuucagugaagagcuuguaaagugacuaaagugacaccaaacacuuguuugucccacugcuggucugcccuuuguuuuuuguuggguuagcuuuguuaugaucacuuagagauugaaagaacagcugaaugcaucaggcuucuuuccuucugugaccuuuuugcauggugucuguuccaugucccucucccugcaguuauuccuagacauggcuuacagagucuugggaaaguugcugcagcccggcgcaugccaccgccugcaaaccugccaagcuugaagucugaaaacaaaggaaacgaccccaacaucgugauaguacccaaggacgggacgggaugggcaaacaagcaggaucagcaagacccaaagagguaaacggaggaggcggguggugagugggagcuggcgcuccaaggguggucccggcauccuucccuguggcaaacuaacccuaacccuuuggcuacugcagcgcuagucuugcaguggcagaauuggaacacugggagaugcaaaugaagcugcuuccucucuggcccuggugcuucguauguuucuuuuucccugccuucauuuuuucuggcuuuuagagccgauggagcagcacaucuguggacaaccuuguccccagugaccacuuucccccugugccuuauuaggaaaggccucaucaccccagaggagcuuaugcaaugacucagagccaauuccuguaagaaacacuguggacagagcuggggcuugaggacuucauuccuggugaugggugucccugugagcugagcucugcagagaaucaugcagcuucccuaaccaucggcccagcagcuucccagacagaggagacuucugcuguugcucuaaacagaccuagucaucagugagaacagcacagaauccuccaggaucacuguacugcagccucccuggaggcucaccuccugccagcacaguacuuacagaaacccuagggggcagaggguggcauggugcugucaaucagagaaacagccccuguguggugggcugaaaacacagggccuggcugccuggggcccacuuggauggcugcaccuuugucuccugcugcaaguccucucugaguguuuagccagugcuaagacaauucagggaaggggauguguucagggagggacagggccuugcugaggcuggcaggcagaaaucugcugcugggguuugccuguuaaggaaugugaacaaagcugucuggcggcagcgcccuccuggccugcaucucugguggccucccugcugauguaggaaaccagacgguaaaagggacccagaucucagccugcugaccccagcauccuuuucuuacaagucugugcuagaaaugaccaugguagcuuuuguaaaauuguugccuguauuuacuucagacaggauguagagagugagcuaguuuaguuauucagcuagaugauuauaaaguaguaaucaaaauagggccuuagaaguuauuuuuaaaacauuucuaagaguuugcuuagggaucauauugauggacaguauagcaugacuuuugaaaucuaccagcccuaagugguuuccagcuagaccacuuauuagcuugauggaaccuggagaauuguuugacuucugagccucagugucccccccuugaaauaggaaugauaccuggcuuugcuggugguuacacgguauccaugaggcauugaugggcuagcauaggucaagugcuuagccuaaaccuggcacagaggaggggcagauauuggcugcugucaucauuccauucaaaugguacucauuccauucacaccaugagcucuggaacgaaauggauauugcacauuuuaauggaaggacugaaauccucugcaccaccaaaaguucuagagaggacaaagcauuacucccuccuguuauccagccuuuacucugccuuugcggcuccagugagggcuaguugugcuggagcacguccgccagggaagaggugaggauggaguguuggugagggcauagacccccguguaguucucugcugccccaggccacauccucccaccaagguaucagguggcaagugggcccacaacguggggacucagugcuuaguuuuggagaacacaaaagugcgacuacuuggaagcuucucuuuuagguagaaggagauguaagaacccgaucaguagccuucuguuuguaauaaucacgaauggugaguugccugggucaggugaaucuuggaagagggugucuguauagaguuuggcuuccauuuacagauaagccacuuguauuggaggaguucccaccagggggguggcugcccuccuugaaucucguugagugaaaaguugccuacugugaccggagcgcugaguuagagcagaaaccuucauucggccauuucuuguugauuucaucacuucaccuguggaguguaaauucacugacacagccuuuuuuuggagggcagccuggcaaucauuuaaacuucaaaauaucuuuugauccagcauuuccauuucuaaggucguaugcuauggaauuacuuacagaaaaauggugcaaagauauguauuaaaaaaaauucuuggccgggugcaguggcugacaucuguaaucccagcacuuugggaggccgaggaggguggaucaccugaggucaggaguucaagaccagccugaccaacauggcgaaacccgaucucuacuaaaaauacaaaaauuagcugggcguggucgugcacgccuguaaucccagcuacuugggaggaugaggcaggagaauugcuugaacccgggaggcagagguugcagugagccgagaucaugccacugcacuuuagccagagugacagagcgagauuccaucucgaaaaaaaagaaaagaaaaaaaaguucuuauuguaggucgggcgcaguggcucacaccuguaaucccagcacuuugggaggcugaacugagcagaucacaugaggucaggaguucaagacuggccuggccaacauguugaaaccccgucucugcuaaaaauacaaaaauuagccaggcguggugcugcauaacuguaaucccagauauucgggagacugaggcaggagaaucgcuugaaccugggagaaagagguugcagugagcugagaucaugccacugcacugcaaccugggcggcagaaugagacuccaucuaaaaaaaaaaaaaaaaaaaaaaaaagccaaaaaauucuuauugcaguuguaucuguaagggggaagaaaaacccauaugagagacugguuaaauuaugaccugucuaguuguguugugugcucauuaaaagcaaaaggaagauccguuucuauguugaugaaaagauguucagaugcaugaaguaaaaaagucauagagcuuuauguauggggucacuccacuucuguuagaaaaauacuguauuccugcaguguaaaacucugcugguuaaaaacaaaacuguauuaacagguauagaaaagucugcuuggaguuucucucuggaugaugagaucaugauguucuguguuaccuaguuuuauuuauaaguuuauuuuuacuaugagcauguauuucuuuuauaaacucagagaagguuaaaaagucagcccucugaguagguaugggcucugggucugggguaaggggcacaagcccuucauuccagugauugaauuucccuauuggcaaauccuucauuugcauuguuuacagugagcuuuuaguuuuugcagacagaaggcucuacaagaaggcagaaaaguuucauuuuuaaaaaagaaaggccaggcaagguggcucaagccuguagucccaccuacucagaaggccgagaugagaggauugcuugaggccgggaagcagagguugcauugagccaaguuuaccccacuacacuccagccugggugauagagugagacccccugucucaaaaaaaagaaaaagaaaaagucagaggacugucuugugcuaauuuuaaaugucagugacuagaacuuaagcaugguuuguuuucuuauuaguuuuugccagcauaagaaucuacuggggaaagucguauuuuuauuggccagaggaggucugcuuccugugagcagcugaacagcuguggcuccugagaacgcagagaccuggccagcgcacucugugcggugccugaccccacugcccugccuuugucuaguuccagugcgacggccucucagccgccggagucgcugccgcagccggguuugcagaaaucugucuccaauuugcagaaaccgacacagucaaucagucaggagguaggugcugggaccccaucccaacuguuuccugggcaugguagccccuaaaucucuuuguugcugggggauggaaggaguugcuacugagaagugugguugugcaugaccugucuauuccagaggcacacccgaugagugacuuuagaaaaccgucaugggaaaccgucaaggucagugguuaagaaauuuaaucugcagcuuuuagaaaaagaccucagauacagacuaggauacaggcaccuacuuugguuccucuugauuuaccgugaggcagggucacucaggcuggacugcagacuaguucagggugaagcuccauggaagcgucacgugagcuccauggaagcuugggucacaggaagacaaaaaguggcaggucacaaaaagguucacuggccaggugaguuugaaaaacaaaacgaagcgagcuccuuuacugcgguacuucucagugccuuucauaugcuaauaccuaaugugacucucugagaagaggauauaaugggcagcagucccugaauuuauuugucccaggaaacauuucuuuaccgaaugucucuagggacuaaugucucucagaacacgcuuugggaaauacgaagcuacaauccuucauuuguugauauguuuuaaguguuuuucuaagcagaaaguaaugauuucaccaagcaagagcucauaacacacucaguccaucagagccuggcuacagguuuccagagauuggcaggaggauauacuuagccagaacuagaaaucuagaugagaagucuaugaauuuuuuagaagacuaaaaguagacguagauaucucauauucaccagcucucuugacagcgggaaugaacauauuuugguuuugcuuugcugcaugggcaauauaaggucucaaaugucauccccucucugcuuuaaccauacucagggaagucuguggcuuugccagggcacccucuccccaccuaacacugaaccgugcuuuuaaaauuaaagacaagaaaagaggucuauaaucaugcaagaugcccuuuuccuuggccuaaauccacugggacccauaggcuagucagaguauuuagaguugaguuccuuucugcuucccagaauuugaaagaaaaggagugaggugauagagcugagagaucagauuugccucugaagccuguucaagauguaugugcucagaccccaccacuggggccugugggugagguccugggcaucuauuugaaugaauugcugaaggggagcacuaugccaaggaaggggaacccauccuggcacuggcacaggggucaccuuauccagugcucagugcuucuuugcugcuaccugguuuucucucauaugugaggggcagguaagaagaagugcccaguguugugcgaguuuuagaacaucuaccaguaaguggggaaguuucacaaagcagcagcuuuguuuuguguauuuucaccuucaguuagaagaggaaggcugugagaugaauguuaguugaguggaaaagacgggugagcuuagugguuagagacucgaaagggcacuggacauaggcaggcuggagacugguccugguccugcuguucugcaucugacucagucacucuucucugagccucagugggggaugugacuagagccuucucaggggguggugagcauucagucaggcugggugugcuucgcauaaugcugacccuggcgaguuuucagcagaggugaccuccuaggguucucaggaggggagcugugccuuguagagucacggucacuacagaaagugcugcagccagcccacccagaucaagaucuggcauguuggccuucuuuguucacguuccucauuagcagcugcgcaguuuuaaagacacaugccggaacugggccuuagucuuugucgcuggagcaaaauaaaguagcucucuguggacacgggagguuccagagcaccgaauggagagaaacagguuuggguccuggcuuugcugugucacugucugugugacuugaagcuggucacuccccaaauccugcuccuugucuguagagugggccuggcauuuucucgucccugggaccgcuguguggagugugcguuacagggaagguucagggcuuugcugcugcucagaaaguggugguggauggauccguauaggguuugaaucuaaggugcuggccucucagcaccuuguuguaauaggcuguuauuguacaguggaauaagggagcuggcccucuucugauucucuuccuucuuucagaauacaaauucagugccagguggaccaaagucaugggcacagcugaauggaaagccaguaggacacgaaggugguaagugcgcacguguguguguuguuuggggacgcuggggagagggaggugaaugccuuuuccagaaugucugguugggucuaggcacccagaagcuuugaggacucucuuccacaaagagguaccgucuauggagcccuugccugugcacagcgggcgcugacucuguagaggugccagcucuuugguuucuuuggaugugugcucuugcugagacagaggagugcugacugggcugugcugcuggugauuuuugaugauagcuugaauguuucuagcauacugugcuucagaccaaacuaggcagcagcucugagugggaaggagaguggucguggugugggcagacgauucaaaggaauguacuggggaaagcccacaauucacuuucuccuguaaagcagcacuggcugcccuuuauuacccuuugccaccauccugauaucgccuucugcuuccugcacuaccccugccagccaaggcuucaccagacuuggucuuuaguagccuguauuagaaaaccagcugcacauccuucguuaccugaaccucacccccagccugccaugccuaggagguccugccccuuauggguugaaaucccugugcucaaaggcucuucccucagucuccaacgggaaaugaccgaucaaugugccaauuggauuucagugccccagcuucucccaaggggcugaggguacagaucgagugccagcaggagugcaguggcacaauuauagcccauugcagccucgaucucccgggcucaagcaauccucccaccucagcuuccugaguagcugggacuacagguguguaccacgacaucuggcugauuuuuuuuuuuuuucuuuccauucugaguagagacaagauuucacuauguugcccaggcugaucucaaacuccuaggcucaagagauccucccacuucagccucccaaguagcuggggcugggaucacaggcgcaugcaccaccacgccuggcuuauugauuaauugauugacugagugauugauugguugcgacgagaucucacuauguugcucaggcuggucuccaacuccugggcucaaaugauccuccuaccuuggccucccagagugcugggauuacagacguaagccaccgugccugaccucaaaagggucuuugaagaugcuuuaugaagagcauucacuggacuuguaacugguucuuuggcuuuccauaucuuauauuucuguaagguuagaauuuuuuguuuuguuuuuguuuuuuuugagacagagucuugcuuugucacacaggcuggagugcaguggcacaauagcucacugcaaccuccauaagguuagaauuuuuaaaaauagauagaauauauuaauuuuuauuuaaaaagaacuacaaaaauuaaaagaaaaacuucuguauaaauuggcccaacuccuauggaagccaguuuggcgcugccuggcaaaauaauaacacauaauacccuuugaccuagcaagugcacccugaggaaauugcucuacaaauuauacucgcccgugugugaaaugacuugcgcauaagauuauucacugcaacauuauaauagcaaaagauugcaaacagucccuugaaaugccuguaaaauuaugguacuuuaaugaaaugugauuuggcuauaaagaaaaaaagcagaaguuuucuauugauuuggcaagaucuucaggugaaaaaaaguacagaaugguauguauaguaucuuaaccauuuguguaaaaaaugggggugagggcuggacaccuguaaucccaggacuuugggaggcugaggcagaaggauugcuugaguccgguaguucgagaccagccugggcaacauggugaaacccugucucuacaagaaauacaaaaaaucagccaagugugguggcagacaccuguagucccagcuacuugggaggcuugaggcaggagaaucaccugagcaccagagguggaggcugcagugagcuguggucacacuccuguacaccaaccugggugacagagcaagacccuaucuuaaaggacaaaacagaaaaaugggagugagaaaaaauacacuucuaaaaaauguuguauaugcauguuuuaaaagccacccaucuguauacugauguauauguguuuaaaaaucuccagaagguaacagaaaacugccaguuuuuuugagggagucagaagggggcaaaugggcauaggggugagaggaaggcuucugugucuaccuuuacaugguguucacuucugaaccaugucacuguguuaccuauaaaaaauguagguaauguaacuguaucacaauaaagcuugauggagaaaauaauuuuaaacuggacgugguggcacacaccuguuaucccagcuacuuggaaggccaaggugagaggauugguugagcccaggaguuuaaguccagccugaaaaacauagcaagacccuuucucuacacaaaauuuaaaaaaacaaagaaaauaauugcaggcagaaaccugccagcccacagaaucgacacacugggcagggugggggccaaguguaaaagucaguuucaguucccccucucgugcuagagucaugcaucugugacacugucaggaguguggggauuugaggguguugcccacaaguguuuucaugacucuuuggaauucaaaaggacuuuuccugaauugauagacucaguugauaggucaccugaaacagacccaggagaccugauugcauguuugggcagaggucagaggcucagauaccagcugcugccccaccaguggcucagccugugaccucggaagaagcccccugacuuuccugccucaguuucucauggcagagaacagauggcaggugaacaucauaaaacauugggaccuuaugaauacugguauuuuggugugagauuuuuuuuuuuccuacccuuuauccuuauuaagauuaauucaugcuuacaauaauauauucaugauucucgaagcagaagaaagagauggaacagcaauguuggacaggugcugguuuuuuuccuaauuucaaaucuaccuuuuuuuuuguuuguuuguuuguuuuuuuuuaggcaggguuucauucuguugcccaggcuggagugcaguagugcaguuuuggcucacuauagcuucagucuucugggcucaagcaaucuucccgccucagccucccaaguagaugggacuacaggcaugcaccaccaugcccggcuaauuuuugugauuuuuguagagaugggguuucaucauguuguccaggcuggugauacuguauuuuaaaaauacaguuuuuauuugauucuugccagugaccuucuaccauaaugaagcgacucugagucagagcccccuucacagagcacuggagcuccuucaugacacuuagaguccaucucuggcuggucauuggugaaugguguccagucuuaccgucagguuuauuugacccuggaccuuuuuacuaagggaguggcaagcgaauugcugccacgugcuuguguggugauccagccgcgccuuuccggcacagucggcuuuagugaacaggcccguggaucaguggugcuaagaauaauuuaaacuacuuaggggaagauuuggguuuagcuguauagggaacaaggcauuccacagggggccauuuguuguguggugucgccacuguuccuagauugcuccugucuggagugugcugcauauuccagaucaaaagacgugccauuuuuaaucuguucauccaaaaaugguggcagaaccucugugcuaaguuuucuguguaagggaacaacauuaggaaaggcuucuucucuaaagcagguuguaaugucaaggaaugaaugaaagaaugaagaaauaaacuguucccaggauuauaagagugaaauguuuggccuuguagggcucaaggaacuuaguacaaaaugcggaaggacaggugaaugaggaguuacucauguguauaaaucuaauuuccaccugaucuuaccacauuugaugguagaaagcagcauuuguuuauuuuauuuuauuuauuuuauuuuauuuuauuuuauuauuuuuuuuuuuugagacggaaucucgcucuguugcccaggcuggagugcauuggcacgaucucggcucacugcaagcuccaucuccuggguucacgccauucuccugccucagccucccgaguagcugggacuacaggcgcccgccaccacgucuggcuaauuuuuuuuuguauuuuuaguauagaugggguuucaccauguuagccaggauggucccgaucuccugaccucaugauccgcccgcgucggccucccaaagugcugggauuacaggcgugagccaccacgccuggccuauuuuuuuauuuuuagagagagggucucacuuugucacccagacuggagugcaguggcacguuuucggcucacugcaaccuccaccucccgggcucaagugauccucccaccccagccuccugaguaguugggacuacaggcgcccgccaccagacuaauuuuuuguauuuuuugguagagacaggguuuugccauguugcccaggccggucuugaacuccugaguucaaaugauccacccaccuuggccucccaaagugcuaggauuacaggugugagccacugugccaggcaaaagcagcaucuuaauccuuuugggguggacuggggcagggauggcagcacacucuguagguguugccuccacaggaaagcaguugccuucuuggccuccccugggcugauuuuauaggaggcugugcuugucuguggccccaggcagucaguagaaccuucccugcuggggcaggcuguggccuggagcggcugugaugucuuaccucuuuccauuuguaagcaggcacugguccuugcaggucagcugggaaggggcaugaugcugucagcagcagucucccuugccacccucagcacccucguggcaucugccagcacagagcacccuugugacaagacucccuucaaaagcccacuuccaggcaacacggcuuucaagguguggagcugggaagcagacgacuguugacuccaucucacuuccuccaugucuaccccgucuucuugacagguuuaaggggcucaagccgacuguuauccuucucucccgaggaauuuccgacgcugaaagcagcuggagggcaggacaaggcuggcaaagaaaagggcgucuuagaucugucguaugggccaggaccaagccuccgcccucagaguaagugacugcagccucugggcacucgauggaguaacagaacuuccuccucucaucucucugcacuccuaaaagggugcugaugccacuggggucuccgguucgagcuggaaacguggcucuuugacucgccacgugaucugugcauccauuggacuugcugccuaggccauuggauugggccuugugccuuuuuugucucuuggguugggccaggccuguccccucccccucugucauccgguuguuaauuuugcugugccugguggcuguggcaaggauggacaaaggaccaauuaacuuagguccccgguucaagagcuuguuuucuaaagcucccaauccuagcuacaucuagucggaaucacuggggaguuugugaaugagucugauuuccaguccuccccucccccagcccaauuaggaccuguauuuuuaacccauuccucuggggauuguuacauaaaucagccugguacuggucucuacuggccccucaucuuaggucgggccagggaaguggcaggauuguguagcacuggcuggaaauuucuccuuggaagccgaggguggcuggagguuaaggugguguuuaggaaugugauuuuccacguguucuacucagggauuuugaaguggcucauguaguccaggggucuugaucaggucuuaaauugugaggccuuuuguuugcuugccuugauguauccccaaggccucucccauucaagucauaagugauguccuguaagucagugaucacuguggaugugucuuacuuaaaccagcacucacugccuuuccaguggcccacacaggacugguuuauuuugcugcuuuuuuuuuuuugagauggaguuucgcucuuguugcccaggguggagugcaauggugcgaucucugcucacugcaaccuccgccucccggguucaagugauucuccugccucaggcucccgaguagcugggauuacaggcaugugccaccacacccagcuaauuuuguauuuuuaguagaggcggguuucuccauguuggucaggcuggccuugaacuccugaccucaggugauccgccugucucagccucccaaagugcugggauuacaggcgugagccaccgcgcccagccuguuugcaucauuuuaagggacacgaauuaugucuuucugggguuaauuaagaggagcugccuugugggacuauaaaaacguagacauagaagaagcuucuaagcaucaguuuaaucuccucauuggagaagaugagaaaacauggacagaggggugaccuuggcuugccccaaaucacacagcaaagggguugaagagcugggaucagacauguccugggucucuuucccuuaagggucguguaacucagagaccuuugugcuucaacuucuaaccaaaaggugaccgaaaacaggggucuguugucucauuugauuucuuguuggccucuaauaauuuccacccgaucuuaccacauuuggcaauagaaagcaucauuuuaaaaagacaggucagcagguuuccgucugugagcuacgcaagugccccacaccuccacuggaaggacagcagcugcgccuugccugucuugugggcugggggaucuuuauuaaaaggugccacugcuaaacaaagccugaaaccacugugcccggaacuugcuccuguuuuaauguguaguccagugcugacccuaagugggcuggucaguguuuguugaaggaaugacccaaggcugguuucaucagggccaucuucaucucucuggguugugagacuuggggaaggguggugauuguugcuuacugaugaagccuucucucugaguagaucucauuuuauauuucacagucagacuucccucagcaaguucauccucauuggccaggggucugccccaaccuucccugacagauuuaacaguucuucacuuuugguguuuuuuguuuuucauuuuauuuuuuuggugaaggagggggucccuugaccuucagaaccucauacgaucccuccuucccccuccucuucccucuccccuuuugcccccuuucaauuuccagaugugacaagcuggagggagggcggugggcgacacauaauuucugccacgucucugagcaccuccccaacugagcugggcagcaggaacucgaguacgggagauggagcccccuccucggcauguaccagcgauucuaaggaccccucucuccgcccggcucagccuguccgaaaaggggcuucacaguucaugggaaauguauaccacccaccuacauaccaugacaugcuuccugcuuuuguaagucuucagaguguacuuuuuuuccccccaugaaguuggauuguguccagcagauaggucaagugguugaaugucccccuuggggucuccucuuggcccuguuacccuacuucugaggcuuccacucguuuugcauuuucucucccugcuuuuuaaaucuucagggccucugacuucuuucccuggugauguggauaugauuuuagccuuugguucuuuagaaacaggagaggcagguuuucccugacauagguccccaagucuacuuacuggcagcaggaaugaaaugggggagauggugguaggauuaauuaggaaaccccaugacuuuccuguuucuuuuucccauuuuccacuuuauaaaacacauucugauuuaaguggaaauugcaguuucagccauuaccagcaaauccuguucauugauguuauguuucagauguguucgccgaagucaucagaaaaccaggguacaguggaacgaggcucuuuuccccuuccucagcuccgccuugaaccucgaguuccuuuuagacaguuccagaugaaugaccaagacgggugaguccauugcauuacagucacguguguagagaugagugcgguggugauucuggucaagaugaggggcugaugaauagaagugcugugucuccuggagaccacagagaacuuaaccagcucagcguggcaggguguguggggugguggcugggauuuggagcuggaugacagauugagucaugauuucaagugccugguagaguugaaguucuggcacguguguguugcugcugcccuaggccuuagcaaccagcauguaaaacugcaggacaaggcagaacuucuuucugggauguacucguuugcucauuauauauuucuuuuaaaggaacugauagaaauaauuaaaucaaacaugaaccuuugcaguguggaauuuauuuuuggaaagguauuugauuuugcuuccgucuguauacuggacaugauuccaucaucuuuucuuuuaucagaaaagaaaacaggcugggauugucucgcccacuccgcccacuaaggcagcugguggagcgggcaccacggcccaccauuaucaaugcggaaaaccugaagggccuugacgaucuggacgccgaugccgaugauggcugggcaggugggcagagaagcacgggugguuuagacgggcaggaccaaaguccauauguacuuaccagggauggaaacccccuggcaccaccguguguuuucccuuggcaagauagggaugaagagccggacagggaagcagaccugaugcccuccuuccucauuuacucccugacuagagguuccuuccuggccaagccauuagcuucuuuuggucuuuagucuugaucuuagaguuuuguuguuaacuuuuuaaaaauuauugaugaugcaaaauuuaaacaaaaaagaaaauagcucccaaccacugaucacucagguucaauaaguaccaauguucugccauucgguuuuuguuuguuuuaauuuaauuuuuuuccaagagacagggucucagcuacucugggcauacugccuguggguuagcccuacucugcaaggagcaguaaaaaauauaaagauaaaaaggaaggcugggcacgguggcuaaugccuauaauuccuuuggaaggcugaggugggcagaucacaagaucaggagaucgagaccauccuggcuaacauggugaaacccugucucuacuaaaaauacaaaaauuagccaggugugguggcgcgugccuguagucccagcuacucaggaggcugaggcaggagaaucacuugaaccugggaagcagagguugcagugagccaagaucgcaccacugcacuccagcuugggcgacagagggagacacugucucaaaaaaaaaaaaaaaaaaaaaaaaaaaggaaagagaaagagucuggcuguguuucccauucuggaguggaguggcuguuugcaggguccaucauggugagcugcagccucaaacucuuccuccuuccucagccuccggaguagcuggaacuacacgcgggugccacaaacccagcuuguucugccauucuuauucguuuaucuccccccacuccccaucccccaaccugauuauuuucuuuuauaguucuuuuuauuuucaaguagauuuaaauuauagugaaagguacccauaucacauuuuaccuguacaguuuuacaaauggauacguguauaucacacacauccauauccagagaaagagggaacauuucccucaccaccgcaggcuuccucauugcuucuccagugcucugcccugccaccgcucaagggccugcugcucuucugauucacuuuacccuagauuaguuuugccuaguuaacagacuucagaugaguggagucauacaguuuuuacucuuguaugguuuucauauucaucaauguuguuuauaugccaguugcuuuuaguugcugagauauguuccagugcaucaauauacuguaauuuguuuauucauucaaaagccccacuauauacaucauacuucuauuucucuuggguaaguaucuagaauuguugggucaaaggguagacauaggauuaaguguuuaagaccuguccaaaccuuuuccccuggugguugugccauuuuacauucccagcagcagugugugagaauuugguaggucuggaucuuacauuuugguguucaucuuuuuuuuuuuaaagagacagggucucacuuuguuuccuagguuggagugcaguggugugaucaaagcucacugcagccuugaacauguuuguguuuuuaauuuuagucauucuaguggguguuuagugguaucucauugugcuuuuaauuugcauuuugcugaugacuaaugaugauaaacacacuuuuaugugcuauuugacagcugauauauuguccuuuguuugguaucugaauuuuaaaaaauugagugguaggguaccagcccaggauacaaauccuuugcaacuuuuauuuugcaaauauauuuccuuauugcauucuuugucuuaauuuuuuuuaaacacuguuuuggugagcagaaguuugaauuuugaaguuuaauuuacaaauuuggguuuuuuugugguuauuauuuuuguguccuguuuaaaaaaauguuugcuuccccuuggugguaaagauguuccuagauguuuuauaguuuuaacuauuaauuuuaggucuuugauccacauuggauuaauuuuuguauauggcauaagauaggagucaagguuuguuuuuucccauacggccaauucuccacaacauuuguugauaagacuucacuuucccuaucgaauugcuuuggaaccuuugccaaaagucaauugacuauaaaagcauuggucuauuucuggacacuguuccauugaucuaguuguuccucauaccaguaccacacuguggguuuauaguaaaucuuaaauuucaguaguguaaguuuuccaacuuugucguuuuccaagauuguuuccacauaaauuuagaaucaaccugucaguauuuacaaagggccugcgggcauuuugguuaggauuauguugaaucuguaucaacaucgauaagugacaucuuaaauuuuuuuuuuuuuuucccgagacagagucuugcucuauugcccaggcuggaguucaguggcaugaucucgacucauugcaaccuccgccucccggguucaagugauuaucuugccucagccucccgaguagcuggaauuauaggcgcgcaccacaugcccaacuaauuuuuguauuuuuaguagagacaggguuucaccauguuggccaggcuggucucgaacuccugaccuugugaucugcccaccucagcaucccaaagugcugggauuacaggcgugagccacugcaccccaccugacaucuuaacuuugaaacuuggugguguuuuuuuuuuuggauauggggucucacucugccacacaggcuggagugcaguggcaugaucucagcucauugcaaccucugcuuccuggguucaagugauucucaugucucagccuuccaaguagcugggauuacaggugugggccacuaugcccuacuaauuguuguauuuuuaguagagacgaaguuucaccauguuggccaggcugaucucgaacuccugaccucaggugauagguccgccuuggccucccaaagugcugggauuacagguaugagccaccauguccaguccuuaauuuugaaucuuuagguccaggaaccugguguaucucuuuauuagggcuuucauuucucucagcagugucuuacuuacaguuuucauguagagguccugaaugucuuuuguuaaauuuauucucaggcauuuuacgguuuuuugaugcuauuagaaaugacauugauuuuuaagaacaauuucauuuuuuaaggguuugcugucauuauauagaaaauacagcugaggccgggcgcaguggcucacgccuguaaucccaccacuuugggaggcugagguggguggaucacaagaucaggagauugagaccauccuggcuaacauggugaaaccccgucucugcuaaaaauacaaaaaauuagccgggcguguuggcacgcgccuguagucccagcuacuugggaggcggaggcaggagaauugcuugaacucgggaggcggagguugcaaugagccaggaucgugccacugcacuccagccugggugacagagcgagacuccaucucaaaaaaaaaagaaaauacaguugauuuuuuuguguucacugguaccagacacuuuguugaauauacauuaguuuuacuaguuuuuguugauuucuuagaguuuucuacauaaacccuuauguaguuuguaaauaaggaguuuuacauugucuuuuucagauuacgugccuuuuauuuauuuauuuguauuuugccuuauugcacugugguauacuucuaguauaauauuaaccucaaguucuuucuggucugaggaagaaaauguuucaugugucagcaugaagugucagcuguggguuuuucagagaugcuguuuaucagguugaggauguguugccuucugugucuaguuugcugagccuuuggguuuuuuguuuuuguaaauuauggguauugcauuguguucaaugauuuccuacaucuguguucauauuauuuuucuccuuuauuuugauaauagauugcauuuuuuuuuaaugcuaaaccaaccuugcauucuuagaauaaacccucccucuuuguaugccuagacucaauuuguuaauauguuuuaaaguucugucaugagggauauuaguuuguaauuuucuguucuuuuaaugucuuugucagguuuugguaucaaguuaugcugggcuuauaaaaugaguuguggaguguucuucucuacuuuccuaaagaauaagauugguauuuuuguaagaucaguauaagauugguauuuuuguaagaucaguauuauauauuuuucuuuuucuuucuuuuuugagacagggucucucucacuuugucacccaggcugagugcacugcugcaauaauggcucaacgcagccucaaacuccugggcucaagugauccuccugccucaccuucugaguggcugggguuacagguuugggccacugugccuggccaguauuacuuuaccagugaaacaauuuugccccuucaguuuucauuguggaaauguuuucaguaauuuauuuuauuugauuaguuaugagacugugcaguuucccuaugucauuucgugugaguuuuucgguaaguuguguuuuuugaggaauuuguucauuucuuuugaguuguugaaauuauuaacauaaaguuguugaaaauauauuacauuauccuuuugaugucuguaggaucuguagugauaucuuuuaauuccugauaauuuguauauuucuuuuucuucauuucugccaaggaauugaauuguuuuauuaaucuuuacgaagcagcagcuuuuagcauuguucauuuucuccauuguuugacuuguuuucuguaucuauuuuaaaugauuuuuuaaaucauugaggcaauuuuuuauuacggggacauuucuagauugcuaauuuaguugucuuacagccagagagcacauucuguaugauuucaguuguuuucaaguuaguaagacuuguuuuaugacuaggauaugaucugucuuggagaauauuucaggugcccuuugaaaaguauauauucuacaguuguuguucagugucauguuuuguauguuccaacuuagucaaggugguugaugguggcauucagaucuuacuguauauuuacugauguuuuugucugcuucuaugaguuaaggaaagugagauguuaaacuccaauuauggauuuaucuguuccucccuuuaauacuguugguuucugcuucauuuauuuugaagcugcuauuaggcauacacacauuuauaguuucuaugccuuucugguguguuuccacauuucccucguuaucucuaguagucuauuaucuugcagucuguuuuguccuguguucauaccauugcucugacuuacuguuuucagcgaaaaucuuuuuccauucuuuuccuuuaagcuccuuuauguuuguauuuaaagugauuauuuaguagacagcacguaauugcaacuugcuuuuucaguuccuaacucugcuuuuuaauuagauugaguuuuuguuguuaccuuuuaaauuuuuuuaauuuuaauuuaauuuauuuuuucuagaguugggaucuugcucuguugcccaugcuggucuuaaacuccugggcucaagcaguccucccaccuuagucuccuguguagccaggacugcaggcauacaucauggugcuuaguuagccuuguguuugaggcaagaucuugcucuguugcccaagcuggagugcaguggcacagucacagcucacugcaacgucaacuuccugggcuuaggugauucucucaccucagccuccggaguagcugggacuacaggugugcacccccauggcuggcuacuuuucuguauuuuuaguagagauaugguuucgccauguugcccaggcugguucaaauucugggccucaagugauccuccugccuugaccucccaaagcgcugggauuacaggcgugagccacugugaauuauaugauuauaugauucacauaauuuuaauauaauuauaugauugacauaauugucauauaacauaaaauuuacccuuuuaaagucuauaguuuagugguuuuuaguauauauucacaagguuguacaacuaccaccacuauucaauuucagaauguuuccaucacucaaaaaagaaacccaauaccuguuggcaggcgcucucucccaccuccuaauccuguggcaacaauaaaucuacuuuccaucucuauagauuugcauauucuggacauuuccuaucaauggaaucaauauguggccuuucuugucuggcuucuuucacuuaguauaauguuuucacaguuaauuauguuauagcauguguuuguauucauucuuuuucaugaccaaauaauauuccauuguguggaccuaccacacuguguucacacaguccucugugauggauacuuucugccaucugagccacuugggcugaucagugccuggggcaagugguaacucacaaaucucacaagucaagcuucuguauucuaaggguagacaacuacuugguuucugccugcuuuguucauccucuugggccuugaaauagauuuuaaagauauaauguucagauuuaagaauuguuaccugugggaggguuagucuaaccaagcugcccugcucuuaccagaagccaaaacugcccuucagucacagggguaggcagccaggugguugacucagcuccucugcugggauagcgagauuucuggccaaaagaaccucuccgauggugccuggguaccacugaccuuuucuuuuucuuuuuuuuuuuuucgagauggagucucgcucugucgcccaggcuggagugcaguggcaugaucucggcucacugcaaccucugccuccugcguucaagcgauucuccugccucagccuccugaguagcuaguauuacaggcacacgccaccaugcccgacuaauuuuuguauuuuuaguagagacgggguuucaccauguuggucaggcuggucucaaacuccugaccucaugauccgcccaccucagccucgcaaaguacugggauuacaggcaugagccaccauguuggucagucuggucucaaacuccuguccucaugauccgcccaccucagccucgcaaaguacugggauuacaggcaugagccaccacguccggccaccacugacuuuuucauucuuucucauucuuccugggcccuccugcuguuguaggccuccaugaagaaguggacuauucugagaaacugaaguucagugaugaugaagaggaggaagaaguugugaaggacggcaggccaaagugguaaggacccguuccugcccuaucagcaugagugcaucccugcuuaguguuguuguguacccagagcauuucccaguuuccauagcaaccuggaauggcagacagaugcuguuuccacuuuguuuugagggugacagcuauugaugauggcugugaaggaggggagccaggguuugccugcaggugugacuguguccugugcauagucggccucuucaccacugcaucaguguguccccagguguguuaugcagaccacgucuucauggauugcuuguggcugucgugcccaaaaaggcugcuguggccaagcaaguuugggaaaccucccuggguucaacuucuuuuuuuuuuuuuuuuuuuuuuuugagacaggcucucacucugucacccaggcuggagugcgguggcaugaugucagcucacuaaaaccuccaucuccugggcucagcgauucucccaccccagcuucccaaauagcuaggaccacagaugcacgccagcauacccagcuaauuuuuaucuuucugcuggagaugggguuugccacguuacccagguuuggucucaaacuccugggcucaagugauccacugugccuggccucaacuucuuucuuuacuccagauuccucggagccuugaacaugcuaaaguacacugggggccgggcacggcggcucgugcuguuaauuccagcacuuugggaggccgaggcagguggaucucuugaggucaggaguuugagaccagccugcccaagauggugaaaccccgucucuacuaaaaguacaaaaauuaaccaggugugguggcgugugcuuguaaucccagcuacuuggguggcugaggcaggagaauugcuugaacccaggaggcagagguugcagugagccaagauugugccacuguacuucagccugggcgacagagcaaaacucugucucaaaggaaaaagaaaaaaaaaauuaagugcacuggggaggugaagaagcagaaugcaugccagcuuuccugaauuuauuugaccauguuaauuuugucucuuuuuuuuuuuuuuuuuuuggaucauuuccuuggacuaguuuaguuuuguuuaauuuccuuuagaaaauacugcauuguacucucaucccucuaguuuuuauaauguuaguagcacuuuuaaaauaauaccccacaauggccaggcacgguggcucacgccuguaauccuagcacuuugggaggccaaggcgggcggaucacgaggucaggagaucgagaccauccuggcuaacacagugaaaccccgucucuacuaaaaauacaaaaaacuagcugggcauggugguaggugccuguagucccagcuacucgggaggcugaggcaggagaauggcaugaacccgggaggcggagcuugcagugagccgagaucacgccacaugccacugcacuccagcccgggcaacagagcgagacuccaccucaaaaaaaaaaaauaccccacaauuaguugggcguggugugcaccuguaguccuagcuacucaggaggcugaggugggaggacuacuggaauccagaaggucgaggcugcagugagccaugauugcaccacugcacuccagccugagugacagaguaaggcccugucucaaaaaauuaauaauaacaaucauaccuaugguugucauaauuuguauuuuuugaguacuagcaaguaagacuuuuuccuuugcuuccuuuguauaaugccuguuuccuucacauuuaucacugcuuuccguuaaaauguaauguuuuauauuguuuagauguuaaugcuuugcuguuggucuugcaaauauuuuucucuguuuucuugucaauaacugaauauuuguuuagucaaaucugugagucaucuuuuucuuuguuauuucauccuuuacuuaaaagcuuccuaaaguaagugcccaucuucuggaaagaguugguaauaaucuuugcuacucuuuuucugaugacacacaaaaaaugaaauucuguaauuuccuuucaugcuguuugauuucagcugaagcuuuggaugcagucgggacauaccuaugggucaguuccuggaacacuaagcucagaaggagcugugaucaagaauuaaaaucaaaggcaaagacauaaacucuuagagacugauuggagcaguaggacacucuguguuccuugucucuuugaggcgaugggaacugcauauuccccugaaggaacuggacauugguuuuggagacaguuuugccccugacuuugaccaagggcacuucaaaaucagagugcccgaacgaucuccuccugaaaccugcucuuuuucuucauguucucugagcugguuggugaccugguagagacuuagugcaugcauccaugucuuauuuggcaucuuuauuuccucauacacaauuggcucccaaaacuugcccugacucugucuccucuuuucauuuucucuggggccacugggaccuccuccuuuuccagaccauccauggguccaccaguucaucuccauccuuucagccuguccuccauggcccguccuugacacccugcccauagucaucuucuaaaaacacaggucuuuuagacaggucagcagcuuuacuguggucuccauuucugacaaagucagauaggaaucaccguuguccccucuguaauuguuguccccucuguaauuuuccccucuguaaucuccuaagcuauguuaccugccucgucuucccucccucgccacguacguguguggguagacacacaggcccacacaucugccaucccugauucccgcuuuucucugaucugcaguauuaccgggcccuugcaaaugcuuugccccagcaccauugcuuccauugugaggcguccagacgagcauggcacccauccccuucuuguccagccaccccugcagcucuguuuggaacaccuccuccuuuuccaugcugugucggcucugcuugucuccucuugcucuuuuuauuguggcacuguuuaguagucaucuuuuguucuuuugaggggcauuuauugagcaacuggcuugugcagagcauagggagggagauguaccaaaaggagacggacacgcaccugggaguccugguucaaaucugugagcuccucccugugaggggugccccguuaaccuugaugagacucagcuacugacuuuuuaaaucaagaguguccaaucuuuuggcuucccugggccacacuggaagaguugucuugagccacacauaaaauacacuaacacuaacgauagcugauaagcuaaaaugaaaaaguuacgaaaaaauaccucauaauguguuuuuauuuuuuuuuuuuucugagacggagucucucucuguuuguugcccaggcuggaguguagugccgcgauuuuggcucacugcaaccuucaccucugggguucaagcacuucucccaccucagccucuaguagcugagauuacaggugccugcuaccacaccuggcuaauuuuuguauuuuuaguagagacuugguuucaccauguuggccuggcugaucuggaacuccugaccucaaaugaucagcccgccucagccucccaaagugcuaggauuacaggcgugagccacuacgcccaggcccucuuauaauguuuuaagaaaguuuacgaauuuguguugcgcugcauccagagcccagggccauccugggccacaugugguuggacaagcuugcuuuaaagugaggaucaugaggacuuuuuuuugcaucggugaaauagugugacauaucgugccuggggcucuguuuaaugagagugacuugauaaaugguggggcugaaccguggaauucacauggaaguagugggaguggugguccauucuaaugaagaaaaugauuuggacagcugacuugggaauucucaaggccucugaccagugagaucagaaaugcuuggccugagugcaaaaacuuaacaucaaaugugguuuguccuaggaacaguugggacccuaggaggcagcggcaguugucaaugagcucugcagacagugcggacgcuaagcggacucgagaggaagggaaggacugggcugaagcagugggugcgucccgugugguccgaaaggcgccagacccucagccaccgcccaggaagcuucauggcugggcaccaggcccugacuaccagguaccaagggcccuuggcuguccuguguauuuguacuucauugaguuggguggcuggguuucugagaaguccuaagugggcauuucuuuuucauuuuuauauuucuucuuuuguuaaaauguuuuuucauagagacagggucucacuauguugcccaggcuugucucaaacuccagcucaagugaugccaaagugcuaggauuacaggugugagccaccaugcccggcuguucuuacuuuuuuuaagauaaggucuugcucuauccuucaccucccacccucaagcgauccucccaccucagccuccugaguagcugggacuaccugugugcugccacaccuggcucauuucauucauuuuuuguagagacgaggucuuacuauguugcccaggcuagucuugagcucgugggcucaagggauccuccuaccucagccucccaaagugcugagauuauaggcaugaggcacuguauuugucuucuuguuauaguuaaaaaaaauuaaaacagccaggcaugguggcucacacaguuugcaaggcugaggcagggggauugcuugagaccaggaguucaagaccauccuggccaacacagugaaacccuaucuccaaaaaaaaaaaaaaaaaaaaaagccaaagaaauaauuaaaacagcuucaaagugauagaaaaguuggaaguacauuacaaacaauauuuuuucuaaacugauugaacaguaaguugacaaccugaugagacucuuuacacugugguacuuguuuccuaccaagauggggacauuccacccagguaacuacaguuacuuccaggaaauuagccuugauaauugauugucguuuaaucugcaggccccauucagcuuuuaccaguugucccauuaauguccuuacucgaaauaauccaguucagaaucacacaccucuagccuucuuuaucuggaucaguuccucagccuuuccuucacuuucaugacuuugaggcuuuggaagauuacaagccaguggaaugccccucaaauuggguuuaucaucaucuuucuugugaagaaguccacaguuuccauccuuggcagggaucuucaggcaugaccugacuuuucucauuucaucccaccaaggcaaccacgacuucauccugucccccucuggcuacgugcacuuuggucucuugauuaauggggugccugccagguuucaugcuguagaguuacucuuuucccuauuuguaguugauaagaauuuuguugggagaaacuuugagacugaacaucucguuuuugaucaagcuuuuaguuuacucauuuauuuacaucaguggguguaaucuacucucaccugguuggccauuggguguuccuucaggccagugcguguccuuuuucccuguucuccauccuuuuuggagcccuuccuucaucuuucccggaugcaugaccugucuuguccuggguccgcccuuucuccaugaaguccuaguuccucuuagugaaggaugauauuuagaaaccagugucugagacccagcaggcuccuugcugcuggggugucacugcuuccgggccuccucagcggacaguugcggggaauguauguagguauaugugugugcacaaauacacacuuucauauuuguauuauuucuguaccuguccauauuggaaacuguguucucauugauaccuccaguuccacagacuuuguuccacuuccucccagugcauguuugcaccuccuuucugugacagggagaaucuaucucucaucgucccucguauuuauacucacuuggucagucuccccauguaugaccaaucucauuucugcugccacacucucucccuugcacauaugcucuccuugcccacucagaugucauuguccccacuccuggaugcccugaaugucccugcugggccaacucugccuaugaaugucccccucaucuagcuugggcuuuggccccacaccucuaccugcaugcccuccuccccuugccugggcucuaaccauuuggagugcagucagccgccaggacucccuggcaccaggcuccuggcuugcauugccacaccuagugacucugggacuggacuguugaggagugggagggcuggggaagggggagucaugacuuugaauacacuugguaaagccugcuauuuucagugcucuuugcuauuuauuuauuauuguuuuuggagauggagucucacucugucgccaggcuggagugcgguggcguaaucuuggcucagugcaaccucugccucccggguucaagcgauucuccugccucagccucccgaguagcgggauuacaggcgugcaccaccaugccuggcuaacuuuuguauuuuuaguagagacaggguuuugccauguuggccaggcugaucuacccugaucuacccaccuuggccucccaaaguacugggauuucaggugugagccacugcgcccggccugcucuuugcuauugaaagggcuucuauuccacauucuuauaaaaugaaaaugccccucagcuacagucuucuuauugaauauuuauuguaugccaggcacauacauaugugcuggguacaagagauacagaagugaaacaaaauagacacaaugccacugcucuuggaaauuauucugcaguuaauccacauuuucauucacauguugagguugcuccguauuccuuuuuuuuuccuuuucaccagucaagaaguagugcugaucaguauucaaaagguuucacuuuaaccuacucauaacagcacuguaaauuagcugaacaucaacagugaugaaaucuauauacuaaauuuauguauccaaggcaucuucugaccaaauuucuuucauucuuucuuuuuugagacagagccucacuuugucauucaugcuggagugcaguggugugcucucggcucacugcaacuucugccuuccagguucaagcaguccuucugccucagccucccaaguagcugggauuauaggcaugugccaccacacccagcucauuuuuguauuuuuaguagaaaugggguuucaccauguugcuuuggcuggucuugaacuccugaccucaggugauccaccuaccucggccucccaaagugcuaggauuacaagcaugagccaaugcaccuggccucuucugacugaauuuuuaagaaaauuuuuaagaauucucaauuuggccagccgcaguggcucacaccuguaaucccagcacuuugggaggccgaggcggguggaucacgaggucagaaguucuagaccagccugaccaacauggugaaaccccaucucuacuaaaaauacaaaaauuagccaggcguggugccgcacgccgguauucccagcuacucaggaggcugaggcaggagaauugcuugaaucugggaagcagagguugcagugagccgagaucaugccacugcacuccagccugggugacagagugagacuccgucuaaaaaaaaaaaaaaaaaaaaggucucagugcaaauuacuuugcagaacauuuagucuauaaaaugauugcuaauuucagggccuuuuaggaaagcacaucaaaggucuugacgguguacaugugcccucugagucuauuauuuccuuuccaggaaauuaucugaaggaaguaaucagggcuaggcgugaaggcuaugugcagugguguauugaaucccaugggauaaaggcagauaggcagauuuugguaugagccaugaacugaucaauacacagccguuagaaagguauggauagacccucagguucgauggcaaagugaaaggaaacugcacgcuucgguuccaaugauauuauauaaaauguaccuucaugccucuaaauuggaaguuuauaaucuuaugauuacaguacuuaccucuggcuuaugagaaguuaauuuuuaggaaacuccuugacuacaguaaauuuguuguauauuucuuuuacugaaguauaacucaccuacaagaaaaggccuagauccuguuuccuugauuugauuuuugacagcuguauacauuuguguuacuagcauucaaaauaggaaguucugucuuuuucugguacucagaucucauuagaauuucaguggccagagcucaggugacagcuguccaucauuuguccuguugccaggucugcaugcugcuugaccccugcagaccaguaagaaagggucccaguaacuggcaaccagcaagaaacucagaaacggauaaagaauccaaaagagauuuuuuuuaggcaugcuuuuuuuuuuuuuuuuuucuuaaugggaucuagccuuguccccuggcuggagugcagugaugugaucucagcucacugcagccuccugggcucaagugauccuugccaccucagcucaguagcugggacccauaagcaugugcccauccccaacuaauuuucguauuuuuuuggggggcugggggguaaauacggggucucaccauauugcccaggcuggucucgagcuccuaggcucaugcagucccccacguuggcccccacaaaguguaggaauuacaggcaugagcuaccgugccuuugcuagacaugcuuuuuuuuuuuuuucccccagauggagucucgcucuguugcccaggcuggagugcaguggcgcgaucucggcucacugcaacuucuaccucccagguucaagcgauucuccugccucaguuucccaaguagcugggacuacaggugcacuccgccaugcccagcuaauuuuuguauuuuuaguagagacgguguuucaccauguuggccaggcuggucucgaacuccugaccucaggugauccacccgccucagacucccaaagugcugggauuacaggcgugagccacugcgcccagccaacaugcuuaauaaagaucacuucgaagcuuuaugucugacagugaauuucauuuuccuagggcucuuucuacccagggguuuauguauuguugugcgggcaggaguagcaguuuucgugacccaggaaugaucaguguguggcuuccuguuccgguucuuagccuuggaggcccuuagcuugcaugcccaucagcaguggugggaguguuugucgugugcgggucgcauguugcuuugcaaacaugguuuucaccuucacaauccuaagagcuuccuuuguuguccccauuuuaaaaacaaggaagugagauauggagaguuggcacuuggccuaaaccacauuucacauacagcagaggccagagcaggauucgaacccagcucugucugccacacgccugugcugccucuugaaggugcuugaggaucuugggaggagaacugaucccaaagugggagugguuccuguaucccgggucccggacccaccgccuuaucucagagacauucucuuggcagaagucaucaaugggcagcauguuccggcaacaguccaucgaggacaaggaggacaagcccccaccaaggcagaaguucauucagucagagauguccgaggcgguggagcgagcccgaaagcgccgggaagaagaggagcgccgagcccgggaggagaggcuggccgccugugcugccaaacucaagcagcuggaccagaaguguaagcaggcacgaaaggcaggugaggcccggaagcaggcagagaaggaagugcccuggucuccaagugcugagaaggcaucuccccaggaaaacggcccugcuguccacaaagguaagagcugggccgucuucccaccaacuggaaacccuggccuguuguccucgucuuguuacuugcaacugccuuccuucuuagcuagcagaacguauggcuuacaacgagaucguauugggaagcaucaguuauuaagagcauaggccugggucaaaugccuggguucugauccuauuugaacuucuuuuuuauaauuucaacuuuuacuuuaguuucaggggguacauugugugaugcugagauuugggguaugaaugauccuaucacccagguacugagcauaguacccaacagguaguuuuucagcccuuuuuccuucucccaucugaacuuguuaaacuagcuggugagcaccucaccucucugaagccuguuucuucaucugugaaaugggaugaguauguaccugccagcacgcggagggguguacagcacgcuccaguuucugggacauugaaaccaugcaucuacucacugaugauacucaucaucgucacuauuauccucgcuaucccugccuaaucaaagacacgugugcucuaggacuuuaauaaaaccacagauccuuuaacauggaauaaaaauaagcccacuugcuugguagaauacauuuuuuccugguguugauucuaaaaggaauggaucacauggcccuauuuuuuuuuugaaauggagucucuuucugucacccagguuggaguggugugaucucugcucacugcaaccucugccugccggguucaagcgauuuucccagcucagccuccugagcugcugggauuacaggcgugugccacgacgcccagcuaauuuuuguauuuuuaguagagacaggguuucgccauguuggccaggcugguuuggaacuccuggccucaagugauccaccuggcuuggccucccaaagugcugagauuacaggcgugagccacugugccugggcaacacggcccuauuuaagaguaaugaagcagugcucuauaaugcagagugucucuuguagcaguuuugaagaauauaaucagcuguuuucuuuauaauuuucuuaaauaaacucagaucagcucuuguuaggagacaaggggauguuugaggcucugaaagcuucucggguuagagaguccuagugcccuucuggccagggaacucauuucuaguuuuucuucugcccuccuuucauuaaagguugagugaggacugugccacucuuauaggaaaguugcacugagcauuuucugccugucaggcacuguuuucaguauauuauuguaauuaauucaauucuuacagaaacccuuggugaacacaugguaguuauucuuauuugcagaugaagaaauggccaaggagagccugaaaaaugugccuaggucacauagccuuucucuuguuuuuguuuuuuuccucuuuuaaaaaaauguuuuuuccuuuauauccuugccagcaggaagucauacacagcauuuccauauguugaguuccugcuguucagauguuggauaugugggcugucacugaguucauggcuguucucuaucaguccuuuuuuuuuugcuggggggagauggagucuugcucugucaccuaggcuggagugcaauggugugaucucacugcaaccucugccuccuggguucaagcgauucucucaccucaaccucccauauagcugggauuacaggcgagcgccaccaugccuggcuaauuuuuguacuuucuuuuuuucuuuuuuuuuuuggagacggauucucacucugucgcccaggcuggagugcaguggcacgaucucggcucacugcaagcuccaccuccuggguucaugccauucuccugccucagccucccaaguagcugggacuacaggugcccgccaccacgccuggcugauuuuuuguauuuuuaguagagacgggguuucacuguguuagccaggauggucuguaucuccugaccucgugauccauccgccucggccucccaaagugcugggauuacaggugugagccaccgcgccugucauuuuuuguacuuucaauagaaaugggguuucaccauguuggcgaggcuggucuugaacuccugaccucaagugauccacccgccucagccucccaaagugcugggauuacaggugugagccacugcacccggccuuauuaguccuuuuuaauaaaacaucuuccaccugaagucacaucucagcucugccacugaccgugugacccuggacgucaucuaaccucuugacccuuaguguccuagucuguaaggugacaacaggugaagccuccucacauguguuguggggagucccugagcuuguguacgugaugcguuuggcacagggccaggguucagggacgugacuguucuagcaguggagcguacgggccaacaggaagaaguacuuguuuguaaacacuugguuggcugagcuucugugagcucacugugucauuucucugcugguauauucucuaggcuccccagaauucccugcccaagagacccccaccacauucccagaagaggcacccacaguguccccagcaguggcacagagcaacagcagugaggaagaggccagagaggcuggguccccugcacaggaguucaaguaucagaagucccuuccuccccgauuccagcgccagcagcagcaacaacagcagguaaacagaugagaugguaaaagacugugauaaacaggccugagugccgagcagauguuuccccuccucguccccaugccccaccuccaacuuagaaaaaggccagaauaucccuuaugugcccccaagaccaguggggacgucaggaguuguaccucaaaacuugugaccuugguagaucagccccuggccauuauuuauuucucugagugguggaggucccugggaaugaauacagucuuugugguuuauugagcuuguuuucuaauauuguuaaggaaccuauucagugcuguuugcagugagcuccauuuuucuagugugcaggcugguuguuuuauuucagagcagugcaccuuggacguuccuuagaggacaguguuucccacccugggguccucccaagguguaagggaggccugugagcuguuugaagagcugcccaagagaggcacgucaccuuuggguuacagauguagguuugcagguuucaaguuggacagcucccuuccugauguugcugcugaacuaguugugcauggccuuggaggggucaguuaugccccucucacccauauuucuucauguguaaaccaggaagaaugaauaccugccuuucagcauggcagaguguuucaugccauaucgccuauaaacuauuuuauuggugucaccguuauuggcuuuuuauaaacuuuauuuuuauuuuuuuauaaauuuuaaaagggaccuacuuuuuguccuaaagaucauguggauaaugguuguaauuccacccaucucuccuaguccugauagucuugaagcacucaucagcaaucgugccuacuagaguaguaauaaguaagggaacacaguagucaauacuaaggaauagugcauuuuggugggacacugagaugauacauagacauuacuuagugcacaccaaacagcaaggugugcaguaaauuauuacuaauauuaauugaaaauauuucaaaacgugugugccauggagaaacaaaccaaggacuuaaggcuuuucccaguaucucacuuaauuaccuuuaaacuucucaccucagccucuucucuccucugggcaccugggagccuuccagggaccgccuuuaaugugauuuuagagcaugggaguguaggcgagcacugcacaguuacucauguucuugggguauagaauuacugaugggggagagcucuggaauuacuugcgccaaaccuagcagcgacaauugcucuagguaacuccuuggggugcggaggaagugauggguaaguccuuccuuaagaauagaaggaauugccgggcgugguggcucacgccuguaaucccagcacuuugggaggcagacagaucaccugaggucaggaguuugagaccagccugaccaauauggugaaaccccaucucuacuaaaaauacaaaaauuagccaggcguggugccgcacaccuguaauccgagcuacucaggaggcugagguaggagaaucgcuugcacccaggagguggagguugcagugagccguggucgcaccacugccuuccagccugggugacagagcgagacuccaucucaaaaaauaaaauaaaauaaaauaaauaauagaaggaagucugaaagcaccagggcagccugucuggucauauucccuggagaccuaggguguagacaggagguggagcugggagauggaggcccacagccuucucuguggacugggagagugaaugacucaagucucuugauugaugagcuauauuuauugagugcucuuaauaggcacugggagugccaacagaacuguccagggaaucagcucaggaugugcuguagacugccaggcagguuggccgccuuuuuguuugcggaauggaagggugugugcuggaggccguuuggguguccucagagugugacgcagcagugaguccugccucaaggccaauucaggguuccuuuaggaauuagcgcccgaggucacugaugggauagagcagggucugaaaugaacccuccugagucaggcaagggccuugauuuugaauaguuacugauaauuuguuuacccauuugugcaaauguucuguauccugaguguggugcugugggcaagggugcacagggagucucuuaggguucagugaggguuaccagcaguaaaauccaucagcugcugugagugcaacaaaggagcacuggccauucugugggagcagaggaccggggaccuggucucgucuggggguuacgacaggcuuucuagaggaggauguguuuaaacugaaaaucugcguuuagggauggagggaagaggcgcuuaccuaggggucccaguguguucccguggccugaagugcguggcagggauauauggagcagaaaguggagggccagucuugcgaggcaaagcuagagaggcagacugggcaaagucacacgggacccaacccucacuguaacaccguaggucacgaguagccucguaggauuuaggcgucggguggagagcgguggagaaccacugaaggcucuuuugagcuagggguugacauauugggcguggggugucugugugaaaagaucauccuagucaaggauggaaaauggauugaagaggccuggagggagcagggaagggaugcugguguauuauuuaaccucagaugguagcugcagacaaggagagaaguggccaauguccagacauucugugggaggcugcuguucgguuccaggagugucugaucuaggugaaaaccuagccugucucguguagcacaggcacagaugagccuccauugugauaauggcauggcuguccaccagccuuggacagggaccugagcuugcaagcuguaacacacugggggcuuccccuugagcagcugcccaucccuccccuccuuggucuucuguucuaggugggcuuucugugcugccagcuggaaagcuggaagggcguguguuggguggcaucucugucccuggccgcaccagccugaccaagucucucucucucugugggcaggagcagcuguacaagaugcagcacuggcagccgguguaccccccgccgucccacccccagcgcaccuuuuacccacaccacccccagauguugggcuucgaucccagguggaugaugaugccuuccuacauggacccacguaucacgcccacucggaccccgguggacuucuaccccuccgcccugcaucccucagguaagcacuguggucugacgguccauaccuguaucacccaggauagcgugguggucaaggguguccucucgaguuaaacagauacaccuggauuuuggucuggcucuuugucaaguacacaacuggucugaguuucaaaguagucacuugcaaaguguagguacaauaauaguucugucauaaagauuuguugggaaagucaugaagaucguguaucauaaauugcuuuaauuaauuuuagauuucugcuaugucguuuuguccuucuucucauucuuaauguucuuugugcugucucuuuuuucuuugauuagucuuucccaagguuugucuagugccuuuuuaaaaucaguauuugggcuucuucauuccucuaacuuauuuggguuuuauuuuaauaaugccugcuuuuucuuuucuuauuuccuuuaaaauauuaucauauacuuaguuuauuaauuuuuggcuuuuaagauucucuuugcaguacuaauuucuaauguaguugcucuguggucagauaauauggucugugugauacagaccaggggucagcaaacuucuacuaaugaccagauaguaagucuuuuaggccuugaucagcuagucaguuuugguguuguaggacaaaaacagccauaaacaauaguaauugagugaacaugguuguuuuuccauaaaacguuacuuguaaaaacuggcagcaggcugaguuuuguuuaauggcuguaguuugcugaccaacuccugacuuagguugcuugacauuuguuggguuuucucuguagccucuuccauggcaauucuuuuuuaacauucuacauuugccugaaaagacuguauucucugguuggagauaguccauuaaguugagcaugcuaauuguguugugcaaaugucuucaucauugcaaguuuuuaucccuuugaccaguuacuaaaagguguuuuaaaaugucccacuaugaugauggauuugucaaaucuucuuugggagccugucaguuuuugcuuugucuaucuggaggcauacagguuuagaauuucuguaucuuguuccuuuuauccuuauguaguaccuuuguugucauuaauagugcuuucuaucuuuauugccuacuuugauagcaauauaauaauuauaguuuucuguugauaaguauuugaagucuuuuguuccaauuuuuacuguuagccucuuugagcccuuauguuuugggaguguaucuuuguaucuacaagauguguauagcuuuaccacucugaaagucuaugacuuuuaauugcaaaaguugguccuuuuagauuuauugggaugaugauuauuauuauuauuauuugagacagagucuugcucugucaugcagguuggagugcaguggugcaauuucaacucacugcaaccuccgccucccggguucaagcgauucuucugccucagccucccaaguagcugggauuacaggcgcccaccaccacgcccagcuaauuuuuuuuuuuuuuuuuuuuuuugagacagagucuugcucugucacccaggcuggagugcaguggugugaucucggccuacugcaaccuccaccucccggguucaagcgauucuccugccucagccuccugaguagcugagauuacaggcaccugccaccaugccuggcugauuuuuuuguauuuuuaguagagacgggguuucacuauguuggucaggcuggucucgaacuccugaccucaaguggucuaccugccuuggccucccaaagugcugggguuacaggcaugagccaccaugcccagccuuauugggauuauuauauuuagauauuccaacuaugauauuucaugcauuccauucuuauucuucucuuucugugccuuuucuucuaauuccugccuuuucuugguccuauuguuuuucuuuugcuucuacauuucauuucuauauguuagugguuacgugaaaauucuaacaugcaccuucaacuuagcaaagcauuuggggagguagaaaucugaagucuuugucccuuaaaccuccaugaaaguaagcaugugagucugaauuccugggagggggacaauuguuucccugcccugguccaggccagacagacccgccagucuguuccugguaguaaagcgcaugugucuaucuaaugugccuuuugaggauguggcccuuuugggucuuuguuuuaaacaaugucucaguuguaucucccugcccuguauagaaaggcuucauccccuguccugaguguuaaggaccaagccuauaucugacaaaugugcuuuucuugcccccuuccuuggacaggucuuugaaccaggcagggugcaugugugugugccuucagagguccucaggucaggaaagauuaagagcccuaugauguguagguggguggggugcuguauccacaugaaagucaggguaacuguuaacuucuuugggccuuugguugacccugagauuggagcagggcuuucuaaaugagaugauguagaucagucuuugccuucuucaggacugaugaagcccaugaugccccaggagucccucaaugggacaggcugucgcucugaggaucagaacugugugcccccacuccaagaaagaaaagugacccccaucgacucacccccuguguggagcccagagggcuacauggcacugcagagcaagggcuacccgcucccgcacccgaagucgagugacaccuuggcuauggacaugcgugucaggugagaugaagccugguccugcugccuugccacugaaggaggacuccagguccuaauugagagggcccugggaugagcuaccauccuaggagacacugcccacgggagacgugcuccuugaagggacuccugguuccucuggggaaggagagugugaggaggauugcuugaaugcuuuguccaagaggcucuuuucagauggugagacguaaggugaaggagaagucccgggguccucaaauccugggcacagggcaggcgggugggggcuucacaaggcaggugggguccagagcaugggucuuggcucauuucuguggaaguaaacagaguuagcccugccacccccauagccccagacucuucacggccucccaggcuccagcuugcucuugcucuuugacccggaggauugccuggcuccucugucuccagggggcacaccguacccagccugcggccacgacagucuucacucucaaggacuccaggggccaccgaccaauucauggccuggcauuucugagacguguuuaaagauagaacaaauguugaugcuuauguuuuuuuuugguuguuguuuuuuguuuuguuuuucuagcuuucuuuuuaaaaaguguuuuaguuuuuguuuuuguuuuuucuuuuuaaaacuaagcucuguguucagcauggaaaccaggaaccaggcuccaaucgcauugacugauuuuucugguuccuuuucaggaaugaaagcucuuucucugccucacucggaagggcagggggcguaagugcucagcgcgaucucuuugaggagagaggggaggaguacuugagugcuuuugacaagaaggcccaagcagacuuugacagcuguaucucuucucaaagaauaggccaggagcuuuuguuuccaccccaagaaaauguucaggaugcaggugcuccugggggucacacccaaaaccucagguguuccccauuggagccugacuuugucccagaugagaaaaagccagaguguggcaguugggauguuagccaccagccagagaccgcugacacagcccaugguguugagcgggagacaccccgggaggggacggccuuuaacaucuccuccugggacaagaacgggagccccaacaaacagccauccucggagccugaauggacucccgagccccggagcuccagcagccagcacccggagcagacgggcaggacccggaggucgggacccaucaagaaaccaguccugaaagcccucaagguggaagacaaggagaaggagcuugagaagauuaagcaggagcuaggggaggagaguacccggcuggccaaggagaaggagcagagccccacggcagaaaaggaugaggacgaagagaacgaugccucucuggccaacuccuccaccaccacuuuggaggacaaaggcccuggccaugccacuuuuggccgcgaggccaccaaauuugaagaggaggagaaaccugacaaggccugggaagccagacccccacgagaguccagcgauguuccccccaugaagagaaauaacuggaucuuuauugaugaggagcaagccuuuggggucagaggacaggcccggggccggggccgugguuucagagaguucacuuuucguggucggccugcuggcggaaaugggagcggccucugugguggggggguccugggggcccgcagcaucuacugcagcagucagcgcagcggccguggccggggccugcgagaguuugcgcggccagaggacugccccagagccaagccccgacggagaguugccagugagacccauagcgagggcucagaguaugaagaacuucccaagcgccgccggcagaggggcuccgagaacgggaaugaaggcucgcuccuggagagggaggagagcaccuugaagaagggcgacugcagagauucuuggcgguccaacaaggggugcucugaggaccacagcggucuagaugccaagagccgaggcccucgggccuuugggcgagcccucccuccccggcugagcaauugcggguauggacggagaaccuucgucuccaaagagucaccccacuggcagagcaaaaguccaggcagcucuuggcaggaauauggcccuuccgacacaugcggaucccggcgaccuacagacagagacuaugucccagauuccuacagacacccugacgcauuugguggccggggcuuugaggacagccgcgcggaggacaagagauccuucuuccaagaugaacacguggcagauucugaaaaugcagagaaccggcccuucaggagaaggcgccccccacgccaagauaagcccccucgauuccggcgccuccggcaagagcgggagucccugggccuguggggacccgaggaggagccccaccugcuggcaggucaguggccaggcaggcccaaacuguguucuggggacaagaguggcacugugggccgcagguccccugagcucuccuaccagaacuccuccgaucacgccaaugaggagugggagacggccuccgaaagcagcgacuucagcgagcggcgggagcggcgggaaggcccuggguccgagcccgacucccagguggaugguggccugucgggggcuaguuugggugagaagaaggagcuggccaagaggagcuucuccagucagagacccgugguugacagacagagccgaaagcuggagccgggaggguuuggggagaagcccguuaggccaggugguggugacaccuccccucgcuaugagagccaacagaaugggacgccuuugaaagugaaaagguaaaaccagacaccaucugggcccuuuuuguuguuguguucuguucucagcagcacugaguucacgcaugcaugccgaugccgccgugugucggggcugggggccugcccccaggccgucugugcgcgucuccauugccugcccccacauugccugucugcuucucguggugguguuauuguggcuagagcucccacccccacccccaccccaguggugcucuugaggccacuguccagcaccugaccugagaguccagucaugugucccuggagccccgccgaggggccgcugcagcgaggaacguugccugugcacagugccaggugccggucaguccaccagaguccucugcuccggaguugcugccaggcggcguccuagggggcaucgcuggccucguggcugcauggaaguggcucuuccuagaugguucugcuucuccacugugaggagacguggccccacggugggguugccaccucagcauggcaggagcccagcaaacgcagaggggagcaggcugcacauggucuggcgagcaccucuuccacagccagaggcauucgggugaugaccucugcucagggaccaggagaggguccccugcacagucuggguugacugacugcacuuggcuugugccucggacagggaggugcaggggcugcugaggccuucccuguccucagcauacugaggaagauggcuucacaccuccacucuccuuagaauucaaggcagagaaacucccagagaaggagccacagggaacaccgacucuuucagguggcaucuaauccagcuuuccaggcgccagaggcugacccuuggcuucaccucaguuuucugccccaagggcccuccggcagggcaguccuggagaggagcagaaaugcuggcgucuccauucugagcauauuccccuugucucucuccccccuacacucugaacauagcaugugggagagcccuggggagccacuuuccccaggagcaggcagagccggugggggcagccuuacacguauguuugcacacggacauggaugcacuguggccagccugccgcuccuccccacccgaggagucagcuagaggaagugggccuagaucagggugccgggcuugugugcaggcugugugcacgugcgguguuuucccuccuuccccagcucugguuaacaagauccucuuucccuuacagauccccagacgaggccuugccuggaggucuuaguggcugcagcagugggaguggccacucccccuaugcccuggagcgggcagcccaugccagugcugaccuucccgaagccuccaguaaaaaggcagagaaggaggccaaguuggcugcuccgagggcaggugaacagggagaggccaugaaacaguuugaccugaacuauggaaguaagucauccucauaucuucaggggaaagaacucaggcagaaccaggggccaugcaguccucgggccucccgaguuugcccuugcacugaguaccuuagcuuucggaacagcucggccaggcccugggcuggguucuggggcuguagaggugagcagaguagguaggauucccaccgaguguugcucacagcccguugaauccccgugacacccugcagcuuccgggcuuuaaagagaggaagccuggggcccagagacguucggugguguguccgaggucacacacagcuguaggagcagagcugggguuuaagcucuuugcguguucucucaguugugcccuugggccucuuugguuugggguaacaauguguuagaucagaggcggccugagaaaagugcggaaguccuguccagguuucugucgagccugaugcuagaucucaggcgccuguugaauuggguuguucuugucuccuggugaguggaaagacuguuccuucucgugaaaucuugguucaggugccaucauugaaaauugcggguccagccccggggaggagagugagguggguucuauggugggcgaaggcuucaucgaaguccugaccaagaagcagcgccgccugcuggaggaagagagaagaaagaaggagcaggccgugcaggugaggggcggagggugggggggcauggggcuggagggcaggcuggcagaugcccaggaaacccagagccagaggguaagggaguucucggucaagcucaagguggcagagaggaagaaaggaguauuuagcaagcacacauugucuccccguuccugcuauuaccaaggcccuucuaucaauguaggaauaggugguggcaucacuguuaugcaguggaagaaaccgagucuugaagagggugacuucucuagggugauaacaguggaaacuuguccaaggcaagaugcagaccuccgucaccucccagcuucuccuuccuccccacuccucauuccugaguggaaugagauuugucucccucaagucaaguggaucgugaacgcuauacuaaaauggagucagggcuggaccugcacacagauuacaguccguuggccuuucaggucuuucuuggggggugcuuugcuuggcaucgcaguucugcuugagguuuugggagacgagcguuccacacaucucuggagcauuuucagguggugugauuuuugguaccugggauacuuauccuggggagaauuugucagucuuggugccuuuggcuagacuacagcauccuuucuuccccucaggugccugucaaaggucgaggccuuuccucccguauuccuccucgauuugcaaaaaagcagaacaacuuaugucuggagcaaggugacgugaccgugccuggcagcagccugggcacugagaucugggagagcagcagccagggugagaguugggggugugaccccagcuguggcacccaaggucacaucacacacuggguuugcuucuggggaggauccugcuuuugagcuacgaauauagauggaauacagauggaguaccuguuugcuguguuccgcugcugagcuagucgcugaaugccgucugagugauuugcugcugcaacccccaaacggauacacaauuuuccuugccuaaaauugguagaagagcagagcauucauuagucuggugaucuggaaaaggauggccccuugggcuuagaucacacaguagugggaauggccuucuuuguuggucgucguuuucucccacuaacuuauggaagagaagcaaaugacagauagaccagccgcaagaguucaggagcucucuucugugcugugcacccuuuucuuaacauggggaaggcucuggaaaccccucccugaaugcucuucuggaaaggcaaacugagaccagaagacgguauacguuacuucuuagaacauuuguugcccugaaaacuuuuuuuuuuuaauucuauaucaaauguaauuuuucugggaauuuuuccuuauaaaauagaaaacuauuuucauagaauagguucuucuugagguuuaggugaggcagggcccugcgcuguuagcccagagcaugcauagaugaauaaaaacauggacauucgauauuucacagcucaggcccaugaggggagcuuggagaggucaccuagugccagcucauuuuucugcaaagcagcugaagcuucuagagggaagggacuugacucagggacuccagggucauaggacaagcacccgagacacugaguucugggccuugauucuuucacuguuuccacauagcuuguccucaugugcucggugaaaacuuugguucuugcaaacuacaaaauaacauucaacaugcccagcuuugauggaaaggaagcacaaccauuugauaaaacaucaauaacacuacauuugguaguggcugagugacaggugucauaguauugguguccaaaaaugcccaggugccagauugguugagcugccaggugugaaucagaugugacucucaggugugagucaucauccccuuuugucagaucuuuuacuccagaauucugcaggggcucauugguuucucagaccagggguuguguccaagggauggcuucagagagcccuuggauauuaaaauagcaugugaaaggauuuuuuuuuuuuuuaaagauggggucucacuauguugcccaggcuggacuugaaccccuggguucaagcaauccuucugccucagccuccugaguagcugggauugcagauaugugcccccacccccugcuagcaugucaacuuuugcaugcauaucuauuuuucugggcuccggauccauggccauucaaaaaguggucugugagcuuaaaaauuuuuaguaauacccgcugggaucuuucaaagacucuguagaagccaccaacuuuggccaggagugguggcucacaccuauaaucccagcaguuugggaggccaaggcuugaagaucacuugagaucaggaguucaagaccagcaacagagugagacccugucucuauuguuuaaaaaaaaaagaaggccaggccugguggcucacgucuguaaucccaccacuuugggaggcugaggcaggcagaucaccaggucaggagaucgagaccauccuggcuaacauggugaaaccccgucgcuccuaaaaauacaacaacaacaaaaaauuagccgggcgugguggcgggcaccuauagucccagcuauucgggaggcugaggcaggagaauggcgugaacccgggaggcagagcuuggcagugaguggagaucgcgccacugcacuccagccugggcgacagagcaagacuccgucuccaaaaaaaaaaaaaaaaaaaaagaaagauauauuuuuuaauguaaaaaaagagaagcuaccaacuuuuagaaauaguauaagugaaaagaagcaugagcauagcggaaauaacgacagagaauccagauuggcaggagugagggcucugcccugcucacucucuccuguaauccaugagauguugagaaacacguugggugaggauguggaaaguuggguaaggcugucagaccagcucuuccacgucagagccguucacugggugucacggguagggggcugggguggcgggugcaggggaggcaggggaguuggauuucugcaagcugugccugugcuuguucuuuaagagcucauaaacucucuagacggguugcucuuugaugcccugacucugucuuccuccccuggcagcucucccugugcaggccccagccaacgacuccuggaggaaagcugucacugccuucagcagcaccgagacuggcucugcggaggugaguguggccgcugcccacaugcugccccugggaugagugugugagugugugcucaccauccacacggccagcuugcuguggcccacccaagccccugccacagcagcugagcuuggaauuagguuguuuccauggggccaagcucaucagugguuuuccaucuugauuucuggccugugcauggggcgugcaugagcaggagaaagagaaaagggguaacaagggaggacccaacgcugggugggaagagggauucagggccuccucugaacuggugucagcagccacguagucugguuugggucacaagugagauggguuuggcagccucggucuggggcccauagaagauccuguggucacgagcucuaucgggguugguguguuuggccacacguaaguugucaggcauccucagcagggcaggaucaagaucaggaccagacuuggcaagggacaggcagcugggguagaaaagucucugugccacaugcaguuuuacucucuggauaaucgaguugggaguuugaggcuauaacccauuuugugcucugcacagcaggguuuuaagagcagccagggagauaguggcguugacuugagugccgagucucgggagucgucugcgaccuccucgcagcgcagcuccccauaugggacucugaagccagaggagaugagcgggcccggccuggcggaacccaaggccgacagccacaaggagcaggcuccaaagccaucugagcagaagguaaccuggacguuccagucacaguggccagggccuggguggaaggggccaucgucucaucaucuuccucaauuccugggacaguagaagcuagagaguguggucauuccagucugugugucuccaccucucugcuuuuuuaucaaggauucagaacaaggcucuggacagagcaaggagcacagaccaggacccaucggcaacgagcguucucugaaaaacagaaagggcucggagggggccgagcggcugcaaggggcugucgucccgccuguuaacgggguggagauucacguggacuccgugcugccugugccacccauugaauuuggagucaguccaaaagugaggcuuugauuuguuuucuugcuugcuuuuuuuacuuuuuauuuugguacuuggagaggcugggggcucagaugggauugucuccuagaaggaauagaaggaugggagccaagcagucuuccagcggcuagaguguugguguggaguccugcacauggccagugcucuguugaguugcuuuaaagauugcuucacugacaccagacaggccagugaucuucccuguuucugucaggccacccaagggacagggagaaagaagugaggcuggcguccugucuccugugccguggggaaaaucuggccaucucgcucauauguggcuccagugaaugcugcucaguggaguuuuugagucggggaaacugcaucacguuaauguaugccucuggggaauguagggccaggaggaucucagugggcuguguggccuuuuuuauuuuuucaggacuccgauuucagcuugccaccugguucugccucugguccuacugggaguccaguuguuaaacuucaggaugccuuggccaguaauguaaguccacacuuccacuuuuggcuccacucacugcuuggggcuggcaggcccugggugaaggagacagcacauguauuucaggcugaccugggcuggcacgugacucaguugcuagcagcuccauguccuuaaaaggugcuuaaauguuccugcccagguuuugugaccuuccaguggggaucauacaguuccuaagggcugguuuauuuggcucucuuugguuccauugucuccucugugccaggugcgagcccagacucaggcugccuuuucuguggccagggguaaggggcacagauugaguaggagagcccuccucaggaggccccaucucaccauccaagggucccugccgccugcaaucuaacuguugugauccagaagaccugcuggcgcucuaccaugggcucaggagcuggcaguugcaucuguuguggccacucggggcugcagcugaggcugucgcagugacaucugguucacugcucuguccucaccaccugcaggggugggugcuagugcauaugcugaaugaacgaguaucauuugggcagcguuucccagaggauuccaaggaaugugagugcuguacaauauucauagguguugaaugaaaacaauguuuuggaagugcugggcucuacgagguucuuuacucgagagucugcggucucugucacaugcagauggacaccggggaucugcaggaagcgggggcacuguugcauuuccagccucuguuaccagagcccucuuuuucaguuugcugaggggcacagccuucccugucuggcccagggcaucuccaggccagguggcaggugccuucugaaccagauguuugugugcgggcugccaguccauauuuauacugccgggacauggcucucccugucuggagggcacuauggaguguggauauggggguggcucucugcagacuuguguggaggaaacugauggaggcagccaucuccaggagaucagucaugguccuggcugccaucaguuucaucuggguggucuuggguacauguggccaauacugaagaugcauuuggacaauucauagacacggagcuguaggugcuuuugggaaaagccauggauggguuugggcaagucauagauacauuuggacgagccuugaguguguucaggagagccauggauggguuugggcaaagccaucucugcaccuguuuguguuccaugguuuccuuuuccuccucuccaggcaggguuaacacagaguauccccauccugcggcgggaccaucacauccagagggccaucggucucuccccaauguccuuccccaccgccgaccuuacucugaagguaacaccagcccugagcugggugagggcccacccaguaccuuagcuuacaaagaggcagaagggaggaguccccgaaccccuaaagcuuagauuggcucuguccacugccagcgugauaguaauuuucaucccucccccuccccuugcuucugaagauggagucugcgcgcaaggcuugggaaaacucccccaguuugccggagcagagcucuccaggcggcgcuggcucaggcauccagccuccauccucugugggugccuccagcggggucaacuacagcuccuucgguggaguguccaugccacccaugccuguggccucuguagcaccuucugcuucuaugccagguaucucauccccugagcaaggccuugggguccuucuccauuuauuaucaagaaaaacggauuaacagccccgaaugucaccuccuggccuugucuuaaguagcauguagaaguagcaacuuguuuuuaggcccaguggucguagcucccaugugcugcagguaaugugcacguccugcuuccccacgcugggaaacagaacugggggauaacagcgaggcacuccugccuacuggugacaggagcgagcaaaggcuugacuuugagucagaccugggucaugugcuggagccgugucgccucggcuggugagcagcucuugccgagccacaguguccucuccucucuuacaugaaacuccgugggguggccacacccgugaggccaggucuuaccuggaaagggcuuuguaucaacagagcccucagucacuggcagcuacuuuuguccugauugcugccauccuuaucgugugccaguguccccaaggggaagcguggggguuuugagggcccagcugccagucucagugauguaauuccaauagauccuucugacccuccacuguggacucaauagcagggagaugaagaggacagugacugagagaccaaggcagcccugguuaaaguagaaugccccuucgagugucugggguaguuggugagugggaggugggaaggguaggccagagcccaccugccuccucccuccuccuaggucugacgcugcacccucccuacguucccugaggugcgugccaggcguguugugagcaggcgugugcuuccggcacacagggaaccuagcagccucuguacacacgcccucguccccacugaguccccuggguagagcagaccuguagacuguuucccucagggacauugagaaguagugaggcuugauccucuucuacgucccuuuugccgcucuguuuccaggcagccaccucccgccccuguaccuggauggccauguguuugcaagucagccccggcugguuccucaaacgauaccucagcagcagaguuaccaacaggugacagcagcuagccagguggccuggcugggggugguggggaggagccagugcagggcggaauuggcuugcucaucuauuucucauugucugucugguuuuccaucccccucacauguggugaccagcaccuggcccgccacggcagccaggaggcauuuguuaagcgaauaaucgagacagggaagaggaguggaguuggcugcuccagacucugcuuaguuuuccuuucucaaaguucucccuccuguguccuagccggggaauuagcuaaaauggaauuuucuuuggugaucagguauccuucugaugaagagaagaaaggccuaaacucccaggcauggaugcauuagaaagagguagucuuagaaaugagcaggcguugguuauuuaugcaggacuggcauacuuucugugcugccaaggggugauuuuuggaagucuccccucuaaugcuggugcugggccuuugggauggucuagccgccccucagacccaugugccuccacagccacgacaguggacuuccaggcagaaucugcuccaagugcaggcuugcugauggaggauguggccucugcugaccucuuuuuaaaaacauguucuuaacugcuguauuguuugguuaccaagauuuugguucuugcauaacugggucagacugcauguaucuuucuuuuugugcauuguuaaauucagcguuauguuuuuggaacucaccucuguugacguaugugcuaggauccauuuuuguugcuguguagaauuccaggguagggauaugcugugguuugggguugcuaccaguuuuucauuauaggcuuuaucccaauagcaagggaagcccaggaaugacaugcuggcauuugaauuuugggcaguguuccagcagccauguggagaggggcaggggaggugggaggggaagaaccaccuggaugggccuugcgguuaccuccccgaccccguuuucccguucacaggccgccgcugcccagcagaucccgaucucccuucacacaucucugcaggcacaagcucagcuuggacugaggggugggcuuccugugucccagucccaggagaucuucagcuccuugcagcccuucaggugagcucauguaccagcuugcggagcuggcagcucacagccagggccuuggcccugugugcagccuucguccugcagcuguuuggugcuugucugcuuuggggccaguggggcggggaggggugggaguuugcucugaaucacucuucaguccguuguuaacugugcucuaggagaggccuggggcgagcugauauguggugggccguguuuugcuuuuccaugucaucuugccuccuuuccuugcuccuuccuccuccucuccccuugacucccugucuccuccccaccgcgggcuucuccgucaguguggcugccagucauuguggcugauguccugugccucguacagccuggaugucuucacuuguuuaauccagcagcaucagcgccaucuaggagcuuguucucaggccccauccuggacccucugagucgcgcucuggggguggggccggggaucugugguuuagcaagcucuccggggaucucugaagggugggaccagauccgcagcuggacucauccaccugaucccgaccaucugucuggcuuuugcagaucucagguguacaugcaccccagccugucaccgcccagcaccaugauccucucugggggcacagccuugaagccuccauacucggcguucccaggcaugcagcccuuggagauggugaagccgcagucuggcucacccuaccagcccaugagcgggaaccaagcccuggucuacgagggccagcucagccaggcugcuggccugggugccucccagauguuggacucccagcucccacaggucaggaauucagucacucuacccaaagcccuaggcuucuuuccuucacgaccuugccuuuucuuuucacccgccucucagugugugcuggccuaucgugcuguugguugguagccaccgugcccauuccucagcgugcaggaaaucagccucuucugaguagccccaucaccuuuuuuuuuuuuuggacagagucucgcucuguugccuaggcuggagugcaguggcaugaucucggcucacuacaaccucugucucccacauucaggcgaugcuccugccucagccuccugaguagcugggacuacaagugugugccacugugccuggcuaauuuuuguauuaguagagaugggguuucaccauguuggccaggcuggucucgaaccccugaccucaaagugaucugcccgccuuggccucccaaagggcugggaugacaggcgugagccaccaccccuggccccucauccaucucuuuauucuugagaccuggcuguccccuaagcacugccugcuccugcagcccccagacgggggcuccuuccuuucucccugcccuugugcaguaggguguggaauggguuaagaguccucuuuguguaguuguugaugcuucuagacuccucuucuuccuuccucccugaaacgccagcuuugaagcccacaccauagacugugccugacaagcccuucacucugcuauggugccaucaccacauccagugucugcugagaaaucuuccucuccgucaaccugugggcaguauuuggcaccuuugaaggucacccuccuugucuggucuggcuugcagucugucuccacucuccuguuccaguuccuagugguuuugaugucugcagagaugaccccgggucucugugccauggacccuguccaugcaguuugugcccuccucgccacuggugcccuuguucacaugggccccugcucugugcacuccugucuaggcuuggcugcucccaguagcuguggcucucgcauaaucucaacucucagugucccucucaguugucaccucuggcuuuuucaauucacucccucuagugacccaacuccaaaauucuuuuuuuuuuuuuuuuuugagauggaguuucgcucuguugcccaggcuggagugcaguggcgcaaucucggcucacugcaaccucucugucuccuggguucaagcaauuaucgugccucagccucccgaguagcugggauuacaggcgcccaccacccaccggcuaauuuuuguauuuuuaguagagauggggguuucaccaugucaggcugaucucgaacugcugaccucagugagccacccaccuuggccucccaaagugcugggauuacagguguuagccaccacacccagucucugccacccauguuuuugucauccucccccuuggccuggcuucuuccuccccaucagcagaucugccgagccacauggccuuugcauuucauccaagcuguggcucccagucaacccccacccuccuagcagcuuuucagacuugcaucuugccccucgcugccucccacccaugaccucccuuucugugucacccaggaaacaggagcagugacagucuccaagccccuguggccacaucccugccuaggugcugccugugccccuggggggcccugccccagcacaucucccucucuuucaugcaucagauaucccuucccgucaguacacagacgagcugcagugcugaccccguaaucccgccccccacaccccucgaaccacuuucuucacccaguuuccaggccgucgcuccuggcuuuccugcugccucaggccuccuccucagucuccuuugcuguccccucuccuucccagucuguaauggucagcaugcccgugggcccugcuuuggguguguuucaagagucauggcucuaaauuccuucaucuucuccucacucccaaauggacaucuuuagcucagaucugucccuggaauugaaucucaaauccaauggacuuuccagcaugucugcuauggugucuuauggcaucucaagacucaucauauucaaaacucgauuuuccucccgguccuucugcuuguccaguccacauccuccuuggcucccugcucccccucaccucacccccuuacccuucagcaggccugucagcucuggcuuuaaaaggauucagaauccagcugugucucauccccuccacaccccugcaugcuguccagcuccuguagggacuccuaccuggccucccugcaagucagaucauaccccaagucagcacucuauaaauggcagcaucuucccaucauuuucauccugcaccauuuuggugcuccaaggaggagcaugguguuuugcggcucuggccaccacaagucucagugauguaauuccaauagauccuucugacccuccacuguggacucaauagcagggagaugaagaggacagugacugagagaccaaaaguggcccagccccccuaccccauccuguuccccuguccuuacagucucugggcccacauccccaccucgcauaucuuguucuaguuaguuaggcccugcagcuacccuguucuccugucagcaugcuucaaaggacccccacagucuggaauccagcccagucuuguuuuuaccaccacuugaugcaaaacaguaagagucuugaacgugugugcuguacaaaggaaugcagagauauacguccgaugcagcuuucaucuuuugggacuuggcuucgccauuacuucugacuuuccucacucguccucuccuugcccaccccgccccgugugcacccauaaaucuggugugcacccacagauccuaugccgcucugcaucccgaguguccugcagcuguguccagugugugacacacuauccuggcagugugcaggcccauguuggacagggcccugccgcuuccuuggcaccuuguaugcuuucaguaagcacuugcuggacaaaggcagaaagggcugaagauagacgcagcccuuagcagagauguggaugagacacacuuaacgcuguuaguucccaugccugcagccagcuuagucuugcccguuuucucaccaccuacucuauuccagcaagaagacgugccucugccaucgaaggugugaaauccugggcgaucucuccugugcugcaguagaaauuagagcauguccugcuuuaugcaggcuuugcuuuaguucuucugaaguguaugaaucugaagugcaugugcggucgcucuuuggugcguuugggguuucuccauagcaucauucccccuccugacugucauugucgcccagcagcugaccaugccacugccucgguacggcuccgggcagcagccacugauccugccccagucuauucagcugccaccugggcagagccucuccguuggggccccccgaaggauuccuccgcccgggucccagccgccaguccugaacaccagcagagagguaaggggaccccaucugccucugacccuagggagggggccuugugucaccaacuuuuucuagcaagcuaaguaccccugugugguagaaagagccaguggcgugggacugccagggcagaaaggaaggugaccauguguggggccaucacagaggcagguccuggggacucugaacaugucgagggcugagggccaggaaucagcauuccuccccagcuccccaggaggcccugcuauggacggccauguuucauuggcucucccacuucacuuuaaaaagaacaaaauauugugaugguucuugcuucuaagaagaagcccucuugagucuggcuuagagggaaagggcuugcagauuucucuagaacagggguccccaguccccgggcugcagagcuguacuggucugugggaaaauugucuuccaugaaacugggcccuggugccaaaaaccacugcucuauaagaugccucccugggaauucccauggcccucaccaccucugcccuggguuguucaguaagugugugguccagcugucuccagggccucaaaugacagcuuguuccugcuuggucucucuagcccucucagauggagaugaaaggcuuccacuuugccgacaguaaacagaaugucccuucaggaggccccgugccaucgccacagaccuacagguaaagccacucccuggggacugcgugcuguguagcugagcaguugccagagcugcggcccagugacucagaagaaucugggcccagggagagccgccagagaccuggucccucuaugggccaugugucacugugguguuucagcacugggaugcacuuguguuccaguuaaauuugggggagugaggagucaggagagugguuuugguuuuaaucauuauaauaagaugcucuggauuggggagcuuucuggaaagguaggaaaaggaacggcugacauuuaguaggcaucaggacugacgugacuucccauuagauccuaaaaacaggacccacuggccacagggcugcauccuggcaaggggaggagcguggccuuucccagcgucucuuuccucagacuugcccuaugaccccugccaggggacuuuuuauugcugggcuuauggggccauuccuuccaugcuacaaaccagcacccucuuuuugcuuccuuugugucugucuccaccuccagcaacugucucagguccccuuagcuggauacucagguggcucugucggauguuggcgagagccucugguccacugccuuuucugcccgugcuggugugugaaggcagcacgcucuggcccugggcuccgagggcuuguacaguccacccuuguuacaugugggagauuccugagaccccucuguguuuacaaaugagugaaacagaccugccugacccauggugcccugugagguuaacaccaucgcugcagacgccaugagguauccccacgacuacacagguacuugugggccugaggagcgcucugcaagccgggcccccauggucugcaaguugcuccagcugcacccccucugccuugcugcccucccucugccccaccgcccuuugccuguccuccaucacagcauuccacucuuguaccuucauuuccagagaaagggguuuuuguagauuuuccucccauuccaucuuuucuguucuuauuuucacucuccuggcuucauuuauuucuguuuuuaguacguuucguuuuccuaccaugucugucacauagaccaaaacaucaggacugugugaaaaagauagcuggacagcaccgaccauggagcggaacuggaaggaggaaggcggcugcaggucucagcagacgcugucccgcugcugccacaggcagauuccagcagccucuggcuacagagccuuccucaaaaagcaaaacccagagacagagccucacgggacaagagucgccugugucuauguaguuguaggaaugaauggcagcagauuauucuuuggagcauauuuagaaaguggaagccuuaaacuaguagcuuuguuucuaugguguuuuagggggguuggggaaauugcuauaauuguauaaagcaguguuugccaaaguguucuggaaauagagcugcugagaugugcgcugcaaaaacaaggguucccuggucagguccuugggggagugcuguccccaggguggccugcuggggaggguacucaccacacaggcugagcgggccuagguugagaguccuguugaacucugcacacggcacuuaggcuuuuugaccgcagacuuuuuuuuuuuccacguagcaccuaauuaacaucccugggaacuaacuaguggucaguggaacacauuuagaagcauguuguacauuuugguucccccauccccuuuucugaaaagugaagacuagaacaauacucggcacaguucuggcucagcgucaggcuucuaggccuuuugucuggggcacugcaucguguugguccagacccugagacggccagugucgcuuucugcacagcaggacagccaugcccaucuguacagggccucagccucccucucuugcggugcgucuccuugagcucuguccuggaggugccaggguggucagugacagccacccccucacccuucugcguucugggcugucuuaggucugugguuguuuuccauccaagagauccacggaccgucccgagugagcgccucuggccgcaggcccuuccuuccuugugccuccuccaugugcuaggcuuugacuccauuucuguggugacacguuguguauucucaaccccugccuuugguuuuuucaggccuagcucugcuagccccagugggaagcccucuggaucagcaguuaacaugggcucugugcagggacacuacgugcaacagguagaagauggcuuuccagacccuucagcccuggacacuuaggcccgucuccaagcgccaaaagagaagggacuguccaaccuaucugagcgcccccugucuaaagacagccaugcccuagcgguuagagcacagaaccgggagcugggccgcccgcgucccuccuggcgaaggcauuucuccucuugacgggcgucuggauccuuccuuguccugcagagaagggaggaugcugauuccucugaggagguggugcuggaagguggaccagcccuggcaggucggggcugaggcgcccugggagacucgguuagguuugggggucggcuuuaggagccggggugcgcgcgcugguucuagucaguggugugucucaucuuugucuuggcugggugggagcacaggugaaauuaaguuuucccauuuuauaaugaaaaggacaucgcagugucuuuuccugcacgcacuauucucuucucuauucucuaaaacgugcuggggcucagagcuuaagccccucagacguggguuuuuaaucagucacugugccuggcugguagagaugggaagugauugcucucauugguuccccuaggggucaugaaaguuguguggaaugagcuucuaaagcuuucuuccagaguucagaccugguggggggcagaugcgcuggcugcucugugacuuccccaccccacuccccguguagagccacagaccaggggagcccugacuaggaauggggccccagggaaagguuacagagugggaaugguggggggguuggcugaaucgcggccagagaucugugggggccaagucugccuagggccccagcagacagucgggggcuccgagacgugcagggggcacuuggaucuacuugaaggggccuuuuuugccuguggggcaggaggugcacugauuugaaaagguucuuccaguuggccuugggaccagaacugcuuccgcccugggaugugccaucgcggaauucuuuguggaggacccggugucuuccugccucuccgaaucacugcacucagggcuuauggggagggagcagagacggcacucgcgccacuuuccuuacuaggagggggguuucuaagucugguccuucaaccaagggacugacaacuuaggggagcuuucccugcaacucaggagcaggaagggaguggugggaacuauguauccaaacacguuucagcgucagggucacuuuguuuuucccauucaucuguccaaaggcaaaacaacgaguggaugagaaacccagccugggagccgugaagcugcaggaggcccccucggcugccucccagaugaagcgaaccggagcgaucaagccucgggcugucaaaguggaggagaguaaggccugacagugccuggcugccaccucgccucucccuacugaggacggugccgccaugcggccucgacacagccgacacucgggagccucaccagauccaccguccaaaugcguggcccagacugagagaccucccuccucuccacucccgaaagcuccguugucaaccagcuugcacccguggauauauggcauugacccgcuugcuuugauacgaaacaaaaaagcagacgacuccuucaucccaucugcuccuaccgugacuguggagugacgccuccugugcagugcagauuugcccucccugccuccucccuguccugccgcgcagccagggcgccuucucagcagugcuuccggcccagccgcccaucccuaggcacagugauuuggcagcagggucauuuuacuuugaggcuuuuuguuuuaaaauguagccaagguuuuuacaaaggggaaaggaaaagaaaacaaaaacgcaagcuccauguguauagcugaacuuuuauauguuucuugccagccccuccgcucccuuccaucucuagccucuguccuguuuaguuugauacgucacugcaguaccuuaagaggugacucuuaagaaugcauccccuccugauuccucagcugguucacccuugagguuauuugcaaaaagaaaaggagguucuugagggcaccgauugcgagcauucuggugccuggcuccccgccugggaagcgauggggugcucagagcagcaggcagguugggggagggggggggucauaguuggguuccagcuccuggcuugaugagcccagggcgcuuacaggcagcccaugaaguugaugacaguuuuagcaugagaaucacacagggucccuguccugggcuccucuaaagccaguggaugugcugggcaccagagacaaaucauggagauggcugcugguggcucccagguuggcccagauggggugagcugacauaccacaggcccaucccaggccccgugggcucugcuucuggggcuccauacccugcccugcaggggugcuguguuuuucacacauuucuuucccugaagccuucuguaaccugucauuuuccuuccuuccucuuccggagccugcugcuuucucuggaccugucuccaccucccacacagcucaucgugaacaccacuuggugauggagggaguggacccgugugugguccccaagugaggccacugggaguuuguccuuuuccuccuuugcuucacucccagcagcagacccagguugucaggacaggagggccugagcuaagcaguaggcaucagucucguuugucuucagacggcgggggcagguccagggugaggcuggguggagggcugaccaagguccaaagggccugcgcagccuccgggagggcagcuucuccagccagaggcuugugugagccaucgugugcugggcuuguuuuuaaguaagaaacaaggaaaucacuccagauucugucauuccaaggaaagggaaggggacaguucagguuucucagcuguucuuaggggucacugagcgucuaccuccuccuccagaggaggcuggcucagaacaccuagaggagggggccggggaugcaccccccaccagaggcugccuucagcgucucacgggugcaggacagcgcucaggcuugggcucuaagcucugugucuaguguagaacauggggaaggagcaucuuaggaacugcugaaguaacuucuuacugcucucacaauucuaaggaagcgggagaacggccuccuaccaacagcgcccaccccagagcugccugggaaagggcaguuuuacugaaaggugcuuuacuguucaccugcaucuuucagcagcuccccuccugcccucaccuggucuuuucccucuuuaucccaagccuuuaugcuugagucccuuccccaggggcugcccacccgacaguuccaggcauucccuaccugagcuucuugucugcuuuuccuucucccacugcaagcggcugcuuguggggccugggaugagcccucucuguccccaccggcccuccuugccaagccauuccugggugaguucaggccugcgggagccacacauucaucuccaccuggacacuugagccgcauggccagaccccucccaccugaugcgguggugcgugugauuugucaaaagaaagccuucuggaugcuguuaagauguacccuucaggugaaccugguaucagacccacaguacuugcuguuugagaaaaaauaaaaacaaaaaggucaccuguucuccagcccuuuucucuuaccugguauuuccuuccuuucuccucccccaccccaaauaaaaaaacaaaaaacacuagaauuuauuuauauguauugauguuguaggucuaggugaaaaaaaaagaaguaaauguuucacugcucuauuuauauauaaugucugaauuaauucugugcaggaaaggccaggaaauugcaugugaaguucggugcagucaccaccugugugugaccugagcugcagucucuucgcugagaugcagguuuuaaaugagacuuggggggcugagggcaggccucaggccucccagcgccccaaccccuccuuggucuaaugaaaugcaguucuuagugcagagauguuuuaaggugcaauauaucucuuccuuucccgugguuuuagagccaagcucaagguaguaggacguagggucuuauuuuguuuucaaacccccauccucagagcgcagauacaugcagaggcuucugccaggauaccacggggccuuagugggaacagguggagaccagcacuucccuuuccugcugcugagguagggauuggggggucagaacccacucacuuuugccuguuaaaguugcccuccugacgcuggcagcucugccuuggucacuggggaugcggcucguugcucagccaccaguggccuugcgguauuguccaccauccacuagagugggaugaaguccagaguguggguauacaucucagaugcccaucuacccacuggggacuucaaugccagcugcauuugguuugguuuucuuaacuguuggcuucuccccacagcguuuuuuguuuuuuuuuaaacauucauauuguuuucaaacuuggaauucauagacacucuggcucuagguuccuuaagggggaaaacaaaagaugacuuuauuucacauucaagaaaaucaguucaguuccaaagcugugguccuuccagccacuucuagggacacuggggaaccuuguuaaacguugacaucagugcucuccagccgugcugucacccuccuaucuucuggaucugccuucgcgauggucagugacagcuucuggaagcugagcacacacaggugcacagccaugcuguggucuggccugcuacggcagcauggcagcucugguggagccuucucccuugccauuugguuccccugugccaaguagcugcaggcugccccucaaaucuucauuugucccuuuucacuuccugcagaacaagccuggguuagagggucugcuggaaauggccuuugaagaccaaggauaccaggaugugugcacucugucguguucugugaugaaugggaaacguaggcuuccagaaagccagcucucuucugaaaugugacggaccuaagcaggaagucauccaggacaggaguggcucaguguuggggauggacgcugucgcccagccaugcuccaccagggccaccaauguguaguuggcugguggucuucgggcaugugagaccugcucuucacuguuuccaccccacuugguggccuccaggaugguaguggcacccucagagccccaucuucagcauguucugaagccucagaguggaaauuccugcuaaggcucuguguggacgccuuucucccgugaucuaaaggggacacuguacucaagcuuuugaccucaugccuuguguaguaaaaaaggauuuggggguuuuguuugguuccugagaggguuguguuuuguuuuuguuuccuuuuguuuauguuuuggccuuuccucuuugucuuuccauguagaccagauauuugaaagggcagacgauggcuagagguguaaugugcagcuuguuuauacgguauuuugggaaacuuaccuuggaugggaaaucgaaucguggauucaccaggccggugcuggcacacucacccucgcccuuucccuccgguucaguaccuauuguuucuccuuucaaauaugugauuguacuagcucuuuccauaugaaagaauucuccuuauuuaaauaaaaaaaguuuaa

SEQ ID NO: 191192 - RNA, 11049 nt, Homo sapiens
ggaaguugggcccgggccgccggggcugggaauucggagacuauagcguccccgccccggguugggaagugggaaguggcacaggagcuaggauccagaagcccagaggcucagcggugcuucuggaguuccagugaucccggagucugaaccggcagugagaguggggaaagaggguagggaagagacucaggaauucaggcuugaaagauccaggaguauugaucugggggugggcuguccaggauucagaagauuggggauccaagugccuggauuugggggagaggcaggaaucagggguaguggagggccccagaaccuggaaaauagaaaauguccgcgggcgcugugucaagagccgguugcccuagaccagacccugaugccagugaggcggguggcacugguuugaugaggguggagccuccaaccagccuugagguccugagggugggaggcacggaauaugaggccuaaggggaaugaaauagcacccccacucccacuuccauugugaacccuccugaagccguaccuaccugccuuccuggcugagugaccccuggcacaccccuccucccucugaguugcuccucuguggguuggaauguggaaccccagagucaugaggguugggguggagcuucggggaacuccagaauucgaauaccccagccuucuguaguucuggccccgcucuggcagggagcaauauagcaauggaccccauuggagagaaugagggcaaaggcccaggagugaagucgggggagccugggcaggaagcaaggcuagcccguuagucaugccaccuucuuuguguagcacucccuggguggggcugaacugccccagacucccauuuuugccagagcuggaaagaugccauacucucuguugcuuaaccuacaggcuaggcuaacagugcuggcauggcaggcgggccugguacuggccuuguugcccuggcuuggccacuggucugcuggcugucucugugccuguggacccugagugagccuuaaccuacuaucugggcacugugguugccaggaugccgugcgcaugcucaauacccugcagaccaaugccggcuaccuggagcaggugaagcgccagcggggugacccucagacacaguuggaagccauggaacuguaccuggcacggagugggcugcagguaagguagagagggccugugaccaccucccacccccauuugugauucccguagcugaggcagggaccuugucugucugucccagguggaggacuuggaccggcugaacaucauccacgucacugggacgaaggggaaggugaggggcaggacccugggguagggggucuauuaaguggcugguggaguagagccugcccagacaaucccuuuucuuucaagggcuccaccugugccuucacggaauguauccuccgaagcuauggccugaagacgggauucuuuagguacuggcuuguggggggauguggugucugugucccaauggacccuggggggcuauggaaccagccagugcuucaggaccagggucacccccaggaggucagcugcaugucucucugcccaguguuuauucauucaauaaacauucaguuagcacuuaccauauuggcccauguuuauggcaaccuuuaauuuuuuuuuuuuuuuugagacugagucucacucuaucgcccaggcuggaguacaauggcacgaucuuggcucacugcaacccccgccugccagguucaagcaauucuccugcuucagccucccaaguagcuuggauuacaggcaccugccaccacaccaggcuaauuuuuauauuuuuaguagagaugggguuucaccauguuggccaggcuguucucgaacuccugaccucaagugauccgcccaccucggccuccuaaagugcugggauuacaggugugagccacggugccuggccuuaauuuucauaauuaaaaaaaaauuggggaaggggcagcaacuuuaauguauaaacuaaauauguagcaggagguccagugugguggcucaugccuauaaucccagcacuuugggcagcugacaugggaggaucaccugagucuggggaggucaaggcugcaguuagcagugaucaugccauugcacaucagccugggcgacagagcaaacugcuaucuuaaaaaaaaaaaagaaaauuacauagcuggaauagucagauggucagaugucucuuuaauaacuuaaaguccagguugagugugguggcucacaacuguaauccuagcacuuugggaggccaaggugggaggaucacuggagcucaggaguuugagaccagcuugggcaacguagugagacuucaucucuauuaaaaaaaaaaugaaaagaaaaaauuuuaaaguccauauauaacuuuaaaaucacauagagauauuuaucaauuaguaugucuuuagaguaaggagaaaauugccuugcaagggcuuaaacgauaaggguggcuugugccauccacguuaaggucuccuaggcgggcugcagauaggagcccuucugcuuggccacucuccacuguggcuuugcccuggggcagcgcccccucuuggucucacuugucuagacuuacacaagaggauggccagguggaaccgggaucacucuuccugugccacgcaugucuucuaagcccaucaccacgaacuucugaaaucagcugccuaaggucauuucaagccgauauguuuucccuaaacaguucuuguucaaauaaagagauggagaggaggacuuacuaccugaguagcuuugaggauugaaacauaaggcaccaaccugucuucuaaaaucacuuuuugggccaggcgugguggcucaugccuguaaucccagcacuuugggaggccgaagcaggcagaucacuugaggccaggaguucaagagcagccuggccaacauggcgaaacccuaucucuacuaaaaauaccaaaaaauuggcugggcacgguggcucaugccuguaaucccagcacuuugggaggcugagguggguggaucaccagaggucaggaguucaagaccagccuggcuaacauggcguaacccugucucuacuaaaaauacaagaaucagcgaggcgugguggugugugccuguagucccagcuacuugggaggccgaggcaugagaaacgcuugaaccugggaggcagagguugcagugagccaagauugcaccacugcacuccagccuaggcgacagaacaagacccugucucaaaaauaaauaaauaaaaacuacaaucauuuuugggauaaaaaccuagccuucaacuugggcccacauggccuugagggccagcccagggcugcagcuugaacauugguugugggcuuugucucugagagcuguaagacagaugacauugugggacagaugucagcagagugacugauugguaugggacuguuggagcccauagaaugugcaagaccagccugggugaggaggcugucuuaguugagaccaacguggugaauagggugagccaggugcagaggccuggagauagaagauggggaggacuggggggcuacagauaguccggggggauggggcaccaggaacaaaccgagggacacaggagagaugaggcacggaggccaguagcaucagucccugcagggugggggaaggccaggacgcucgggaagggaguccugaugaccccagcugucccggcagcucuccccaccuggugcagguucgggagcggauccgcaucaaugggcagcccaucaguccugagcucuucaccaaguacuucuggcgccucuaccaccggcuggaggagaccaaggugccgcaugcaggagggcuggcggguggguaugguugggggugcuacguguuccagcaccccaucuccccagagaaggggcugcaugggcucugggcccugacaugucccugugccacaggauggcagcugugucuccaugccccccuacuuccgcuuccugacacucauggccuuccacgucuuccuccaagagaaggugugugcccucucccuagaacccugcaucugaggccuugggaacgggaaccucagcaggccugggggcucccugcuuccaugcggccucugggcacccucauauccccugccaugcccucuggucuuugacagguggaccuggcagugguggaggugggcauuggcggggcuuaugacugcaccaacaucaucaggugagcgcaguugcuugggacgagggguggcagccaggagcacagccucaccugccgccugguggcucagggcagggccucauggccuuuuccuccccugcaggaagccuguggugugcggagucuccucucuuggcaucgaccacaccagccuccugggggauacgguggagaagaucgcauggcagaaagggggcaucuuuaaggugaccaggcagacugggggaagggagagacauggaaggccugggagucuacguuuucauccuggcuucacugugugacuggaacaaguugagucuccucuccagacuauuuccccauugaaacgugagggauggcugggcaugguggcuuauaugcuugcaaucccagcauuucaggaggucgaggugagaggaucaccugagauccggaguuugagaccagccugaccaauauggggaaacucugucucuacuaaaaauacaaaaauuagccagguguggugguguacgccuguaguuccagcuacuugggagacugaggcaggagaaucacucgaacccgggaggcagacguugcagugagccgagauugcgccacagcacuccagccugggugacagagugagacuucaucucgaaaaagaaaagaaaagaaacaugagggaugagagacagugguagcccagacccagggaugugggggccagagauaggaguguggaggaugcuagguagcccuuucucucuccuucuucccuccacagcaaggugucccugccuucacugugcuccaaccugaagguccccuggcagugcugagggaccgagcccagcagaucucaguaagucugauuggaauggggcagcggcaggguggguuugugucccuccuguuugaggaggcacugcauccucuggggccucaguuugcccaucugugcagugaggacgcugggccagcugccaggccugcuggaacacaucucaguucugggagcagggcuugguggcugggggaggggagagaugcaagggcugacguggucagggagggccucugcugacccgcuccugccugucuccccuaguguccucuauaccuguguccgaugcuggaggcccucgaggaaggggggccgccgcugacccugggccuggagggggagcaccagcgguccaacgccgccuuggccuugcagcuggcccacugcuggcugcagcggcaggaccgccauggugagugggcagcugagugggcaggcagguggguggcaccuguggagccugccuaggagggucccggacacacuuggucucacacaccccgcaggugcuggggagccaaaggcauccaggccagggcuccuguggcagcugccccuggcaccuguguuccagcccacaucccacaugcggcucggugaguuagaccuuccugcccagcugggaccacugcgugugucugugccccuucagauuuuuuuuuuuuuuuuuuuugguuuucuguuugggagauaagagacaauuugaaguggugcuuaagagaaaggacucugaugucagcaaaccucccugaccuugagcucaugaacucuuucugagccugucuucucaucugccaaaguagaugaugauaggagccacugccacgggcugugguggggauucgcugaggugacaucacuaaggugcugagugcagagccuggccaaugugggauaaagugccagccagugguagcugcugucacugucacuaucaucaucaucagacccugagguucuggaggauggugauccagucaucugcuucuugccucccccaaagcuuucagcacccagcaggugcucaugcuguuaagccccuucagcaaauggugggcccgcugugugccacgccuguuaucaagggcaagugacaagguccuggagacaaaccgaccucgcaucacaucccggccccagcuaagggcucucaggcugucaaacgggaauagcaggcccuuucaggguugccugaaagauuccaccagaugagacagccgaaaagcccaagccauugacuggugcuaguaaaaaguuccugggcugccgggguccugaguguugagggcgggcgcagccugcaggggagaacgggcucaggagugugugugcggaauugaggacgggggugggagagggccuggaggacugccuugcugcccucccccagggcuucggaacacggaguggccgggccggacgcaggugcugcggcgcgggccccucaccugguaccuggacggugcgcacaccgccagcagcgcgcaggccugcgugcgcugguuccgccaggcgcugcagggccgcgagaggccgagcgggugaggggcagggcuggggguggggccggggcuggcccacgaggaggggcgggaucuuggggaagggcggggcggggucguggggaagggcgggggcgggcccauggggaggggcggggucgugggcggggacgggauugguaccgcagggagaacgggcggcgcccuuugacccagcuccucaccucugucgcaguggccccgagguucgagucuugcucuucaaugcuaccggggaccgggacccggcggcccugcugaagcugcugcaggugaggggccaacuugggggugggcggcaggcaguccugaagcccugggucuggcggugugacccuggggggugccaauccccucccccuugaguuguauugaggauuagaugugacaaggugccugugcugguucugccaggugcugcagggccguggggaggccagucauaggucauuacucauauucccgcgugucuagacucaaguccaggcuuaagaggagggccagaucguggcuaaagguguagacucuggacucgcuugucaugccccuuuaggcacuagcauaucacccuggacgagaagcggcauuuccccgagccucaguuugccucuccguaaaaugggguugcugcuaggggcacccgcuucucagguuugguugaaggagucauugggccuuucucugcuuggggaaacugaggcugcccaagcugucagggcugaaguggccccuagguaucaucucccauuucacagaccaggaggcugaggcuguauccagaaccucucccauuuacccacagccuuuuuccagccuggauuuggggcccccucacuaucugagugaccuucagcaaguccccuugcccuguggccacuguuccccugucuguacaguagguuggggcuucgcugcucaggccacaggccaggcaggguauacugaggcagaugggggcagggugcugaaguaccuuggcuagguuuauacagcaucauucuaguugucagggaggcugcaucuccagagaugugggcgcagggggccauauggaaguugguggacauccuuucgggggucugacaccaagucuuucccuuggccuucuagcccugccaguuugacuaugccgucuucugcccuaaccugacagaggugucauccacaggcaacgcaggugagaggugacaggcauggccccuggggaugagcaggggucccugagguagacagugggggcuuccaaacuggagguuugggguaggaaauaaauuuguuuuacuguguaagaacacuuuaguguacuuauacucuuuuauacaccaaaguauacuuuauuuaauuuuauuuuaaaaaauuuuuggcuggccacgguggcucacgccuguaaucccagcacuuugggaggccaaggcaggcagaucacgaggucaggagauugagaccauccuggcuaacauggugaaaccccgucucuacaaaaaaaaaauacaaaaaauuagccaggcguaguggugggugccuguagucucagcuacucaggaggcugaggcaggagaauggcgugaacucgggaggcggagcuggcagugagccgagaucgcgccacugcacucuaggucugggcgacagagcgagacugucucaaaaaaaaaaaaaauuaauuuuugagacagagucucacucugucccccaggcuggaauauaguggcacaaucucagcucacugcaaccucugccuccuagguucaaaugauucucaugucucagccucuggaauagcugggauuacaggcgugugccaacaugcccagcuaaguuuuauauuuuuaguagagacaggguuucuccauguuggccaggcuggugucaaacuccuggccucaaaugauccacccaccucagccucccaaagugcugggauuacaguugugagccaccacgcccagccagcauuuuuuauuuuauaugaaauagaguagaauagaaaauaccaguguacguugcacagaguaaggguagguccuguuuggugaagauuagucuguuccaggcauauguauaaguaugugaguacugaguugcaguguaaaauguguuuuuuaccauguaucauguuaaaaaaaguuugaaauaguguaaaaauuacagaucccaggcuggacuugguggcucacaccuauaaucccagcacuuuggcaggaggaucguuugagcucaggaguuaaaagccagaccucaucucuauaaaaaaaaauagaagaauuagccagguguggugguguacacccgugguccuagcuacucaggaggcugaaguggaaggaucgcuugagccuggaagguggaggcugcagugagucaugaagucgugauugcaucacugcacuccagccugggugacagagcaagacccuggacccucucuaaaaauaaaaaaucuccaguccucacaucagucugguuggggagaguucuggaaucugcauuuuuuuuuuuuuuuucuugagacagucucguucugucacucaggcugcccaggcuggagugcaguggugccaucucggcucauugcaacuucugccucccagguucaaaugauucuccugccucagccucgugaguagccgggacuacaggugcacgccacuacacccggcuaauuuuuguuuuuuguuuguuuauaagauggagucuugcucugucgcccaggcuggagugcaauggcuugaucucagcucacugcaaucuccaccucccggguucaagugauacucuugccucagccuuccaaguauagcugggauuauaggcgugugccaccacaccuggcuaauuuuuguccagcuaauuuuuguguguguguguuuuuuucagagacgggguuucaccauguuggccaggcugaucuugaacucuugaccucaggugauccgcccgccucggccucccaaagugcugggauuacaagugugagccacugcacccagccuggaaucugcguuuuuaaccagcauccccagaaauaacuaugcucaccuggugaugguccccagcuggauguacauuuuauagauggagacaaugaggccagaguggggaaggggugccuagugggcaaaagcuuuggagucagacugucuggcucugccucucgugaccuuggugaagucacugaaccugccugagccucaguuucuucacugugugcauggagaaggccacuagccgagacugcuggccugaugacguaaaaggcuuggugcgaagcaggugcucacggugcacccgccccuuucuccaccccugucccuuacucccucuccccuucgcugauaggccuuucucugugccccacagaccaacagaacuucacagugacacuggaccagguccugcuccgcugccuggaacaccagcagcacuggaaccaccuggacgaagagcaggccagcccggaccucuggagugcccccagcccagagcccgguggguccgcaucccugcuucuggcgccccacccaccccacaccugcagugccagcucccucgucuucagcugcauuucacaugccuugcaauggaucagccaaggccgagaccccaucuuccagccaccuagucccccaaagggccuccucacccacccuguggcucacaguggggccagcauacuccgugaggcugcugccauccaugugcuagucacuggcagccugcaccuggugggugguguccugaagcugcuggagcccgcacugucccaguagccaaggcccgggguuggaggugggagcuucccacaccugccugcguucuccccaugaacuuacauacuaggugccuuuuguuuuuggcuuuccugguucugucuagacuggccuaggggccagggcuuugggaugggaggccgggagaggaugucuuuuuuaaggcucugugccuuggucucuccuuccucuuggcugagauagcagaggggcuccccgggucucucacuguugcaguggccuggccguucagccugucucccccaacaccccgccugccuccuggcucaggcccagcuuauugugugcgcugccuggccaggcccugggucuugccaugugcugggugguagauuuccuccucccagugccuucugggaagggagagggccucugccugggacacugcgggacagaggguggcuggagugaauuaaagccuuuguuuuuuaaagaaauggcaaagccuucgacugacccuugacccccugcucccucagcagagacggagggaggggcugcugguggucagggaccugcacuguguagagggagccuggcuguguggccuggaacaagucccucccucccugugcgccucagguggccugucugugagaugagaagaagaccagacugaagccuguucaccauaugccaggcagugcuuucu

SEQ ID NO: 191193 - RNA, 52016 nt, Homo sapiens
agcgcacugaagacagguuuauugacacuccugcuucggaucgagcuacaugggguaaggagggacaguuguggagagcaggagggccccgggguucuggggagcagcagagagggagacccaggguugcuggugccacugugagcacaggccugcaccacacgccuucccaggaaggccuccccucacccagccaggcccuccugcucccuucccacaugcagggugggacgggccugugcauggcccccagaugaggacccaagcuccugcaggggcgguggccuucagucaagacagcugggaggcagcagauccgugauuaggcugggacgcuggcucccaggcucgggugguggugcagcggccucuccagccccagcccccaggaccauucagacugguggugucauggaugaggagcaccucugccuggcccagacaugcuuggagcuuaggaugggggcuccugggcaguggggaaggggcccagggcaggggggagccucauacgagucuggcuggcacaaggcugagcaggagcccggggcucacaguggccgaggcagggcuaggaccaggcccaggugggcgggcagcacucagcugcugugguagaugcggaggcgcugggcgauguccuggcggcacagcgggcaggugcgcaguggcuggcagcacugcuggcagcagcagacguggccacaguugaggaagaucaucugggccuggggagggagagcgggagcauguggcuggcccuaccggguuccaggagucccaggcccgucuuuuuuuuuuuuuuuuuuuuuuuugagacagagucucacucuguugcccaggcuggagugcaguggugggaucucagcucacugcaaccucagccucccggguuuaagugauucuccugccucagccucccaaguagcugggacuacaggcgugcaccaccauaccuggcuaaauuuuuuguauuuuuaguagagaugggguuucaccauguuggucaggcuagucucgaacuccugaccccaagugaucugcccgccucggccucccaaagugcugggauuacaggcgugagccaccaugccggcccccuucauuauucuuuagcaucuuuaccauaaacgccugauaguggggccuucgggcauuugaccaccacagaaacagaacaggcacggccgaaacagguaaccuaggccuucuguuagcaguuugcugucuauuucucuauaguuuguaaaaaauauaaauacccauauaaaugccccaacugauucuuucuuaaauaaaacuggggauuauauuccugcgcucuggacaggcgacggaggccuauuccgccggccccugccggagggcacgcaggguguucaggcuucuuucuuguugaugcacuugcccaggcccugaacuccucagucuacaaacaaucccaacccggagcagcagccacugacucaggaccacacuuugccucagcaucuccugcuuucaggaacugauccaagcuccgcucaaagcugucuggaaugccaagggccccagaacagggauuauauuuggaaccaauagguccauccauaucauggcaugagucaggucaacgggagacccuggaaucaucaaacugcaaacauggcugcuuuucuaaguaggaucccucaguggaggcaaaggaggauuuguauuucauucacugcucuguguaauuuuuagaguaaguguuaaugaauuuuuaaaagaugauuuuuucuuuuuuuugagauggaaucucgaucugucugccaggcuggagugcaguggugggaucuuggcucacugcaaucucugccucccggguucaagcgauucuccugccucagccucccaaguaucugggcuuacaggcgcccaccaccacgccuggcugauuuuuguauuuuuaguagagauggaguuuuaccauguuggccaggcuggccucaaacuccugaccucaggugauccaccugccuuggccuccaaaagugcugggauuacaggcgugagccaccaugccuggccaaaagaugauuuucuaaagccucugcaggguaaaucauguuguugauauuucaugauuugggaaauuuuuuccuaauguauuuauuaaguaggaacaaaaagaaaaagguccggaaaaugaugugagcgcagcucauauuugggucaugggaccaggggucaucuuuauuuccugccuucuuucuagaugagcacagucuacuuagagaacuggagaaaacacguucagagacaacccuguaccugcagaauuugaggaggguggccacaggcagggcaggcggguggggagggccccggacuuaccucccguuccaggcacacgacacacucugaggccugcaccuccagcucugcagggggagcggauggccucacagacucaggaggcuccuggggggccguaggggugacgaccucacccauuggugguuucagcucuguggggaccagacagacagacugagccagggucaucuccgcugacccuaaccccugggggcucauuguggcccugcccauccccauggugagugagcuggagggugggggagccucugcucucagaucugagggaagugcucuccuugccacacacucucuucuucucuucucugagccucauuucccaucugcagaaugggagugaagucucucucugcagggauggccgcagcgcuuguuaaguggguccucugaucucuaauguccccgggacgcuucauagccacccugcaaguagggcuuggcacuuucagagaugagacauuugaggcucagagacggggagucacucaacccagggccauguggccaucuggugaugcagcugcagaucccuggggcaggagcucucagugaagggccagcucuuggcuucuccaccugguugcccaggagacaggaugggcugcugcccaucaggugacccaggggagcagaaugagaggccccccgcaaggcuguuccccugcccccagccccacagaguccccagcaugcuggcugcucugcccuggagucagcauccccugcuaagacaucagaagcagcccuuacaaaaugcuaagucucuuuuuuuuuuuuuuuuugagacagucucgcucugucacccaggcuggaguucaguggcgcgaucucggcucacugcaaccucugccucccagguucaagcaauucuccuuccucagccucccgaguagcugggauuacaggugcccacuaucacgacaggcuaauuuuuguaucuuuaguagaggugggguuucaccauguuggccaggcuggucucaagcuuuugacuucaggugaucugcccaccucagccucccagagcgcugggauuacaggcgugagccaacgugcccggcugcuaagucucuuuuucuaucaugcaacgugagccacccacuuccuugacucuaucccucguucccuuccugaucacgguucacuuuauucuacggcuugaauuacaagcauuauuuuuuauaacaggaaaaacuaaaguuuuucuuuuuuuuuuugagauggagucucacucuugccaggcuggagugcaguguggugcgaucucggcucacugcaaccuccgccuccuggauucaagugauucuccugccucagccucuccucuugcguaucugggacuauaggcacacgccacugugcccagcuaauuuuaguagagacaggguuucaccauguuagccaggauggucuccaucuccugaccucgugaucugcccgccucggcuucccaaagugcugggauuacaggcgugaggcaccgcacccggccacaacuaaagauuuuuuaaaggcuguuacaacacuagacccucuaaggcuaucagugcuuccccccaaaccaccauuucgagggggcauucauauauauauauauauauauuuuuuuuuagacagggucuugcucugucacccaggcuggaguauaguaucaugaucacagcucacugcagccucaaccucccaggcucaagcaauccuccuaccucagccuccagaguagcugggaugacgccuugcuaauuuuuuuuaauuuuuuuguuuuguuuuugagacagucccacucuuuuccaggcuggagugcaggggcacaaucauggcucacugcagccucgaccucccaagcucaagcgauccucccaccuuugccccccgaguagcuggaacuaaggugugcaccaccacacccagcuaauuuuauuuuauuuuuuguagagaaggggucucccuaugucgcccaggcuggucucaaacuccugggcuugagugauccucccacguaggccucccaaagugugggauuacagccaugagccacugcacccagcuucuauauuuguuuuuuucuuuuucuuuuuuuuuuuugagacagaguuucacuugucacccaggcuggaaugcaauggcaugaucuuggcucacuguaacuuccgccuccuggguucaagcaauucugcugccucagccuccugagucugggacuacaggugcacgccaccacgccuggcuaauuuuuguauuuuuaguagagacaggguuucaccauguuggccaggcuggucucgaacuccugaccucaggugauccgcccaccucagccucccaaagugcugggauuacaggugugagccaccacaccuggccccagccucuauauuugauauaaaguauaccgauuucugggaguaauaagagaauugcuaggaaauugaggguuucccuugccuucuggaacugaggacggaucccaccauggccccuuccccugccaaugggcacaagcaggaagcccugagcagcccaggcauccguuuucugcauguggccacagauccucauggccaaucugcuauggagaggaagaaccugcuuguuugcuccagggaugacucaaacagugagaagcagccgguccugaggacugcugggcucagaggcacugcaccccacucagggugaagggcaccuguuuguuuguggcuccugcucacgugaggcuugucugccgggggugaccccaacuccugauggaaaacucuucugaucuccagucugagagcuggggggucaggaacauccagaaggggccuauucugcacaugacuugauaucaaaaagcuaagaaguuuaaugacuuuuuggggguugagucagugucccuggaguaaaaguagcugcaaaacuggugccugaagcuauccuggggcugcagucagcccagcccccuggagccccggggccuccccacugagguccaguccagaacuccaccuucgccucagcuccuccgcuucuuccuuggcucuggcuaaaaaugcccuguccagagccucgcccagcccagcagcacaagacugcccucuccuucaccccugcucuggccccucaccucuuccccagggaggcaggcaagcccaguggcuccaccaucugccagcaaugggaccugaugggggacaugcuaaccucuuugcgcuucaguuuccccaucuugaaaaugaggaccacaacagugccuccucacgggauggauccggagguuccucaacgugguucaugcacagcggugggcaggugccgggcucccagaucaugcucagcacauggcagaccccagacuccacaccugccccuucuccccacgggccucacgaccugccuuugccccuucacagccuguuguggacaucucuccauguccacaggcaugccucaggcccagcauuggguauacugcaggcccuggggacgggcuauuucucccucuaguccaaagucccucaguguguggaucccagcgucuguaggguggacugagggaaggcuaugggacagggagcugggagggccccuccacugcuacguggaggucuccuguucucccaauuugguggcccauuuuucccaucuguaaaaugggcucacugaucccuaagccugcuccuugggaggaaaccuuaccgaccagcagaggcuagaaccagcccucaggagucauccugaaauguaagcaaaugacuguccccaccagagcccacacauacggcuggagcccugccuggaagaggcuggagcugugcuuguaccuggcuggauccuggcugcauccagcaguuccuggacucuccggaggaucucgugcugcaggccagcuucugagacgcccaccugugacaguucaaggaagugcagacuguggccugggcgggagcccgcuaaauggugugagccacguggcacaggcccaggcucacaggaccgucgacaccuccugcuggaaauguggaagccuuccggggccuggcggggcccacggucaggaugaggcagugcggcaccauagcugugagggcaaccuccccaggccucagcccaacaaucaguguggcagggguuggggggaaacugaggcccaaagggaaaccagcacuagcaacagcuaugguuuagcaacugcuucccggugccaggcuucaccugcacaccucagccacuuccccaccaggugggggaggagagaagccuuggaggccaagccacuaagcagcagcagcacacgagccccacagucccucagccuccagagccugagcggcauggccuugugacccucagugccauccaguccucuuggacccuggugucugcaucuguccagggaggggcaggagagucucaugaaaaagaacacgaacucuggggccacacugcuugggguggagaccucacucugcugugugaccuugggccaaguuauugccuuacugggucucaacugaaagaugaugauaaugauauguacccugcugggcugucgggagaauucagugaguucgaauacaaaaagugcuuaaaauggugccccgcacgugcaggugcuacaaaguuagcuggcacagcgaugaguauucuguuuugaagaauaaguggauuaaugugcuguaaagagcucagcuugugcccagaaaggaacaggggcucaggcagugcuguggccacgacaguuugugacaccaugaggcagggcagaggcuggaucagauaagccccaagggccugucuugucccuccagucugaagauccagucugaucaggucagcaggacccaccuccccaggauuucccagugagacagugugcagggcacacacaggcggcuggggcagaugggcagguguucuggccaucuggaagcaagguggcccugggccauuagguaaggacaggccucaacgaggacuacacaaggagcagaucaacccccggcuggucaggacagcggccuugcgugccccuccccuccaugcagacggcugcugcccaccuuggccagguccccugggcucauuuggcucagcagguccagugagaggcgguggugcgcaaagaugggcagguagugcucagccgacagcuccuccaggagggccaccagcuggcgcuccauccccucuuccugcaagacagaaacguguaccaugagcaggaaggaagaaaagaacccacuguuuacaacaggaaaugaaggguuugaauauuuauaacauaauacauagaauguacucgggauuuuuccuacaaaaacucauagguaggcacacagagauagauagauagauaggcccagggguucacugccgcucugucugcaaaccugaaaauaguaagcaacuugaacauccaccaagagggggcuguuucaacugccucucuguccccgcaggugcuggacagacaguggcucccggcacaggcuuugcucuacugugggcucaguggucucugcccugcacagcagugaccagugccuugucgucccccucaccagaaugaacacucccuuacucucgcuucugucuccacuggggcuuggcacaggaucuggcaugcuagagucaccagaaaaguaacaagaggcagagcaugguggaggcaccacaggcgccucugggaggagguccccagggcucccuggccgggacaggcaccagcaguccuuacuugcagcuucaaggacaagggcuucugguucaaaagccguugauacugaaucagccaguaauuuuccugccugguuucacuuuuggcuucuaacuccgucugccaggaaugaagcaggcaauguuagucacaaaaugguaauaaaaccuguaauaacaaugaugguugccaggcgcgguggcucaugccuguaaucccagcacuuuggggggccaaggugggcagaucaccugaggucgggaguucaagaccagccugaccaacauggagaaaccccccaccucuacuaaaaauacaaaacuagccaggcauggcggcacaugccuguaaucccagcuacucgagaggcugaggcaggagaaucucuugagcccgggaggcagagguugcagugagcugagaucgcgccacugcacuccagccugggcaacaagagcgaaacuccgucucaaaaaaacaaaacaaaacaaaaccaaaaugaugguuaugaaccaugcuccucugagcggguggacagcacuugguacuuuuauuuuauuuuugagauggacucuugcucugucacccaggcuggagugcccgaguagcugggacuacaggugugugccaccaugcccggcuaauuuuuauauuuuuaguacagaugggguuuucaccacguuggccaggcuggucucaaacuccugaccucaagugaucugcccaccucggccucccaaagugcugggauuacaggcgugagccacugcacccagccugaaugugauucuuuuauucugccauucgauaacucuucguugaguacuguucuaggugcugggaauacagcagugaacaaacaaugcugauaacagccacggugacaacaggcguagcugacauguucacagugccaugugccagaccaugcugugcaccuaacgaugccaucauuaauucucacaacuccgggaaggagauucuaccucccaggugagggagcugagguucagggugaugaguaaccugcccaggguggggccaggaauuggacccaggccugucuugcuccagagcccgugcucagaacaacggagcuguucagugagggcuggcaugacauggggagugggaucaacacaggcguuucucaaucccugcugggccugacugcccuuugcgggccccuccuggaccuggccacgcccacugcucccuuccgucguuggcccucccgggcugcagccccucucuuccagcgcccaggagccggaugggcuguguucugcuggggcggugcuuccuccuuugguggugacccccaaggccuacaagggcaggggcaccagccauaguaccuggcugcuaaggcacagcgccaaggcaccaucugcaaaguaaccugaugcguaggagauggcaguagggcaccgugaggaacaggcagcuuccucugaugggcacaggcaccacuuggcuuguucagggcuccagaagcagcuggucucucucuucuaaaccugcacaggacccggccuaggacgcagcucagagggcaucuggugcauucacggggacacaggaacgacucggucuuuuccaccccagauggugagccuggccucuguccucauugcuugggugcccucugggucuagaggagacacucucaagggggccucugccacgcugaaaaugugccagugucaaacccaucaggggacagggacagcugggccacuccugccaaaagcuuaucaaacggccugcccuggacauagugaguccugucuggagugaauacucauggcuguucccgaauacucgacuacaaaggcauucggagagcauugccuagaaaaguuuaaaaaccagaaguaauccacauacucaacaauaggggccacggacagccuugagaaaggacgucaaggaauaguuuaaugacuugaaaagaaugugcggaaacaggcugcucgaaaaggguaugcagcaugccacguuuaaaaggcgcauacacgaacagcuauaaaggugcaucacaauguuuggaaaauaugcaucaaaaccgcaggagaggcuaggcgcgguggcucaugccuguaaaaccagcacuuucggaggccaaggcagacagaucguuugagcccgggaguuggagaccagccugggcaacauagcgaaaccccaucucuacaaaaaauaaaaaaauuugccaggcaugguggcacaugccuguagucccagcuacucgggaagcugaggugggaggaucgcuugagcccaggaagucaaggcugcagugagcugagauugcgccacugcacuccagccugggcgacagagugagacccugucucaaacaaacaaauaaaaaauggcaggagauaacgcuuggaaaugcaauuauuuuccuuuguacuuuccaguuuuucuuugaugaauaacucuuacuugaauaacagguguuucuaaaaauggcaagucuguuaaagaaaagcaaaugccugugugaugcugagcacagaagccaaacacauaccaggauuucccggagcucuuccucucgcugcugcuucucuuugagcagcugcuggagcagggagcugagggcccagcgcugcuccgagaucaucuccugcgaacaagaccacaccccgcaccaccgugagcuggcggcagcgcaggagucccgcaguggcaggauggagaagggccuggccucccgcucacucgguucucugcccaaugccuccaggcugcguugggggacaaagcuaagaggcccuucugcccccuuacccuaagcccgcaucucucuuccuugugggguuaagucaggcaugggauccuggugacugaugacaaugggaugguaagaaacaucaaacaaaagaaaugacaagccacaggugccugccuuuggucucccagacaacagagcacaugggcagaagcaaauggcggggagcaguguggggccccacacaaauggaggugcgugcaaaccagagccuggggucccugcuucacuccugcgccugcucuuggaaaccccaugggggccccaacagccagagcccugccacacuugugggcagggacuagggcacccgccaggcaugaugaccgcagcuucucugagagcagucccaguccccucaucucuggagaucauuucaaggcucacaaagggcuuucccuugcuagcucagccuucuccgauggccugauggcacaggcugggccuggaggaccgcugccaucuuauggaguaggggaagaaggccuggaggggcagaggccugucuaagggcacacagcacaccugcggugcaccugagaccagggauccagaucccagacccuucacugcacugaggaguccaugggauggcuugagacuucuccacugagaacagacacagggacagugacagaccgaaggcucugcucaaacuccuggcacaggcacauguccucacacaccaucccauccagcccuccgucugcagcuggagaggcugagguucagagaggggaaagggcugccucuccucccccaccugccaaaguugcacagcagggcugugcugggccacacccggcucccaggcauccaguccaggacgccagcugccagucccugcugcccucucaucugugugcgcaggacucccgggcuggagccccagagaugcugccugcagggaguuacacagaugcggcugggcccucuccuccagacaacccgggacacccaaaagcuccagcccuggaggaugugugccugggggccuaaagcacggccuacagagagagacaggagcucagcggcgggcccgcacccagcacaggagacacagugauggagaugagcaggggagccuuggcaaugaaacccuccuuccucugacccuccugccucgcaacaggcugaccaccucuaaccuuggccugcgcugggccuucuggggcugggggguguccucuggugucacagccacagaggagcucugcccucugucugcuggggaagcccuugacucccaggggcuggugagcagcugccagaggcugggagggagcaccaggugggggucucaccacgugaaggagggcaggggcagggagcccuacauaccuggagugacucuguguccagggacuuccucuuuaacuccagcugugucagcugcaauaacucaguuucuauuaacuuaaucuaaacagaagacgagacaggguuuuuuuuuacucacauuaaccacaguucaguuuugugcugcuacucucuggugaccaagugggucuaagaagccuuucuggggaggcuggggaggcucuggaaugaggggaaccugcgggccugggaaccucgucaaggggcuugaacaagaauucguuccuucauggccucgcguuccuggggcauggacgugcuuguuguggccaaaauuguuuaccaagaggccagcacaggaucucuccuagagugggaucaggauaaaggcuugugcaauggagagggggcuuuccuuggggauucaggccagaguaaagcacagacagagcuaucacccagucuccugcuggucaaguucucuugucccucgcaucgcuguugcaggggagagcagaggguaguggaagugacugaguaacagugguaguaguagcugguaugucuugagcaccuacuaugugcuaggccugugcugcacacuugauguaucauauuucaucaauucucuggcugcuaggagguauuauugccuccauuuuauagacaagaaaacugaggcucagagagguucucacuugcucaaggacacagagcagguaagggagagaucccuuucucugggaugccucagcucaggguuuaagggcaauagcugaccuggucaaaaccaucugcagugagaauguggggggcccucacaggcucuccagggugugucuaggggauuuuagcccugggcaggggugggggucagaccccauagccaguacuucucuauccugugcccaugacccugugacccucaucccuaagucccuaugacaccaccaaccccuggucagaggaaugagcuucauguccggcaauguggaauugaaauuaaagagggaaauuaaaaagguaaauugguccaaaaaaagaaagaaagaaagaaagaaagaaagaaaaauagagaaagaaaaaaaccaugcaaaaaugcaaaauucagugugcugaacaugaugcaggaguacucccauagccugacgcucacuucagccccagccccagccccacuccacaggcggugaccaccaagccguguaggugggcuugcccaaggcuugaaggucagcagccggccugcggggggugggggguaucuugucacaugagggagggucuaagaggaggaccgccuccuccugggccgaggucacuuuucagcaggcgucaggaccaccguggcucacagcucccccugcccucuucugggggaaauacuauaugccccugagacgccucugucugucugagcuguaggagcgcuggggccugcgccggcugcuuuucccaguggggaaguccugccuggagcagggacagcagaggcagcuggagcagucaaagccacacaucagcaccagccucccuggcccaggcgugguggagacccgccucgcuggcaagacccucgccagaccccggaauaggaggucucuagacacccucccagcagccccgacacaaggcugggagcaaagggagguucugagggcaaggccucgaccucuuguugggcuagcaagccaaggagcugggguucaaaccucaacugcugcgaccugccgcccuggagggccacucugcaagucucugagagagcagguccagggaccccagccccagcgcucaccuggcuccugaucugccgaugcaucaggucuuucuucaccuggagugccucgaacgcagccuucugcaucgcgcucugcaacacagaccaccagcccucagcaggggccgugcccacacuuuucccugcagccccaucccugugaaaagcaaaagcuguguacaaagcaccuuaauggauggguuuuuucugagagagggagaagauuucaccucacuuguguaaaccuuaagaugguacuaggggcucacuucgggcagccucuaccugaugcacuuccggcaucgcacccugaguuuccaccacaguggaccgugggggugcuuuuacugccccacuucacagauggggagugacacucagaggcaugaaucagcggcgcugggacacacaccaagccuauccagcucccgagccccacuuaaccacaaggcagaugccuccucugagaaauggagaauuuuccucagacaagcuccacagauacuaagucaaaccauuuuagaacagagauugaaauuagggagaaaggagcagggugggaugacaaacacgcagaggacaggggagaaaggcgagggaagaagggaggcagcggcaagacucccacggggcugcaggaaagagcugaacaggccgguggcucaugucuguaaucccagcacucugggaggccgaggcaggaggauugcuugagcccaggaguuugagaccagccugggcaacauagggaaacucugucucuacaaaaaauaaaaaaaaauuagcugggcaugguggcccuguggucuccgcuacucaggaggcaaaggugggaggaucguuugagcccaggaguuugaggcugcagugaacugugaucacaucacuucacucauccugggcaacagagcaagaccuugucuuaaaaaaaaaaaaagaaaagaaaagaaaaaaaggaaaauaaaaagcuaaacaggcugggcacggugucugaugccuguaaauccagcacuuugggaggccgagguggguggaucagcugaggucaggaguucgagaccagccuggccaacguggcaaaaccccaucucuacuaaaaauacaaaaauuaguugggcguguuggugggugcccguaauccuagcuacuugggaggcugaggcaggagaaucaguugaaccugggagacagagguugcagugagccgagaucgcaccacugcacuccaaacugggcaacaagagggaaacuccaucucaaaaaaagaaaacaaaaacgcuaaacagaguaauauggacaccgaaggggaggaggucacaggggcccuucguuucauccacucaagagcccugccaggcaccuccugagcaccgcagagauggaagagcagauagcagcacagcaggucuggacaugagaagaggccagaggucccacagcguccucugugcccugaccuccaugguguggucaccaucaccuccugccacuuaaguccuuccaauggagccuccuacacaggauggggguaggagccugccagagagcagguggaggugcuucuguggauuuuagugaccagaagaccaucccccgggcccccccucagccucucccaccccucacccugaucacuuguacaccucuauggucacaaaccucuguggucccacaugcugucuaggaagggcuccguguggagcucugcacucugcccuggcuccugaaccucccuccugagcucccacccucaggcucugggcgagggcucaccuccugcaggaucuggcugauggcuuuguucugauccauuugcugccacgacagaaucugcuggaaucguucauccauuucggccaugcugccagaaagacagcaaauucauucauucuuggaacguuucccgagcaccuacuaugugccaggccccuuggaggagaucaagauaacccauuucuucaguggaccacauucauggaguaccugcugggagccgggcccugggugggccacagacacugagucugucugaaucccauggccuggagggaaggggaucgaguugggagcugggagagagaugcuuccagguccucucacccaaccugccaccagaauccccuccccagcaccccccggaaguggaugccugccucugcccagccaccuccauggguggggagcuccugacucccauggguggugagccaccgaaguaugacaaagcuguccuucccggcacucucacccugggcagggagcaaggagcagcccuugacuugggcacaagaaccugcagccucacguauguuugugcuuuggcaccaucuugguuguuuuuuuuuuuuuuuuugagacagagucuugcucugucacccgggcuggagugcaguggugugaucguggcucacugcaaccuccacuucccagguucaagcaauuuuccugccucagucucccaaguagcugggauuacaggcgcccacugcuacguuuggcuaauuguuuguauuuuuaguagagacgggguuuuaccauguuggccaggcuggucucaaacucccgaccucaggugauccacccaccucggccucccaaagugcugggauuacagacgugagccacugcgcccagccaccaucuuggcuuuguuuauuucauaauagcaacuguuuuuucccagugaggucccugcuucacaacaauagcaaauauuuauuggaccuuuaugcacuagagauuaugcucaucaacacucaucaaauucuccaccaacucuacagguagguacuaugauuuaucugauaaggaauuugaagcccaaagaaggaaagagacuugccugagaccucacgguuaguaagcagaagugggaccuggauccaggucuguuugaccccugcgcuugcaacuccuaagcacagugucacauaucaggaaaggggggagaaauucccacaucugcagggacccaggggaggcccgcacaguccaggcgcccuggaggguggcagcagugccagccacaugcaugggaggaaaaacagggcauccagggcugcuggccugucccugucuggggcuccugagcacugaguuuuccccacuggcucugcugggcaccuguggaaccuccaacaaacccacagugcccagugagcacagggagccggaccccagagcagccaucagcaugaaagcaaccccuucacuuauccuuccagggcaucccacccccaaccguggggguccucagacacugaugaguguaccacagucaagagcacaccccuccccucugccgggcucaaauccuggcuccgccaccugcuggcuugcuuccuugggugcguuauacaguuucucagaaccugaguugcgauugugaaaucgggcuaauaacaauacagucccuccuagaaucaaucagcgaaugugguucaucgcuuagccgagugccugccacacaggaagugcacaagaaaugggaaugacuguuaccacuuuaacacagcccaacacugaaucauggauccggcuagaaaacucaggaagagcagccaucacuugccccuaacagcagagcagaggcugggguggcccagggcgggagguuuagugcccagcucucaucccacggucuugggcccugagccagcucccccagcucccucaccugggacuccucuuccuuaccuuaccuggaacaggccugcuggaccaaguucugccucugagauucguaggccaucuggaugagccgguucuuacagcucucagucagcaucugcugcauggcggcugugggaacaugagguggggacagcugaguggaguggcugcuccuggggcaccugggcagggaggcagcagggauuuccacaggaacugaggaacaggccuugaggccucaccugguuaccuaccugauaguuaucuuaaaaaaaacccuuuguuccuuuuuguuuuguuuuguuuuuugagaugcagucucacucugucacccaggcuggagugcaguggugcgaucucagcucacugcaagcucugccucccagguucccgccauucuccuccucagccucccgaguagcugggacuacagacgccugccaccacgcccgccuaauuuuuuguauuauuaauagagacaggguuucacuguguuagccaggauggucucgaucucuugaccucgugauccacccgccuuggccucccaaagugcugggauuacaggugagccacugcgcccggccuguucuuuuuaacuauaaaagcaacguaugcuuggaaggcuaauuguaaaacacugaauagcacauacauaacaucuccugugaucuugucauccagaaauauuauuccauuuugauauauauucuucuagucaguuuuuaugcauuuaggaauuaaacaaauuaaaauaggccaggcgugguggcuuaugccuguaaucccagcacuuugggaagccaaggcagguggaucaccggaggucaggaguucgagaccagccuggccaacauggcgaaacugugucuguacuaaaaauacaaaaauuagccgggcaugguggcaggugccuguaaucccagcuacuugggagucugaggcaggagaaucgcuugaacccgggaggcagagguugcgugagcugagaucaugccacugcacuccagccugggcaacagagcaagacccuaucucaaaaaaaaaaaaaaaagaaaaaaagaaaaaucaaaaaauuaaaauaauugaaagaaggaacuagaauagauguuuguacacacacauuuguagcauuauucauaagagucaaaaaguggaaacaacccacauucccacugauagaugaauggauaaagaaaauguagacgcuggacauggcggcucaccuguaauauaagcacuuacgggaggccaaggugggaggacugcuugagcccaggaguuugagaccagccugggcaacagagugagacccuaccucaaaaaaaaaaaaaauuagccaggugagguggcaugugucuguaguccccacuacuugggaggcuguagugggaggacugcuugagcccaggagguggaggcugcagugagcagguucacaccacugcccuccagccuggugacagagcaaggaaaaaagaaaaaaagaaaauguggcauauacaggaaaugcaacguuauuuacuauuaaaaaggaagaaaauuuuucccuggugggccaguguuuagaaauaaagaagcaggaaaaaaaaaaaaaaaaagggaaagaaauucaaacacaugcuauaacauggaugaacccgaggacauuaugcuaagugaaauaugguagacacaaaaggagaaauauuguaugauuccacauauaggagguacuuauaacacucaaauccacacacagaaaguagaauguugauucccaggggcugaggggaggggggcacggggaguuaguguuuacuagggacaguuucaguugaggaagaugaaaaaguucuggcgauggauggugguggcaguuguacaacaauaaugccacagaacuaauauauuuuaaaaugaagaccaggcacgguggcucacgccuguaauaccagcacuucaggagguugaggcaggcgaucacuugaggucaggaguucaagagcagccuggccaacauggcaaaaccccaucucuacuaaaaauacaaaaauuagccuggugugguggugugcaucugugauccuagcuacucggaggcugaggcaggagaaucgcuuaaaccugggaggcggagguugcagugagccaagaucgcaccacuguacuccagccugagcaacagagcgagacuuugucucaaaacauaaauaaaauaaaauaaagugauuaagaugguaaaguuuacaugaugcauauuuuacaauuaaaaaaaugaaaaugguaucaucccacuucccauuuuuaugaacacucccccugauaacaugcuaaugggaugcuaauacugcagagugccacagcauauggaucaccaacauuuauuuaaacaauccucuauuugggggcauuuggacuuucuuuuuuuuuuuuucugagaaauggucucgcuguauuacccaggcuggagugcaguagugugaucacagcucacugcagccuugaacuccugggcucaugugauccuccagccucggcuuccuaaagcgcugggauuacaggcaugagccccgacaccuggcccauuuccuccauuuuauagcuaagaaaaccgagccuuggaaaaguuggggagcaguaagcaguaaugucccuaaggucacaugguggguguuugaacugggacucugcauccacaucuaggcugaccccagagccugugcuccauggcaggacuugacugccccucucgagggcuaacacucagggcccuccaugcauggccaacagagggagggccauccacccugccagcccagccagcaggcagcgugcucacaagcuccccaucccaaaacucacaggcaacgucacgucgccgcaggcucucagucuccuccuggguuauggacaucaacuguuccauucuuauucuagaaaaaaauccauccauucauucagcaaauuuaacauuuccaacagggaaucccagcagaugaacaccaccuccuccaggaaggccuccuugauuuggcaaccuacaccuagaugggcucucuggaugccuaccgcaucacaagcaacccuuggggcccucuguucgccuucagccuguaguucgaguaucuuguguaaaaagauggacgcucccuuagaaaaugggcaaaagaagcaaauagccaaugcugaaauucaagugaucaauaaacaucuggaaagaugcuuaacauuacugguaacuaaagaaaguaaaaucuuuucaccuacuagguugguugacaguaagaaaacugguaacuguuugugauggugauggugguggagaaaugggcacuuuccuacacugcugagaggaguguaaacuggcagaauguuuuugggaagguaaguuggcaccuagcaaaauguccuuuaaauauuuccuucacaaauagucacauggccgggugcgguggcucacaccuguaaucccagcacuuugggagccugaggcaggcggaugacuugaggucaggaguuugagaccagccuggccaacauggugaaacuccaucucuacuaaaaauacaaaaaucagccggaccuggugguaugcgccuauaaucccagcuacucgggaugcugaggcaggagaaucgccugaaccugggagguggagguugcagugagccgagaucgugccacugcacuccagccugggugacagagugagacuccgucucaaaaaaaaaaaaaaaaaaaagauauacuaaaaauucugcuauaaauauagccugucacuuuuuccauuagcaauauguuauguuuucccuuaaugagaaauauuauucaauaagacauuuaauggcugcagguuauuccuccauacauaauuuauguaacuaaauaauuuuucuuuccagaaauuuagauuuuuuuucugaauuucuuuuuuuuuuuagcuggaaccauaggcgccugccaccacuccuggcuaaguuuugauuuuuaguagagacagcguuuugccauguuggccaggauggucucaaacuccugaccucaagugaucugcccaccucggccucccaaagugcugggauuacagaugugagccacugcgccuggccugaacuuuuuauacuaggaauauaguuggacauuauauaucuagccuuauucaugucucugaauguuuuucaggaguguacguauguuuuaaugaacuugaagacaaugauucuuuguaauuaaauaucgucuaaggaggugaaucuccuuauagcuuuagggaaauguccuggcauaauccucuggagaaucacaagacauucuccccucaaagcugcucuccuuggccgggagcaguggcucacgccugcaaucccaguacuuugugaggccgaggcgggcagaucaugaggucaggagaucgaaaccauccugguuaacacggugaaaccccgucucuacuaaaauacaaaaaauuagcugguggugguaugcgccuauagucccagcuacucgggaggcugaggcaggggaauugcuuggaccugggcggcggggguugcacugagccgagauugugccacugcacuccagccuggcgacagugcaggacuccgucucaaaaaaaaaaaaaaaaugcugcccuccccuggaagaacacuuaccuuucauuuuccagcgauuucaaaaucucggagcuuuucuuuugucuguggagaaaaucauaaaagguccuggcagucaccagcaggccuguuuccugucucacugcguuagcugugcagaggggcuuaggaaaugggcugggggcaccuuggcuccaccaccuugaagcucuggguucuuagccaguuacugaaaccacucaagucccagguuuccucaccuaugaaauuagaagaauaaaaaaacccagccagacacaguggcucacaucuguaaucccagcacuuugggaggcugaaguggauagaucacuugaggucaggaguucgagaccagccuggucaacauggagaaaccuuaucucuacaaaaauuagccaggcgugguggcccaagccuguagucccagcuccuugggaggcugaggcaagagaauugcuugaaccugggagaaggagguugcagugagccgagagcacaccacugcacuccagccucagugacacagcgagacucugucucaaacaaaacaaaaugaaaacaacccagcuucuuggugcauuuguaaagacuuaaugaagaaauagauguaacaagcuuggcacauaagaagcauccaacaaaugacugguuuccugaacucaugcagguacuuuugaaacugacaggugagggaggaacgagugauucaggguuagaaaaaagaggccuggaaguggcagggcauauggcuggagccuguuucuggaaucauccugcaaugggcccccucacuagacuucucaggcuuuucuggcgccaugucuccccagccccaucaagaucugcucuuacuagcucguaccuugcacaggguuuguuaaggcaaaucucacuacaggugaacagcugaccucagugcaacggguuacgcagaacccaaaauacuggagcaggaugugaucccaacuaucuugucaaacccacucacuuuauagaugggaagcuuggggcccaguggggaaacauuugcccgaggccacagguccaaucugguagcagucucaugcuaagaaaccagacuuuguaaugacugggucagauucuuuucucucuacgcuggugccaguugaagcacccagacuggauccugacaagggaagcccggggcaggggcagaggcagugagggagaaacacacuccucccggcuccucaggggacugcacggggaaggacucuggggcuggggccgaggagcagagcccaaccucugauuguccugcagcagcuucuggauccggcuggaaauguucuguuccgucugcuucagcugcuccugcagccgcugccgcucugcguugagguggcgcuggugcucacucaggcccugcuccagccgggacugcuccugcagccggagguagggguccugagccccugggacccccucagacgccgugagggguacugacugggguuaggaggcuggcuuucccacccugccuugccaauccuuuuugugugaccuccggccagcuccucccaguaggcuacaguguccaucugcacacggggaggcugggcugggugaucuguaagggcccucccaggugcugggggacagaaggaagugacagcuucaucccacugccuuuccacauccgagggaccuuggcccaagccaggaggccacuggcugggggaugcagccaggcuggacccuagcaggcggcucacaaaccuccuugaccgucugaaggaucucauccuucuggcugcugcucugcugaaggagcugggugugcucccgcugccccaguuccaggcgccguucaaacucgaguuucuccagcaucuucuguuccugcaagacacagauccuggugacugucagcacaggcccugggggaguuaggacacagaagucgggagaauccaccccucaacacugacagggcaggcuccaggucuucaugcugagcaacccccacuccccuccagggcccaacuguaagaaaacaagcuguucacaggaagaggcuaguggucuagagcccggugcugggcucaaccccucugagccucagucucugcaccugucccauggaugcucuaccacccaccugaggcaugugaggaugcagcagacugcguguaagaggaaggcauuacugugaccucuaauucugagcugggaagaagucauuuucucaaauauuuuaugaguugaguugagaucuuuaaugagaaaagagugacagaaggguaaaggcauuuucuuaccuuccucuucucauagucugagaaccuguucugggaggaaaaaaagacaguggucaagagaggguggcagcagugguucucccuggcaugggcaccaggaacccccggguggccugauguuauacaaacucuggcccaccccagaccacugccucagaaugguggggucgggggaugaggggauccguauugaucaagggcaccaggugguuccaguggacaccugaugagaaccccugggcugucacugugugcauggcacuguaggaggggcucuucaagacaguucugggaugcagcccugagcagggaugguggucugaagagcagagcaggaaaugggauaucugaugcccauggaugucugcguaacacaccuacagcacccgguuccaguccaccaaaauacucacagugcacaaagguguggguacaacuuccugcagaauuauucaaaagagcaaaaacacuggaaauaacucauacaucuaucaacaucuguccguaagucauggugcauccauacaguggacuauuacacaaccgccaauggggcgaaugugugagaucccucaccuguguguagcaugauucuacuuuugcaaaaacaucaucaagaaaacucaacucugagcauaugugugaagguauugagucaaaggucaagaaggacagucauuaaucaguuaaugaugacuaccuccaggcaacgggagugcaggguggaaggguugacauucacuugguuuguaauugucuguauuguuuaaauuuauaacaaggagcagguauuaaacaucaauaauguaauguaauuauugguguuuaauuaauuaauuuauuauugauguaauuaaacagcaauacacauauacacaagaguuagguucuucuuuuuuuuuuuuuuuuuugagacggaguuuugcucuuguugcccaggcuggagugcaauaauggcacaaucuuggcucacugcaaccuccaccuccuggguucaagcaauucuccugccucagccuccugaguagcugggauuacaggcacccaccaccacacccggcugauuuucuguauuuuuaauagagacaggguuucaccauauuggccaagcuggucucgaacuccugaccucaggugauccauuugccucggccucccaaagugcugggauuauaggcaugagccacugcgcccggcccacacaaguuuuuucuuugugauggagucucacucuugcccacgcuggagugcaguggcacaaucucagcucacugcagccgcgaccuccugggcucuagugauccucccaccucagccuccuaaguugcugagacugcaggcacgcaccaccaugccuggcuaauuuuuuguauuuuugguagagacaaggucuugcuauguuacccaggauggucucaaacuccugagcucaagcauccacccgacucggccucccaaagugcugggauuauaggcgugagccacugcgccuggcacacagguauuuuuugaaugguccuucuauuuaguuauccuguuuugagaacaggaucagucucugaauuauaaaagcagcaaccuauaaauaggauuuugccuauacuaaugguaggaauauaauuuuaaaauuaaucuucaauuauacagauaacaucucaauauauucuccuuguaaaaguuugaaacaugguauaaaaaacuaaagcaucuacugaccacuccagccuaacccugguuccccucccaccccacaccuccugucagguguaacugucauuaucaggcccaaggcaugcaucuguacauauauaauuugugccuuugggaaagaaauauauuuguauuugugugcauauauaaacauuuuuuuaaucaaguauaaucuauuuacucuaauucacccaauguuagugaacaauucuaugaaucuuuauauaugcauagaguucuguaaccucuaaacacaauuaagauagaaaacaauucuggcugggcgcgguggcucaugccuguaaucccagcacuuugggaggcugagacaaguggaucacuugaguucaggaguucgagaccagacuggccagcauggugaaaccccgucucuacuaacaaaaugcaaaacuuagccaggcgugguggcaggugccuguaaucccagcuacucgggaggcuaaggcaggagaauugcuugaaccugagaggcagagguugcagugagcugagaucaugccacugcacuccagccuagugugacagagugagacucugucucaaaaagaaaaaagaaaacaauuccaucacccucgaaaauucgcucaugccacuucaucaucaaauccucuucccacuccagccacuggcaacuaccugucuguuuccuuuuuuuguuuugaguuuucuuuuucuuucuuuuuugagauagggucuaguucuguuacucaggauggggugcagugguguaaucuuagcucacugcaaacuccaaccuccugggcuuaagccauccucccaccuuagccucccucguagcugggaccacaggcacgugccacuaugccuggcuaauuuuuuuguauuuuuuguagagacagggucucgccacauugcccaggcugguguugauugaguuuucuuuuuaaacauaagaauggaaauagacuagcccauccuguucugcaaucugcccuuuucacuaauccaugugucccagcgagccgaggcucaaaugcuccaucucauggugugcacaugacccaggggcagugccuucucacugacaaacauuuggggggcauccaauacuacaaauaaggcugcaauaaacacuccugcaaaugucuccucaugcaagcauuuaucuuggguauacauugagaagcggaacuucuggaucacgggcugugcccaugaaaauuuuugacaucuggcgggugugguggcucacaccuguaaucccagcacuuugggaggccgaggugggcagaucacuugaggucaggaguucgugaccagccuggccaacauggugaaaccccgucucuacuaaaaauacaaaauuagccgggcaugguggcgcaucccuguaaucccagcuacucgggaggcugaggcaggagaaucacuugaacccgggagauggagguugcagugagccaagauugcaccacugcacuccagccugggcaacagagugagacuccaucucaaaaaaaaauaaaaaaauaauaaaaucuuuuuugacaccuacugucaaauuauccuccaaaguugugauaccaauuuucacucccaagagcaguuuaugaggacaccuguuuucccauacucuggccaacagaaauugucaugucaaaaugugugccaaucuugaggaaggaaaugguauuucaauguuguuuuaacuuaacaugccucuccucugauuaccagcaaaguuggcauuuuuaaauguuuguuuguuuguuuguuugagauggagucucauucugucaccuggacaggcuggagugcaguggcgcaaucucagcucacugcaaccucugccuccuggauucaagugauucuugugccucagccucccgaguagcugggauuacaggugcacgccuccaugccuggcuaaguuuugcauuuucaguagagacaggguuuuacuacguuggccaagcuggucucaaacuccuggccucaagugauccaccagccucggccucccaauauuuuuucuauugcgaugguuuucuucuuacugauuggaaagaguucuuucucugcucaaucuacgaauccuucagccagugacuguguugcaaauauuuucugagaaugugaacuggcacaauuuucacauacagccuucuccucccucucuaauucuugcugaacuauaaaauaauaauaauaauaauaauaauaaaaucccaaaugcauucccagcagcaguggaaaacgggaaaggguggcaucuaggaaccagagauuaagagucaguggaagauaugaagccaaaugcccggcagcugguacuccugcccagugauggccucccccaucuaccagccagcagaggacccuggaucaugagccuuggggauggcggcagagggggcacgcaggcuaauguggcaaacccuuugagcuuccuccucugugucguccugugcuagcuugucgccaggaccugacagggccagccugucacuggugcucacacaugugccugucugacuccuucacuagacccagagcauggugggugugugucccagacagugaguagcauuugguccagaaguauuugcugagagauagcaaugaacauuacagacacaaucccuauucucacaaagcuucauccagcaggggagacagacaugagacagaucauuucccauagaguuccucaucaauuuagcgcugugauaagugcuaccaaggaacugugcagggcacucugagaacacacaacaggagaccugaccucgacuggagcuucucagaggauguaauguuuaaacugagaacugaaggaggcugagcaugguggcucaugccuauaaucccagcacuuugggagucugaggugggaggaucacuuaagcccaggagguuaaggcugcagcgagcuaugaucacaccacugcacuccagccugggugauggagcaagacccugucucaaaaaaaggaaaaaaaaaaaaaaaagaacugaaggauaagacaagugaguggggagauuccagacagagggagcugcuuguucaaaggcccugaagagggaaggaucaugguuaguucagggaacagacagcagcagggcacagcuugugcuuggcaagcugguggggugaggcugccacagcaggccuugaaaaagcaguucaacucgucaggaggccaguucuaguucuauggaggaaucugggagcugcagcucugaaccaccgcccccuuccauucccagcucccucaacacacauacaugcacacgcacacacacacauguaugcgugcagcaggcugccuugucuuaccugccacucuaacuccucccuugagaaucuguccgugggcccaucagggcugucccgagaguucucgauuccaucuugcuccagaauuggcagcaaguacugagaagggggguaguauuccagcccugacucuguaagagacgggacacaagcugaccaggagggaggagacagcugagguacccagagacacccgcucccacugccagggcagccggccccacccugacucagccacugcucuccucuucccuagccugggcgcuucguguuuuucaccgguccuagcccugggccuggaauguggcaggugcucaguaaaugucaguggagugagucaauggguacuggcuaccccuuacaccucuuuaccauccaagugagaaugaagugaugaaaaagccugagauaagcagugaaaccugcguccuagauccagcucuaccaauaauucccugaaugugagaccuugggcaagaugcuuuccuucucuggccaugugugguuuugccuguaaaauuucaaaggguucauaccuuagacucacuuccuauuuggcuguuugucuuuuuccuguugauuuguaggugcucuuuauauauuguaguuaauaaccuuaggucuauaauauguuguaacuaucuucuuccaggugguaacuggucuuuuaacuuugaugaugguguccuuccgggguaaacaaguuguaaguuuugauguacucaaaguuaucuucuuuccccucaugggaaggauacagucacgucacaagaaauacuaaaaaugggcaggagacguaugaaaaauauucacagaaucaaggaagugacauuagaauaauaaugggcucucuuguuauccauccgauuagcagacucuuuaauaaaauacuucauguuacgcagguugugaagggggagagagguccucccagccacuccucaugggauggagacugaugggaccucuucccaggcacccuagggcgcucgugcccucucacacacccuaggggaaagugcacacggugacagagaggugucaguucaaauguucagaacagcaggaaacuggaaaugccuuccaacagggauggcuacgaagcuacaggugccaccacaugaaauccugugaccaguuuaaggggacauucaaaccguacuaugagacaggaaaauacccaagacuuuucuugagagacaaaaaaagcaaggcauagaaucacaucauaugauaccuuuuaugguuucuuuaauguuuauuuuuauuuuuauuuauuuauuuauuuuuugagauggagucuugcucugucacccaggcuggagugcaguggcaugaucucugcucacugcaaccuccuccuccuggguucaagccauucuccugccucagccuccugaguagcugggauuauaggcaugcgccacuacacccagcuaauuuuguauuuuuaguagagacaggguuuccgcauguugguaaagguggucucgaacuccugaccucaggggaucugccagccuuggucucccaaaguuaugggauuauaggugugagucaccaugcccagccucuuuaauguuuuuuaaaaggucaaaaaacaaauuuuacacacacauauauauauauauauacuucuacauaguuuagguaaauugaaaaauuauuucuuggccaggcguggugucucacgccuguaaucccagcauuuugggaggcugaggcggguggaucacgaggucaggaguucgagaccagccugaccaacauggugaaaccccgucucuacuaaaaauacaaaaauuagccaggcgugguggugggcgccuguaaucccagcuacucaggaggcugaggcaggagaaucgcuugaacccaggaggcagagguuguagugagccaagauugcgccaccgcacuccagccugggcgacagugagacucugucucaaaaaaaaaaauuauuucuugcagggcgugguggcucacacuuguaaugccagcgcuucgggaggccgagguggguggaucaccuuaggucaagaguaugagaccacccuggucaacauggcgaaacccugucuuuacuaaaaauacaaaaauuagccaggcgugguggcuaauuguucuuuuuucuuuuuuuuugagauggagucuugcucugucgcccaggcuggagugcaguggcgagaucucagcucacugcagccucugccucauggguucaagcgauucuccugccucagccuccugaguagcugggauuacaggcaugcaucaccacgccuggcuagucuuuguauuuuuaguaaagauggcguuucuccauguuggucaggcuggucucgaacucccgaccucaggugauccacccaccucgaccuccuaaagugcugggauuacaggcgugagccaccgcgcccagcccaaaaucuuuuuuuuuuuuuuuuuuuuuuuuuauaacauaaggucucucucugucacccaggcugcagugcaguggcacaaucuuggcucacugcaaccuccacuucuuaggcucaagcaauccucccaccuaagacucccgagcagcuggcacuacaggugugccaccaagcugggcuaauuuuugcauuuuuuguagagaugaaguuuugccauguugcccauguugaacuccugggcucaagcgauccacccgccuuggccucccaaaauguugggauuacaggcgugagccaccuuguucggccccaaaaucuuuuuaaagaaaauaaaggcuuuugucuagcuagcucagccauuggccaggguguauauuggaaucaccuguugcucgaagacucuaauuugcauauguguggccugguggcuaugaucgcagccaccccccuccacuuucuuuuaaaguaaaauauaacauacauacagaaaagagcacaaaaucuuucucucucuuuuuuuaagauuagucaagugcagcggugagaagaggagaaagaguggaacaaggccuuaaaucuguaacugacugugagcaaucaauugagauaacucacugccuuugggccgagagcacagaaucuucaugcagagcuugaugaauguuuaaaggugaacacacucucaugaccaggaaccagugcugguucaaagcucuguggugacugauaagagcacauauuccuuugugucuggcuccucacacuccacauuguuugugagacucauccagguuguugaaaggagcaguggcucauucuuuccacuugccgugugguauccacacauugaguauaaaacaguuuaguuauccauucuacuccuaauggacauuaaagcuguuuccagguuggacuggcauaaauagugcugcuaugaacauuuuugcacauggcuuuuggcauuuauucauaugcauuuccauugggcauugauauggucuggcucuguguccccaccucaaucucugaauuguaauccccacguguugggggcgggaacucgugggaggugauuagaucaugggagcaguucccccaugcuauucuuaugguggugggugaguucucacaagaucugaugguuuuauaaggggcuucccucuucacuuggcacuaauucucucuccugcugcccugugaagaggugccuuccaccaugacuguaaguuuccugaggccucccggccaugugaaacugugagucaauuaaacuucuuuucuuuauaaagaauuucuucauagaaauugggaauuucuucauagcggugugagaacagacuaauacaggcauguaccuaggaauggaacucaugggccauaggauauuugaauguucagcuugaguagauauugagaauaauuuuuaagguaauuuucacuuuacauucccaccugcaguauauggaaguuccuguugcuccacaucuuugcuaauucuugguaucaccaguucaauuuuggccauuuuauuuuauuuuuuugagauggagucuugcucuguaucccaggcuggagugcaguggcgcaaucucggcucacugcaagcuccuccucccggguucacgccauucuccugcuucagccucccuaguagcugggacuacaggcgcccgccaccacgccuugcuaauuuuuuuuguauuuuuaguagagacaggguuucacuguguuagucaggauggucucaaucuucugacgucaugauccgcccaccucggccucccaaagugcugggauuacaggcgcgagccaccgcgcccggccuauuuuuuguuuuuuuauuucugguugacuugucagcaggaaguuuuuuguuuuuuuuuuuccauugaaaaguucuggccauuuuaguggguuugucaaaguaucucuuugcaguuuuaauuugcauuuucccauugacuaagaugauguugugcaauuuuuucagauacuguuugcuaucuguauaucaucucuuuuuuuuuuuucuuuuugagauggaguuuugcucugucauccagacuggagugcaguggcacaaucucagcucacugcaaccucugccucccggguucaagugauucuccugccucagccuccugaguagcugggauuacaggugccugccaccaugcccaguuaguuuuuguauuuuuaguagagauggaguuuuaccauguugaccaggcuggucucaaacuccugaccucagguuaucugcccaccucagccucccaaagugcugggauuacaggugugagccaccguguggauauucucuuguguaaaaauucuuagucaagucuuuugcuaaugucuuuuccuuguggaucuguaggauuucuguuuauaguccagaucccaguccuuuguuggauauauauguauugcaaauaucaucucuaacuuuauggcuuuccuuuucuuucccuaaaugguaucuuuugaggaagagacauuuugauuuuaauuaaaccuuuuuuuugagauaggguauugcuuuguuggagucuugcuccaggcuggagugcaguggcaugaccacagcucaggcucaaaugauccuuccaccucagccucccaaguagcugggaacacaggcacgugccaccacgccuggcugauuuuuuuuuuuuuuuuuuuuuuuuuuuuuguagagacaggguuucaccauguugccuaggcuggucucaaacuccugggcucgagauccuccugccucagccucccauagugcugggauuacaggcgcaagccaccaugucuggccuuaauuaaaucuaagguaccaaucuuuuaucaugaguacugccugcuuccuguuuaaggaagagguuaaaguucauuuuuuccacagggacaaccaguugauccagaaucagcuauugaaaagaccauccuuccccacuguuuugcaauggccaugauaagucauaggcaugugugucuugguugcauucugaaagucccacaggugaccagaaccacuagcuaagaacuuccagccugacagggcauccugcucuccucccgccuccagccagugcuggcuccggguuuuagcuccuucugcugugcaucucuccuggaugaccccgacagccuccuaacugguccccuguccugcacucuuucuuuccuccuccaaucccuucuccucccugcagccuaaugacugaucacaugcucucccacuggacacugggcccgggcacugucuuuggcuucucccaucucucuucucucugcuuccucccuccagcuacacuggcccucucucugucaaacuucccaucaaggcccuuccauaugcaccuacuggcggaacagcuuucugcuuuuucuagaucuuaaccaugacuccgugucaguggagccacacucucaaagacaggccuucccuguggccccaaccuaaaucagcugcaccacugcacucccauaaccacagucuguaucuauuucccuguguaaacauuuguuuugccuguuucccuugccagaccucgaacuccaagcagguaggcacuguggccauuucugucucugcuguuccccagccugggcuggcacaggguggccaugggggucauaguuccucaaugaggggaggaggcagcggccuggcuuuaccuuugcagaggaacugcaagauggccgcagugccggcaccacacaccucccgcggcggguagaccauggccgaggcgucaaggcucagcaucugcagacacaaggguaacccgcuuuacuguucgcuaccaacgcaaccggagaccacacgauuuccuuaucaauuuguguguucucugucaccucuacccagcaggaauggccugacagcagagguggcugaacugucuuguuacuuacagcugcguucccagugccugggaugacuguaggcaggcagugugaugcccuaccuuguuuuaaccugagugacucucuccuagcagagagagagccggacagacuccauuuuaguuucuucaccugcagcccccuucccucccucccuuaagggcauaacuaguguaaacugacucaaagcacauccaggaaugcacuuacugauaagauauugaggugagcugcaccagcagcuccuggggacacgcgcaguggauggcacauaaagccccugcauuuaucccuuugugauaguuuaagccccugcaccuggaacuguuuauuuuuuguaacugcuuuuguaaccaauuaauuuuuuaacuuuuugccaguucugcuucuguaaaaauugcuucagcuaaacuccccccuccccuauuuagaccacaguauaaaaacaaaacuagccccuuccucagggccaagagaauuuugagcauuagcugccucucgguugccagcuaauaaaggacuccucaauuugucucaaagugugguguuucucuauaacucgcuugguuacaacagcagcaagcacuuuuuuacauuuuucugagacagggucucauucccauugcccagacuggagugcaguggcacgaacacugcagucucgaccuccccagguuuaagcaauccucccacuucagccuccugaguagcugggacuauaagcacaugccaccaugccuaauuuuuguauuuuuuguagagauaaaguccuacuauguuacccaggcuagucucaaagucuugggcccaagcaauucgcccgccucccaaagugcuggaauuacaggugugagucauacacccagccucucaguucacuuuggauaaauacauaagugagugaaaaaaaggaaguuauaggacagcauauagaauaugauuccacuggcugggugugguggcucaugcguguaaucccagcacuuugggaggccaaggugggaggaucacuucagcccaggaguucgagaccagccugggcaacauagcgagaccccaucucuaguggaaaaaaaaaaaaaaaaaaaaaaaaaauauauauauauauauauauauauauauaugauucuuccuuuguuagauaauauauucauauaauauauucauacacuuucacauucauauuuuauagaaaaaaauuggagggauaucuaucaaacuaaaagugguuuccucuaaaaggagauuuuggguuacuaucuacaugaaaugcuauuauuauuacuauuuuuugagacagagucuugcuguguggcaggcuggagugcaguggugugaucucagcucauugcaaccuuugccuccccaguucaagcaauucucuugccucagccucccgaguagcuggaacuauaggcaugcgccaccacacccggcuaauuuuuguauuuuuaguagagaugggguuucaccauguuggccaggcuggucuugaacuccugaccucaagugauccacccaccucgucuucccaaagugcuaggauuacaagcuugagccacugugccuggcagaaauguuucuuaauauuugcauuuuuuuuguuuuacaauauacaguaugacuuuuaaauuauguaaugacaaauguuuaucagcgcacacaugcagaugccuccguguuuaugaagcccaggaagcaggggccucagcucacagccacagaacugccccauccacggugugaguuguguuggacccugcccucccgcugccaaccucugacuucccacaggcccucucaucccagagugcuggcaggcacugauauccucuaugccuggguaucaggggaguccuggaaaaggagaaggccugggaagcucugauuuugcuguaacacaaguggcugggugggaaggguagcucaggucccccagcccuggccagcccagcccucacacgguggguguugagugaacgugcuuugcacagggagugggagacugccccagggaagaggaacugaccgcccagaugcugagggcccaacagcagaaaaccccauaccuggaagcaaaugaaccccacaugggugcucuuagucaccaucaguaaagcgugguggcuuaagggcacggacugugggcuauaccaggaugcuggcuacaagccauguguggccauuuaugguuacauuuuaaguaacugaaaauaaaucugauuuaaaguuugaguccaugguugguugcagucaccacauuucaagggcccagcagcuacaaguggcugggguggccauguuggcugcacagaucauagagcauucucaucgugggcagcaggagcagugacuggacauugcugugccaaagacaccgccauggcuucagaucccggcucauugcaugcuggccauguguuugcuuaaucaggccccuuaguguccuggggcuguggucuccucauagccaaacaggcaguguuaccgaccuggugggcuguuugguggguggcgugcgugacaccugaagaucuugcccacaguacggccugaacucagaacgguuaucucauccuaaaagaagguuuguccgaggugccaccaagaaacccaaaagauuuuuuuuaaaggaaucaaaauaaaaugaaguguccagguugggugugguggcucacaccuguaaucccaccuacuugggagucaaggcgggaggauugcuugagcccaagacuuugagaccaggcugggcaacauagugggaccucaucucuacaaaaaauaaaaaaauuagccaagagugaugggguacaccuguggucccagucucuugggaggcugaggaggaggaucucuugagcccaggaguuugaggcugcagugagcuaugauugagccacugcacuccagccugggugacagcaugagagccugucucaaagaaaaaaaaauugaaguguccagaacucauacuagaugucgagauggcuucaggauugggaacgugcucugagcuguauugucuaaaaugguagccacuaaggacccacggcuauuuaaauauaaauuaauuaaaauucaaugaaaucaaacuuuuaguuccuggcuguacacacaagccacauuccaggugcuccauagauacauauggccagcggcugccgcucuggacagcacggucuccaggugcucaauagauacacguggccaguggccgccgcucuggacagcacggucaccaggugcucauuagauacacauggccaguggcugccgcucuggacagcacggucacugaacauuuccaucauugcagaaaguuccaguaggcagcagagaggacaagccauguuggcccaucuccccagccggcccuuucucaggcaggagggccccagcugcugaggucaguccuuccucugcugucucugugaucacccacccacucugacacagacaccucugcucagcaggcugggcuggcugagaguggggucaacuccaggccacuccggaaugcuggccagacugcgugccaccaugaauggagaagucccuguuccagaagccgagucauacagagguggggagcacaggcgucagcuucagacggccugguuuacaacgaucucugcugucagugacuguguggcccuugggcaaguuucuuaaacugccugugccucaguuucuucaucuacaaaguagcacaauaguaucugccucacaagaguucugugacgauacacggagcgauuccagguuaugcccagucuuagaaagccccagauaaaggugagcuaccucauuagcaugacugugagagcugcuuuccgugagcagcugccucugucagugucugucaugggcugaacuaugucccccucccaaguuccuauguggaaauccuaauccccccaucccucagaauguggcuguauguggagauagcaucuuuaaggagguaauuaaguuaaaaaggggucauuaggcugggcccuaauccaaugugacuggugugcuucuaagaggagggaauuuggacccggacauguacacagggaagaugaggugaagacacagggagggaagacagcaccuacaagccaaggagggaggccucagaagucaccaacccugccaacaccuugaucuuggacuucuagccuauagaacuccccuggccuggauaauucugaacccccaucccaacggcucccuaccuccuucucucccucccagcuuucugggccccauaucacacaagcucagcagcuuccaaccacaucacuuccucgacccucccugagacaaucugugcuucccaccaccugccuccugcaccugggcugccccuguuauccaggucugcucagaauuuuuuuuuuuuuuuuuuuuuuugagacaaagucuugcuuuguuguccaggcuggaaugcaauggcgcaaucucggcucacugcaaucuccgccucccggguucaagcaauucuccugucucagccucccccgaguagcugggauuacaggugcgcaccaccacgccuggauaauuucuuguauuuuuaguagagacaggguuucaccauguuggccaggcuggucucgaacuccuaaccucaagugauccaccugcuuuggccucccaaagugcugggauuacaggagugagccacggugcccagcccagaaaucuuauuccuccuuuaaggucuggcuugaauaucacaacuuuuuuuuuuuuuaacuuuuuuuuucuucugcaacuuuuaagcucaggaguacaugugcagcacgugcagguuuguuacaaagguaaacaugugccacggugguuugcugcacagaucgucccaucacccagguuugaagcccagcauccauuagcuuuucuuccugaugcucucccuccccaccacccuccuccgacaggccucacuguguuguuccccuaccgacaacuuucuuaaagugucagccucuucuggauucagcauucuuucuucuucauucuuaauguauguuuuucugccucuauuauggcagcaaaagucauauaauuacgaauguucacacauuggccucucuacaagccuccaaggaccaugccuugggaucucuguguggcccugguaccgugagaucagagcaagcacucaguaaugugggagagaggggaggugggcaggccagagagcaccccaggcaagaacagcuucccauuuaccuccaggguucgaacgugagccagcaucugcggcaaucucuggaucucguuuccacugauguugaggguacgcaggcuucgaagcucccccacggugucuggaagcuccuucagcuuguugucugcagagaccccaauagcacagcucaacaccccaaauccccaucaccagcuuccugccugaugcccgcugggagccacucugaccucuagggcacacaacagauccugggcucugagguuuccuaggcucaagaagguggaguuccaguucaaguccccacuccaccaauuacuagccaagagacuuuagacaacuggcuuugccuccuugugccaguuuucucaccuggaaaauggggaugacacugccacccagccuuauaagaacacggggagauuggagguucagguagaugaugugugagguccuccgcacagggccccucaugcuguaauggcugagcaauggggcgccacuguuguucucauuacucauauguuacaguugauaaacagaggcacucugcaggaagugcuuaaggacagccaggagaagggagagagcuggguguggcgagcagagcgcuccugcggguaaggcgccugugcaguggucuuggcucugucaccaucccacgggguggucuugagcaagucacacuugauuucccgggccuuguuuuccucguguguaaacuggggauggcaccacugcccucagccugcccaguggacuccucaggaggcuuggugcgucgcuggagguggaagcacugcucagaaccuuacugcggcuccuuaggagcucucgccccaucaguccucuacacucaccauuauaaauaugagugacugaggcucggggcccagcugcccuccuccccauacggccauacggcccuggcucucaggagccacaggaacccuccagacagccugucucugguuaccaugaagacagcugacccagcaggggucaguccauuuacagcgacccccggagacuggcugcccuccugcucaauggcucccgggcggggcagccuguggaucccggccaggauggcccagagcugauggagggucacacggacacggcuucuuggucccuaccuuuaacauugagagucuggagcugggucagguucccaauggaacgugggagcugcaucaguugauuccuuuccacguuuaagaccuaagaaagaggaagaggcagccaggcgcaguggcuuaugccuguaaucccagcacuuugggaggccgaggcagguggaucacaaggucaagaguucaagaccagccuggccaacauagugaaaucccaucucuacuaaaaauacaaaaauuagcugggcaugguggcacacaccuguagucccagcuacucgggaggcugaggcaggagaauugcuugaacccaggaggcagagguugcggugagcugagauugcaccauugcacuccggccugggcaacagagugagacuccgucucaaaaaaaaaaaaaaaaaaaaaaaaaagaaagaaacaggaagaggugacacgagaacccacacacagaccacagugaugacccccgcaccccucgcccugccgggccagggcacccaggcacuacacacacaagcucuuaucucccccuaccggcccuugaggaagacagaaauucuuguuuccgcuggagacaggaaaaaaacugaagcucaggguggcaaagucacgugcucaggagagcacagccaggccuugaaccccuucuggcugagguuccagcacuuacaccgaccacaaaaugcucaguaacugccccaccaucagggaaggagggagaaggggacuacagacuuggggaucuggggaggcagcacaggaggcucuaguuccccuggccuuaaggaaaaggcugcccuaaggccgugugauccacccaaggccucaggccggcaguggugcugggacugaaccagggcuuguuggauuccgaagcugugcucccuccagaaggugguaccucgaggugagcaaggcuagcaggaugacacacuaaccauuaaaaauagaugcaaugggggccaggcacgguggcuaacaccuguaaucccagcacuuugggaggcugagguggguggaucaugagaucaggagauugagaccauccuggugaacauggugaaaccccgucucuacuaaaauauaaaaaauuagccaggcauaguggugggcgccuguaauuccagcuacuuaggaggcugaggcaggggaaucgcuugaacccgggagguggagauugcagugagccgagaucacaccacugcacuccagccuggugauagagcgagacucuaucucaaaaauacaaacaaacaaaaaaugaugcaauggaaagcuaaguagccauuaaaaauaauaagaugaauauuugaugaaccaaaggaugcuaugaguuauugucagguauccaaaaguuacaaauuagugaaugcagcaauucuauaaaaauacaccuacuggccaggugcaguggcucaugccuguaauuccagcacuuugggaggccaagacggguggaucaccugaggccaggaguuugaggucagccuggccaacauggugaaaacaagucucuacugaaaauacaaaaauuguccaggugugguggcgugugccuguaaucccagauacucaggaggcugaggcaugagaaucucuugaacccgggaggcagauguugcagugaguugagauggugccacugcacuccagccugggugacaagagugagaaaaaaaaaauacacauacaaaaaguccuacaccaagguauuuauuguggcucaaagugguacaauuggucaggcgugguggcucacaccuguaaucccagcacuuugggaggccaaagugaguggauaacuugaggucaggaguuugagaccagucaggccaacaaggcgaaacaccaucucuacuaaaaauacaaaaacuagcugggagugguggcacacaccuguaaucccagcuacuagggaggcugaggcaggagaaucgcuugaacucgggaggcagagguugccucugcaacucugauggcgccacugcaccccagccugggcaacgcagugaggcacugccucaaaaaaaaaaaaaaaaaccccaaagggccaaggggaggguggagcuggcacugauugcagccugcuuccacuggcuggagcccggccagaacauuccaggcuugagugacugccuggucucacuaaggccauccgagguggguuucuguuucugcagccuuaccuggagggcagucagcugccccagaucgucaggaagggcugucagcugauuaucguggagaucuagaaccugcagaagaaagaccccugugagucuccaagugagaaagucccucagacuccgggcuccagagcgcugaggaggggcuggggccaccucacacccccagugcagaaacagagugccugccacuccuuucccacucaguguugaucauucccgccucauuuuccuucucaaaccauuauaccauuuucuuauuuuauguauauuuauuuuuacuguuaacugaaaaacuaugcuauaaaacaguaugccuagauacuaauauguuaaaaagaaacacuccauuguauaaauauguaagacuuucaaauaugcgauaaaauauugacagugguacuccacaguguaaaauuauagauguuucccccuuugcuuaacuguacuugcuaauuuuuaauuuaauuuuauuuuauuuuguuuuauuuugagacagagucucacucugucacccaggcuggagugcaguggcacgaccucagcucacugcaaccuccaccuccuggguucaagugauucucgugccucagccucccaaguagcugggauuacaagcacaagccaacaugcucugcugguguuuuuuuuuguuuuguuuuguuuuguuuuguuuuguuuuugagacgaagucucgcucugucgcccacgccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccauguuggccaggcuggucuugaacuccugaccucaagugacccacccgccuuggccucccaaagugcuaggauuaugggugugagccaccacgacugacugcuaauuuuuuaaaaaugaaaaugcacaaaaaaggccuuggagaaauauuuauacaugugcacacacagguacccuccauaucuauggauucaaccaaacucaggugcaaaauauuaaaaaaaaaaaaaagaaagaaagcaucuguagugaacacauacaggcuuuucucuugucauuauucccuaaacaauauaguauaacagauugggccugugcugcugggcugacaccugugcugccggccuccucugaaggugcauaucacucucccaagcucaggucugcgcauaacaacccugggcucacaccucccacauguugugaaugccucccagcccauccggggaggagcucacagucagcagggaguccuuccagaucaccugcgcgucccuccucuuccuucuugccugggaccaucagucuccucgcccucugcuagcugacucgccaugaggcugucacuuggcuuuccuccuggcauguaaacuccccagggacagggccuguggcuggucaucuuugucacccuaacccacacacagcccacagaaguauccaguaaaccauacugaucaaaucccagacugacugguagauugggccccucugacaugcaagaggcagcccaaaaggagcaggcgcucagcugccgcguggaaccccaugcagagccccagcugccugggaggagggcccaguaccuugaugguugccagacucaggaggcugcaggauuugggaagcagggaagugaggugauucguguggacgaucagcaccuguguggagagaugugcggccaugcugggcugaggaagagcagcaggcagggcaggcuaagggcgugggagccagcccagcgccgugccacgccccaccaucuugcucucccagacaccaccacggggaugcgggucaguaucaugaacucucccaauggggaaucuaaugcccuuccuuaaaaccuggaucuucaagggugaaagagaccuuagaggucuacaucuuccuuccaucugagaagggaucccccugcagccauccugaucauaaccuucccagcaccagcgucuucacguggaaaauagagaauaauaaagugcuugccucccagggcugccaugauguuaaauaaaagcucaugcgcaaaacuuccagggcuggcagaggggccagggcucaguccaggucaucuacugcuauuuuuccuuuucuuuuuuuuuuuuuuugagaccaacucuugcucugucgcccaagcuggagugcaguggugugaucucagcucacugcaaccuccgccucccagguucaagcaauucuccugucucgcccucccgaguagcugggacuacaggcgcaugccaccacacccagcugauuuuuuuuuuauuuuugguagagaccggguuucaccaugguagccaggauggucuugaucuccugaccucgugaucugcccaccucggccucccgaagugcugggauuacaggcaugagccaccgcacccggccaaucuacugcauuuuucuuaggcauugacugcggcccaacacuuccagcacagacugggcgugguggcucacaccuguaaucccagcacuuuggcaggcuaaggcagguggaucacuugaggucaggaguucgagaccagccuggccaacauggcaaaaccucaucucuaaaaauacaaaaauuaguugggcaugguggugggcgccuauaaucccagcuacucaggaggcugaggcaggagaauugcuugaacccaggaggcggagguuucagugagcugagauugcaccacugcacuccagccugggugacagagcagagcguccgucuucaaaaaaaaaaaaaaacaaacaaaacuuccagcgccaaggagcucacuacucuguuggcagggaacacuuuuuuuuuuuuuuuuuuuugcauauucucauuuagauacuucacuuagagcgcuucuacccaucugcauucaaagcugcaaugcucugcugaaaaaucauucacuccccucugaaucuccccugggugaccagaauaaaaggcgugaguuucuauuauuacuaacaccgggguucauaagccuuuacuacgugguaggcauguacacucaguauauuucuaucucuaucuagcuaucuaccacucauuuaauucucacaauaccucaggaaggagaacuaugaaugucuucauuucacaggggaagaaacugagaaguaagaguuuaaggaaguugcccaagucaugaagccagugagggcagaguuagaaugugacacaggaagguccaaccccaaagccuacucuccuaucugugaaaacaccugcugcaggccaagagcauaagaagcagagagaaaggaggugucuacgccgggaagacagcuccucaaagucccuuguggguucaaacaagcagacaugcaacaagaaagucucugaagaugaagcuccaucuuaccuucuucugcagaacuuugcauguugcaaaagcuccaaauggaaucuaagauaagauaaagaagaguaagugucuccccuccugccaguuuuuagcuuguucucugaguggcauucacgugaggaagagacaggcaggaggugaacaagggcaaaacgccacagcagguggcagugcugagcccaggggcaaggcuggcaagcagugguguuggggauguggccagcccuucccucggucagcuggcaggagacugcccugccccacccacccuguccccauugugaaccccuucaggggcuggagaaugccaggcccuuccagcaauguaggagucuauggguacauuuucuaccuagacuccuugacucuuggagacuacguuauauugaggccaaaggaucaucuucaauuauuuuggacgagaacaaaaucuaaggaaacaucucgugacuagagcuucuggccuuucuaaagccccaguccaccucugucuuuccuagggacacaagauccaagaaaacgggacagauccaauucacagcccaacacuauccucaguuuaccucugagagcucacauuuagagaugucgagaaugucaucugccccagcuucuuuugccuaaggauaaaaagaauuuuuaaaaaguauuaagacaaaacaccuuugcagaguggacaagccaggcaaagaacauaaauguaagcagcugcaaaggaccauagacacuaucugguuccacugguccauuuggcaggugaaccaaugaccccugcuuucccagagcuugaggcccagagggaugaggaacugaaaagcaaugacagugcgcucagucuacaggggagaagcacccuuggcagggggccucaucuguugggucuaagucaaauauuucuucugugggugggggaggcagaugggaaggagcacggcuuguugggggcagugcggaggccuacuccauggggaccgaggaggagaugggauagaguuagaggaaacccacuuucccucaccaaacacaucugguacuccaggcguuuccgagccuccucacuggguuuccgcuuccggaagaagagcggcauccuucccuuuucccagagcgaucuuuaggacccuggggcacaggagagaaguuagggacuggggaauuugucacagcccccaacacccgggacagguagugcaguaacacagagcaugcagcuggucugcuggaccaugaguuccauggaggcaggggcugugucucccuagugaguuccacggaggcagcggcugggucuuucuagagaguuccauggaggcagcaacuuucuagugaguuccaugggggcagaggcugcaucuuuuuagugaguuccacgggggcagaggcugcgacuuuccagugaguuccacggggucagggacagcgucuuucuagugaguuucacggaggcaggggcugcgucuuucuagugaguuccacgggggcaggggcugcgucuuucuagugaguuccacgggggcaggggcugcgucuuucuagugaguuccacgggggcaggggcugcgucuuucuauugaguuccauggaggcaggggcugugucuuucuagugaguuccaugggguaagggucagugucuuucuagcgaguuccauggagccagggacugcgucuuccuaguuucauggaguuccaugggggcaggggccacaucuuucuagugaguuccauggggucaggggccacaucuuucuagugaauuccaugaggugaggggcugcgucuuucuaguucuuccaucuguguccugagcccacagcaggcacucaguacuccuuguucuuuguugacuaaacauugagcagcaggaugagguggagacagacaagccagaugaccuggguuggggcccauauuugccaccgacccauagugaggccuuggcauuauccuuuuccuguucuagggaaacuuagagacguuuccucaggugcuuuccaaggcuguucuuugaggacucuaacagacucugccaaugaaucacuucuagccccccaaacgcugucagagcaggaucagcaggagcaauccagagccagccaggaccucagggagcucaacuacaucaugaccaaagagaccucugcggugaauacaaauuaaaaagcaauucucagcuuaccacccucguuauuauuccauuuuguucucaccauaacccuuuuuaaagugaagaaacacgccgggugugguggcucaugccuguaaucccagcacuuugggaggccaagacaggugggucacuugagcccaggaguucgagaccagccuggguaacauggucaaaccccgucucuacuaaaaauacacaaagaagcugggcguggugauaugcgccuguagucccagccacuuggaaggcugaggaacgagaauugcuugaacccaggaggcagagguugcagugagccaagaucaugccacugcacuccagccugggugacagagggagucucugucucagaaaauaauaauaaauaaauaaauaaagugaagaaguagaugcuuauuaaguucaguggccuggcuguacagccuggauugcagccuggaaccguggucucucaaguccugaccuaugggauuugcccgacugcuuggugcucacauaacuuggcacacacgaaguacacuguccugaacucagagccaggugcucacugccugcccagggccugcacagugucuguaaauaccagagcuggauaagggauggcaaugagccaggaggcaaucacccagggaagugcauggugagcagcacaggcuuugggaugaaaagagaacuggguuugaauccgaaaucugccacccacaacugcagaggucaccuugguucaccucucagagccucaguuuccucaucuguaaagugugaguaaccaugcuaccaacacuggcuucuaugaggauccagcgacuucauguaugucaagccccuaguacaguaccuggcacaugagcgcucaauaaauguuagccacaaagcaacccacaugcaagcaacauugauucagggcccgcuagaggagcuagggagaagauagucaugggaggagaugcaguugaagaagacauacacccaguccucagagggaugggcaaagauggcagcucugcacccacgggggcggggcugucuggggaggcagccaggccugcagagccaguucaggcccucuugucaccccaccugccugcaaggauggggaaugguuugaaaacagcccucccccauccgucccugaugaccagcacuuacccuucugcuccccaaucacuaacccucuugcacccccuuccugaugugcagcccuccccacuuccucccaaccaccaucgcucucccaccccuccccgaagaucaguucuuuccaggcugccccacaugccugucccucccucuccgacguccagccuagaugcggggggagggccacacccauauuuccugggguggggugggcaguggcugaccuggcuuugcggauggagggaucccccacguugggacccgcgggugcacccgagggcaggccgaucacucggagggcuuggucacggacucggggccgcagaccacccggcacgggccgggcggagccggagucuggucuccuucaaaggcaggugcugggaacagaaacucagaaucucauaaagucacgcagaccgggaugacgaagucugaggcucuaggaaucgcggacucuccgaaugaagagcgggacuggauuuccacauagacuguuuugauaacuaaagugcacacaacaagugcucgagggagcaggggucgccgcgguacuggggucucggaaugggacuacggaccccucaggggaggggcggggcucugggauugggugacggggaccggggugacacucacgauaaaggaauaugggaaacagcuagggcugggaucaccggagccacccuucucagacuucuccggagcgaacuacccgaacccccuuucggaaucucuagcuucagcgcaccgcggugcccugcuugccagccgucagccucaggcgccugcccacaacaaacauggcgacaagggcgucucu

SEQ ID NO: 191194 - RNA, 103180 nt, Homo sapiens
aagccaacaggcgaguggcgaagguggcggcagcggcggcgggggcagucaccggcuagggcgacggcuccgaggccgaguggcgguccgacagaguccuccguguccucccccgcaugacccccuuggugaguacgcgucccgauuuaguccgcgggcugugagcggcucccugccucgcggccggguugcuccggccuagggccgcagccugucucugacugcccggccgucagguccaacugaccccgggguccugggcucuucccgucagugucgggcgaggugggggucgggggacacuggguuagacccaggggagagauguggcggcgcgcaggagccagggcggccuggggcugaggagagggagagacgcgugggggaugggaugggaagggacaggaggaccgcggggcggccucgggugggggccagagacgagaggcccggcagguagggaacugaguauaggaggcgagaacgaaauggaaugucuucugagugucgcugauaaagauaucgugcugcagggaagcuugacaagcuggacacacgggucugggggcagcccaccuaacacagacacucacuguacuuggcaucuuuccacuugcugucggaggucugaaagugagggagcuguugguuguuuccaucccuuuucuuuuaacuucaccuuuuauugacuggcaaaauuguagugagugcuggcuaggcaaaccacagaaguacacccaggguucuguguauaaaugugcauaaaaacagggagacauagugauagguucagaugagaacuaggucaaaggaggaaucaguguuuuuauuuuuaaauuuaugacgaaaaucaguucugagcaggacuuugaacuagagagggguuuuaaacuggaguucauugauggauagaauuagaaggguccuuucacuagaaggaggauaaaaugacaucauuauuuuuauugacugcuaacugaaacuuauuauuuccuucaguuacgaauguggacaacaagccagaguagcauuagcagcgccuaugacuuugugaucaauaaaaauuacggauauuuuugcaucauguuuacaguugcagauagcucagaauaucauuuaugguuaacacuucuuugaauuucugguguuacuagacccgccguuagacauuguuauuuaaugugauaauaaggcuguacauauauuaugaccauauuaguuuguuguuuugcuaauauuuccauauaauugguuucccuuguaaucacauguauuuaauuaugcacuuaaaagaaaucugagaaagggaccauaggcuucaccaaacugccaaugagguccgugcacaaaaagauuaagaacuccugaaauaauuugggaggccgaggcgggcggaucauugaggucaagagaucgagaccauccuggccaacauggugaaaccccaucucuacuaaaaauacaaaaauuaguugggugugguggcccaugccuguaaucccagcuacuugggaggcugaggcaagagaaucacuugagcccgggagguggauauugcagugagccaagaucacgccacugcacuccagccuggcaacagagcgagacuccgucucaaaaaacaaaacaaaacaaaaaaacuccugaaauagaaauaagguuuuuuggauuuauaagucuacuuagaagaacuguuguuuuuuuuuuuuugguuguaaguuuauucaaugcaaaagaauccucuccaauuuuacugagguggcugaccacguccacgaccaaauccgucucaacuggaauuuggcugcugacccagccccagccucagcuuucuugucggcacuaaguggcacagcacuccaucuguagguaugucugucagcacuccaucuguagguaugucugucagcuuccccucuugugagucucgcaggucacucacccuccagaccuuuaggcugaggccugccggucucuggacagcuauggcguaggguagcagguacagucuccggggggcagaugaagguaaucccggagauacuggauacccucauugguaagguaccaguagaaaugucuccaggcaaacuguuccuucauguagccuugagacuugagagacugcauggccuucaugacaugaagguugggcacguucuugucugccagcucugggugcuuaggcauguggacauccuucuuggccaccaugacucccuccuuaaaaaggaguucauaaauggcaaucugguucuuuagaagaacauuugaaucauugaaggcagacaggaugacaguguagacgaaagagaauuucauaaucagggagauaaaaaauuuggaugggaucaggguagucuuuuguuuuguuuuguuuugagacggagucuggcucuguugccuaggcuggagugcaguggcaugaucuccgcucacugcgaccucagcuuccuggguucaagcgauucuugugccucagcuuccugaguagcugggacuacagacaccagccaccacgccuggauaauuuuuauauuuuuaguagaggcaagguuucaccauguuggucaggcuggucucaaaguccugaccucaggugaucugccugccucggacucccaaagugcugggauuacugaugugagccaccgcguccugcccagaguagucauuuugaaagaauagaccauagauauuucauucaggguaauggggaaugaacaaaauaaucggaagaagaaagaaaagugaauauguuggccuuuaaauuuuuguauuaaggcaccuccccacuuccaagggauugcagcucuguaagcucuaauguaagccugagaaaagaaauuuuacuguuugcugguuuucuuuaaaucauggagguggauuuuuuuuuuuuuuuucugagauggagucucaggcugucgcccaggcuggagugcaguggcgcgaucucagcucacugcaagcucugccuaccggguucaugccauucuccugccucagccucccagguagcugggacuacaggugcugccaccaugccuggcuaauuuuuguauuuuuaguagaaacgggguuucaccauguuggucaggcuggccucgaaccuccugaccuuaagugaucugcccgccuuggccccccagagugcuaggauuauuggcgugagccaccgcgccuggccaucuuacauuuuuuaaaagacaaaaaauuauuucccagcacuauguugugcuuuugugagcauuugguuucauauggggacuaaucauucuuaguacaugcugccauauagguuugauuauucaucauuuuguaugagguaauaaaagggaaagucuguaagugaaguucuuguuuugcugagguucuuuuaccuuuuacugugugauccuagguuguuuuauuucucuucauucuucuuccuucuuucuucuuccuucuuuuuuuuugaaacaaggucuugcugcauugcccaggcuggacuugaacuccuggacuugagugauccuccugccucagccuuaccaaguagcuaggacuauaggucggcaccaccacaccuggcauuguuucuuuuucuguucuucuuucugagagggagucuuacuugucucccaggcuggagugcagugguguaaucuuggcucacugaaaccucugccucccggguuccagcgauucuccugccucagucucccuccugggcugggacuacaggcgggugccacgauggcuggcuaauuuuuguauuuuuuuguagagacgggguuucaccauauuggccaggcuggucuugaacuccugaccucgugaucugcccaccucggccucccauagugcugggauuacaagugugagccaccgcgcccggccaaaaaaaaaauuucaugucugacgauaucaaauguuggugaagauguggcaaaaaugguaauuuugaaacuacuggccaggcgugguagcucaugccuauaauuuuagcacuuuuggaguuugagggccacuugaguccuugaacccgggaguucaagaccagccugggccucaaagugagaccccugucucuauuaaaaaagaaaaaauuuauaaaaaaaaaaaaaaaaagaaacugcuaccgguuacuguuaggaggaggaaaaaaaaacuguugguugaguguaaacugguauagcugcuuuugaagacaguauuugcagcccuuaguaaaguugaagauaggcguacucuauaauuucacgucuauaagggauuaugaaugggagguaguggcaaaggggaugauaucuauaauuuuuuuuuuuuuuuugagguggaguuuugcucuuguugcccaggcuggagugcaaaugcgcgaucucggcucacugcaaucuccgucucccggguuccagcauuucuccugccucagcuucccgagcagcugggauuauaggcaugcaccacuaugcccggcuaauuuuuauuuuauuuuauuuuauuuuauuuuuuuuuuuuuagacggagucucgcucugucgcccaggcuggagugcaguggcgugaucuuggcucacugcaagcucugccucccgaguucacgccauucuccugccucagccucccaaguagcugggacuacaggcgcccgccaccaugcccagcuaauuuuuuguauuuucaguagagacgggguuucaccauguuauccaggauggucuugaucuccugaccuugugauccaccugccucggccucccaaagugcugggauuacaggcgugagccaccgcgcgcagcccguuaucuauaauuucuuuugaggauaucuauacuuuuuuuuugagacuagacacuacugugacaacagcuaauucugggaggcagaauauacgugcuaaauuauuauuuguaucuuucccuauuuucugcuguucguuuuguuuuuuucuuuuuguuuguuuuuugagacagagucuugcucugugguccaggcuggagugcaguggcgccaucucaagucacugcaacuucccccuccuggguucaagagauucuccugccucagccuccugaguaacugguacuaugggcacgugccaccacaccuggcuaauuuuuuguauuuuuaguggagaugggguuucaccauguuggcaagccuggucuugaacuccugugauccgccugccucggccuccccaaagggcugggauuacaggcaugagccacuguacccggcaggcuuuguuuuuuuguaauccauaacuucuaaauauuguuuuugcaacucuuugaaaaauuguaagccuacagaaggguuguucaguaaacauucauauacccuucaccuagauuugcuguuaacauuuugccauguuuacuuuacacauagaagaugcacauuuuacuuugggaauccgagacggucagauuacuugagccuaggaauuugaauuuugaggcaaggucuugcucuguugucuagguuggaguucaguugcgcuaucagggaucauugcagucucgaccuccugggcucaagcuguccucccacuucagucuccugaguagguugggaugugcuaccacacccgguuaauuaauuuuaguuuuuuauuuuuugagauggaguuucacucuuguugcccaggcuggaguacaauggcacaaucucagcucaucgcaguuucugccuucugauucuccugccucagccucgcgaguagcugggauuacaggcaugugccaccaugcccagcuaauuuuguauuuuuaguagagacgggguuucaccauguugaucaggcuggucuugaacuccugaccucaggugaacugcccgcuucggccucccaaagugcugggauuacaggggugagcuaccaugccugaccaauuaaaaaaagaauuuuuuuuuuauugggaagacaggaucucccuauguuccucaggcuggucucaaacuccugggcucaagcaauccucccaccuugaccucccaaagcuuugggauuacaggcgugagccacuaugccuagcugcuagaauuuaaaauaaacuuuauucggccaggcacaguggcucacaccugugaucccugcauuuugggagaccgaggcggguggaucaccugaggucaggaguuugagaccagccuggccgacaugaugaaaucccaucucuacuaaaaauacaaaaaauuagcugggcgugguggcucgcgccuguaaucccagcuacucaggaggcugaggcaggagaaucgcuugaacccaggaggcugggguuguagugagccgagaucacgccacugcacuccagcuugagcaacaagaacaaaacucugucucaaaaaaaaacaacaacaaacaaacaaacaacccccccccccaaaaaaaaaccaagaacuuuauucuacuggugcuuucuuagccaccgucacaauguugucacuucucacuuuacgcagcuggcuccacugaggguuugugagcuggucuccagugauggcacauaguucuuauuaccuuacaugguaacacuaccugaucauggcguucuggaaauugugacaauauguacugaucuuuuguuggugcaacuaacaauacaaaaguugcugcucuguaaauguaugcuucaguuucauuaguuuauuuggaauaauuaccccuaacauuguuuuuuuuuuuuuuuuuuuuucgagacaaggucuuggucugucaugcaggcuggagugcaguaacgcuaucacagcucacugcagccuccaccucccugucucaagagauuccccugccucagccuucugaguagcugggaccacaggcacaugacaccaugcuuggcuaacuuguauuuuguauuuuauuuuuguuugaccagacgaguuuuaaauacaaguuuuguaguuuuuguagaggugcccacacuggucucaaacuccugaguucaaguaguucaucugccucggccucccaaaguacugggauuacaggcaugaaccacugcgcccagcuacuuguaauguuuguagguaguuuaauagcgaaaguagguacauuccagugauaagacauucaguuuauuauuuuuuccuuuuuccuuuuuuuuuucuuuagggguaaguguacuggagagaguugguuauacauucuaggaaucucaaagguaaaguaugauuuaaaaauauuuuuuuaaaauaauuuuuuuaaguuugccuacagcuacaaauuuuuaaguuuuauguaaguggaauccuuuuuuuuugagacauauucucacucugucaucagagugcaguggugccaucauagcucacugaagccucaaacuccuggccugaacagggcgauccuccugccucagccuccugaguagcugggaauacaggagcaugcuacuuugcccagcugaguccuucuuauuugcuuuggacagacuaguacuugaaaaaauaauuuucaaauguuuaguugaguguuuuuuuuuccuucaacuuuugggaggcuguuuuuuugucauacauauuuccuucucuggaguuaauuuucuguuaagcaagaaggauuucaguuauguauuuuuuacacuugaacuaccuaaacuugugcuugcauagaauuauuuucaacuuuaacuccuuaaguaaucguuuucaggauauuuuaguuuuuguucuuguuuuuuuuuugaguuggagucucguucugucgcccaggcuggagugcagccucccgaguagcugggauuacaggugcuaccaugcccugcucauuuuuuauauuuuuaguagagacaagguuucaccauguuggcuaggcuggucuugaacucgugaccucuggugauccacccgcugugcugggauuacaggcaugagcuaccaugccuggcuuuuuuuuuuuuuuuuuuuuuuuuggaggcagagucucacucuguugcccaggcuggaguacaguggcaugaucucugcuuacugcaaccucugccuuccagguucaagugauucuccugccucagccucccugguagcugggauuacagguggcugccaccauguccagcuaauuuuuuuuauuuuuaguagagacgggguuuuaccauguuggccaggcuggucuugaacuccuacucucaagugaucugcccgccuuggccucuggaagugcugggauaggugcaagccaccaugcuugggcagauguuuuaauuuguaaaggaacuaggaccaauaauuuuuuuuacuguauacacauuuuagaauaaguuuuaggcaccuagcuguuugauuucugguaacuaagauuauagucaguuaaacuuuacugcuggccaggcaugguggcucaugccuguaauccuagcacuuugggaggccgaggugggcgaaucacuugaggucaggaguuugaguccagccuggccaacauggagaaaccccgucucuacuaaaaauacaaaaauuagcugggugugguggcgcacaccuguagucccagcuacuugggaggcugaggcaggagaauugcuugaaccugggaggcagaguuugcagugagcugagauugugccccugcacuccagccugggugacagagcuagagucugucucaaaaaaacaaaaacaaaagaaucuuuccuucuuuaugcuuaccuauauuuucuaacuuuucuggauauguuucaauauguauuaugauuuuguaaaaaauuucagaagggugguuauuuuuuguuucaaagcugaaacccaguuuaaaacucuaauacaguggucagaggaaguggugaauaucuugauacuucaguuucuaauauuuaauauauauauaagugaaugguugaggccgggcgcaguggcucacgccuguaaucccagcacuuugggaggcugaggcggguggaucaccugaggucaggaguuugagaccagcgugaccaacauggagaaaccccguuucugguaaaaguacaaaauuagccagguguaguggcacaugccuguaaucccagcuacucaggaggcugaggcaggagaaucgcuugaaccugggagugggaggcagagguugcgaugagccgagaucgugccauugcacuccagccugggcaacaagagcgaaacuccaucucaaaaaauaaaaaagaaugguugagugaaggacuuaacagacuacauagggguuucuauaaauuuuuuuuuuugaguuugaagaugaaccagauaccugauaaaugcuugugucugaaagaaaaguauaaaaguauaauuuaauucuaauacucuuuguguguguguguggccaaaauuauguuuuuguauaccuuuuuuuguaagccauuuaaaaaauacaggcuuuaaacauacucuuggaaguguauaaacagauacugugucugcuuguuaaucuaagaugucuguccgaaaaggugcuugcuuggucuugcucccuuauaaugccgguacacccacgcuggagacuaguagaaagcauguugucagacguguuuaguucuuuuuuuuuuccuuaccaacuuauguguuguuauuuauuuucugugaaucuuuggaaggauuaaacccacgugguuuuucuaucagaaaaaagacaaaacaaaauuagucaaggcauauuagucuuuuuccuuuuuccuaggaucagaguguaguaauauccugccaaucuuaauuuuaacaaauacuuauauuuuucggacuuagauuaacuuauuuuuuuauuuuuuauuuuuugagacagacucuugcucucuugcccaggcuggaguccagugaccugaucuuggcucacugcaaccucugccucccggguucaagcgauucuccugccucagccucccgaguagcugggauuacaggcacccaccaccacaccuggcuaauuuuuguauuuuuaguagagacguuguuucaccguguuagccgugcuagucuugaacuccugaccucaagugauccaccugccucgagugcugggcuuacccaccgcaccuggcccuccuuucacuuucuaaugcagaauucuaaucuaucccuuuguuuuacuuguguuauuuauauuuacuuacuuccauuaucuuggcuacuuuacaaaaaugcauuaggucuaaaaguuauaacauuuaaggcugaauugccaaauguuuaaaaauauagauuucuguaccagaaaaacuuuggaaaaacuacauuaauucuuuuuuuuugagauggaguuucacucugucucccaggcugaagugcaguggcaugaucucggcucacuucaaccucugcugccugaguucaagcgauucuccugccucagccaccugaguagcugggauuacaggcgccugccacccugccuggcuaauuucuguauuuuuaauagagaagggguuucaccaucuuggccaggcuggucuugaacuccugaccucgugauccacccgccucggccucccaaagugcugggauuacaggcgugaaccuccgcgcccagccaaaaauacauuaauucuuuaugcagagaugauuucaucuuuacuaacuccuuuggaacccgaggaaucuaacuuugauuccucuaaaacaaaguccuuuuaauaucuaacuauugcagguugugauaggccaacuuggauucugacaaaguaacuucuuauuaaggccucucuaugaauaaguuucuguuccuuaguuugaaaacauuaccaugauaauaguaaugguaauagcugacauuuauuggauucguucucuuuuucuuaggcauuaugcacauuauuugaaauuaugaauuccauaauucuauagagacaucuuaaugauugauuucuuuuugaaaaccuauuuuaacaaacuggauaauauuguugacuaggagguuucuuuuggguagaaccacaguaaugaugguaacgcuguuuggaguuugauaaugaauauguauacuuuuuaugaaacaccacucugguaaaugugaugaaauguacaugacagcccucuguuuacauucuuuaauuuugaggguggacucuuggaucuugaaacaggcuuuaccaguauuacagcucagcaaaaaugcagcugaggcucaaaguucucuuucugcuccuucauucgguuguuuuguguacccgcuguauuuauggaagcagcuuaguuuauccagggaaccaaagcuuccucaaagcauggggguugugaaaacuuccucuaaguuuacaguguucuaaggauuucagauuguucuuaguuacuugguuuaucuugaucuccagauuuauauauaucuuacugaguugucauuagagauuguuaaauuagauuuggugguauuuaauuucacacucauacaauuaauggagguuuaucuaauugugaaaguuccagauaggcacccauuucuagauugguuggauacuucuauguuauuugcuuccucugggaaauaaugggguauaauuuuaaugccauugcaguucugcuuauuagugugcagcuuguuauuguugaacuaugucuuauuuugaaguuuaguacuaugcccuuuuuguggcacuuaaaaauuuucucauuuuuacagaauuugucuugucuugaguguuucaguaauugcacuaguaggucuucagcagggaagagcuuggugccaaauuuuuauuguuuuucuuuucuuuuuuuuuuuuuuuaauucuucagcuaagacugcagaagaggugauuuauuguauggauguuauacuuggccacaaggaaacacagaaauagugcagaaugucacagguccagggcagaggaccaacaugggcaguuuuuguuaugagcgaggugggucucaggugaucggugaucagagggcgaugaaguucuagauccauugagacaagcucuagacaguagcaugcagucccacaacuuguaccagcauccccagcaucuggcauuccauguuucugcuccuguggccuccacggugcaacaagcuagugguuuucuuggaccucugccuuaucuuucuucuuuugcguauucacuucuuccuccacuuggcugucauggcacagagguuuccaagaaaauggcgcuaaggcugagagcucuuuucuuuuuuuuaaaaaaaaauuacuaaaguaauaaauauucuuuguuuuuuauuuuuauuuuuauuuauuuauuauuauuauuaucuugagauggaguagugcuccgucacuugagcucaggagccugcacuuggccaggcuggagugcaguggcgcaaucuuggcucacugcaaccucugccuccccgguucaagcgauuuuccugccucagccucccaaguagcugugauuacaggcuaacgccaccacguccagcuaauuuuuguauuuuuaguagagacgggguuucaccauguuggcgagccuggucuugaacuccugaccuaaagugaucugccggccucggccucucaaaguguugggauuacaggugugagccacuauccugggccuguucuuuguuuuuuuaaaaaaaacuaaaaacaauggaaaaaaaaugaaggguuuucuuucucacauaugcaugcacuuaccauuugauuugaauuauuuucccccaaaauuauaguuaacauuauauauaauaagcgcuuuguacuuuuuuuuuuuuuuuuugaguuggaguuucacucuuguugcccaggcuggagugcaauggugcaaucucggcucacugcaaccucugccucccggguucaagcgauucuccugccucagccucccgaguagcugggauuacaggcaugcaccaccacgccuggcuaauuuuguauuuuuaguagagacggguuucucuguguuggucaggcuggucuugaacccccaaccuaagguaauccacccaccuuggccucccaaagugcugggauuauaggcgugagccacugugccuggccgcuuuauucauuuuaauucauuuaacuuucaaaagccugugaacauacccuaugaaguagguucugguguauguguuugcagaugaagaaacugagucauagagaaguaaaguaacuagccaaagauugcacagcuagggaguggcaaaccugagacuugagcccagguacucuugcuccagcguuuaacuccuagacugccuccgggaucuuaggcauauuguucugcaguuugcucuuuucgcuuaaugaugucugauggacaucuuucuuuuuuguuguuguugcuguuuuucguuuuaauuuuuuucaauuuuuaaauuaaaaaaaauuuuucuuugagacaucuugucacccaggcuggaguguaauagugugaucucggcucacugcaaccucugccuccuggcuucaagugauucuucugccucagccucccaaguaccuuggauuacaggcgccugccaccaugcccggauaauuuuuauauuuuuaguagagacgggguuucacuauguuggccaggcuggucuugaacuccugaccucaggugauccacccaccugggccucccaaaaugcugggauuacaggcguaagccaccacacccaaccuaaauuguuuauuuuuuugauggacaucuuucuacaugguuugaguguaccauuacuuauuuaacuuaaugccuuucaaacuuaaucuuguugccaggcauggugacucaggccuauagucccagcacuuugggagaccaagguggguggauugcuugagcccaggaguuugaggccagccuggccaacauggcaaaacccuguuucugcaaaaaauacaagaguuaguugggcaugguggcacauacguguagucccagcugcucggugggaggcugaggagguaggacgaucaccugaacccgaggagguugagguugcaguaagcugugaucuagccacugcacucuagccugggggacagagcgagacucuuucucaaaagaaaaaauaaaaagacaaucuuguuuaacauugccaauuucauuaguaaugauuucaaguuauauaaaaagucaagguuuuugaauuggaauagucauggaacauuaguauuuccuaaguaaugcauauuagcuauucauguguauugauauugucucaguugaguuguauaauaaaauccgagcuuaacccacaaaccauuuauuacgaaugaguuuaauuauuuuuguaguuauucugucuucuuuagcucuggaaaauuaguguauugaggguaaaaucaauaaucuguuuggauuucguuuacuuuugacaucuuccagaauucuguugucgucacaagaagucuguuguguugauuugaacugugaauacuaucugacauuauauuaccuguauuuucaaaguaauuugccuuucaauuccuuguacuugugccaggcagcguuaguugguaguaagcccauucuuuuuucuacaauguuucacucuugcuucaaauauaccaacuauucuguaggccagaguucaaaacaaaacaaaacauacgaaaaaccaaauaauacugacuaaagauacuaaaaugucacuuguuucaaauuuuuucucauuuaauauuuacugccuaauuuugaagaaauaucuuuccagucuuuaauaaaaauguuacaccuguaaucccagcacuuugggauuacacaggcggaucacuugagcucaggaguuugagaccagccugagcaacauggugaaaccccaucucuacaaaaaauacaaaaauuagcugagcgugaugguguacgccuguagucccagcuacucaguacgcugaggcaggaggauugcuugagccugggaggcggagguugcagugagccgagagugcaccauugcacucuagccuggagaacagagugagacccugucucaaaacacacaaagaaauuucagauaugcucauuggaaugugagaagauauuuucaacuaaauuuaguugcagguuuuuuuguuuuguuuugagacagggccucgcucuugccugagaugaagagcagugggaccaucauagcucacagcagccucaaacucaugggcucaagcaguguucucauaucagccuccugagaaccuaggacuacaggugcaugccaccacgccuagcuaauuuucuaaauuuuuuuuucguaaauauggagucucccuauguuguccaggcuggucuuuugaauuccuggccucaggcgauccucccacuuuggccucccaaagugcugugauuauaggugugagcuaccaugcccagccuuaauuacaguuuucuaauaauguuuucuaauaauuuuggaacuaaguagcagcuugacugauuccuaauuggagcauugcucuuuaucagucagucauuuuuaaaauuaauuauaaauucaaacauucauucagcaccugcuaaaugccagucacugugcuaaguaauggggauaccggcaugacaauguccuuacuucagggaacuuggaguuuuguuguaaaaacaacauuuuguugcagacaauguaaagugcugugggagagaugaacccaaaugaggaaauaucugagucaagggacuguacuugguuugagcuacacccugauaccuaagugugauuuaacuggccaaugaaaggaguggacacagggcucuaaaaacagaauguauagaaguguaguuugugaaaacuaguagaaauugucacuggaaagucauguaucccuaauauauuguguauccuucaguaucccuaagguaauaugcccuccaucaagaucagaccuugccugucuuguucaucagugcuuagcacauaggagguauuuaauaauuaacaucuguugaaugaaugagugaaggaaguguguuaaguaaagcauacuaugcuugucuguuuuuuuuuuuuuuuugagacagggucuugcuuugucuccuaggcuggaguacagcuuacugcagccuugaccucccaggcucaagcaguccuccuaccucagccucccaaguaccugggacuucaggugcaugccacacccagcuaauuuuuaaauuuuuuuauagaaacagagucucacuauguugcccaggcuggucuugaacuacuguacucaagugauccuccugccucagccucccgaaguguugggauuauaagcgugagccacuguaccugaacuugucaauuuuuuggaacgagaaugaacccauuauuuuaguauauuauuaaugccugacaauuuuuagaucauguaauuucacaaaacauaaaaugagcaagaaacugcuccugcacugaagggaguaaguucuguaaggagaaguaaauguaaauaaaucgucgugauucaacaugauauuuguaaaaaauauuugcaagagacacucaucuauuguauggauugguuaagucccugaaaagugguggauaauuuaaaaugcucacauuaggcugggugcgguggcuuauggcuguaaucccagcacuuugggaggccuaguccggcggaucaccugaggccaggaguuggagaccagucuggccaacauggugaaacccugucucuacuaaaaauacaaaaauuagccggacgugguagugggugcugguaaucccagguacucgggaggcugaggcaggagaaucacuugaaccugggaggcggagguugcagugagccaagaucaugccacuacccuccagccugggcgacagagcgagacuccaucucaaaacaaauaaauaaguaaaauguucacauuaggccaggcaaggugguucaugccuguaaucccagcacuuugggaggccgaggcagaaagauugcuugagcucaggaguucgagaccagucugggcaauguggugaaaccucaucucuacacaaaauacaaacauuagcuggaugcgguaguacaugcuuguagucccagcugcuugggaggcugaagugggaagauugcuugagcuugggacaucaaggcugcagugagccauuaucaugccacaguacuccagccugggugacagagcaagaugcugucuggaaaaaaaaaaacaacaaaacucacauuaaaauuauuugauugauaaaaugcaagggauaacauuauagcaggucauuuuaaaaauggcagucauggcugggcacagugacucaugccuguaauccuagcacuuugggaggcccaggagggcagaucaucugaggucaggaguuugagaccagccuggccaauauggugaaaccccguaucuacugaaaauacagaaauuagccaggugugguggugggugccuguaaucccagcuacucaagaggcugaagcaggguaaucacuggaaccugggaggcagaggcugcagugagccgagaucacaccacugcacucgucugggagacagaacaagacuccaucuuaaaaaaaaaaaaaaaagacagucauguacucuuuugcccuauuacauuaaugugaauauuacauaaauacuaugaggaaggccggccgcaauggcucacgccuguaaucgcagcaccuugggaagcugaggcagguggaucacuugaggucaggaguuugagaacagccuggccaaauggugaaacccugucucuacaaaaauacaaaaaaauuaucugggugugguggcacacgccuguaaucccagcuacuauggaggcugagacaggagaaucacuugaacccaggaggcggagguugcagugagccgagaucgugccauuguacuccagccuaggcgacagagugagacuucaucucaaaaaaaaaaaaaaaaauuaaaaaucaaaaauaaaaaaaaaacacugaggaaaaguaugugcacaauaaaaaaaaauaguucugccaaaguguaggcaucgguauauaaaaaucuuucccauacauaaucuucagauaacaucaugguuuuucccaaaugugcuuacuauuugaacuauuauuuauucagugacuuuuuuuuuuuuuugauacggagucuuggugcgauguucaggcuggaguacaauggcgagaucuuggcucccugcaaccuaugcuuccugaguucaagcgauucuucugccucagccuccugaguaguugggauuacagguacgcaccaccaugccuggcucauuuuuguauuuuuaguagagauggggguuucaccauguuggccaggcuggucuugaacucccgacgucaggugauccacucaaccucggccucccaaagugcugggauuacaggcgugagccgcugcgcuggccaaaacauaguuauuacaacuauuucaggaauguuauauagaauaaaugagaagagccgggcacaguggcucacgccuguaaucccagcacuuugggacuccaaggcggguggcucaccugaggucaggaguucaagaccagccugaccaacauggagaaaccccgucuccacuaaaaauacaaaaucagucaggcaugguggugcaugccuguaaucccagcuacuugggaggcugaggcaggagaaucgcuugaacccaggaggcggagguuguggugagccgagauugcgccauugcgcuccagcuugggcaacaagagcaaaaguccaucucaaaaaaaaaaaaaaaaaaaaaaaagaauaaaugagaccauccaugaaaagcccguaguuggugucuagcaccuggcaggccugaaaugugugguaguuauuacuguuuuuauuuccuaagcacccuuauucuuuacugcugaucaguuaaaacucuucaagcucaacuguuacuacuacuuuuuuuuuuuuuuuuuugagucagagucucacuguguuguccagacuggagugcaguggcgcaaucuuggcucacugcaaacuccgccuccuggguucacgccauucucccaccucagccucucgagugacugggauuacaugcgccugccaccacgcccagcuaauuuuuuguauuuuuaguagagaugggguuucacuguguuagccaggauggugucaaucuccugaccuugugauccgccugucucggccuuccaaagugcugggauuacaggcgugagucaacgugcccagccaacuguuacuacuucuaauaaccuaaaaaaagauuugcuauuagguggaagucaauauaaaaaguagcuuuucuuaaacuauucuggcuggaaaauauauuuccuuugcuucgauugaucagaaauuagugcaaauguaauauagcuauggaaauuuuguuucaugaaguuucuguguuucauuugugaucacagugaacugaaagaaaaaauauuuuuagugugauaaacaccauaauguguuaacagauguuaauggguucuggaaugucauaugggagccguucccuuuucuaggccguggugguuagagauugugauaauuacaguguucgaauacugcucucaaguuuguauaauuuuuuuuacugaaaaaaguugcuaacucagauacuugaauuuagaaguauauuauuuguuuaauuuaaaagguagacuuaaauuuuuuuuauuuuuguagagaacagucuugcuauauuguucaggcugguuaugaacuccugaccucaagcaguccuccugccucagccucccaaagugcugggaucacaggugggagccacugugcccaaccuagaguuuauuuuuuagaucaauuuuagcuuuacagaaaaauugagaugaugguacagagacagcaucaagaucaauucuucauauuauuaacaucuuauauuagcauaguacauuuguuucaauuaugacaguuuguuacaauauugugaacuaauauugauacauuaucauuaaauaagguucauacuuuguuccaauuuccucaguuuuuaccuaguguccuuuuucuguucaggaucccauucagcauacuauauuacauuuagauguuauuguguaauuuuuaauuagauugucuugaauuagauacauuaauguauguguguggaugaagcacacuauauuacucauaaugcucuuaaagauaauuggcuuuuuuuuuuugauggagucucgcucugucacccaggcuggaauacaguggugggaucugggcucacugcaaucucugccuccucgcugguucaagcgauucuucugccucagccucccaaguagcugggauuacaauaggcaccugccgcuacaccuggcuaauuuuuaaaaaauuuuaauuuuaguggcucaugccuguaaucccaacacuuuggaacgccaaggugggcggaucacaagaucaagagauugagaccauccuggccaacguggugaaaccccgucucuaccaaaaauacaaaaauuagcugggcauaguggcguaugccuguagucccagcuacucgggaggcugaggcaggagaaucacuugaacccaggaggcggagguugcagugagcugagaucacgccacugcacuccagccuggcaacagagcgagacuccgucucaaaaaauaaaauaaauaaaaaguuuuaauuuuuauuuuuaguaaaaacgggguuucaccauguuggucaggcuggucuugaacuccuggccucaagcaauccaccugccuuggcgucccaaaguggugggauuacaagcaugagccaccacuccuggccugauagucggcuuuuacuuuuacuuuuaguuaagucuuuuacacauguagguuucauaauguuagcagguagucuguuuuaccucuuuaguuacgacuuugauauuucccacuuacuuugaugaaaaggucauuuuggucaauuuuguuaugugauggauauggcgucuugucucauugccccuaggaaaugauaaaaaguuacccuaccuuuuaauugauaagaauaaugauauccuacacucugcagcaauuuauacuuuaguuaucuuacaguauaccaucugagauagauaagggcaucaucccaauuuugaagaugaggaaauaaacuuuggugaagugccuagccacaagucacguugccaauaggugucagaguucagucuuaaauucaucagaucuucugauuccaguuuuaguauucuuucgccuauguuaauuaaaauagucuuuguagaaauuaagaaaguaggaaauggucuuuuuuuaaugacuuucuaacaacauuauuucugaaauuauuggguuaauaaagaggugauucauuuguuuaccugaauucuagcuguuacuuaaaguuuauuuuuauuuuuauuuauuuauuuauuuauuuauuuauuuauuuauuuauuuauguuugagagggaguuuugcucugucgcccaggcuggagugcaauggcgugaucuuggcucaccacagccuccgccucccagguucaagcaauucuccugccucagccuucugaguagcugggauuacaggcaugcaccaccacacccagcuaauuuuguauuuuuagucgagacuggguuucaccauguuggucaggcuggucucgaacuccugaccucagaugauccauccaccucggccucccaaagugcugggauuacaggugugagccaccgcacccagcuuauuauuuuuauuuuuuagacagggucgugcuguguugcccaggcugaagugcaguguggcgcagucuuggcucacugcagccuugacauccccggcucaagugauccucugccuucagccucuggaauagcugacaccacaggcguacaucccuccaccuggcuauuuauuauuauuauuauuuguagagauggggucucccuguauugaccaggcuggucccaaacuccugggcucaagugguccucucaccuuggccuccugaaguguugggauuauaggucugagacaccacaccuggccuuacuuugaguuuugaauugcuagauacauaucauuaauuugggauaccauuaauuagaaauucucaauagcaaaaacuugaaaugugauucuuaucccauaaaaaguuggaaauauuuuuuuuccuaccuuagagaccuucucuuuagucagaggaguucauuuagauauaguuguuaacauuuguaauauauguauuuuccuugaaacuuuuuuuuuucuuuuuuugauauggagucucgcucugucacccaggcuggagugcaguggcaugaucucagcucacugcagccucugccucccggguucaagugauucuccugcgucaggcuucccaaguagccaggacuacagguacgugccaccaugccuggcuaauuuuuuugaauuuuuaguagagaugggguuuugccauguuggccaggcuggucuugaacuccugaccucaagugauccacccgccuuggccucccaaagugcugggauuacaggcgugagucacugagccccgccagaacuuuuuuuuuuuuuuuuuuuuugagauggagacucacucuugacacccaggccgaagugcaguggugcgaucucagcuugcuggaacuuccaccucccagguucaagcaguucuccugccuuaaccuccugaguagcugguggugcacaccaccaugcccagcuaauuuuuuguauuuuuaguagagaugggauuucaccaugcuggccaggguggucucgaucuccugaccucaugauccgcucaccucggcuucccaaagugcugggauuacaggcgugagccaccgcgccuggcaacuuuuuuuuuuuuuaaagagacagggucucguuauguugcccaggcuguucucgaacuccuggccucaagugauccucccuccucagccucccaaagcacugacugacaggcuugagacaccacaccucuggccuccuucagaauuuuaaugugcagucauggguccuuaaugagagggauacauucugagaaaugugucauuaggcagugucauuguguaaacauuauagaguguguuuacacaaacuuagguggcauaguccccuacucuccuaagcuauauggcauagccuauuuucuucugggcuacaaaccuguauagcauguuacuguacugaauacucuaggcaauuauaacauaauaguaaguguuuguguaucuaaacaagaaaaauaguacaguaagaauauuguauaaaagcuccauuauaaucucaugggcccacuggaguuucaccaugguugacugaaaggucuuuauguggcgcaugacuguauuuuguaauucauaaauuucaccuuaucggacagugccuccucucugugcuuugcguuagaguagauaugcuugcuuaucagggguuggcagaguuuuucugugaagggcuagauagcagauauuuuggacuugugggccacauggacuguggaggacucuggcaacuauucagcucugccauuguggcaugaaaccagccauagauaauauauaaacaagugaguauggcuucauuccaauacaacuuuuauuuauacaaacaggcagcaggcuaaauaugaccugaaagucauauuuugcuggccccuccucuauaccauuauggaaagauauagaaauccagugugcuucacucuugccacuaaaaucuccuuacugugcucucagugauaaguguuaaaacaugaguugaaaaacuugaacuucucaaaaucugauuaauaugcaugggcauaaucuauuucuuuuuucuuuguuuuuuuuuuuuuuuuuuuuuugagguagagucuuccucuguuguccaagcuggaguguaguggcccgaucucggguucaagugauucuccugccuucuggguucaagugguucucuugccucagccucccgaauagcugggauuacaggcauccgccaccacacccggcuaauuuuucuauuuuugguuagagaugguguuuugccauguuggccaggcuggucucaaacuccugaccucaggugauccaccugccucggccucccaaagugcugggauuacaggugugagccacugcaccuggcccaucuguuucguuuuuauagaaaauaugguaaugcuguugaacuuauuuuauuuuauuuauuuuuugagacagggucucauucuguuggucaggcuggagugcaguggcucagucuuggcuuacugcagcauugaccucccugcucaagugauccuccuacuucagccuccugaguagcugagacuacaggcaugcgcgaucacacucagauaauuuucguguucucuguagagacaggguuuugccauguuucccaggcuggucucaaaauccugggcucaagugauccaccugcuuuggccugccaaagugccggguccauagaugugagccacuucaccuggccauauauauauuaauauacguguuuugagauggaccuugcucugucacccaggcuggagugcaguggcgcaauuauagcucacugcaacgucugccuccugggcucaaucaauccuuccacuucagccucccaagcagcugagauaacagcugugcgccaccaugcccagcaaauuuuuuuauuguuguuguuuucuuuguuuuuuauuuauuuuuugauagagauggaguuuugccauguugccuaggcugaucuuaaacucuugggcuuaagcaaucugccugccuuggcuucccaaagugcuggaauuacaggcaugaaccaccacuccuggccagcucuugaccuuacagguuuucaaagucuaguuuuuuuuuuuuacuacagagaaacuaacuuagaaacugcucgugaauuucaggaaaaaauuauauuuguuauuuuagguaugccuaauguuaauuuaaaaauucuuugauuuuacuuauguucuuauucauagagcaacuggugacaaugcaaauauuagcaaagauaaaauauugagagcugcuuauguuuggccaugguuugggggcuggggauacauaggccuaagagaugcccuaugccuuugaggacacggaaagacaggauauagacauuaaagaugaaaguacaaaaaaugguuucaaauuggugguaucaaaaguuucaccgggcucgguggcucacgccuguaauccuagcacuuugggaggcugaggugggugaaucaccugaggucaugaguuugagaccagccuggccaacguggcaaaaccccgucucuacuaaaaauacaaaaauuagcuggacguggucgggggugccuguaauccuagcuacucgggaggcugaggcaggacaaucgcuugaacccaggaggcagaaguugcagugagcugagauugugccauugcacuccagucugggcaacaaaagugaaacuccauuucaaaaaaaaaaucagugugucaggaguucagaguugagauuuauugccaugugcauacuguaugguuggaaaggaagguuuuauugagucuggucuuggaaauuggaacaucugcaugagagggggccagauauaaauauagaaacaugacgaugaacucaaaguaaaaaugggccgggcgcaguggcucaugccuguaauccuagcauuuugggaggcaaaggcagguggaucacuugagcucaggaguuugagaccagcuucuacaacauggcuaaacuuugucucuacaaaaaaugcaaaaauuagcugggcaugguggugcaugccuguagagggaggauugcuugagcuggggaggcacagagccaugauggugccgcugcacuccagccagccuggcgacagagcaagaccuugucucaaaaauaaaaaauaaaagaaaaaugggaaggccaguuuggcaggagcaggaaaguuuauguagggaaauagcauaaauuaggauuggagggguggauugaagcaagauugugcuuugaauauuaaaccaaggaguuuggaaauuaucucugagggguaaagaauaacugaaaauugugagcaacuuuguaccuuuauuccuacuuuaagucacuuauuuauuuacuuauuuuauuuuauuuuauaucuuuugagauggagucuugcucugucaccuaggcuggagugcauuggugugaucacggcucacugcaaccucugccucccagguucaaacaauucuccugccucagccucuugaguagcugggauuacagguaugugccaccauguccagcuaguuuuuguauuuuuaguagagacggguuucaccauguugacgaggcuggucucgaacuccugaccucaagugauccgccugucuuggccucccaaaaugcuggaauuacaugugugagccaccguuucuggccuacuuuaagucuuauaugaaacuuccagauguuguuuuuaauguuuuuggugcaguguguuuauuuuaguuaauuuuuuuuuuuuuuuuugagacggagucucacucugucgcccaggcuggagugcaguggcgcgaucucggcucacugcaaccuccucuuccuggguucaagcgauucuccugccucagccuccugaguaacuggauuuauaggcgcgcaccaccacaccuggcucauuuuuguauuguuaguagagaugggguuucacaaugcuggucaggcuggucucaaacuccugacuucaugauccacccgccucagccucccaaagugcugggauuacaggcuugagccacugcacccggccuuguuaauauuuaaugacaauuuauauuguucacaucuucuuuucccauccaccaaaggacuacauccuuguucuguguuauuucuaccuuuuguuuugaagccucuaauaagaauaugucauugaaauaccuccuuuucauuuuuuuaagagacagaggucucacuauguuccccaggguggucuugaauucuugggcucacaugauccucccgccucaacuucccaaagugcugggauuacaagcgugagccaccaggcccggcccauucuuacauucauuuagcaaguacauacugaagucuugugaugugccaggcucucuuauggucagugaugacugcaagggaaccaauuaggcaaaaaucucuuuucuuauggaguucagauuuucuuacagagauggucaauacaugagauaaauaaguaaaauguauaguaugcucagugcuaaggagaaaaaacaaugcagggaaaguguguggcauaguagaggcugaaaucuuacauaggguggccaaacucacugaagaacaugauacuuugguaaagaccuaaaggaaguaagaggucugggauggugagcaagugcaaagguacuaagguagaagugugucuggcacgucugacaauacggcuggagcagaaugaaugagggagagaguaauagagugacuauauguucuuguuuaugucuguugucuugaaauuauugauacugccuacuuuuacucccaauagaguccagauauugagugaugaauuauauggucuccugguaauaggaggugagguaggagagguaagguggugaggagcagauaauggagagcugagaugaacauuugcaggauuuugaacacgggagcccuaugauuugacucaugcuuuacaggcuuacucuggcugcuguguucauaguagacuaggagcaaagacugaagcauaguuaguuaggaaacuauugcaguaauccaggugagauauguggugcuuugggacaggaugguagcaguaaaaguguugagaaguagauagauucuggauguguuuugaagauacacaucaggauuugauauggauuggguauaggauuuacgagaaagaagggagucaagaaugauagaguuuuuggccugagcaguuggaaggauggaauugccauugauugagaugggaaaggccgucuuuuuguggggagggaagcagguguuuuuuaggggaagaugaggucaguuuuggacauguuuuaauuuugagaugcguauuagacaacccaagggagauguugacuaggcaguugcauauauggauuuggcauucaggggaaagggacagacuggagauauuaauuugggaacuguuaucacuuugaugguacuuaaaaaugauugagacugaaugagauugccuaggaagugaguuuaguuagaaaagaaaaaggucugaagauugagccuugggguaauuuauccaguguuucaaaaucagggagauaagggaacuaacaaaggagauagacugaguggagaaggacaggagcaaacccaugagaauguggguguccuagaagucaaagaaaguuucuuaaagaggagagaggucaaccaucucaaaugcuucuguuaggucaggaagaggaggaaugauauuuaccauggauuuaguagcauguuuauuguugaacacuaguaguuuugaguaguggagcaaaacugaugagugcggguuuaggaguggaugagaggcaagacaccucuuugaaagaguuuuguuguaaagggaaggagaaaaaaugguauggaagcugagaggggaaagugaaguagagagauuucuuuuuguauaagaugaaaaaugacagcaagucuauauguuggugaaaaugauccaguagagagaaaaauaugaacguggggaaaggguggcuggauuucuuuagcauugcuuuuaaguaaauaugaagggaggaagccaguguucaagugaggauuggcaaugaccaguagaaaagcaguucauucaaaguaaaagcaaguagaaagagcauagauguagauaagucaauguaaguaugauacugugagcuuguggaaagucucuuucucauugcuucauuuuucucaaugaagacaaaagcgcggagccgaauaaggauaagggaagagguguuggaaguuugagaagaggaaaugauaugaauuagcugccuuggagagugggacagugggggauggauugggaaaauacagugugcaugugucacaacaguaagcguccaucuaggguuugugauaaugggguuaaagugauaauagccagacaugguggcucacacuuguaaucccagccaaagccaggaauaucacuugagcccaggaguuugagaccagccuagguaacacaaucagaccccaucucuacaaaauaaaaauuuagcuggaugugguggugcaugccuguggucccagccucuggaugcugagguagaaggauugcuugagcuggggaggucaaggcugcauugagccgugaucacauuacuacacuccagccugggcaacagcaagacccugucucaaaguaaaaaaaaaaaaaaaaaagacugggcauaauggcuucaucccagaacuuugggaggccaaggcaagaggcucacuugagcccaggaguuugggaccagccuaggcaacauagggagaccucaucucucaagaaaaauagaagaagauagcugggugugauggcacacaccuguagucccagcuacucaggaggcugaggagggaggauugcuugagccugggagguuguggcuacagugcugugaucaugccacugcacuccagugugggcaucagagaaagaccuuaucuaagggaagaaaaaaaaggauacuagcguugucauguguguguguuuccccagcuacauguguggaugaggcagaacauuugauuuaacugggauugcgguuuagucuagugaggagggcagguugagggugcauucaaggaagugauuauaaugauuggccaugggauuuacacuagcuagguaaggagggaagcaaaaacaggaagcaggugaagguuaguuaaaaaggugguaagaucaauggcuugaaagucuuguuguggggucauaugauuguuggaguugugugguguuggagaaguaagaaaagacuguaguaugugccugcaagagagggaggaugauaggugguaugguuuaaugaaaugagauucaaagcugggguuuuuaaugguggagggaggaagaguggugugaaaguggacccauagugugaaggauaugggagagaaaacagccuuaccuaagaggucuauagaggaagccauguucccaugggaaagccagauuuuaguuaaggcaggaagguaaagagaaccucuccagaaaagguucaaguuacagauuuucugauaauugaacuuguguuccaggagccacugugaaaaggauugaagagguaaggaggagcaggaggugagauaggaagaggugauguacaaagcuauccaggugccaggcacggugacucacaccuguuaucccagcacuuuaggaggcugaggugggaggauugcuugagcccaagaguuugagaccugagcaacauggugagacucugucuccacaaaaagcaaauuuuaaaaauuagcuggcuguagugucauauaacuacagcuacucgggaggcggaggugagaggauugcuugagucugggagauagaggcugcagugagccaugauaccgccacugcacuccgcuuggaugacagcaagacccugucucagcaaacaaaacaaaaccauaagacaacaacaacaaaagaaacacaaagcuguuuagagauuugguuuugcaggauaaaggaugaccuggaaguucugacuuuauuaugauugacaugaacagaaauaaagggcagacuaaacuaagacuuggugguccaggguagauuuuuuuuuuuuuagacacucuugcccugucacccaggcuggagugcaguguugugaucucagcucacugcaaccucugccucucggguucaagugauuuucuugccucagccuccugaguagcugggauuacaggugugcaccaccaagcccggcuaauuuuuguauuuuuacuagagggauuucaccauguuggccaggcaggucuugaacuccugaccucaagugaucugccugccuuggccucccaaagugcuaggauuacaggcgugaaccaccacgcccggcugguccaggguagauuuugaugggguuggcaguaagggcugagggaauggagaggagaagaucuucuugccaaauacaugcaggauuuucuggggcuuccauuuggcuucugauacuggaaguauggaguauuaauuaaggggagucuuaauugagcacacaggcucuccugacuucugcagauguuuuaauauauucuggcacuauugggaaaucauuaauggcuuucaaaaggaauucuggagggauugggaaggauuauauuaacuguugcuuuggaaauaccaaucugacaguguaggguagguuggagagagaagaaacuugaaguauaggaacauguuaggaaauuuuuccaguugucauggauuuaugauauggaauuugguuauuugcagaacaauucaaaaggaaaggaccaaugugagaguagaacuuggugacagaccuugcugaggagaggaugguuccugaguuuggagucuaggaaccuguuugugccaugacagaaauagaaaagucugaaagaguugcugguuuuagaagggagauugcuaugcucuaggauauguuugaaucuugggugauuggacucuuaggucuccuuucaucauaccuguagugacuuguaauuuccuuguucuuagcuucacaguugacuaagcuuuaugaggacagagauugugucuguuuuguucuguauugucagugccuggcacagugaauacauuucagaaauaauugcugaauuaaaguagagaaauggcuuuuuuuuuuuuugagauagaguuuugcuuguuggccaggcuggagugcauuggugugaucucaguugacucuaaccucugccacccggguucaagcgauucuucugcuucagccucccgaguagcugggaugacaggcagcugccaccaugcccagcuaauuuuauauauauuauauauauauaauauaaaaauauauauauuauauauauaauauaaaaauauauauauuauauauuuauauuaaauauauauuuuuauauuuuauauaaauauauauuuuauguuuuuauaaaauauauacauuuuuauauuauauauaauauaaaauaaaauauauaaaaauuuuuauauuuauauaugaaauauaaaaaaauauauauauaaaaauauauuuuauauauauauauauauauauauauauauauauauauauauauauauauauaaguuuuuguuucuguuuuuguuuuuuugagauggcgucucacucuguugccagucuggagugcagugguacagucucagcucacugcaaccuccgccuccuggcuucaagcgauucuucugcccuagccucccuaguagcugggacuacgggugugcaccaccaugcccagcuaauuuuuguguuuuuaaguggagauaggguuucaccauguuggugaucucaaucucuugaccucgugauccgcccaccucggccucugaaagugcugggauuacaggcgugagccacugugccuggccaauuuuuauauuuuuaguagagacaggguuucacaguguuggucaggcuggucucgaacuccugaucucaagugauccacccgccuccaccucccaaagugcugggauuacaggcaugagccacugcgcccggccaaaauggcuuuuuuuuuuuuuuuuugagacggaaucucgcucugucgcccaggcuggagugcagcgcgugaucucggcucacugcaaccuucaccucuuggguuugagcaauucuucugccucagccuccugaguagcugggacuacaggcgcgugucaccaugcccggcuaauuuuugaauuuuuuaguagagacgggguuucaccauguuggucaggcuggucucaaacuccagacguugugauccaccugccucagccucccaaaaugcugggauuacaggcgugagccaccguacccagcuaaaaugguuuuuuuuuuuuuuuuucaaacuuuccuauggugcugagagaaauggcuuuuaauaaacuuuucaauucugaaauucugucuugauauucagauguuuugcagguagaggaaauaaagaauuuaagcucagucaagagauaagggcuggagacacuauguuuugugugguauuuggguguaaacucaaaugaaguagaugucaucagaagccaaauaaaguucuauaaaaaccaauagguaacaggaacuuuaaggaguaaauuuuuaacagaacuagaaauuaaaguagauguuacugacaaaauguuuagauuaguugauugagagcaagugcuucuuucgagucagacagaacugaguuuguuugaaucuugacuuagcuacauacuagauaugucaauacuuuucucaacugucaaaugaggauaaugagaguacaccugucacaggguuguaagaguucaauuaggaaaaagaauagcagaguacuuggcauaacuccuaaauaaaugcuaguuugauauuaauauuauuauuguuaguuugauggucauguuauuguuacuuuucaggaaacaaacugauuuauuuccuaaugucuguacuuuucuguugucuucaguauuguaaaaauuuuccuacuuuuaguuauucaugucuaaauuuuauuuaagcuauuccuggugacccugaacuccucugauauuauaguggugucuuagaaaagcagaacaaauugguauacuuuuuaaauuaucaaacccuuuuccucaaucuuuuuuuuuuuuuuuuuuuuugggacagggucuggcucugucacccaggcuggagugcagugacacgaucucagcucacuguaaccuccgccucccggguucaagcgauccucccaucugacccucccaaguagcuggcauucagguaugcgccaccacacccggcuaguuuuuguauuuuuaguagagacgggguuucaccauguuggccagacugaucuugaacuccugagcucaagugauccgcccacauuagccucccaaagugcugggauuacagguaugagccaccaugcccagccucauguguuaauuuuuuaacguaaaguuguguuugaagacuuuaauuucuaaauugcaugaauuggcucauauuuugcugugucauugaaaacauuuuauguucucuuucuaucuugaacaauauuucaauuguaauuagguugugagcuccuugagauuaggcgauuuggcuaggcuccagcgaaacucagucauauauuuguucaauuacauugaauuaagcagcaagaaaggcacaguuugagaauuucuaaaguauuuuaccccauuuuuuaauuaugaaaaauuucuaacauacaaaaaccauugaaagauagcacagcgaucauuauauaccuaccaccucaguucaacaguuuauauuuagcuauauuuaaaaaaauucucuuaauguuuuugcugaaccauguacaaguugcagacauccuaacacuuucuuucuuucuuccuuuuuuuuuuuuuuugagagagagucuugcuuuguugcccaggcuggagugcaguggcacaaucucggcccacugcaaccuccaccucccggguucaagcaauucucugccucagccucccaaagugcugggauuacaggugugagccaccacacccggccacauauaguucuuagguuuuuuuuuuuuuuugagauggagucuuacucugucaccagacuggagugcaguggcgcgaucucagcucacugcaaccucugccuccuggguucaagcaaugcucuugccucagucuccugaguaacugggauuacaggcaugugccaccaugcccggcuaauuuuguguuuuugguagagaccagguuucuccaugauggucaggcuggucuugaacuccugaucucaggugauccccuugccuuggccucccaaagugcugggauuacaggugugagccacugugccuggccuuuuuuuuuuuuuucuccuauuuuuuuggagacagucucguucuguugcccaugcuggagugcaguggugcgauuucagcucacugcaaccucugccuccuggguucaaguuucuccugucucagccuccugaguagcugggauugcagccaccugccaccacgccuggugaauuuuuguauuuuuaguagagacagggucucaccauguuggccaggcuggucucaaacuccugaccucaagugagccaccugccuuggccucccagagugcuaggauuacaggugugagccaccgugcccaacccaagaaauuuuuugcuaacuugaugacugucugcugcccagacacacaauauuauguuuuguuaucugugccacagguauuucuguuguugauuuaacauuugugaucuggcacaaauucuagauucaagggcauagcuuaaauaauaaugcuuuaaaauaugugugcuauuuguaucaguuuguuuagcugcuagauaaauaagaguagugagauuucauuuauuccuuuggcaaauauuuauucaacuccugcugugaacuaggccgucuccuagucccugaaauuacagcugugaaugaacaaagcaaacaaggcuuggcccugcugucacuuaccuucuaguggggaagccucacaauaagcacgauuaacaugcagguagauaucuguaauauaaugcuagauaggggcagugcuuuuuuaaaaggccagaagagggauuaggaaguuauauuuucuauuuuagaaggaguugucugagaaggccuuucuaaauacacguuugaguggagagaucugaauggaaugaagauacuggauaaccuuccagacagagaggucagcaaauguggacacuuugagagagggacaugcuuggccuguucaaggaacagcaagaaggcagauguucuggagcugugugaacuagggugggauuguaggagaggaaauuggagaaguagccagggguagaucauauaggaccuucagauuucauucuaucaugaaauaaagccuguggaugguuuccaguaggggaaugaagugaucugacuuaaguuuuguuuuguuuuguuuuuugagauagagucucacucuauugcccaggcuggagugcaguggcaugaucucaccucacugcaaccuccgccuaccagguucaaacaauucuccugccucagccucccgaguagcuaggacuacagguguacaccaccacacccaacuaauuuuuguauuuuuaguagaaacgggguuucaucauguuaaccaggcuggucucgaacuccugaccucaggugauccaccugccuuggccucccaaagugcugggauuacaugcgugagccaccgcgcccggcugugaucugacuuuuuaauucacuaugcuauguagagaacagacucuagaaguacaagaaaggaagcagcgagaucacuuaggauguggugauuaugcaccuccuagugagaauugaugugauuagcaauggaggggggaauaaguagucagauuuuaaauauauuuugaagauagaaucaacaggauauuuugauugugauuagaaagagcacagucaaggauaacucugggguuaacaaauagacauuguauuugaggauauacacaggguuuacagcaccugucucuaagcgguggccuuagcagugagcuuuuuuuucuuuuugcuuaucuguauuuaccaauuuuucuaugcugaaccuguaauacuucuguaauaaaaagauagagauuauuugaaaauuagaguuaaaaguggcaucaaauguaaccuaauuuuuuuuuuuuuuuuuuuuuuuuuugagaacgauucuugcucuguuaucaggcuggggugcagugaugcaaucucagcucacugcaaccucugucucccggguucaaggaaucccccugccucagccuucugaguagccgggacuacaggcgcgccccaccgcaccuggcuaauuuuuuguguuuuaguagagacagggguuucaccauguuggccaggguggucucgaucucuugaucuuguaauccgcccgccuuggccucccaaagugcugggauuauaggcaugagccaccgcgccugcccaaauguaacugaauucuuaaaguauucuccugucccuuuugauuuuagaaaagaacuuaagugacauacauaaacuuuaaaucuuuaucuuuuuacucuuagugaucagccuuugagccuuucccacauugaagauggugaaacuagauauucauacucuggcucaucaccucaagcaggaacgcuuauauguaaacucugagaaacagcucauucagaggcucaaugcagauguacuuaagacagcugaaaaguuguaucguacagcauggauugcgaagcaacagagaaucaauuuggaucggcuuaucauaaccagguaaagagaugauuuucagguuuuaaguuuugugaaccacuaugauucuguaaauaaauuaguaacuauaaauaaaugaaucuguuuccaacaaagugcauuauuuaagauaauuuacaucaauguuaaggugagucuuugcuuauaauacaguuuauuuggauuauuaaguaacuuaggcacuuuuauagaaaauuguaacuuaagcauugacauuuuauaucacaccaauugguuuugugucuuugucuauauaaaauguuauuguuggcugggcgugguggcucacaccuauaaucccagcacuuugggaggccaaggcggguggaucaugagggcaggaguuuaagaccagccuggccaagauggugaaacuccgucucuacuaaaaauacaacaauuaucugggcauugugguaggcgccuguaaucccagcuacucgggaggcugaggcagagaauugcuugaacccgggagguggagguugcagugggccgagauugugccacugcacuccagccugggccauagagcgagacucugucuccucaaaagaaaaaaaaaauguuguuguagagaguaaauuaucuguucugcuuuucuccuaauauuauuuaauauauagguuuccagcugggugugguggcugacaccuguaauccuagcacuuugggaggccgagguggguggaucacgaggucaggaguucaagaccagccaggccaagaugaugaaaccccaucucuacuaaaaauacaaaaauuagcggggcaugguggcauacgccuguaaucccagcuacucgggaggcugaggcaggagaauggcuugaacccgggagguggagguugcagugagccaaaaucgcaccacugcacucuagccugggugacagagugagacucugucucaaaagaaaaaaaaaaaaaaaauauauauauauauauauauauauauauauauauauauauauauauauauauauauguauuuccauguuuugauauuguauagcuauuuuucggguuuagaaaccacauuuuauugucuuaauaccuacgaagaacauuuauuuuauuuuuuuuuuuuuuugaguuggagucucgcucugucccccaggcuggagugcaguggcacaaucucagcucacugcaaccucugccuccuggguucaagagauucuccugccucagccuccugaguagcugggauuacagacuugugccaccaugccuggcuaauuuuuguauuuuuaguagagacgggguuucaccauguuggucagacuggucuugaacuucugaccucgcagucugcccccucggccucccaaagugcugggauuauagguaugagccacccugccuggccaagaacaguuuuuaacucuaagaauaucagugcuguugagaauauaagccagaugcaaaagaauacauacuguaugauucuauuuguaugaaguucaaaaagagacaggacugaucuuugaugacagaaaucagaauaaugguuacuuuuugggcuugagagggugguauugacugggaaagggcacgugaaagcguucuuggguuuuuaaaauguuccaugucuuaaucugaguggugauuacugggugcauguauguguaaaaauuguucaagcugaacacuugacauuugugcacuuuacuguauuuuaccucaauaaaaaugaguuuaaaaaaaaaaaagaacagugcuguugugggcauugugguuuuuuccccacaucuuuuaggcuuauuuuauuuggauuuguuuccagaagcaaaaagccuaguuaaaggaugugauucugcaggucauuacauacuggcauguugcuguugagaaugguugagcaauaugcugauaucgacuucauuuuuauuauuuuuuaguacuugaguauuuguaaacuuucuuauguccauaaauaagcauaagcaguuuaacuguagcugauuuuuuuuuuuuucagacaggaucuggcugugucgcccaggcugaaaugcagugguaugaucuugagucacugcugucucaagcuccugagcucaagcgauuuucccaccucagccuccugagugcugggccuacaggcacacgccaccacaucuagcuaauuuucauauuuuuuuguagagaugggguuucaccauauuuuccaggcuggucuugaacuccugggcucaagugauccucccaccuuggccucccaaagucugggauuacaggugugagccacuguguccuuccuguagcuaauuuuaauuuaauccauaagagggcagcucuggacaguuuuuaggaucuacaaacugauaauuuucuuucuuucuuucuuuuuuuuuuuccagacagagucuugcuuuguuggccaggguggagugcgguggcaugauugcagcucacugcaaccucuaccuucuggguucaagugauucuccugccucaauuuuccaaguagcugggauuauaggugccugccaccaugccuggcuaauuuuuguauuuuuagaagaaaugggaguuucgccguguuggccaggcuggucucgaccuccuggccucaagugauuugcccgccucggccucacaaagugcugggauuacaggucugagccaccgcacccagccccaauacuuuucauugauucugauuugauaagaggaaauuguccuuuguacuuuuuaguuuuguuguccuuuacucauugaguugcuguuaguuuaaaaaauuuuagcaauucagagugaccucauuguugggaccauaaucaacucacauauccauguuuggauauaguauauguguuauuauuauuaauacuauuauuuugcuuguuugcucuuuuuuuuuuuuuuuuuagugcugaagcuuccccugcugaauguugccaacaugccaaaauuuuggaagauacacaauuuguugauggguauaagcaauugggauuucaggagacugcuuauggagaauucuugagucgauugagggaaaauccucgucuuauugccuccucuuugguugcuggagagaaacuuaaucaggagaacacacaaaguguuauuuacacaguuuuuaccucccuguauggcaauugcaucaugcaagaagaugaaagcuaccuccuucagguuuugcgauacuugauugaauuugaacuuaaagaaagugacaacccuaggcgacuuuugaggagaggaacuugugccuucagcaucuuauuuaaacuuuuuucugaaggacuguuuucugccaaacuuuuccucacagccacuuuacaugagccaauuaugcaacugcuuguugaagaugaagaucaccuggaaacagauccaaacaagcuaauugagagguucucuccaucucagcaggaaaaacucuuuggagagaagggcucagauagauucaggcaaaaaguucaagaaaugguggaguccaaugaagcaaagcuaguggcuuuggugaacaaauuuauugguuaucucaaacagaacacauauuguuuuccacauaguuuaagguggaucgugucucagauguacaaaacccucuccuguguagauaggcuggaaguuggggaggucagggcaauguguacugaucuccuguuggccugcuucauuuguccugcaguugucaauccagaacaauauggaauaauuuccgaugcuccuauuaaugaaguagcacgauuuaaucugaugcagguaugcuuuugcuauuauuauuaacguggcauuuaguuuaaaauucaguugauugggcugugggggugggaacaaauaauacgaugacaguauuuguauauucuuacaacuuuuucucaaccaguccuaaguauuugcaucuuauuaaauaaaagcaguaauacugggauuuaaaauuauugcggucacaaaacauuuugucuuugucuguuuuuugagacagggucucacucuguugcccaggcuggagugcaguggcgcaaucucagcucacugcaaccuccgccucccggguucaagcaauucuccugcuucagccuccugaguagcugggauuacaggcgcacaccaccgcccuggcuaauuuuuguauuuuuagccaugggguuaaaauuuaggucaggcuggucuuaaacuccugaccucagaugauccgcccaccucggcuucccaaagugcugggauuacaggcgugagccaccacuccuggccuugggugauuguuaaaaaaugauuagcucaagcugggugugguggcucucaccuguaaucccagcacuuugggaggccaagguggguagaucguuugacaucaggaauuugagaccagccucagcaacauagugagacccccaacugccccauaucuauuaaaaaaaaaaaaaauuggccgggugcgguggcuuacgccuguaaucccagcacuuugggaggccgaggcgggcggaucaccugauguccagaguuugagaccaaccugaccaacauggagaaaccccaucucuacuaaaaauacaaaauuagccagguguggugucacaugccuguaaucccaguuacuugggaggcugaggcaggagaauugcuugaacccgggagacagagguugcgaugagcugagauugcaccguugcacuccagccugggcaacaagagcgaaacuccgucucaaaaaaaaaaaaaaaaucagaaaaaaugauuagcuguuuuuaaugaucaguuauaucaccuugggauguuuagcaauucacuguauagaaaugccugaaauaaaauuuuuaacuuuuuuuaauguuuauaaauuuaaaaaaauuauaauauggaacacuucacaaauuugugugucauccuugcacaggugccaugcuaaucuucucuguagaguuccaauuuuaguauaugugcuucugaagcgagcacaaaauuuuugacaugaaacaguagguuuuuuuuuguuugucuguuuguuuugagauagucucacucugucacccaggcuggaguacaguggugccaucuuagcucucuguagccuuugaacuccugagcucaagugacccuucugccucacccuccugaguagcugggacuacagguguguaccagcacaccucgcucauuuaaaaaauguuuuuguagagacagggucuugcuuuguuguccaggcuggucuugaacuccuggccucagguaauccuccuauuuuggccucucaaagugcugggaucauaggcguaagcuacugugccuggcccaugaaacacuuaaauuuauucuuaugguagauaauguauuuguaguuuuuuuuguuuguuuuuuuugucauuccaguagagaucaaauuacauauuuucagaaucaguaaaaagggggcuugucccagauauuaagaagaggauguuguaauaacuuucaucauuagccuuuaaaaagagugcaguaacaaauuuugccaguaagguacuuguucuaugaauuaguauuuacuuuaucaaaccagcuuauguuaggaaucauuugcuuuuaaaucuagggaaaaaauuauaccuugauugcuuugugaacgcuauaagguaauguucuuaauauuaacuuaaggcaauuuaaugaaugagucagcuuuuacaaauuaauuuaaaaagcucuaaacaaaugaaaaguacaaugucagaaacaaauguauugugcuuuuuuucccuaauguugauaucuuauguguuaaagagaaauuaaagcaaaaauuuauacuuucucuaacucuuaaucuaaaaauaguaaaagcugacauaagguacacauuuuuugggggauacuauuucauaugccuggucaggugauaugaauaguauuaugaaacagauuuuuagaacagaauagacgugcuugcuuucauagagacguauuugugaguaucugucuguagcuuaugucucccuaccacugcuuuggguugcagguaggccgccuuuugcagcaguuagcaaugacuggcucugaagagggagauccccgaacaaagagcagccuuggaaaguuugacaaaguaagaauaaauaugauuuauagaaaauucugaaguauuagugagccuaacuguucucuuuauuaaaucuuguccuuaggugauaucuaaauuaaauguucuuuuaauuagcuacaguauuggaucagcagcauuuaaagaugauuaauucccacagauguauugaggagaugccgucguaagagaaucaaagagcuguuaagauuauuuuauuuuaaaaaguuuuuuuuuuuuuuuuuuuugagauggagucucgcuccgucgcccaggcggagugcaguggcaugaucuuggcucacugcaaccucugccuccggguucaagcaacucucugccucagccuccccaguaacugggaucacaggugccugccacuacacccggcuaauuuuuguauuuuuaguagagacgggguuucaccuucuuggccaggcuggucuugaacucauggccucgugauccaccugccucggccucccaaagugcuaggauuacaggcgugagccaccgcgccuggccaacuuuuaaauuuucgagucagugucucacucuguugcccaggcuggagugcaguggugugaucauggcucaaacuccugggcucaugcaguccuugcaccuuagccucccaaguaccugggcuauaggggcacaccaccaugcccggcuaaguguuuuuauuguuauagagacgaggucuuguuauguugcccagacuggucuugacuccuggccucaagugauccuccugccucagcauuccagcgugcuaggauuacagaugucagccaccaugccuggucgauaauuguuuaauuuuaaguguaguuuauaaguuaacaucuaugacauuguucaauuaauauaguuaaauaaaauuuuaaucagucuuacuuugauuaagcuguacauucaaccaaugaaaauucaaggauauuugaguaaaauuucccuuccacgucucaucucuagucuucauucccugcccccacaaaacauucuuuuuuuuuuugagacagaguuuccuucuugucacagagguucgcuguugucacccaggcuggagugcaguggcgugaucucggcucacuguuaacucugccucccagguucaagcaauucuccugccucagccuccgaguagcugggauuauaggcgugagccaccacgccuggcccccaaaagauucuugauguuauuagguuguuuuuccuucuagagguccauauguuuacaggcaaauuccuacguacacuauauacuuccaaccaucccuuccuuucccuuucagaaauaguagcacaauguguauacuguucuguguuguguuauguuugucuccaacaucuuauuguuauuuucuuuuuuuuuugagacagggucucacuuugucacccagugaugccaucucagcucacugcagccucgaccucccuggcgcaagcaguccucccaccucagcuucccaaguagcugggacugcaggugcgcgccaccacaccuggcuaauuuugguauuuuucauagagacaagguuuugcccuguugccccaagugguuuugaacuuccgagcucaagcaguccacccaccuuggccucccaaagugcugggauugcaggcaugcacuaccacacccagcuccaagaucuuagacuauaucaguacaaaaagaguuuaauuuuuuuagguugggugcaguggcucaugcugguaauccuagugcugagcgcacuuugggaagcugagguggacggaucacuugaacucagaaguuugagaccagucugggcaacauggugaaaccccaucucuacaaaaaauacaaaaauuaggucaggcgggguggcucacauuuguauuuuuggcacuuugggaggccgaggcggguggaucaccugaggucaggaguucaagaccagccuguccaacauggcaaaaccccaucucuacuaaauauacaaaaauuagccgggcauggucguggcaccuauaaucccagcuacucgggaggcugaggcaggagaaucacagugggggaggaggugugcagagguugcagugagcugagauggugcuauuucauuccagccuggguaaaagagugaaacuuugucucaaaaaaaaaaaaaaaaauucaacaucuuaaaaaaauaugauuuuuaagauguuuaaauuuuuucaugcuuguccaccuuaaugagaaauuucguuccaguauuuuaaagggaaauguuucacuguuuuuuuccuguuuuaacagagcuguguugccgcuuuccuugauguugugauugggggccgugcaguggagaccccuccauugucuuccgucaaucuucuggaaggauugagcagaacugugguuuauauaaccuacagucagcuuauuacucugguaauggcuucauuguuuaagagaauuucucgaaagucuuuuagcuaagcgugagcaaaaacauacaugaguacauugugugggaaauacauauuguauuugaaaaagugauuucauuagcuaauguucuuugcuuuugccaggugaauuuuaugaagagugugaugucuggagaucaacugagagaagauagaauggcucuugacaauuuauuggcaaaccuacccccggccaagccaggaaaaaguagcaguuuagaaaugacucccuacaauacaccucagcuaucuccagcaaccacuccagcaaauaaaaagaaucgauuaccuauagguaaagagaauuucucguauuggagcuuucucuuaaaucuaauauuucauuagccuuuguuauugcugaguguuuuggaacauauguuuaaguacuugggaaagucuuucucuucauguuuacugaugguauuucaguuuuuagaaaucguaucagauuaguuaagguuuaucaguagucuuuagcuuugccuacauacuuuucauaauuaauugaagucaugcuauccacaguauacuuucuuuaaauuuuauugucuuuucuugaaaaaauuuuggaaauguuauaaguagucaucuuuaaaacuauguagcccucagccuggugugguggcacgugccuguggucccugcuacuugggaggcugagauggggagauugcuugagccugggaggucgaggcugcagugaaccaugauugugccacugcacuucagccugggugacccugagugagacccuaucucaaaaaaaaaaaaaauuauguagcccccuccuuucuacaaaguucuaaauaauauaauaaacaauauuauuuuagaaguuuccaucaauaaaguggaaaauaauaguauuuucuauuauuuucauuaacaaucagucuuuuaucaacugagcuaagauaucuuaauauuacaaaaugaagcaaaaguuucauuuuauuuuuucaaguuuguuuauuuaagaauucuauuuaauuaagccuuauuugcuugguuaacauuugcuaucuaucugucuauaaaaaaauuaauugagcauauaccauguuccauacuguggguaggcacuuuauaaauguuguuucauuuaauccccacagaaguccugugagaguggaugugucuugcacaugaggcacugugauagacacuggauacaaagaccauuaggaccugcccuuacugucaaguuggcuguugauaguuuaguuagggagagcaagaagagacuaguacccuucagcauacuaagcguucugaggagauaaauaugaggguuauggugacaccuaacuuagccaaaaugguagugguaucaggagaagaucuuggagcaggugaagucuguuugcacuuugugaugaaugggaguuagacaaaguaaacaagaugaggaaaaaguguuuaagccaggggaacaggaguauuuuagugccugccuauuuauaacgaggaacucagcaacacuuagugaacauaguucuuuuuaauuuaugcauuuugaagagagggauuuuacuuuuaaacuucugugagcuaauuuuuuaagaacugccaguuucuuaaaauuaaucuaccuuauauuuaacguaauguggaauuguaucaacaggaguguggcaucauacucuucaagucuuugucuuauuguaucaccccaaaaugucaguuuucaaaauaaaaaauagaaaaagcgauuuuacacuuauugguguuuuuuuuuguuuguuuguuuuuuguuuuuuuuugagauggagucccccucuuguugcccaggcuggagugcaguggcacaaucuuggcucacugcaaccucugccuuccagguucaagcgauucuucugccucagccuccccaguagcugggauuauagaugcccaccaccacgcccggcuaauuuuuauauuuuugguagagacaggguuuugccauguuggccaggcuggucuugaacuccugaccucaggugauccaccugccucggccucccaaagggcugggauuacaggugugagccaccgugcccgggcacuuaaugguuuuuugugggcuauuugcacucuguucacaugaugaaguaaaugauuuuuaguaaaucagagauuuuuucuccauuguugacugcuauacauuaguuuuuucauuucccguuauccaaaagugucauuaaauaugagucugauggaaagugaauuucaaauguaugcccaauauuauuuuguauagucuuguuaccuggcuauugcauuuauuucguaucuuaacaaaucuguccauuguucagaggguugauuuucuuucuauuuaaugcuuuugcaacccaggacaacaguuagcagccaucacugccugggauuccucagcuaccaauauuaccucucauauuacaguaguaaccccguuugguggguaauaggcuguucuuccucuucuuuuauaauuuuauuuaagaaauaguuuauaaaaguaugcuccaugugcauguugcuuuuacuuuauguaaauugcuacauaaaauuugauugcuugcauuuuuauaaauuauaguuacagaguuuguuaugauucauagaucuguuuaugaacuugaauuuaaauuugcaauucaguaaaagauagggugagcaaauaaagguaugaguaggccuauuuuagacuuggaaauugaugugugcucugaauuuucagauuaaaagugauuaaugaacauuaaucagcauuguaaagaaaggugauuguuuauauuucugccucugucuucaagugggucagcuuucauacaaugugaaguugacuuuugcugcuacuauaguuguuuuugcuuuaugucuguauuuuuuauuauuuuguaccaaaacauaauuucuauuuaguauucugguuguacugaauuuuauugucuucugaaagaaaauagaaacuuuuuuucuugauuuuuuuuuuuuuuuuuuugaggcggagucuagcucuuguugcccaggcuggagugcaauggcgugaucucggcucaccgcaaccucugccuccuggguucaagccauucuccugccucagccucccaaguagaugggaucacaggcgugugccaccacgccagcuaauuuuguauuuuuaguagagauggguuuucuccauguuggucaggcuggacuugaacucccggccucaggagauccacccaccucagccucccaaagugcugagauuacaggcgugagccaccgcgcccagccuucuucuuuuuuuuuuuuuuagacggaguuucgcuuuuaucgcgcaggcuggagugcaauacugcgaucucggcucacugcaaccuccgccucccggguucaagugauucuccuaccucagccucccaaguaguugggauuacaggugccugccaccaugcccggcuaauuuuuuguauuuuuaguagagacgggguuucaccauguuggccaggcuggucucaaacucccgaccucaggugauccaccugccucagccucccagagugcuaggauuacaggugugagccacuacacccagcaauuauuuuagaaaaaaauauuuuucaucugcuuauacacaggggaaagaaacaaaaauaauugaagccuuuauuaauuuauacuguuuccaaagcagaaaggaccucuucuccaaacauaaauaaauuuucucucuuuuaucuuugaaaagacauuaaugcauuucagggggggaagguacauuuaaaaacugauucugggcugggcacgguggcucaugccuguaaucccagcacuuggggaagccaaggugcguggaucaccugagaucaggaguucaagaccagccugagcaacauggcaaaaccccgucucuacuaaaaguacaaaauucaccaagugugguggugucugccuguaaucccagcuacuugggaggcugaggcaggagaauugcuugaacccaggaggcggugaucgcaaugagccgagacugcgccauugcacuguagccugggcaacaagagugaaacuccgucucaaaaaaaccaacacugauucugguuuuguuaacaguugccuaacuuaaaguauccuauuuauguggcuauuagguuuucauauaaaauuuucuuuauuguuucuuuuuuuuuuuuugagauggagucucacucugaugcccaggcuggagugcaguggugcaaacuuggcccacuucagucuccgucugccugguucaagugauucuccugucucagccccccgaguagcugggauuacaggugcaugucaccaugccuggcuaauuuuuuguauuuuaguagagaugggguuucaccguguugcccuggcuggucucgaacuccugaauucaggcaauccaccugccucagccucccaaagugcuaggauuacaggaguaaucccucauaugaaauuuucuaaugcuuguaagcucaguuauugguaugggagaccuguagcaguuacaucaauuuauaggaaaaauagugaagguaucuuaaaaagauaagaaaugagguaaugcuuuucuugucacuccaagucuuaaauuuauugugacauguuugcuguucugcagaugugaucaucuguguggcacuuccugucagaugcacuuggaucauuguucuugauuaucaguuuugaaggagaaucuuuauuagucaguagaguaacugggaggaucugguuuguuuuguuuuguuuuguuuuuucuuauuuauauuuuuuaccacucuugugcaugugcaaauguucugcacuaauagaaaauauauucauauuuagcauaccauuuucuucauuugucuauuucucuaaauuauuuuauuugaaauuuuuuauuagcaacucggagcagaagccgcaccaauaugcuaauggaccuacauauggaccaugaaggaucaucucaagaaaccauucaggaggugcaaccagaagagguguuggucauuuccuuagguacagguccccagcuuacuccagggaugaugucagaaaaugagguaugaaucaguugcuucuauaaaucaauauucaugucuuaguccauacaggcugcuguaacaaaacaccagagguuggguggcuuauaaacaacagauauuuauuucucacauuuguagaggccaggaagucuauagucaaggcagauucagugucuuguaaggaucuguuuacugguucauagaugauguauucuugcugugucuuugggcuuauuuuuuuuugagauggagugucacucuuguugcccaggcuggagugcaauagcacgaucucagcucacugcaaccucccaaucccggguucaagcaauucuccugccucagccuccugaguagcugggauuacaggcaugcaucaccaugcccagcuaauuuuguauuuuuaguagagacaggguuucuacauguuggucaggcuggucucaaacuccccaacugaggugauccgccugccuuugccucccaaagugcugagauuacaggugugagccaccgcgccuggcugguugggcuauuuuauaagggcacuuauuccauuugugagggcccugccuucaugaccuaaucaccucuccaaaggcccgaucuccaaauaccaucaccuuggggguuagaauuucaacauacagauuuugggggagcacaaacauucagauccuagcaaugaauuuuuuuuuuucuuuuucuuuuucuuuuuuuuuuuuuugagacagagucucacucugucaccuaggcuggagugcaguggcacgaucucagcucacugcaagcucugccucccggauucacacuguucuccugccuuagccucccaaguagcugggacuacaggugcccgccaccacgcucggcuaauuuuuuguauuuucaguagagaagggguuccaccguguuagccaggauggucucgaucuccugaccucgugauccaccugccucggccuuccaaaguguugggauuacaggcgugagccaccgugcccagccauuuuuuucuuuuuuuuugacauggagugucacucuguugcacagcuggagugcaauggugcgaucuuugcucaccacagccucugccuccuggguucaagcaauucuccugccucagccuccugaguugcuggucuuacaggcaugugccaccacacccggcuaacuuuguauuuuuaguagagacgggguuuugccauguuggccagacuggucucgaacuucugaccuccagugauccacccaccuuggccucccaaagugcugggauuacaggugugaaucacugcacccagccaaugaauuuaaugcuuaauucuuuguuaucuucaguggucccaccaugacacaccaucacaugcuaagcucccugugaacaguugugaggcccuucacauuaauacaucuguggcacugagguuggugaauagguccaagcauaaggaauuuuccaggcaguagcagaagagagaugaagccaggagauugugguauggaaauuaaagagacuuuuccagugacuuguaggaaauguuuuguguucauuuucuuucuagugguauacuaguaguauuccugcauuauagagccaaaaauauguugagauguauuuugagauacauguuguauucuuuggcuggucaggaaaaaauggaagaaauaauggaaaacuaagaaaauaaauuuuuuuaagaaauggaguuugaggcuugggaaucauuuuuaauauauuuguaacaaaaagcuuggcuuaaaggugaaugaaaagaaggucaggccugguggcucacaccuauaaucccagcacuuugggaggccgagguggguggaucccccgaggucaggaguucgagaccagccugaccaacauaguaaaaccccaucuuuacuaaaaauaaaaauuagcugggugugguggcgcaugccuguaaucccagcuacuugggaggcugagacaggagaaucgcuugaacccgggacguggagguugcagugagcugagaucgccccauugcacuccagccugggcaacaagagugaaacucugucucaaaacaaaacaaaacaaaacaaaaaacagaaaaaagaaacaaaaagacaagaagaagaaaucuugacucccuaaagauaggagucucuucucauagaauugugaaauugugaccuccugaaaaaguagcagcuucuuuuuuuuuuuuuuuugagacggagucucacucugucacccaggcuggagugcaguggugcgaucucggcucacugcgagguccaccucccggguucacgccauucuccugucucagccucccuagcagcugggacuacaggcgcccgccaccacgcccggcuauuuuuuuguauuuuuaguagagacaggguuucaccauguuagccaggauagucucgaucuccugaccucgugauccgcccaccucggccucccaaagugcugggauuacaggugugagccaucgugcccugccaguagcagcuucuuauauucaacagugauugcuuguuauucaagaaaaugggcuagaaagaagaggccaguuuuagugauugauaaagugauggugguugguaaagcuguguuugggacuaugacaugauaccccauagggaagaagaccaacaaucuucgaaacuccauccuccacacacacacacaaauaagcuggcaaaaacugucagaaucaacuuauuuggaacucuggaaucuaauaaaaaacuuuuaacaacaaaggaaugcuuaaugaagaaaaagacugcugaauuuuguuaagagagcucugugauccuacccuguuaccaucuucaacccccagcccaguggcugcuuugaagacagcuuauauuacugugcagugugcugguacuugagggaggaauguggaccuuauucugaaagcagcaugguuguguauuuugaucugucugguagguccugaaagaucgucucaaaggcuuggcuuuguuuugccugccucugaucuuucccagggccgaggcagcuacacagguggcauuugucaaaaguauugaaaagcagauauauuaguugcuucugcuugcauuaagggauaacagucagggcaauccgcauacagauccaaaugcuuaugaaggaagaggcuugggaaggagacaccagggggcacaaaggcuuugaaaagcucccacguguucuggggaaucuaccagguuguacacauacccagggcuggucaugugcucaggaaagacccuagaagauccaagcucucacugcuggguaaccuucaggcugaacccaaguaggaagugaaggcuaagguacaguugcaaacugccuggcuaaguguugaaguuccccaaaacagagccaaucuucaaagacuuggaaauguuuuguuuuguuauuccagguguuaaaucugccaaaucacgugcucaccacuaagcuaacagaacagaaacuucagaggccacacaugacagaaaauuuagagagaucauuaaauagucacuacaacaagcagcaacaaccaacuagggguuaaggguauauaaucugauuuccagaauugccacuuuguaacauuuauuuguuuauuuuuuauuuuaauuuuuuuauuauacuauaaguucugggauacaugugcagaacgugcagguuuguuacauagguauacaugugccauagaucuacauuagauauuucuccuaaugauaucccuccccuaacccccuaccccugcgacaggccccaguguaugauguuccccucccuguguccauguauucucauuguucaacucccacuuaugagggagaacaugcgguguuugguuuucuguuccugcauuaguuugcugagaaugaugguuuccagcuucaucuguaucccugcaaaggacaugaacuaauccuuuuuuauugcugcaaaccacuauggcacauguaucccugcaaaggacaugaacuaauccuuuuuuauggcugcauaguauuccaugguguauaugugccacguuuucauuauccagucuauuguugaugggcauuuggguugguuccaagucuuugcuauugugaauagugcuucaauaaacguaugugugcaugugucuuuauaguagaaugauuuauaauccuuuggguauauacacccaguaaugggauugcugggucagaugguauuucugguucuagauccuugaggaauugccacacugucuuccauaacaguugaacuaauuuacacucccaccaacagugugaaaguguuccuguuucuccacauucucuccagcaucuguuguuuccugacuuuuuaaugaucacuuuauaauauuuaaaaugucugcuuuucagcaaaacuuaugaggcauauaaagaaacaaaaauauggcccuuucacaggaaaaaaguuaauagaaaauguccuugaugggccaggcgcagugguucauggccguaaucccagcacuuugggaggcgaaggugggcuguucaugaggucaggaguucgagaccagccugaccaacauggugaaaccccgucucgacuaaaaauacaaaaauuagccaggcgugguggugugcaccuguaauaucagcuacucaggaggcugaggcaggagaaucgcuugaaccugggaggcggagguugcagugagccaagauugcgccauugcacucuagccugggcaauacagcgagacucugucucaaaaaaaaaaaaagaaaacguccuugauggccgggcgguggcucacgccuguaaucccagcacucugggaggcugagguggguggaucaccugaaguugggaguuugagaccagccugagcaacauggagaaacccugucucuacuaaaaauacaaaauuagccaggccugguggcacaugccuguaaucccaguuacucgggaggcugagguaggagaaucgcuugaacuugggauguagagguuauggugagcugagauugugcuguuguacuccagccagggcaacaagagcgaaacucugucucaaaaaaaaaaaaaaaaagaaaagaaagaaaagaaagaaaauggccuugaugaagcacagacauuggacuuacucaagacuuuaaaucaauuuuuuuuuuaauauacuuaaagagcuauggaaaccacggacaaagaacuaaagaaaaccaagagaacaaggucucaccaaauagaagauaucaauaaagggguagaaauuacagaaggaaccauauagaaauucuggaguugaaaaguauaauaacuggaaugaaaaauacacuagagggguucaacagcagauuuguacaggcagaaaaaucagugaacuugaagauggaucaauugagauuaucuagucucaggagcagaaagauuacaaaagacaaagacauuauauguugauaaauagucauuaagaagauacacccagcacuuugggaggccgcucucacugcagccuccgccuccccuguucaagugauucuccugccucagcuucccuaguagcugggaccacaggcauaugccacuaugcccagcuaauuuuuguauuuuuaguagagacaggguuucacuuuauguuggccagguugcucucaaacuccugaccucaggugaucugcccaccucagccucccaaaguguugggauuagaggcgugagccacuguggccagcuaaaguuuuuuuagcacucagauucugugguuuuaguuuaauccagaguuugcagaugcucugauuuagaagcaugaaauuagauuuucguauuuuauacuccaguguguauuuuguauuuuauacuccagugugacugacuuuguacaguggcuuucuguauggcgucucaaaauugcuugccuuuggauaugauuuggaaaaaauaucuucauuguguuauauaaucccuuuucuguuaauucacgugaaucuccagaccuugaaaugauuuuucuccugauguuuuaguuucacaucacucacuauggugaauaguuuaaguuaucuaauuuaaaauauuuauguuggccaguuaugguggcucaugccuguaaucccaguauuuugggaggcugaggugagaggauugcuugaaaccagaaguucaagaccagccugggcaacauaguaagaccuugucucuacaaaaauaaaaaaauuuccagggaugguggcucacaccuguaaucccagcgcuuugggaggcugaggcagaaggauccuuggguccaggacuucaagaccagccugggcaacuuggcgagacccugucuuaauaauaaauaggccaggcgcaguggcucacaccuguaaucccagaacuuugggaggccgaagcaggcagaucacuugaggucaggaguuugagaccagccuggccaacauggugaaaccccaucuuuacuaaaaauacaaaaauuagccgggugugguggcacaugccuguaaucccagcuacuugggaggcugagacaggagaaucgcuugaaacugggagguggagguggcagugagucaagaucaugccauugcacuccagccuaggugaaagauugagacucugucucaaaaauauaauaauaauaauaauaauacgaagaacuaaaaugaaaaaaauuagcugggcuuggugguguguaccuguagucccagcuacucaggaggcuaaaacaggaggauugccugugccuagggguucaaggcuguggugagccaucauugcaccacugcacuccagccugggcgacagaaugaguuccaucuuaaaaaaauuuuuuuuaauaaaaauuuuauguguauuuaauuuuuuuuuuugagauggaaucucccucugucacccaggcuggagugcaguggugcaaucacagcucacugcaaccuccacuucccagguucaagugauucuccagccuccugagcagcugggauuacaggugugugccacgacgccuggccuaugucuauuaauuucaagcaaauagggaaaaaaaaacuuuuuuuuuuuuuuuuuugagaugcagucuugcucugucacccaggcuggagugcaguggugcaaucucagcucauugcaaccuccaccucccggguucaagcgauucuccugucucagccucccaaguagcuggaauuacaggcguacaccaccacaccugguugauuuuguauuuuuaguagagaugggauuuugccacguugcccagguugaacuccugaccucaggugauccaccggccuugaccucccagagugcugggguuacaggcaugagccgccaccgcucccagccaaaaaaccuguauuuaaaggcaucauguguaaauguauaaaaccauuucaaaaccuuuaauuuacucagagccaaaacagcaaccaagaauuuuuuuuuucuuucuguuuaaaaaucauuuaucuuuuagcugacaaaauuguaucuauuuaugguauacauguuuugauauacauuguggaauggcugaaucaagcuaaauaaccuguaucgccucacauauuuuucauuuuuugugguaaguuuuuuucuuuguaagugaggguacuauucuuccuucauauuucagcaacagccaagggagccaaggccucugaguucaaguccaagguguaccuaaaacaugcuaugugacuuucaacaaagcacuuaauucuucauuaagguggagauauacacacaaagcugaguugugaggcuuguagggaguagugagauguaguuauguuauuuggaagucaucuggcaaauggaaagcauauaaaaaggccaucagucuaagcuggagaugucugugaagucauacuuuaguuucugguguggacuuuuguggcccuguauguauguugugaucaaguggacguucagacuagauggauuaaaucuugaugccuacaaaauaacaugauuacacguuuucuucuaguugaauuuauuuacuuuuauuuacuuuaaauuuuauuuaaauuuugcaaauuuaguauguuuaaaaauuuuauuuauugauuuuuuauuuuuauuuuuuugagauggagucucacuguaucgcccaggcuagagugcaguggcgcgaucucggcucacugcaagcuccgccucccagguucacgccauucuucugccucagccucccgaguagcugggacuacaggcacccaccaccaagcccggcuaauuuuuuuuguaguuuaguagagaugggguuucaccauguuagccagcauggucucgaucuccugaccucgugaucugccugcccuggccucccaaagugcugagauuacaggcgugauccucugcgcccagccuuguugauuuacuuucuuuaaauuuugcaaauuuaauacgugacaugacaacuguuuuaugugcaucuuuuuacuuaauucucaacaauuacauggcauacauacuguuacugucaccauuuuauagaugaagaaacugaggcuuagagaauuucaauaacuugccuauccaagguuacauaguugacacaugacagaauuagaaggaccagcgugcugacaccaaagacuucugauuuguauaauucucaccacuacucaucugguagucugguugccuguucuaucuguaacacucguaggguaauggaaaggcauggcuucagcugcuuuaauuuauauacuuuuauuccacagguauuuaaaagcuugacagaccuucuaaauagguuuguaguuaaaaauugauaauuuaagauuaaggaguuaaauaugcauuugcugugguuuguuuccuuaucaguaaucuuuccauugauaaaccaaaauugacauuuuauuuuuuagguccuaaacaugcagcuuucggauggaggacaaggagaugucccuguugaugaaaacaaacuccaugguaaaccugauaaaaccuugcgcuuuucccucugcagugauaaucuggaaggaauaucugaaggugaaggguuacuucauucaaggaguugugugguucaauuaauaguuuguuuuguguuuuuuaaaggagcuuauaaauuauaauuauaccaucugugcuucucacugaggagacuaaugaagauuuccucuaaugagccugaacaguuggcuguaaagauuguuuccugaauaaaauuaaaauugcaagaugccuuuggucauauaaaauggagaagauaugucuuuauucagacuuaaauagaauaacagcaaguucuguuucugcaguauuaauauauaccaaagcuuauagagcuccuuuagaaggauaucaugcaugucgaaacgggaaaaaauggacuuacuaguauuucaauauguugcacauacucuuaaauguucuguauuccuuuacucacacucacacauaccuuuaugaagcagaagacaauggaaauagguauuaaaaagaaaauucaaagccaagauugugaaaugagaauaugucauuuugccuacuaguaccaauuuuuuuuuuuugagacagagucucguucguugcccaggcuggagugcagugucgcaaucucggcucacugcaagcuccgccucccggguucacgccauucuccugccucagccuccugcauaguugggacuacaggcacccgccaccacgccuggcuaauuuuuuguauuuuuaguagagacgggguuucaccguguuagccaggauggucucgaucuccugaccucgugauccgcccaccucagccucccaaagugcugggauuacaggcgugagccaccgcgccuggccccggguuuuuuuuuauuuaaagacaauaguucaaauuuacugacauuuaaaaagaaaccuaaaauauaauaacuucauauuuuaaucugacuuuuccaaaaaaaugacauguaauguauguucauucuacaaaacagagaaauagaaucaccuauaaucucaaaauuuuguugauagcaguugacguuuuagauuauucacagcaaaauuagguuuauccuguuuuguaaccuuuuguaauuuaauaauauggcauuaacauuucccuuuguaauuuaacauucuuaaauaacaugguuuuuauggcuguuuuccuuaaccucacauggcauaucauaauuuuuuucaacuuucuucugugauuaaaucuauagauuucuuccacuuuuuggacauaauaacuucugggcugggcgaaguggcucaugccucuaaucccagcacuuugggaugccgagguggguggauucacugagcucaggaguuugagaccagccugggcaacacggugaaaccccaucucuacuaaaauacaacaaauuagcuggguguggcagcgugugccuguagucccagcuacucgggagacugaggcaggagaauugcuugaaccagggaggcggagguugcagugagccaagauggugccacugcauuccagcuuggacgauagagcgagacucucucuaaaaaaaaaaaaaaaaaagaagaaaaagcucuauaacaagcaacuuuagauuaauuauuauuauuauuuuuugagauggagucucacuuuuguugcccaggcuggagugcaaugaugcgaucucagcucacugcaaccuuugccucccggguucaagcaauuccccugccucagccuccuaaguagcugagauuacaggcaugugccaucaggccggcuaauuuuuauauuuuuuguuuuguuuuguuguguuguguuuuguuuuguuuuuugagauggagucucgcucugucgcccaggcuggagugcaguggcgcgaucucggcccacugcaagcucugccucccggguucacgccauucuccugccucagccuccugaguagcugguacuacaggugcccgccaccacgccuggcuaaauuuuuauauuuuuaguagaggcuggguuucaccauguuagccaggauggucucgaucuccugaccucaugauccacccaccucagccucccaaaguacugggauuacaggcaugaggcauugcacccagcagauuaauuuguuauuagcaccuuaggauaaauuccuagaagcagaauuucucaaagggcauguguuuuuuuaagguauaaaaaguauuaaaaacacuuuaaucaguuguuagucuuuuaucaaggcaugaaaaauugugugguggcucaugacuguuuuaaaaagauugcucacacuauaaacauuucucuagguccuucaaaucgcuccaauucaguguccucccuagaccuagaaggagagucugugucagaacuuggagcaggaccuucuggcaguaauggaguugaagcucuacagcuguuagaacaugagcaagguaaagugaaguugaacacaguugccuaaguagcaaagaauuuaccugauugcaagaugagcaguguguuuucauuaaguuggcuugguucaguaagagauuaaaucaccauuaaacuuaacauuuauucaucauuccuucaguucuucaaaaucuauuuaguugguaaguggauuguuuaggcuuaauaaauuaauauaaauuacuugaaauucaguaauauuugauauuuuaauuauguaauauuuuagggauacaauguaaauacucaaggcucaaggaacuuagaauagggaaagaauaguacacaauugauuuaaaguaucaugaaaguauuuggcaguucugagugagagauacauaugguugaaaguauagggaaagcugcugggcccgguggcucacaccuguaaucccagcacuuuggguggcugaggcggguggaucaccugaggucgggaguucaagaccagccugaccaacauggagaaagcccgucucuacugaaaauacaaaauuagccagggugguggcacaugccuguaaucccagcuacucgggaggcugaggcaggagaaucgcuugaacccaggaggcggagguugcggugagccaagaucguggcauugcacaacaggcugggcaaaaagaguaaaacuccgucucaaaaaaaagaaaguauagggaaaguuuauuggaagaaaauauuagccuugagggcuggcuggcauugccuuggcagaaguuggagauaggucauucuaggugaaggacaagcauaagcaagucaaagaggugggaagccauaguacuuuuucagguaucaguuagggaaauggagugagguaaggauuaaaaaguagguggaucccuguuguggaaagaaggauaucaguauuuuaguaguaagcuggaagccacugaaggcuuuugguucagugaagaugaggaagugaggugccuuaggaagauuaaguugaaagaguuuuuuggauuuguucauuuaagaugaugcccuuggccagguacaguggcucgugccuguaaucccagcacuuugggaggcugaggcagguagaucauuugaggucaggaauuugagaccagucuggccaacauagugaaaccccaucucuacuaaaaauacaaaaauuagccaggugagguggugagcaccuguaaucccagcuacucagaaggcugaggcacgagaaucgcuugaaccugggaggcagggguugcagugagcugagaucgcaccacugcacucuagccugggcgacagagugagacucugauugaaaaaaaaaaagaugggccgggugcgguggcucauaccuguaaucccuagcacuuugggaggccaagacaggcggaucaugaggucaggagaucaagaccauccuggcugacacggugaaacccugucucuacuaaaaauacaaaaaauuagcugggcaugguggcaggcgcuuguagucccagcuacucgggaggcugaggcaggagaauggccugaacccgggaggcagagcuuagugagcagagaucacaccacugcacuccagccugggcgacagagcgagacuccaucucaaaaaaaaaaaaaaaaaaaagaugaugcccucaacuagguuugacacagugauuuuagcaugcauaagaauuaccugguuagcuuuuuaaaaauuccauuucccaagucuuacuucuaaaaaagaagucaguuuuuagaaagaaaaagaguauugucauuggaguguguguggcuugaaaaaaguaaugcuguauuuuacuggauuuguuuaucaguguauuaauuaggauuaaguuuguugcaagcagcagagaaaacucaaguaauaaaguaguaccuccuuauccaugguuucaccuuccauggcuucaguuacccaugggcaaacuuggugcaaaaauauuaaauggaaaauuucagaaauaauucauaagcuuuaaauucugugccauucugaauaaugugaugaaaucucacacagucucacucuaucacauccaggacaugaaucauuccuuaguucaguguauccacauauacacuaccugccuauuagucacugcuuaucagaugaaaacagcauggaauauauaggauuugguacgauccgaagcuucaguuauccacuggaggccauugcauaaguggaggaggaacuuucauaugagcuuaugaaagaaguugaacaaaugucaccucuuuagcaaacuuccugggagauucugagauaggugguuggcauaugcaaaaugcuagauuaagaagugaauugauaggccaggcacaguggcucacgccuguaaucccagcacuuugggaggccgaggcgggcggaucaccugagauugggaguucgagaccagccugaccaacauggagauaaaauucuuuaaaguugauuaaaaagucauagcugugcuacuauuuuaaaagugcuuaauuuuguuuuugauagcuacaacacaggauaaccuugaugauaagcuaaggaaguuugaaauucgugacaugaugggauuaacagaugauagggacauaucagaaacagugagugagaccuggaguacagacgucuugggaagugacuuugacccuaauauugaugaagaucgcuugcaagaaauugcagguaacugccauuuaaugucucugaaauaucacgguuuaguuauucaaauccaccaaccuuucaugggagggagcaccagugcccugacaaacauuguguguguuagcaccaucugggaaacuguuauaacuguauggaacaaggcauuuggguacuuuuuucuuuacuuaaauauaacuaguguuuuuccuuucuacauuuaaucccaccccuuacccauccuccucccagcugcccaaaaaaaaaaaagaaagaaagaaaaaccaguguuuugaauuagcuucuggucaaguguuguuugcagggcauaguauaaguucuuagucugucucuaauuaguauauucucuguuugaagccaaacaccuaaccuuaagaugaaaauucuuauagauuauagccauaaaaucuuucacaacaauaugauacugcuguucucuaaaaaaaugaauucacuucuggaagaguuaauucaguuccuaaggguaaccagguuuuucuuuuucuucuucuuacauuuuuauuuauuuucaaauagagacaggauuucgcuuuguugcucaggcuggucuugaacuaaugagcucaagugauccuccugccuucuuuuuuuuuaaugugaaguuuauucaggugcuauguauauacacuaaaauucgcuccuuuuuggauacuguuuuaugaguucugaaagauauauagucuuguaacccucaucuucauuuuguuuuuaaaucauggaaaauuuauugauauguuuauuuuucuucaacuuuuauuuuagguucaggggguacaugugcagauuuguuacaugggaaauuguuagagcaaauuguauguugcugggguuugguguacagaugauuuugccacccagguagugagcauaguaaccaauagguuuuuuuuuguuuuuguuuuuuuaauuuaagauagagucuuacucugucgcccaggcuggaguugcaguggugcgaucucagcucacugcaaccucugccucccugguuuaagugauucuccugccucagccucccgaguagcugggacugcaggugcccaccaccacacccagauaauuuuuguauuuuuaguagagacgggguuucaccauauuggccaggcuggucucgaacuccugaccucaagugauccauccgccucggccucccaaagugcugggauuacagucaugagccauugcucccggccuaaaucauggaacauuuuaaacaaauacaagagauggugguaucaugaacccaguguacccaucacucaguuucaggaguuagacccacauggccagcuuucuuucaucuguucuccuauccacuacccucuucucuccccucauuauguuuaggcaaguuccagacauuauuuuauuucuaauuauuuuaugauauagcuuuaaaagguaacuuuuauuaguaacuuuuuuucuaauuuuuuuucaugcccugaaguagaauuauucuuuuauuagguuuaauccaaaguagugaagccuuuugaacuucaguguuuuuaacacagacguauaauaauguuuaauacuuucgauuuguauuuuuaaguagugcaaauagauuucuuuuuuuuuuuuuuuuuaaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggaguggugaugacucuuaaggagcaugcugccuucaagcaucuguuuaacaaagcacaucuugcacugcccuuaauccauuuaacccugaguggacacagcacauguuucagagagcacaggguuggggguaaggucacagaucaacaggaucccaaggcagaagaauuuuucuuagugcagaacaaaaugaaaagucucccaugucuacuucuuucuacacagacagggcaaccauccgauuucucaaucuuuuccccaccuuucccgccuuucuauuccacaaagccgccauugucauccuggcccguucucaaugagcuguugggcacaccucccagacggggugguggccgggcagaggggcuccucacuucccaguaggggcggccgggcagaggcgccccucaccucccggacgaggcggcuggccgggcagggggcugaccccccccccaccucccucccggacggggcggcuggccgggcaggggggcucaccucgggaggccgaggcuggcggaucacucgcgguuaggggcuggagaccgcccggccaacacagugaaaccccgucuccaccaaaaccagucaggcguggcggcgcgugccugcagucgcaggcacucggcaggcugaggcaggagaaucaggcagggagguugcagugagccaagauggcagcaguacaguccagcuucggcuccgcaugagagggagaccguggggagagggagagggagagggagagguguaaauagauuucuuaauugguuuuacauuacuuuguuccagaugccaaagugguauuguucuuggcaguuagcuguauuugcgcaauaagcuguauuugcaguugagugagugcuaugaagauguguauuuuccugugaauguaucuuauugcccugaauagugacuaauaugcuggaagaaaaaauauuuggccagcauaacauucugugguuaaacucucaguguuuuuaaucuuuguagggcuauaaauuuuagaacgauauuaaggaccccuguaaaauuugcugagaaaucaaagcuaaagcuguugaaauuacuugacuuaaugauguguguuuucucuauggagagucaaaggugaacuggaggaaacuggugaaaaggguauugugccauugugaccaaaguaggaacuuguguuuuuaguggugugcuugauugaaguuauucuuacuuuggccucuuucuuguagguagagaggaauuuggugguuuuuuuuuuuuuuuugagacaaagucccaaaaugacacggccauuuuuauuuuugagacagggucucacucacauugaccagguuggagggcaauggcaugaccucggcucacugcagucucugcacccccugcaaccucugccucccggguucuugugccucagcuucccaaguagcugagacuaccggugcacgccaccauaccuggcuaauuuuuguauuuucaguagagacgggguuucgccauguuggccaggcugguguugaacuccuggccucaagugaucugccugccucagccucccaaagugcugggauuacaggugugagccaccgcgcccagccaggagauuuuguuagcuaguguuuggcuuuucuccacuaucacugcacuuuccuccaggaucuuuguuaacccuuugcuucccacugguuauacaggugcugcagcagagaacauguuaggcaguuugcugugccucccagguucagggucagugcuucuugaccccugcacugguucuaccauaucagagacaacaagugaagcuuggaguguagagguauugccaagugacucagguuaguaugcugucauuguuugcuuuuucauuuauacagaaguuuuaauuaaaugcaagguaucccaacucuguauuauguauauuuugucaaauacacuuuuuuuuuuuuuuuaauggagauggagucuugcucuuuuacccaggcuggagugcuguggcgcgaucccaacuuacugcaaccucugccuccuggguucaagcagucuucucgccucagccuccugaguagcugggauuacagacaugccccaccaugccggguaauuuuuguauuuuuagagaaacaggguuucaccauguuggccaggcuggucuugaacuacugaccucaggugaucugcccaccuuggccucccgaagugcuggaauuacaggcaugagccaucaugcccagccaguuauacauuugacaaagaugaggugaucacauugcuaagaaugucaaauggaaaauuaguuuagggcauuuucuguccauuaagggaaaaugcucuguuagauagcauagacugugauggcaggugcuuucagacucuguguugaguuauuuugaaagcaauuuucugugauuaucagaguccgugugaaucauugaauuuaguaucuuccacaaacucaugacaggauaagaguagcaacacaguucaaacugagugcuugcuugguaaacacauuuagauuuaucacaggggagaacuugacucucuaaaacaugcuuaauguguuuuugaaauacguugaaauugagauucuguaauccugaggauuuuuuuuuugugcagguuauuauaaauguauauaaaguguuuuguacuuugucuuuucauaugcauugcauuuuuuucugauuaugaagacgcaucuuugcuuucaacuaaaugucaacuaccagaauguaaauauaaguaacuguguaucugcauuacauucuguugauuuacuugguucaagaauuauuaagugauccugauauguguuuuauaauuuuuuuuuuuuuugagauggagucucacucugucacccaggcuggagugcaguggugcaaucacggcucagugcaaucucugccuccuggguucaagugauucuuuugccucagccucccaaguagcugggauuacaggcaccugccaccacgccuagcuaguuuuuguauuuuuaguagagaugggauuucaccguguugggcaugcuggucucgaacuccugaccucaggugaucugccggccucgaccucccaaagugcugggauuacaggugugagcuaccacggcuggccuguuuuauaauguuaaagcauucagauaugcuagccuuguuugaagaccaguuggggacaauaggauuagcuuaccagcuguugaguauucauaggaguuacuuuuuaggaagugguugauuuaauaccaggcuauuccauacucucuuguccaguucacauguuaaucaauagcauacucugugacauuagugaucuagaaccacguuuucaucugugcacagugaacuggcuuauauugggaugaaaaucacaacuuugacuuaacacuuaaucuaacuagcauuaacuaguccagacuuacacauguauuugcacugauuuuauucaugcccugguagcuuuguuuaucugggucacaaaagcugaaauuguggugugcuaagagaaucacaaauguaacauaccucuuaucuucuauuuagaggccccagaccuaaagcaggaggagcgucugcaagaacuggagagcuguucuggacuggguagcacaucugaugauacggaugucagggaggucaguucccgccccagcacaccaggccucaguguuguguccgguaugucugucuuguuuuaaggaguagggauuugaagguguucacccccuacccccuccuauuuauaaaguugauacaaaaagauauguuauauuuaagagcugaguaauuuccagaaaacaaacuuauuuccauugcaccugaaaucuuugagaacuuaauguguggccuuauggagccuguugaaguaauuggcaaacagucucucuacaacuguuucuguucuuaguagccuguccuacuuuagaauuguacgauucugauuauguuguguaaagcaagguaaguauauuuaagcaguaguaccauaaaggauauaauacuaaacucacauguauagaacugggacacaaaauucgagaauguuucaguuucuccaaauuucauauacuuuuuguguggauauuuuguucuucuuccuguuuauuuuuuacuauuguuuuuuaaaggcauaagugcaaccucugaggauauucccaauaagauugaagaccugagaucugagugcagcucugauuuuggggguaaagauucugucacuaguccagacauggaugaaauaacucacgguaagagggggaaaugaggaugacuuaaaaaaugaccacauccgugguugaaacuggcacugugacacauugcuggugacagcaucuguugguauagcacuuugggacauacuuugucaguaucuauuuaaggucuuaaauguucacauucuaaauuuagucagguuaguuccacuucuaggugucagucauaaugaaaaaauuccauguguagagaaaguccuuagcacgaagauguucuuuauaauguuuuguauuggcagaaaacuagaaauaacuuaaaaaauugaaaaguggaauggcuaaauaauuuugauguaacugcuuauuggaauuuauguagcuauuuuaaaaugcauuaaggaauaugaaaugacuuagagaaaaaacuagaacauacuacauggaauuuauuuuguagaacuuuacacacaaaauaauaaaacuucuguuuuuuuuuugagacggagucuugugcugucacccaggcuggagugcuguggcacgaucuuggcucacugcacuuccgccuccugggucugcuggguucaagccauucuccugccucagccuccccaguagcuuggauuacaggcacccaccaccacgcccagcuaauuuuucuauuuuuaguagauacggggguuucaucacauuggccaggcuggucucgaacuccugaccucgugauccaccugccucggccucccaaagugcugggaguacaggugugagccaccgcacccggccaguaaaacauuuuuuaaaaaccuaugcaagaaguaaguacuggaaauaccaaaaugcuagcagugguuuuauauauuggguguuagguuuugagguaccuuuugucuuuuuuuuuuuuuuuuuuuugagacagaguuuugcucuuguugcccaggcuggagugcaauggcgcaaucucggcucaccacaaccucugucucccagguucaaaugauucuccugccucagccucccaaguagcugggauuacaggcaugugccaccacgcccagcuaauuuuguauuuuuaguagagacaggguuucuccauguuggucaggcuggucuggaacccccaaccucaggugaucugcccgccucggccucccaaagugcugggauuacaggcaugagccaccgcgcucugcgagguacuuuuucuauuuuuacaauuuuuuuuuguucuaaaccaggguuuuuuaaccuuaacaccauugacauuuugggcugggaaauucuuuguugugggggccuguccugugcauuuuaggagguuuaagcagcucuggccccuaccaguaguauaugcccuuuacccccugggguugugacaacgaaaaaugucucuagacauugccaaaugcucucuugggggacaaaauagccaccaaucaagaaccacuguucuaaaccagcagucucaaagcauggucuccauggaccacugagguccuaagacccuuugagggaggaguguagaugaagucacaacuguuuucauaaaaaucaaaguuaacuguccauuuucaccgugucgacauuuguacuuacggugcauaggcaaaguggauaaaauuugcuggggcccuagcaggaugcaagggcaccacacuguauucuucacucacaguuaaaaaaaaaaaaaaaaaaaaaaguuuuacuuaggaaugucuuugaugaaggaauaaaaauuacuuaaucacaucucaacccuugaguauacaccuuuuuaauauucugugugaagaaauaggaagcacccauauugcguuuucaccgcauucugagauaugaugagaugucucaagaagcacuuauggauuauuugaguuguuagcugaacuagccaauguuucuccuuauuuuuauuugguuuuucaugaaauauuauuuuuacuuggaagaaugacagauaaacuguauuucuuaugaauacguaauuggguauuuggcagacaucucaaaaauuaacaaaguguggccaggugcguuggcucacaccugugaucccagcacuucgagaggcugaggcuggaggaguccuugagcccaggaguucgacaucauccugggcaacauggugagaccucgucucuacaaaaauaaaaaaauaaaaaaauuagccaggugugguggcgcaugccuguggucccaucuuuaaaaaaaaaaaaauuaacaaaaugauccuguuucuuagagaagcaacuaauagaguggaguuuguugccagugaugaaauucaaacuuuuggacaaaaauuagaauuuuggaaacgugugucuaccugcaugagcuugacagcuuucuguuguuuaaagacuuuucuggugagauugguggugauaugaaaaaugugaauuuagcagaggacaaaaaguucauugauuugguuucaaauucuaccuuguagcuauccuuuaaaaaacuauacuucucaagaugugguagaguaucaaagaauaauauccacaauuuucugaaaaggcuacuaacauauuguuccuuuuccaacuacauguccgugugaggccagauuuucuuuauauacuucagccaaaacaacauuuucaacacauugaagcagaagcagacaugagaauccagcugucuucuaguaagcuguacauuaaaaauacuugcaaaaaaugugucauucucuucauuuuuuauuuuggaaaauaauaguuauuuauuuauuuauuuuuaaugcuuuuuuguguuaccauuaaaauuuuuucuuuuuuuuuuuaaaaauggggcugggcgcgguggcucacgcccauaaucccagcacuuugggaggccgaggcaggcggauuacgaggucaggagaucgagaccauccuggccaacauggugaaaccccaucucuacuaaaaauacaaaaaauuagcugggugugguggcgugugccuguaaugccagcuacucgggaggcugaggcaggagaaucgcuugaacccaggagguggagguugcagugagcugagaucacaccacugcacuccacccuggugacagagugagacucugucucaaaaaagcaaaaaauggacagccucccaaaccagaguagguucagagagacucuuguauuaccauuuaauggguauauuuaaaugaauuaauaaauauuuaaacuucaguuuucuaauauagaauaucaauagauauaaccaccauaaacaaaagcuauuagggucaguaauuuuuuaaguuguaaagauaucuuggccaggcaugguagcucaugccuguaaucccagcacuuugagaggcagaggcaggaggagugcuugagccuaggaguucaagaccagccugggcaacauggugagacccugucucuacaaaaaauaacauaaaaauuagcuggguguggugugcucacagcuauuugggaggcuaaggcaggaggaucacucgagcccaagagauugaggcugcagugagcuauguuugcaccacugcacuccagccagggugacagagcaagacuuugucuccaaaaaaaaaaaaaaaagccugagaccaaaauuugagaacugcuguuuuaguccaucuuuuauaaugaucuaacuauagaacaaaaguaaaaaucaaaaggcauaauaguacucucauucauuaucaaaagauauagcuugagaccaaaaaaaaaaaaaaacaaaaaacaaaaaauagcuucagacuaaaaacauuuagauuaauaauuuuuuuauguuugaaauuuccauccucugcauacuuaucuauuuuaaaguuauuugcugagagcaguguuagaacuucaagauuuacagccuuuuauuuguacgcugucuguacagaguauugccccuauguuuauaauuuauuuauuuuuuaauuuuuaguucuuguaaauuuuuguagagaccaggucucaccaucuugcccagacuggucuugaacuccugggcucaagcgguccucccuccuuggccucccaaagcacugggauuaaaggcaugagccccuacaccuggccugcccccuauauuuucaggugaggggaaggcgaggcucagggaagcugugacauucucaaaacauugaugguuuaggucuuccggcuuuguucucuuugcaugaaccauacuagcauuuggccauuagaaguaacaggcauguagaugccagaccacuuaaauguaaagaaaaucuguguaugaagauacucauaaaaacagaaaaugaauuggaaguaaucauaauuugauuuuuuuuuucugguaugccucucaaguucuaauggaucaaaaaaggaaccgucaaagaauacuuaaaacccuuuaaacuguguugagaccgucuguccugcguccuggcuuggucucacaguuucccuccuguuuuaggugcccaccagcugaccucuccuccuucucagucagagucucugcuggccauguuugauccacugucuucacaugaagguaaaccagugaaaugaacuuuuucacuuaugucacagacaggaggaggaaaccaaauccccuuguuaaugccuuuguuagauauguugugucucaguuacaaaacuuuuuuuccuguguugcaggggcuucugcugugguaaggccaaagguucacuaugcuaggccaucgcauccaccaccagaucccccaauccuggaaggagcugugggaggaaaugaggccagguugccaaacuuugguucccauguuuuaacuccagcugaaauggaggcauucaagcaaaggcauucuuacccugagagacuaguucgaagcaggagcucugauauaguaucuucuguccggagacccaugagugaccccagcuggaaccggcguccaggaaaugaagagcgagaacucccuccagcugcagccauuggugcuacuucuuugguggcugcaccucauucaucaucuucauccccgaguaaggacuccucaagaggagagguaugggacauaggccgugaaaaagaauuauguucugccugccuaguucucuugauaucugaaauuaacauggaauauauaaaucuaggauuacagauagagaguagucaugauuaaagaugauuugucaaucuaugggcccacaaccauaaccgcaggaaaccuguacaacuuugguuuuguagugauacuaucuugcauuuuuaugacacuuuuaguuucucuaagcaauuuuguaucugauuuuauuuaaaccuuacaauaucuuucugagauguuagaugaguuguuuuuuguuuuuugagauggagucacacucuguugcccaggcuagaguacaguggugcaaucuuggcuuacugcuaccuccgccucccagguucaagcgauuccucugccucagccuccugaguaggugggacuacaggcaugcgccaccacacccggcuaauuuuuugcauuuuauuagagacgggguuucaccauguuggccaggaugguuuugaucuccugaccuugugauccgccugccuuggccucccagaguugcugggauuacaggcaugagccaccgcaccuggccccaugaguauuuuuuauuuuaaacaauuuuaaaguuacaaacaaguuggaaguacaauaaaagaacacucccuccccauuugugagcaaguugccaaccugaugcuccaguaccccuaaacacuucaguguaaguuuccuacaaacaagcagauucuccuacaccucaugguacagccaucagcuucagcagaugaacauugauacauuacuaccaguuacuuaucacaccccauucaugugucccaguugucccuguaacauuuuuuauaguaaaaagguucuauucagaaucacagacugcuuuuaguugucaugccuuuuuagucuccuucagucuagaacaguuccucaguuuuuucuugacucauaugaccuggacgcucuugaaauuuacaggccauuuguuuucucgaauguuccucagguuagguuguuugauguuuucuugugauuagacugagguuauucaucuuuggcaggaauaucacugaaaugacacuuuuuuucauugcacuuugucagguagcacaguuuuaauuugucccauuucuacaguguucauuuggauaauuugaggaaauguugucuuccaggcuuugccacuguaaaguuacucuuuuaccuuuauaauuaauaaguauuuagggggagaggguacuuuaaaaauauguaacuaucuguucuccaucaaauuuuuaacuuaccuacuuauuauaucuguggucucaugguuuucugucuuuuaaaaaaauuuguguguguguguguguguguguguguguauauauauuuuuuguuguuguugugguuuguuuguuuguuuuagauagggucuuguuuuaucacccaugcuggagugcaguggugccaacacugcucauugcagccuuaaccucccaggcucaggcaauccucccgcuuuggccucccaaguaguugggaguauaggcaugcaccacaugccuggcuaauuuuuucguuuguuuguuuuuguagagauggggacucacuguguugcccaggugcuuaucuugaacucuugggcucaaacaguccucccaccccagccucccaaguguugggauuacaggcgugagccacccacagugccuggcccaguuuucugucuugguuaggguuugucacuauuacuuauuuugaagcccaguugucccuaauugggccaaugagagccccuucaggcuggcuccugaguucuuuugaugcacugcuacuauucuuugagcauaucuuuacuuucuggcaaaagauguuauaggcggauacuguacuuuguccuaguuagcucuuucucgaaguacccuuauuucuuuuaaugaaaaaugcuuuuuuggaaauugagaucuggauacaguguuuauuugcuguaggaguguugcugcucccaggacuacucagugaauagagcuagggaguguguguguuacacacacauuuaccuguauauuucauuuaucuaccuuucuccauaaauaagaccaugaacuuacacugacacauucaauucuaguccaaacacaacagaguuuguuucgucuuucuuccuuuccaaauuuguaacucauuucuccaacagugagaaaucuacuuucacuauucuucaugggcauauuuauuccaucaguucuccuguauguauucaauuucucauccccacuguuaaguuaacucuucccuggcacagaugcccucaucucucugcuaggguucugauaauucuuuaucccagguauguagaugaaaauggaaauuaagugauuuguccauggucacaugauaggcuauuaaaggaauuacagucccuguccuuuggccuguuuuuuguuuguuuguuuguuuuugagauggagucucacucugucgcccaggcuggagugcaguggugcgaucucgggucaccgcaaccuccaccucccggguucaagugauucuccugccucagccucccaaguugcugggauuauaggcgagcaccaccacgcccggccaauuuuuguauuuuuaguagagaugagguuucaccuuguuggccgggcuguucuugagcuccugacuucaggugauccacccaccucggccuuccaaagugcugggauuacaggcgugagccacugcauccagcuucuuugucauguguuaaugauaacuuaauauaauuggugaucaaaacaugaacuuuaaaguugcuuaggucuagguuugaguccucagcugugccacauauaggcuguguaacuuugaggaagagggggagguaaccuuucuuuagucucauauuuuuuaucgauaaaaaaggccgaauauaggaccuaucucugagguuacuguaaagauuaaaugagauuauacauauccuuacuaugcucagcauuuggcacauaguacacauuugguuuuauuauuauuaauacuacugcuaccaucucuacugcccuucuggaguuuauuuguacugcauuuacuuuuuucauaaguauuuauugagugccuagucuauaccaggcucuguauuaaggcuucaguuuauuaacaguaaugagauagugccugcccucaagcagaugacaguggugcugaaaagguaaacuaccgugcuccaaaagucaccuacguggcaauaagaguugugccuuaaggcaaacaagacugacuuucuuauuucacaaacuuacuuaaauccuuuuuagccugagcaacauaguaagacccugucccuacaaaauaaaaauaaaaaauuagcugggcauggugguguguacaccugugguccuagcuacuugggaggcugauacggggaggaucgcuugagccagggaagucgaggcugcagugagcugugauugugcuacugcacuccagccugggcaacagaaugagauccuaucucaaaacaaaacaaaaacaaacaaaaagaaauccuuuucuuaguaauuuauccugcuauccaacuccaaauaaagccuccaacuuuuucuacagacugaagaacgcaaagauagcgaugaugagaaaucagacaggaacagaccuugguggagaaaacguuuuguuucagccaugccuaaagguaauuuuauaaaauauuagaacgcuguauuagcaauaagaagcaaagccccagaaucucuuucagagagccaaugucucaacuccucuguaagacuugcugggcuuaaguuucuagcuacuuugaggguguagaaagugguuccacucagaugaaugcuaaggcagagcuuuagaaauguucuuguucuuugcaggaagugauagugguuucauaaauggaagucaugccugucacuauuguuuaaauaucauauaccauugaaguuaaacauauagaggacuucugacauauauauugcuauuaauuauugcaggaaaaugggacguuauugguaauuaaacauugaaaacucauccuuuacauuccuggaauaaguugaagcuuuuuaugucuauguucauugagaauguuuauacuguaaauaucagugaguguuuauuuuggaagguagcuguauaaaauuguuuacuuuuuuggugaacagccuggcaucauuugaguuggcaaaagcaucucuuccugaaagaagagagcauccaggaguaaagcuagaaacuuauuccaaaggccucuucucagcacgguggcacucaggaacucuggggagagcugcuuucacgccauacucaagcgcuugaugaggaggagagaaugaagcuaggaguuuugaauguguuuuugagcagagguuaagagucagugguuuugauuuuagucccaauggauuccuguuaaauuauucuuccuaugacagaugacuccgaagcagguucugaaaguuccuuuaaaaaccuucauuacuauuuuaaggacaauuaucagucaacacuuggaauuucuuagcuuuuaaacuuuucagccuccuuucacuuagaaauguuggcacaccaguuaacuuccgaguagugcaguauguuauaugucacacuacugacuuuauuuaauuuccagcuccuauaccauuuagaaagaaagaaaaacaagaaaaagacaaagaugaucuggggccugacagauucucaacacucacagguuuguagacccauggacuuccuggcuccuucauucccagagcacauauuucauaacacuuuuucuugggugccauaagcguugccuuucuagaagagugugucuguguguacaguggggaguauguucuucauagcucugugguuuccaguugguggccacaguaaaccugugugcucuuccugcagacugccaccaccaucaucauccucauuaucauaacuccguuuaugaugaggccccugauccugagccucuaggcauacccuacaacucaacaucuagugggaugaugacacacagugccuuuuaggaaaguguggugacaguuuuggugcugugcaugcuguaucuuuggaucauugauugaauaguuuucucuaacauugaucguagaauucuacauuuauuuucaucuacaguuuguucuugauuauucaggaucacagugaaauucuguuuuaccuaaucguuuccuuuuuugugauaaaguguuuguucaaacaguaucauaaaugccaaccauuauaaugaaaguuuuaaaaacuuuacuaauuuuuuacagcuugaaccauuuuaacauugccaucugacccaaggaaaauacagcuggggguuggguuuuuaccugauuaagcguuuguauuucugcagcugcuuuuuggcacauuaugaaugagcacccuaaaaggacaguuugagaguaguguuaaugacccagucuuggguuugauagcuguguauuguuuccaguggcuauuauagagcaucuugagcaaguuuguucaacccacggaccgcagaccacaggcagcccaagacagcaggacagcuucgaaugcagcccaacacaaguucauaaacuuaaaacaguaugagauuuaugcaggaacccuuuuuuuuuuuuuuuaagcucaucagcuaucauuaguguuaguguauuuuauguguggcccaagacaauucuucuucuuccaguguggcccagggaagcuaaaagauugaacaccccuggucuagaggaaaguucauuucucaccucuuuuuuuugauuuugaauuguuuuccuacuaaguuaaagugaaaauuuuuuucauuaaacaauuuuauuuaaaaaugggauagauaauaggauaagaacauccucaucaaagaguucagcauuacagguagaaucccauuuuaaugccuauuauucuaaugguugguuccauauauuuauauguauuuccauauccuagcauauaaguccuugcuuuauuugaaauggugauuuccccagaauaaaggguuuugaacagcaggagaugugcuuacaggccacaguucccugcugagagcagcuaagccuguccuauucaaucaguaaauacuuguugaccaugugacucaugccaggcacugugcuaaguguuguggguauuaagucaaaucacacaugacucuucaggaccuuccagucugauugggaagagcuggaaagacauuguccuuuuggcaaaguauuucuguauccuuacgacauguuccuaauguuagaagaacacuagcguuuacaaagugaauuacucuuaaugacaucucauguuuuuaaaauguugaaucaacaauucugaagaaguuauaaauuauuauuaugguuuguuuguuugaaggaguuauauuuuacuuauccucuuuaggcaauauauuuuucuugguucuugauacuggaacuagaagcuaaguagaguagaauaagucuuuuucauaaaguaauuuauuuucuuuggcugugauucaagcagauuagcuuccuuacugguccagaaauuucuacccaguccuuauuaaugacucauugaaaguuuucauuaaaccaauuuaaaaauguuauaggaggaaauuuccuagcagucuguucauaauucugugacccuaacuacuguucuuuuccuguuaucuccuaaucuuuuuccauauuuguacguggcuuuuucuugacugaauuagauuaugcaugugacuuuguauucuucuuuuaccaaguuauuuuauaaaaccucccccaauuuuuagacauaguuggguuuuauaucauuuuuauuagcuauaaaauaaucugucaugguuuuacugcaguguaaacguucucuuacuaauggcuauuuaaauuguucccaauuuuuuauuaugaaaauauuacagauuuauauaaauugcauuuuuuguuuaauuauucucuggggguaaaauuuuuaagaacaguguuaauagaaauaaagauuauaagcaacauuguggcucucacuguguuuggccauaauguauuguauugucccuuuuucagaccucucaacagcacugaaaaguaauaaccaacugagugagguggagcaugccuauuaucccagcucuuuuugggaggccaaagugagaggauugcuggaggccaagaguuugggguuacauuaagcuaugugccacugcacuccagccugggugacagagcaagaccuuguuucuauuaaaaaaaaaaaaaaaggcaguagccacaacguacuuccccuucaaaacaagauucuguaaugauaaaugcuuuaucaguuuacauuuggagacagaucagauuuuauuaagaaucucuuaugaauucaaauacuguuauagcaaaaauacuaaauuacuuugggaauccugucuauauacaauuguccuucagcauacucagggaauugguuccaggacucuugcccccccacuucauacccuaauccgugcauacuggaguccugcaguuggcccuguggaaacuguguaugugaaaaguuggccuucccuauaugcuuguuucacagcucugugugaaauguaguguuuucuuuuucuuuucucucucucuuuuuuuuuuuuuucuuuugagacaguaucuugcccugcugcccaggauggagugcaguggcgcgaucucagcucacugcaaucucuaucuccuggguucaagugauucuucugccucagccucccgaguagcugggauuauaggcaugcgccaccauguccagcuaauuuuuguauuuuuaguagaguugggguuucgccauguuggccaggcuggucucgaacuccugaccgugggugaucugcccgcaucggccuccaaagugcuaggauuacaggcgugagccaccgugcccagccuaauacaguaucuucaaucugcauuugauugcaaaaaacuguguauaaauggaccugugcaguucaaacccauguuguucaagggucaacugcaguuuacuacaauuucacggagacaugaauaccauguguuuguuucaugagaacaaaagaagagccgaugagcaugcuacuuaagcugucuaugucuugauuucgucuucuguaaaaugaggaugauaacaacguuucucuguaagguuguuugaucaguaguugagauaaucucuguaagguacuuagcacaguuccuggcaugugguaagugcucaauaaauguuagcugcuauuagcugcuggaaacacaacacacacacacaaaauacguauauguauauauacacauaaguguguguguguguguguauauauauauauaaaaucuagugauuucgauguguuuguauaauuuuuagaaaaugggauucuaccagaaugugaacauuuauggucaccugccuggccuaggacuaacccaggaguuuguguuucacuauggaacuuuguccuguagaucuauagcaaucccuugcuuuaacaacccaguugacuacuauuuuagauuccaggauaauauuuuugaugugcugauuuugacagaguaaugguccugucaguaaacagugcugcauuugugauugugguacguuuuuucucuaugcaucucagguacaauuccagcacuccccaagaaugucuagauucucuaggagugccucugacaucauugcaugcacaaaagugcucuauuccagcagcagcacugucauggugagaucuagugagauagaauaugaauauuguuaguuuucaaaugcguggagagagauucauaaaggaagaauggaaaaagacauuuguuauuauuuaaagggguuuaagucuaaauuugaauaguuuuuuuuccuccuucagcauagagaugucugaauaaaugaagucugcauguaaaaaugcacuguuggaaguucuguuagcaugaauugcugauaacagugauuugagugcaaacacuuuagaaauccgucauccauucagucugcccugaacuuugacacugucauucuggugaugaugagaagguggagcuacucuucccaauuuccugcuuuggcaaggcucucagaccuagaaaugggaugaguaggcagcugcauggugccucuuaacauugagauaugugcucuuuuuaagucuuaccuccuaaucugccuuugggauuaugcuacuggugucauacuaacaucagaggugguacaaacccaaggggcuaauucucucacucuccuuucccuugcagaugaucccagcccuagacucagugcacaagcucagguggcugaggauauucuggacaaauacaggaaugccauuaaacggaccagccccagugauggagcaauggcaaacuaugaaaguacaggugauaaucaugacagagauuugaguaguaaacuuuuauaucauagugauaaagguaaucugaauuuaaguggccuuuaaaagaaagaauagcuaagggagucaguuuacuaccucaaaauuacagacugccuaaacaaauguuuaaauugauguccuucucuggauucucccacuagcccuggguaccccugaauguucaaaugccuuagaguuguccuccuuugcaucuggggugacuggcccacagagaguuggggcauauuuuaaugggaggagguucuuuuucaaugucuacagcuuuguaauuuuauccaguuaugcacucucaauauagcugugggagcaacuugucccaaaagggacaaguuauccauugucaccugguacuuauuuuaaaggauucuguuuuccucauaauagaauacugaauagcuuucagaaaaaugagauauaguccccaagauaaaugaagagaaaaaguguauaaaaguauaaauaggggcugagcacgguggcucacaccuguaaucccagcacuuuggggggccgaggugggcagaucacuugaggccaggaguuugagaccagccuggccaauguggcaaaaccccaucucuaccaaagauacaaaaaauuagcugcaagugguggcagaugccuguaauccucagaugguugaggcauaagaauugcuugaucccaggaggcggagguugcagugagcugagaugacgcuuacugcacuccagucugggcaaaagagcaagacccugucucaaaaaaaaaaaaacaaacauaaauaguauacugcauaaauauguguuuaugcuuauaugcacguagaguaucuccuggaagaaucucccaacaaacuggucacaugaguuggcucugaggaagacuccuaggaagccucagagggagagugggcagaaaggagaacuuccuguauuuuuuuauuuugaauaguuuccaaauagcagaagaauugaaagaauaauacaaugaagguucaucuacccucuaucuagacuuaucaauucuugacauuuugccacguuccgccauauauagagaguguguguguguguauauauauauguuuuguuuuuguuuuuguuuuuuugugagacagucucacuaugucacccaggcuggagugcaguggcacaaucaugguuuacugcugcagccucaaccuucccaggcuaaagugauccucccaucucagcuuccugaguagcugggaccacaagcacguuccacugugcccagcuaacuuuuguauauuuuuguagagauggggcuucgccauguugcccaggcuggucucucccuauauuuuuuccugaagcauuugaaauuauuuccgaagaauaaggauauuuucauauaugaacacaauauauuuauuauauuuauauauuuuuuuguagaggugaggucucacuauguugcccaggcuggucuugaaauccugagcucaagcgaucuuccugccucaugccuguccaaacuuuuuauucguuuugauuguauacauguauguguuguauuauauguucuuuugugugugugguuuuuuucgagauggagucuuacuuuguugcccagguuggaguacaguggugcaaucuuggcucacugcaaccuccaccucccgaguuuaagcaacucuccugccucgaccucccgaguagcuggaccacaggugugugccaccauacguggcugauuuuuguauuuuucauagagacaggguuucaccauguuuuucaggcuggucuugaacuccugaccucaugugauccacccaccaaagccucccaaagugcugggauuacaggugugaggcaccgcacccagccguguauucuugauuaagacauaaaaccaacuuuggaaaccacagaucugacuuuguugcaugugugauuuggucccuugacucacucuuggguguagcaggaagaccuccaguagagagaaucaggagaccuuaacccauagucaaccuuggccauuggccaaccaagaaauuuagagcaagccauuuucugacugggcaggaguccaugucuauaaaaugaggguauaaaaugauuuuugaagccucuuuuaguucucugguucagugauucuaagauguuaacuuuauuaaguuaaugugaacuuucauuauuuugcauuaguucauuguuuugcauuaguauugggauaagaaguaaaaccacucucuucucagcaacuagucucuugauacauaauuguugcuauugauaauucaguuaaguauuugaaguuuguuuuuucuuucuuuuuuuuccagagaacucuuauuauuagucaaugguaauuuauucuugaguugcucugaauaccuacuagugccauaauauuccaaaugaaccuggguauccguuucuuggggguggguuuuguuuagagguuaugggugauggugaaagugcacaugauucuccccgugacgaagcacugcagaacaucucggcugaugaucucccagacucugcaagccaagcagcccacccgcaggauucagcuuucucuuacagguauuucuuuuauaggauuugggacuuuaggguuuggacuuuucagcaccauugcagucacgucaagucaagugauguuuugagucaauaaauguauaaagcagggagagaaaaaugaaaugcuguuuacuaagaagacuuuguuucaguuguagauguuauguaucaaagguguuaauucaaggauuuaaaaaacucgcugggcgugguggcucacgccuguaaucccagcacuuuaggaggccaagacagguggaucgcuggagcccaggaguuggagaccagcuugggcaacauagcaaaaucccaucucuauaaaaaagaaaaaggaaaaaaaaaaaaagaagaaaggguuucuugucagguagugagcuuauuuuguggcgucaucagcguuucuaaagagaugugccagaaggcauuccaaaucuggguguugggagcuucugacuuccguggucccucccacucugccauaauaugcuuuuccgauucuuauagcacccgucauggaacucaguguaugaaaaaaggucagaaaggauuuguuguuugauucuggugcuuuaaagaaugguccuugccccgagcacaccuggcuccuuggguaauuagaaagccuguucuuuuaaguggagugucaguuaagaaucaucuucuuuaaaauguuugaaacauuugaguccuaagguaacauuaauuuauauaguaaauauuuguaaaaugugaccauaucuggauaaagaaauuaauguauuuucuacucauuuuucagagaugcaaaaaagaaacugaggcuugcucuuugcucugcggacucuguugccuucccagugcugacccauucaacaaggaaugguuuaccagaccacacagacccagaagguaaauugcugcaggaucguuuaauuuuuccuauguuuauggguugcaccauaugaaauugccaguauucagcuguugaagcuguacagcaauuccauaugguucaacuuaauauguuuacauuaguaucacuuaagggcacuuugauuacugaugauuuauuaaaguauuuucuaauugggaguggcaauacagcuuaguucuaaugauacgugacaaagcagaauugacgucccaaaugcugaauuagcuuauuuaagcacauggaaauucucaagaauaacagaauucuuguaucuuuuauuuagacaaugaaauuguaugcuucuuaaaaguucaaauagcugaagcaauuaauuuacaagauaagaaucuaauggcucaacuucaagaaacaaugcgcugugugugccguuuugauaauaggacuuguaggaaacugcuggcuucgauugcugaggacuacagguaauauaccccaccuguucagcuuuuaaaccuaguuguuagcugcaaguguuuucuuuuuuauccuuauuucagaaaugaaucuaggcuuccuacaaagugcuuggcuguauuuuccuggauguagauuucuguguuagucuguucucacgcugcugauaaagauauacccgagacuagccaauuuaccaaagaagagguuuauuggacuuacaguuccauguggcugggaggccucacaaucauggcggaaggugaaaggcacaucucacauggcagcagacaagagaagagaacuuguucagggaaaccccccuuuuucaaaaccaucagaucuugugagacuuauucacuaucacgagaacagcacaggaaagaccuguccccauugauucaauuaccucccacugggucccucccacaacacaugggaauucaagaugagauucggguggggacacagccaaaccauaucuuucugccccuugcuucucccaacucauguucucacauuucaaaaccaaucaugccuucccaacaguugcccaaagucuuaacucauuuuagcauuaacucaaaaguccacagucaaaaauuucaucugagacaaggcaaguccuuucugccuaugaaccuguaaaaucaaaaucaaguuaguuacuuccuagauacaauggaggugcaggcauuggguaaauacagccauuccaaaugagaaaaauuggcagaaacaaaggggcuacaggccccauccaagucugaaauccagcagggcagucaaaucuuaaagcuucaaaaugaacuccuuugacuccguggcucacauccaggucacgcugaugcaagagguggguucccauggucuuucuuuuuuuuuuuucccccgagauggaauuucgcucuuguugcccaggcuggagugcaauggugcgaucuuggcucacugcaaccucugccuccuggguucaagcaguuccccugccucagccucccaaguagcugggauuacaggcaugcgccaccacgccuggcuaauuuuguauuuuuuaguagagaugggaugucaccauauuagccaggcuggucuugaacuccugaccucaagugauccaccuaacucagccucccaaagugcugggauuacaggugucagccaccacacccagccaggguucccauggucuuaggcagcuccgcuccuguggcuuugcaggguauagccacuuuucuggcugcuuucaugggcugguguggaguugcuggcuuuucuaggugcacggugcaaacugucaguggaucugccauucugaauucuggaagacaguggcucucuucucacagcucuacuaggcagugccccaguagggacucuuugugggggcuccgaucccacauuuccuuuccgcacugcccuugcagagguuccccaugaggacccugccccugcggcaaacuucugccugggcauccaggcguuucuauacaucuuuugaaaucuagguggagguucccaaaccccauucuugacuucugugcacccacaggcucaacaccucauggaaucugccgaggcuuggggcuugcacucucugaagccacagccugagcucuguguuggccccuuucagccauggcuagagcggccggagggcagggcaccaagucccuaggcugcacacagcauggggacccugggccuggcccaugaaaccauuuuuccuccuaggccucugggccugugaugagagggucugccauggagaccucugacaugcccuggagacauuuuccccauugucuugggaauuaauauucagcuccucauuacuuaugcaaauuucuauagccagcgugaauuucuucucagaaaaugggauuuuguuuucuaucgcauugucaggcugcaaaguuucugaacguuuaugcucuguuucccuuauaaaacuguaugcuggccagcaugguagcucaugccuguaauccuagcacuuugggaggccaaggcagguggaucacccgaggucaggaguucaagaccagccuggcugacauggugaaacucugucucuccuaaaaauacaaaaaauuagcuagguauggugguggguuccuguaauccuagcuacuugggaggcugagacaggagaaucgcuugaaccuggaagcggagguuacagugagcugagaucacgccacugcacuccaggcugggcaacaagagugaaacucugucucaagaaaaaaaaaaaaaugaauaccuuuaauagcacccaagucaccucuugaaugcuuugcugcuuagaaauuucuucugccagauacucuaaaucaucuuucucaaguucaaaguuccacaaaucucuagggcaagggcaaaaugccaccagugucuuugcuaaaacauaacaagagucaccuuugcaccaguucccaacaaguuccucaucuccaccucagccuggaccuuaucguucauaucacugucagcauuuucgucaaagccauucaacaaaucucuaggaaguuccauacuuucccacauuuuccugucuucuucugagcccuccaaacuguuccauccucugccuguuacccaguuccaaagcugcuuucacauuuucgggugucuuuuuagcaguaccccacucucgguaccaauuuacuguauuugucuguuauuaugcugcugauaaagacauaccugagacugggcaauuuaacaaaagaaagagguuuaauuggacuuaacaguuccauguggcuggggaggccucaaaauuauggcggaaagugaaaggcacauuucacauggcagcagacaagagaagagagcuugugcagggaaauuccguuuuuuaaaacaaucagaucucuugagacuuaguaucacgagaacagcacaggaaagacaugccuccaugauucaauucccucccacaacacauggaaauucaagaugagauguggguggggaauacagccaaaucauaucaauuucuaagcaacauauuuggauauuuacucuggaaauguaguuacaaaugagcaguuccaaauagaagagugcaauuuacuucagcuuugcacaaaagcagguaaagagguaugccuauauuuugaggcuagaacaacuagaauaucauauuucuuuucuuaguggugauaggaaagccuacuuuccuggaccagagaagcagauguaaguagccuuaggaauugcugugcuuuuucugcugccaguccccugcucaugauuauggagaaaaauguaacugagaugcuuagguagugaggaggcuucaaggcuuagggaaugggcacucuaguaaaugugacauuuagacuauaagcaaguaauuggugggggauguuugugaccuagugacauauaaccuguauuuguuguuauuguuggucaucuguagcugucaauuuccuauuaaguaugagguccuauagcuccaguauaaaauacaccaaguaugcagaggggcuuaguaacauuuagugaauuagguaacuaagucuucagccccauagauccucccaaacaaaaugcaaaaugggugucuguucugcagcuggcaccaugaucagucucuaccaugucugcagccugacaugcuacuuuguauaugugcuacugaagagagcacagacaugcuacuuuguaaaaccagucugugcaguaauuuuucuaaagaaaaguuaggacccuuauucuucaaagagaguaugcacugaauauaucugaugucaugcaaaguauuuuuccuuuuagaaaaagagccccauauauugcuuaucucacucguugucgacaaggacuacagaccacacaggcucaccuggaaaggcuauugcaaagaguuuugcgggacaaagaaguggccaaucgauacuuuaccacugucugugugagauuacugcuugagagcaaagaaaagaagaucagggaauucauucaagguaacucaauaccuuuaguuuaagcaucucuucaccuguaauacuguugggaagauuuagaaauacuguuuuguuuugcuaguuuguucaaguaucugcaugccuuaaauacccaauuauuuuauggaaucuuaauaaauuaaacuuugaugucaaaccaauaaauugcauuuuucuccuggauugaauaucuguagcuuacuuuuuaaauuggggacauugguaaauuuuuggaucuauacaaauuuucucauuuuuuuuaaaaagccaaacauauuuuuuuuagaaacuuuugagacggagucuugcucugucgccaggcuggaguacaguggcgugaucucggcucacugcaaccucugucucccugguagcugccucagccucccaaguagcugggauuauaggcacgugccaccacgcccagcuaauuuucauaucuuuaguagagaugggguuucaccauguuggccagaauggucucaaucuccugaccucgugauccgcccaccucggcuucccaaagugcugggauuacaggcgugagccacugugccuggccuagaaacauauuuuuauaacaaauuccuugcacuuaaacuuucacauauuucuugcuuuuucuccugauuuaauuauauggcuacauauuguccuaaaauaaacuacacugaaacacuuuuggcuuuaagaucauggugucugcauagcuagugauuaaaauuauuucuaugauuuccuuuuuaaaauuauuuagauaguuuuuauuaaacuauuuaaaaauuauuauuuugcuuuggagacuuucagaaacucaccgcagcugacgauaaaacugcucagguagaagauuuucugcaguuucuuuauggugcaauggcccaggaugucauauggcaaaacgcgagugaagaacagcuucaagaugcacagcuggccauugagcgaagcgugaugaaccggauuuucaagcucgccuucuacccuaaucaagauggggacauacuucgcgaccaguaaguacuucuauguugagugccuauguggaacuacauagggaucuaccagguagcccauauuuuaggcaagcuauacguguaacuuagugucugauuguaaaaggaaauucauugguuaccauuuuucaccugucagaguuacaugaucacaaagaauaauacccaguuuucagggaugugggcagucaagcuggaaggaguagaaauugguauagccucuuuggaaagcacugcuguuuacucugccuuaacuaaucuucccuuccuucucgugauuaagucuuacuuaugcuucaggucuugacuuaaguaucguuucccugaugaagccuguccugacuagguuacauccuguuagggcucucucaggccucggugccuuucuuuaguacuugccacaguugccauuugacaucuguuugagucaugguuucugaacccagcccuacuaacauuuggggccagauuguugaugaugugggaggcuguccugugcauuauaggaucuuuaggagcaucccugaccucuacacacaagaugccaguaauaccccaccaguugugacaaccacaugucuucagacauucccaaaugucccuugugggggcaaaauucuccccuguucuuuuuuucuuuuucuuuucuuuugagacagggucuugccaugucacccaggcuggagugcaguggcaugaucacagcucacugaagccucaaccucccaggcuuaugugacaagugauccuccuaccuuggccuccucccaaauugcugguacuauaggugcacaccaugacaccuggcugauuuuguuuuuauuuauuuauuuagacagagugucacucugcugccuaggcuggagugcaguggcgugaucucagcucacugcagccucugccuccugggcuuaagcgauucuccugccucagccucccaagcagcugagacuacaggcaugugccaccaugcccugcuaauuuuuuuuguauuuuuaguagagaugggguuucaccauguuggccaggcuggugucgaacuucugaccucagaugauccgcucgucuuggccucccaaagugcugagaugacaggcaugagcuguugcgcucagccuuguuuauuuuuuguagagacgaggucuugcuguguuuccgagguuggucucaaacugcuagacacaagcgauccuucugcuucagccucccaaagugcugggauaagagcuaggauaacagggcaugagccaccaugccuggccucuccccuguucuuaaucacugguuugugugauccuuugaugaauguucucuccacacugccuuauucccucugcgagaccaggaaauaaugcuuuuauuaaccauucuaacagcaccaggcacagugguuggcuucuaauauaugcucauuauauauuuauuaagaaugaacaguuggucgggcuucauggcucacacuuguaaucgcagcacuuugggaggccaaggcagguggaucaccugaggucaggaguucgagaccagccuggccagcauggugaaaacccaucucuacuaaaaauacaaaaauuagcugggugugguggcaugcguguauagucccagcugcucaggaggcugaauagggaggaucacuugaacacaagaggcagagguugcagugagcugagaucgcgccacugcacuccagccuaggcaacagagugagacucugucuaaaaaaaaugagagagagagaaugaacaguuaaguauuugaauaccagaaaaugcuuggaauuguauggcuugugaguuauaucucaauaaagcuguuuaaaaauauuaauccuggcugggcgcaguggcguaugccuguaaucccaucacuuugggaggccgaggcagguggaucaccugagguucaggaguuggugaccagccuggccaacauggugaaacugugucuguacuaaaaauacaaaaauuagccaggcaugauggcucacaccugucaugccagcuacuugggagacugaagcaggaggauugcuugaacccaggaggcagagguugcagagagccaagaucacaccacugcacuccaaccuggacaacagagcgaagcucugucuuuaaaaaaaaaaaacacacacacacacacacacaaaacaauuaaucuugggaaaaauuaaccuggaauaguaauagcgauuauuuuuggguaaagagacuagggaagauuuugcaguuuuauuuuuccuccucuguauuuucuccuuuuuuugagauagucucacucugucacccaggcuggagugcaauggcgcaaucuuggcucacugcaaccuccaccucccaaguucaagugguucuccugccucagccuccugaguagcugggauuacaggcacauggcaccaugcccagcuaauuuuuguauuuuuaguagagauggguuuucaccauguugcucaggcuggccucgaacuccugaccucaagugauccacccaccuuggccuccugaaguacuggguuuacaggcaugagccaccccgcccggccuucuguauuuucuugagcacugcuucauaacccuguuucugaccucaaccauguuaaaguuguuaccaugcuucuuaacagugacaguggcuuacugugccugacucccagggguccguguaauaggauccucgggguguggguuauguuuguaugaaauauuuuucauggagauuuucagauguugcauagauauuugagagaauucacuuuccugugaaguggguuaggauccuuccaaucugccuuccucauuuguuuauggucucacaguguuuggcccaccccagacuucugugcuuaauaugccagauggggccuguuuucucuccagagcacuaguuuuugccuuuaggcauaggauaaggaauggggacauucaaaccauauagacuacaaacagcaacuuugaaggagauuauuuuuccccacccuccguggcauuucugugggguuuauagaggguggaaagccaaaagaggaauuggaaggaacacgagcagccaggaagcuggguucagccccuguuacugacaccuguguagcuuaggcaagccuuuucccuuuuuaagccuacuucucuucaucuacaaagugaaagguugggugaaugguggaggcccuucuccauguaauuaauaucuuugguuucuggcuuuugauccuucuacuuccucucacuuuuucccccccucuccuuuuccucuaccuuacaaaauaauguguccaagcagcuccuaccaagggcuccucuccuuucuuccuugcagugcugucugguccagagaggaaagacucccuccccucccugcauccccuuggcucacucagcauuucugagcagauuagaaagaauacuuaucuaagaggcucaacucuaacuguaauccauaucuagcuguaauccauaucuagucaacauguuucacguguuuuguaaaaaucaaugaugacuguuuguguaccauauuuucugaaaugaauguuuacauguguauuuugggggguuuucaggguucuucaugaacauauccagagauugucuaaaguagugacugcaaaucacagagcucuucagauaccagagguaauacagguuuauauagcauggguaauguuaacuaaaugcugcguguuauuauaccauauaauguuaccacguguucaaggaacugaaaugugauaaaauauaaaacaucauuuucacucuauguaauucagucuaacugcgaaguuccugaagaugcuuucagggauuaaaauucccugguaugaaauaguagaaagccaguugugaggagcccuuccuugaugccacuucucaagucagcccugcucucaggggcaguaccucuccaucagugcuuuuauagucagguuucuacagaaauguuuugaagaagugggaggcugauagcacuccaaagagugagauaugcugucucaggagaggucauugagucugcaugugaucucagauuaccuuuuagucauugauauuagcauuuuuaccuguccuacaucucuuagaaaauaagaaaacaugaaaauuucagguauuugagcuuucuguuuguuuuuguuacaacccccacuaaugagacaugaauuagcauaaaauuuuaaauuaucuuuaguuuuuugaaucuguuauuucuggaauuacugcaacaaugguacauauuuuuaaauuaaccucuuuuaucacaugugauaaaucuaguuccuguguagagccaguuuaagcuaguuuuaaggaaaaguccucuuuuaguaguuuguacuucuggaaucagcuacuaaauguagagaaguuccauucuagcuauuuaagaaagagaaugguuugaaauuuugugaauucuagcuucugugcuguugaaugcccuuuuucuauuaauggauaucugguuugcuguauuuuaaaauucagagcaacuuauuuaaaaguucuaaaguuacaaucuuuagugaaggggaaaggggccugcaauaugguuuuaccaaagagaggaaaaagcaaccacauuauccucugccuccugacacggagguugcaguagucacugcgcaggguugccacuggauucagaaucuguauauugucuauggucucacuuagguuuaucuucgagaagcaccauggccaucugcacaaucagaaaucaggacaauaagugcuuauaaaaccccccgggacaaagugcagugcauccugagaaugugcucuacgauuaugaaccuccugagccuggccaaugaggacucugucccuggagcggaugacuuuguuccuguguugguguuuguguugauaaaggugggccccuuacuacuaucaguuaaggaguuauguggcauucugagcagguggcacagggcuucacacaaccauagauaucuuggcucuuuuccaagucacaagcucuggguuacucagaaagaaagugccuaaugucaagauuuguucuuuugagacagaaucucacucugucacccaggcuggagugcaguagugugaucucagcccacugcaaccuccaucuccuggguucaagcaauucucaugccucagccacccaaauagcugggauuacaggcgugcgucaccaugcccagcgaauuuuuuuucauuuuugcuagagacaggguuucgccauguuggccaagcuggucucguggucuccagcuggccucaagugauucgcccgccucagccuccugaaguguugggaucauagacaugagccaccgcgcccagccaagauuuguucuuaccuuaggauuuucgaaagaaaggaugggaggacuagauuccuagaugaacauuuucagcuaaaaagcagugccuagguugggcgcgguggcucacgcuuguaaucccagcacuuugggaggccgaggaggguggaucacgaggucaggaauucaagacuagcuuggccaagauggugaaaccucaucucuacuaaaaauacaaaaauuacaggcuccuguaaucgcagcuacuuggaagguugaggcaggagaaucacuugaaccugggcagcagagcuuguagugagccgagaucacacugcugcacuccagccugggcaacagagugagacuccaucuuaaaaaaaaaaaaagcagugccugaaguucuuaguuggggcucaguauauaauuauuggaugaauggaugagggcagguucuuuauauuauacuuuuaccaucuucuuuaauauggaauuccuugcaguacuugucauauaggcuaccaaacuuaccaaucuccuuccucuuuuagcuucuuauuuuguaauuguaguauaaaaguacugacaucucuaguucuuguugacuuuaaaauuaaaguuucaucauuuaaaugguuuauuuugaacauuuugagggugaccauguaguuugggugcacacagccacuaagugaucguaucacuuguguguugcagucagcucagcccagcuguugcugucuaaagugugugugacauaugucuuacuauuucuuaguguugugauauuucuacaaccugaacacuuagcuuggagggagaaacccaugggguuggucgucacagcuccuccuguuggccaucgcucuucuggcuuccacaugugauaaaucuaguuccuguguagagccaguuuaagcuaguuuuaaggaaaaggcccuagcucuuccucuuaaccauuuaacagccugugcccuuucucaccacaugaaaaagguaaaaaaaauucaggagauguccucuguuaccucuggcaacagagggcaugucaucuuuuuuaguuuuuucuuucucagcuuauucucccuggacuuaccagauauaacucaauuugccuacagcauuuauuuuguuaucuaacauucugaaauccggggauguugaguaagaccacagagauuaguucagccuucuuagaaaucagugagguuaaggacuugcaaggauagaaaccucuagauagauuagcugagauuagaaccuggguugccuuuccagcauauuauugcuacucauggaaacuaggguucacagauuacuuccaaaaaauaacuuugggguuguuuucaaaaggauugguaugucuuucauagaagaacauucgaagaacacuuaaaugauuuuggcagagcuaugacaucugaguaauugauucuuuuuuauuuuucacuucucuaggcaaauccacccuguuugcugucuacugugcaguauaucaguagcuuuuaugcuagcugucugucuggagaggaguccuauugguggaugcaguucacagcagcaguagaauucauuaaaaccaucgaugaccgaaagugaccaagaccaaggcccaccaaggcagcagacuguuaaucagacaaacagaucucugagaaggugcaucagcugcuuugaaggcugaagauuguuuuguaugauacugcacagcaucaggcauuuuaaagcagaucuuuacuaaacagguuaaugagcuaacaagcagguucucucgucuuugggcucuuuccuuucugaguugcauauucuauuuucuuguccccaaguagagacuaguacuacaaaaagggaccacauuuuucaaguauuucuaaguauaaaaaacaaaacaaaaaucucuuaggaaaugucuagaccuccauucuuggauucccuuucuuuccuuuuauuuuaaaaaagaacaguaccccucuuuuaagaugcugucuuacauuaaugagcaucuaauggaaagaagguaugaguugcacugaggauuagaauaguggugcguuaguggcauuaucuauaaauacacucaccuaaauugaaagcuaagaaggaaauguaaauauaauauauauuuauauuugauguaauauggacaucugcagauucuaauaaacaaggacuauugcugauaguaggcugugacauacugucuugugaaaugguuuccuugacaaaauuuaagcugagcuuaaaagcaaaaaacaaaaaguacacagaaauauuuauuaaaauguaauacaguuuauugaacuuucuagguauggaguuugauggacagggcugccuuuaaugagugugaaggucacuaagucacuuagacaucucaccguggaaguuugugagccugcauuaggagauagacugauuaccauacaugacauaaaaaggaacaguggauagcucauacuuuauggugguucuucuccuccgaaauaauauacugcagaaaucccagacagagcuccuuacaaaccuuuaauuguaauauauuuuugaugauuauucacauugaaugcacagaccaagaauucagugaaugucauuuuuuaaaaaacuaauuuguauugucugcucuagugauacaaguuuuacuagugauaaacuauuuuaaucaaccauacuauucuuauggaaaaaaauaucuauuuuggcagguuucugugccuuuauuucccucuucugaaaaaaagucuguguuuucauaguuugguuugcauuguauaucaauaauuaaucaggaauggguuuuggugccugaaaaauuggccauggaggcacaccaaagcuucaagcacaagucuuguacaugggccaucacugucugguuucacuucguguguuuccuaaacacauuuagcugcuuuuuuaacaaacucagccccauacuugagucccuuguuguugggagcauuuccaggcaucuuuuaagggaacugugacaaacagccucgggcagaugaacacggaggcucucuguugucugucucugagaucuuugugucugggaaugccuaaagauuuuauuuuuuuuucuuuguuuuuauuuuauuuuauuuuauuuuuuugagacagagucucacccuguugcccaggcuggagugcaauggugcgaucuuggcucacugcaaccuccaccucccaguucaagugauuccccugccucagccucgcgaguagcuaggacuacaggcgcaugucaccaagcccggcuaauuuuuguauuuuuaguagaaacgggguuucaccauguuggccaggaugauccucaaucuccugaccucgugauccacccgccuuggccucccaaagugcgggauuacaagcgugaaccacccugcccagccagaaacuagauuuucuuuaugccuccaccccuucuuauucauuuacuuuacaauaccaaaauaacaaauugcauaggagugugggaugugguuucugccuucuagagagagaucagaauuaaacuaguacuaugaaauguccuuuugaauguuaggucaagaaauccauguacagagucgugcacuucauuggcuguaacugucaaacuugccuuguauuagaaguuaaaucccaucguaaauacaucacgaggccagcugugugauuucugagaccuagaugagaguccauuuacuucagccuuugauucaguaaauguuaagcagcagaagacuucgaaugguugaaauucauuguuacaggauuuaacucauaaaccaaugagagauuuuuuuuuucucugcaaugguugcuaagucuauuccauguuaacacuguggaaauaaauaugaagauguggacauugca

SEQ ID NO: 191195 - RNA, 33618 nt, Homo sapiens
ggagucacggcucgcgacuggccuaagucgccgcagguauugcaguccggggcuggaggguaggggcgaggguccccggauaccgggucuaucacggucucgggcagggagucugaaucuuuuaggggagugggcccaagccgggugcaaagaacggggaagggccuucccuggcuccgucccggccacuuugaccgaaucagccuguucuuucccgaccccgucuccuauccccuagaacugccacguggggaugagauuugcugggcugguagcggcggcugcugcgggaggucccgcccacgugaagccagccuaacugagcucuggacuuuggggacagcugucaguggccuaggccgcaggugagauuuauccauucaucucucaaucuauuuucuuucuucauucacuagccacucccccacuucuacuccaugccagguccauugguagguucucggaauggaucugacaggcccagcccucuaggaacuuagucuaguggaauuuaaucuagaaucuagucuagaagccuuaaauagauaaacauuccaaaugauuccugcaauggugauggcuaauaccuucagagcccaguggguggaagaaggaaguaacuuggauguggguggaagagaaaagggcaaaucagggaagguuucaccagggaagggacuuuugaacugggcuuugaagguuaacuaggaguuugcaaauuucccagaagggaagcgacauuccaaauaggggaagcagaacaggcugcaaaauuaugaaaaggccugccauauuacaagaacagcaaaaaaaccaauaaugcaagagauuguggaggugaguucacgggaaaaaagcucaacagcagaaggccuuacuuucuaugcuauguugaggccaagauuuaucccagagcucaguauuucucagcuucuuuaaauauuuuguccuuugagcggagagcaguggcucacaccuguaaucccagcuuuuuaggaggcugagguggaagaauugccugaggcuaggaguucgagaccagccuggacaacaaagcgaaaccuccauuucuauuuuuuuuucuuuuuuugaggaggagucuugcucugucgccaggcuggagugcaaguggcgcaauuucggcucacugcaaccuccgccucuuggguucaagcaauucucacgccucagccuccugaguagcugggacuacaggcgugggccacaacgcccagcuaauuuuuuuuguauuuuuaguaaagacaggguuucaccauguuggccaggaugguaucgaucugaccucaugauccgccugccucggccucccaaagugcugggauuacaggcgugagccacugcucccagccccguuucuauuuuuaauuaaaaaauaaauaaauggccgggcucaguggcucacgccuguaaucccagcacuuugggaggccgaggcgagccaaguucaagaccagccuggcgaacauagugaaaccccaucccuacgaaaaauacaaaaaaaauuagccaggugugguggcacuugccuguagucccagcuuacucuggaggcugaggcaggagaauagcuugaacccgggaggcagagguugcagugagcugagauccugccacugcacuccagccugggugacagagugagacuccaucucagaaaaaauaaaaauaaaaaauaaagccaggcacgguggcucaugccuguaaucccagcacuuugggaggcugaggcgggcaaaucaccugaggucaggaguuagugaccagccuggccagugugguaaaaccccgucucuacuagaaaagcuagaaaaaugagcugggcgugggugggcaccuguaaucucagcuacucaggaggcugagaaaggagaaucauuuaaaccugggaggggaagguugcagugaguggagauugcaccacugcacuccaaccugugcaacagagugagacucuaucuaaaaauaauaauaaagauaaauacauaggccaggcacgguggcucacaccuguaaucccagcacuuugggaggcugaggcggguggaucagcugaggucaggaguucgagaccagccugaccaacauggugaaacuccaucucuacuaaaaauagaaaaauuagcugggcguaguggcacaugccuguaauccaagcuacucgggaggcugagggaggagaaucguuugaaccugggaggcagagguugccaugagcugagaucuugccauugcacuccagccugggcaacgagagcuaaacuccaucucaaauaaauaaauaaauaaauaaauaauaaaaauaaagaugaaaaguuggugauucuuauucaaaucaaucaggccuagaaauuaguacauucaacaggaaagguuuaaaaaggagguugaauugauuaagaugauaaucauaagugucuaaaaagugccuuucuuucuuaugcauaggacaccaugaagcaacugccagucuuggaaccuggagacaagcccaggaaagcaacauggucuguaaggaaggauccagacacagaaaagcaugaguuuuuguuucauuuauaaguaguuuauuuacauauuugaucaucaacaaaaagggguagagaugaaacugucugcaguuucugguaauuagacucaaacugucugagaaagucuucagaggaaagauaggggggcaguaauuaucacagagcagauguuaauuuuauuaaaauccauuuaccagaaagaguaaggcacugaccaucuggcauccucagcuccaaugcugugucuucccccgagcucugacucauuuuuaagauuuuuaggaaauuagauuuggauuaaacuggcuucacuguuucuuggcuguuuguucaaacaacccuuuauucaacaacuaacauuggccugaugggggcagcugcucugugggugcuggagguagaauuguaaauagucucuguguacuggggacuacagacuaagcaggugauggugauaaaaugugaucugcucugagucagggcccacagaagguuguagagagguggcaguucuucaacaggaccuugaaggagagacuccagacuggcuuccaugcaucugucuugcucuguacccagaauacagccaaucauggcauuuccuaguuuaaaacccuuuugugccucccuguugguguugggauaaaaaucagacuccugggcugggcacgguggcucaugccuguaaucccagcacuuugggaggccaaggcggguggaucuccugaggucaggaguuugagaccagccugaccaauauggugaaaccccaucucuacuaaaaauacaaaaauuagcuggcaugguguugugcaacuguagucccagcuacuagggaggcuaagacaggagaauugcuugaaucugggaggcagagguugcagugagcugagaucaugccacuguacuccagcaugggccacagagcaagaauccguuucaaaaaaaaaaaaaaaaaaaaaggccgggcacgguggcucaugccuguaaucccagcacuuugggaggccgaggugggcggaucacgaggucaggagaucgagaccacucuggcuaacauggugaaacccugucucuacuaaaaauacaaaaaauuagccgggcgugguggcgggcaucuguagucccagcuacucuggaggcugaggcacuccagccugggcgacagagcgagacuccaucucaaaaaaaaagaaaaaucagacuccugaccgggcgcaauagcucaugccuauaauccuagcacuuugggaggcugagguggguggaucacuugaagccaggaguuugagaccagucuggccaacauggcaaaaccccgucucuacuaaaaauacaaaaauuaaccgggagugguggugcaugccuguaauccuggccacucgggaggcugaggcaggacaauucuugaaccugggagguggagguugcagcaagccgagauggugccacugcacuccagccugggcgcaacagagggagacuccgucucaaacaaacaaacaaacaaauuagacuucuuaaacuggcccaauggucccugcaaaauguuucugccuguauuuccaaccucaaaucccaugacuuguuccuuuguucucuuucucuucuuuauugugcccuuugcacuguuccacucaggagcuguucaugcuggucucuuugccuggacugcucuuucugccuggagugcucuuucccuccacuuuuugucccucucuuuucccagcuuauuuuauuuuauuuuugagacaaguucuuccucuguggcuggccacccaggcuggaaugcggugguacaauuguggcucauuauagccucgaccuccuggccucaaguaaccuucccaucuccaucucccaaguaacugggacuguugguguguacuaccaugcccagcuaauuuuuuuuuuuagagacccagucucgcuauguugcccaggcuggucucaaacuccugggcucaggcgauccucccacucuagccucccaaagugcugagauuacaggugugagccaccacaccuggccuacccagcuaauuucuacucauacuucagaucucucuccaaauggugcuucuucaggaagccuucucugaccacccuaucucccuggcuccuuacagggugagacccuccuaagacaugcauguccucauacuauauauucuguacuccuuucuaccacaauugaagugaaacagauaguugugaaacuguugaauguuucuuuucccaacuagucuguaagggcuaucaaggcagggacuuuuuuuuguuauauccaccaucucuggauggcugugugcuuuugguaaauuacuuaaccuuucuuagcuucaguuccuccguuguagaacucagaugaugguaacagcuguuauccucaaagcguuuuuuuaguuuuuguuugucuuugaaacggagucucacucuguuggcagguuggagugcaguggcacaaucucggcucacugcaacuuccgccucccggguucaagcgauccugccucagccucccaaguagcugggacuauaggugcaugccaccacacccagguaauuuuuguauuuuuaguagagacgggguuucaucauguugcccaggauggucucaaucucuugaccucaugaucugccugccucggccucccaaugugcugggauuacaggcgugagccacugcgcccggcccucaaagggguuuuauguagauuaagugacaucagaauagagcucugaaugggaaacaaauuuggcaaccacugaugaauauauagaugagugauaauugaaguuaucacuacagauaacauuaaucagguaagcaaauguaaagugaggaaaagagaauugagaaugacggagagucaggagguggcugguaggaaaggagucggagaaggaagcagaaaggacaaccagaaaagugagugcagaaccaaaggaagggaugugggaaagccuggcugggagaaaggcacaagaagcgaggagaggucaggagucucaaacaccagagaggucaaauaagacagggccugaaaaacagcuacagaauuuucuuuuccaaucaggaagcuucaaguguguuuucucagucagcauucagaaucacuguggagaguggaaugggcugggcguggugggcgcgucccuagcacuuagggagaccagggcagaaggauugcuugaggcugggaguucaaggcuggccaacauagugaaaccccaucucuacuaaaaauacaaaaauuagccaggcaugguggugcgcgccuguagucccagcuacucgggaggcugaggcaggagaaucacuugaagccuggaaguggagguuauggugagccaagauugcaccacugcacuccagccugggcaacagagcgagacuccgucucaaaaaaaaaaaagagagagagagauaguggaaugaccgaauucuguaugugauuuuucagagugcuagcuuuggcuuccaucagauugagcuuuggggguaaucuggaaaagcucugaaaucaguaaauucuggauaauuuuuuugauggagaggaaucacuggcuaguggcaagagccccagggcuguugauuaccaugugguggcacauaaagcucucgccaccauuuauugaguccuucccugcccuguuuugacgucuugucucagucuucacaaucaucuuuugcaguaagaacuguugcuguccagccaggcacgguggcucacgccuguaaucccagcaauuugggaagccgaggcgggcggaucaccugaggucgggaguucgagaccagccugaccaacauggagaaaucccaucucuacuaaaaauauaaaauuagccaggugugguggcacaugccuguaaucccagcugcuagggaggcugaggcaggagaaucgcuugaacccgggaggcggagguuguagugagccgagaucacgccauugcacuccagccugggcaacaagagcaaaacuccaucuuaaaaaaaaaaaaaaaagaaccauugcuguccucauuucacaaaugaguaaacuaaaguucagaaagguuaagugacuuccaaaaggucacacaucuaggaaguaccugagcucgaauuugaaccagaucugucugaauucauacaccaugcucacagccaccauccugugccaagacccaucacugaacauuucuggaggucaguuucccuaucuaccaaauggggaaaaauaagcccagugcauuccuaccagauuacugugagaugaagacagugacaaaauugaaaagccaaagacugugugcaaaggggagguacuauuauuaaucagagaagugcugcuuuauuggguacaauuuaaagugucugcauaaggcucuucauucuggugaauauuucaugaggaauggaaagagcacacuacugcauuuauucucugcucaggccuccugaauacauccuuccuuuggcagguacaccuugacugucccuggagacagccccugugcucgaguuggccacagcuguucauauuuacccccaguugguaaugccaagagagggaaggucuucauuguugggggagcaaauccaaacagaagcuucucagacgugcacaccauggaucuggguaagaucagcagcugcagaguacaugcccuauggccagagaacagggcugugugcugcuagccaugagcagggcauuccuaaaaacaccagcaggguuuuccuauaagaaaacauggccaggaccaggugugguggcucacgccucuaaucccagcacuuugggaggccaaggcagguggaucaccugagguuagaguucgagaccagccugaccaauaugaugaaacccugucucuacuaaaaauacaaaaaaauuagccgggugugguagugggcaccuguagucccagcuacucgggaggcugagacaggagaauuacuuugaacuggggagauggaaguuaaaguaagccaggaucaugccacuguacuccggccugggugacagagcaagacucugucucaaaaaaaaagaaaaaagaaaaagucagcaucacugacagaucccucagguuucuuaguaggccccuggcacacauucaucugaccaguaccuccuuguuuagcgggagagaacccuuauggagcccugguuguccagccauuuauucaucaaauauuucuguaggauacauugaugacuaccaccacucauucuauucacauauccaauauaucacuaagcccuacauaucucuuuucuuuguuuuuuguuuuuguuuuuuugagauggaguuucgcucuuauugcccaggcuggagugcaauggcgcgaucuucacucauugcaaccucugccucccagguucaagagauucuccugccucagccuccccaaguacuugggauuacaggcaugugccaccaugcccagcuaauuuuuuuuuuuuuuagacggagucccacucuguugccaaggcuggagugcaguggcacgaccucagcugaccgcaaccugugccuuccagguucaagcgauucuccugccucagccuccugagaagcugggauuacaggcgcccaccacuacacccagcuaaucuuuuguauuuuuaguagagacugaguuucaccauguuggccaggauggucucgaacuccagaccucaugauucacccuucuuggccucccaaagugcugggauuacagguaugagccaccacgcccagccuacauaucucuuaucuuuauccaugucuguccauuuccacuacuacuacuguaguccaagccacuguuaucucucaacuagacuuacaagagccuccucaccagccucccugcuuccaaguuuacccccuauacagugcauuuucucuaccuagccagcgaauaucaucuaaaauacaaaucuaaccaugucacucccuauuucagacuuuucucaaccucccuuuuuuuuuuuuuuuuuugagaccaagucuugcucuguugcccaggcuggagugcaguggugcugcaaacucggcuuacugcaaccucugccuccuggguucaagcaauucuccugccucagccuccuaaauagcugggauuacaggugugcgccaccaugcccugcuaauuuuuguauuuuuaguagagaugggguuucacgauguugaucaggcuggucuucaaauccugaccuggugauccucccgccucauccucccaaagugcugggauuaugcaugugagucaccacaccagccuuuuuuuuuugaggcagcgugucgcucugucacccaggcuggagugcaguggcacaaucuuggcucacugcaaccucugccuacuggguucaagcgauucuccugccucagccuccugaauagcugggauuacaggcgcgugccaccagccuggcuaauuuuuguauuuuuaguagagauggggguuucaccauguuggccaggcuggucucaaacuucugaccucaagugaucugcuugcaucagucucccaaagugcugggauuacaggcgugagccaccgagcccggccccaaccucauuucuuggcucucuccaacccacauuugcugcacuggauauccuucaguuccuugaacacagcuugagcucucuggccuccaugccuuugcacacacagaucccucugcuaggaauguuuuucccuuuucuuaucaucuggcuucucuauaucuuucagauuucagauuaaaugucacuucuaccaggaaccuuuccuguuaccucuggacucguucaggcacuacaugacucuguauguccguagucucaugugcucuuccauccugucugccuucacagcccuaucacaugugauuguuucuuguccgucugccccacaagaacauaagcuccucagaaacagauagcauauuuuccucaucauuguaucccagacacuaccacagggcuuaguacagagugggugcucuauaaguauuuaaaugaaugaaugaaugaaccugcuaauaagaaacaauuggaucugggcgcaguggcucacgccucuaaucccagcacuuugggaggcugaggcgggcggaucgcuaggucaagagaucgagaccauccuggcuaacacggugaaacccugucucuacuaaaaauacaaaaaauuagccaggcgugguggcgggcaccuauagucccagcuacucggggaggcugaggcaggagaauggcgugaauccgggaggcggagcuugcagugaguggagaucgugccacugcacuccagccugggugacagagcaagucuccgucucaaaaaaaaaaaaaaaaaaaaaggaaaugauuauuagcugggcguggugacucacgccuguaaucccagcacuuugggaggccgaggcaggcaaaucacaaggucaggagaucgagaccauccuggccaacauggugaaacccugucucuacuaaaaauacaaaaaaauuagcugggcaugauggcuugugcccguagucccagcugaggcaggagaauugcuugcaucugggaggcagagguugcagugagccaagauuaugccacugcacuccagucuggcaacagagcaagacuccgucucaaaaaaaaaaaaaaaagaaaauaaaagaaacgauuauucuuugcucuacacaagggcagaaguugaacaauggugacccacuuacguauuuuguuagguccauguaacauuucccuauuguuuuaaucuuaaguuuuguuuuuuuuuuugaaauggagucucaaacugucacccaggcuggagugcagaggcacgaucuuggcucacugcaaccucugccuccuggguuaaagugauucuccugggccgggcaugguggcucaccaugcuguaaucccagcacuuugggaggccgaggugggcggaucacgaggucaggagauugagaccauccuggcuaacacggugaaaacccaucucuacuaaaaauaaaaaaaaaaauuagccaggcgugguggcgggcgccuguagucccagcuacucgggaggcugaggcaggagaauggcaugaacccgggaggcagagcuugcagugagccgagaucgcgccacugcacuccagccugggugauagggcgagacgccaucucaaaaaaaaaagaaagugauucuccugccucauacucccaaguagcuggaacuacaggcacgugccaccaugccccgcuaauuuuuguauuuuuaguagagauggguuuucaccauguuggccaggagggucuugaacuccuaaccucaagugauccacccaccucggccuccccaagugcugggauuacaugcgugagccaccacgcccagcauaaucuuaaauuguuuaccaaccaauuaugcagaaaucuacauauaaaaauuuaaaugguuuggcuucucuugauaauguuggaaaaucuaaugucaguaggccucccugucuacauggcaacaauuauuuggaacugagcugccaccuaucaagagggcucuuauucuccaguuugccacaguuuuuguuacucccaccuaggcauuugaauuucuacucccugcacuaaaaaaaucaaagguaggcuggacgagguguaaucccccagcaccuugggaggccaaggcgggugggucacuugaggucaggaguuugaggccagcccggccaauauggugaaacccccaucucuacuaaaaauacaaaaauuagccaggcauaguagcucacacuuuuaaucccagcuacuugggaggcugaggcaggagaauugcuugaaccugggaggcagagguugcagugagccgagaucgcgccagugcgcuccagccugggcaacagagcaagacuccaucucaaaaaaaaaaaaaauucaaagguaaauuaaaucacuucuagcccucaauuacauuaaauuaguucaacuuacaucuuuauugcaaccuauuaauagcuuugugacccuggcuacaccaucucaaccaucuggaccucagugcucuauaaaguagggauaauaacuugcuucagaucuaacaagauaaugccuguaaaggucuuguguaauugguuaaccaaguaaaauaauuguuaauaauaaagguuaggguuuuuuguuuguuuguuuguuuuuugagacggagucuuacugugucacccaggcuggagcgcaaucucagcucacugcaagcuccaccucccggguuaaugccauucuccugccucagccucccaagcagcugggacuacaggcgccugccaucgcgcccagcuaauuuuuuguauuuuuaguagagacaggguuucaccauguuagccaggauggucuugaucuccugaccucaugauccgcccaccucggccucccaaagugcugggauuacaggcaugagccacagcgccugaccaagguuagguauuacuauucugugaacuugucuuagccagccaucauuuauuugcaaguaacagaaucucacuuaaaccagaggaaaaagggggaauuuauuuagucagauacaggcguguuucuuucuuucuuucuuuuuuuuuuuuuugagacagaguguugcuguguucccagacuggaguacaguggcacaaucuuggcuugcugcaaccuccgcuugguuuaccaaguaaaauaacccuggguucaagcgaguccccuaccucagccucccgaguagcugggacuacaggcacgugccacuaugcuuggcuaauuuuuuguauuuuaguagagaugagguuucaccauguuggccaggauggauucgaucuccugaccucgugauccgcccaccugggccucccaaagugcucggauuacaggcgugagccacugcaccuggccaauacaggcguguuucaaagaauucaaggacaggaaguagagcccaggaucaugagaaaguggaagcacuugaucugguuggcucauucugguuucauuggcuaccuucaacccaaucagcuaaagcuacaaagucaaagcauaguacaaacaugucaucugggaucuauccuugugguugacaaaguggggacaguuuccauagaacggggucuauggacuaggcagacagcccccuaaguaucuauuauagaauuuucuggagguugacaacaugcccuuuaagugauucagugguuuucauuuauguuuauggcccucuucucaugacccuccucaagugugccaaccaauauaauaauuggcagccccaaucuaggaacugggugaaauguuuuccaggaaaacaccagugggacuuagauaccugcaagggccucuugccccgguaugaacaugcuagcuucauucccuccugcacaccugaccguaucuggguauuuggaggugccaaccaaucaggaaaucgaaauugucuacaaguccugaauccugguaaguagccaaagguuauuuuauuuacguacauacaaauaaacuuucaugcacacacacacacauauauauaaauccaauuauaauuccaguacauuuggauuauacuaauuaccauuuaacuuugcugacauagaaaauaggaauuuuaacuuguagcauaaucugaaaacaacagaauaaaaacaauuguugguaacacauacaauuuuuaacuuguuaaaugucaaagcuggaagggacuucagagaacagcuauaucaagugggcuacucagguuuaucaagggcaaagugacuuuccuaaagucacaagaggccgggcaugguggcccaugccuguaaucccaguacuuugggaggcugaagaaggcagaucacuugaggucaggaguuugagauuggccuggccagcaugguaaaacccccaucucuauuaaaaauagaaaaauuagcuggguguaguggugggcgccuauaaucccagcuacucaagaggcugaggcaggagaaucgcuugaacccgggaggcggagauugcagugagcugggaucaugccacugcacuccagccugggcgacagagugagacucugucucaaaaaaaaaagaaaaagaaaaaaaaauuuuuuuaaaaauaaagucacaagagagucagugacugagccaggcuuagaacccaagucaccuagauuaguaguccuccaguaaaggcgauugugcccccgggggacauuuggccauaucuggaaacauuuuggguuaucacaacuggggguagcgugggcuacuggcuucuaggggguagaggccagauaugcuguauauauauccugucgugccuaagacagccaucacagggaagaauugucuggucuaaaaugucaguagugccaaaguuaagaaacacugaccuggauccuccuaguauguuucuuuuagccaaaaguacaaaguuccuaacuugucucacuggcaagacauuuuguuuguucguuuuguuuguuuguuuuuguuuuucauaucuugcuguuuccaucacuggcaguuuuauuauagaggaagcaguuugggaacgucgcuacugagaggagguugcuaaaccaccuguggggaaguggacuugucuuuuugccuuuuguuuguuuguuuuuguuuuucucuuuacaaauauuauuuauguucauuguaaaauauuugaaaaguacaaauaaguggaaaaagucauccacaauccauuauuauauuaaggcuauuaccaauuuucugucuuuuuuuuuuuuuuugugacggaguuucacucuuguugcacaggcuggagugcaguggugugaucucggcucaccacaaccucugccucccggguucaagugauucuccugccucagccucccaaguagcugggauuacaggcaugcgccaccaugccuggcuaauuuuguauuuuuagcagagaugggguuucuccauguuagccaggcuggucucaaauucuugaucucaggugauccgcccaccucagccucccaaaaugcugggauuacaggcaucagccaaugugaccggcccagcuuucugucuuuuuccugucuuuucucuguuuuuacaagccugagaucauacuauauuuacacauucauaacuuuuuccuuuuaauuucauaaucccaggagaaauagguggguuuuuuuuuuuuggcuuuagcaaaaauaauugauuuguuauuaauaacaaugcuuuguuaauauaauaucauuuguuuguuuuuuuuggguuuuuuuauuguugguaacuuuuuuuuuuuucgaggcagggucucacucuguugcccaggcugggaugcagugguaugaucacagcucacugcagccucgaccacccaggcucaggugaaccuccuaccucagccucccagguagcugggacuacaggcgcuugccaccaugccuagcuaauuuuuuuguauuuuuuguagagacagaguuuugccauguugcccaagguggucucaaacuccugggcucaagcaauuuuccugccucggccuccugaaguguugggauuacagacaugagccacugcaccuggccaacaucauuuuuaauggcuguaucauacuccauuauauauaaaauacuccauaauaucauaacuucuccauuuaugaacauuuaguucuuuucagguuuuuaccauuauaauuaacaaagcagugaacaucuucauucagaagucauagacuguauuucaaauuauuuucuuaggguuccugccaagaaauaaaaaggcuagguaaaauacugugaaccuuuucaagguuuugauacauacuaccaaauugcucuccagaaagauuuuuccgguuuauccucucuccaacuguguuuaacaguguuucuuucauuacugaccagcacugaauuuaucaguuuuaaacauugcuaauuugauaggcaaaaaaacuuguacauaguuuaaauaugcauuuugggccggugcgguggcucacaccuguaaucccagcacuuugggaggcugagguguacagaucaccugaggucaggaguuccagagcagccuggccaacauggugaaacccugucacuacuaaaaauacaaaaauuagccaggcaugguggugcaugccuguagucccagcugcugaggagggcgaggcaggaggaucgcuugaacccuggaggcagagguugcaaugugccgagaucaugccacagccugagcaaugagugagacucucucucaaaaaagcauuuuuugaccuggacauuuuucacaugucagccaacucuugcucaguucccucuaucaacaauauauuugggguguugcccaccuacuacauuuguugaguauugcccgauaaaaaaauuaaaauuaaaaaaaaaaacuauuguacaauaguuggucagaguucaggaacuaggaccaaauuuucuuauaugucaaguauuuaaauuccuucagcacauuuagacaguauguuaucuuuuaauuugauuuauuuguuuggguauuuauuuccugucuucccuccucuuccaugcccucccucuguggaacauaagcgcuuugaagggaagaguuuguuuauuguugaauacucaggguacagaacacuguccgaaauaaaguagacacggccgggcaugguggcucaugccuauaaucccaacacuuugggaggacgaggagggcggaucaaaaggucaggaguuccagaccagccuggccaacauacugaaagcccgucucuacuaaaaauacaaaagaaaaaauuagcugggcuugguggcaggugccuguggucccagcuacuugggaggcugaggcaggagaaucgcuugaaccugggagguggagguugcagugagccgagaucgcgccacugcacuccagccugggugacagagugagacaccgucucaaaaaaaaaaaaaaaagaagaaagugauagaguagacacuuggcagaccauuuggcuaauugugaagccaauuugcuuggaggacuagcaguauaauauggugcuuaagggcacagaugagggucucuguuuugcuaugcacuaacuaugaccuuggacuagugauuuaaccucucucugccucuguuuucugucacauuggauaguaauaguuucuaccuuguuaauuugucaaggauuuaaauaaacucaguaucuggcacauaauuaaugcucaguaauuguugugguaguugauguaguuaagguuuggcaaagggaaaucaguucuggaacccuggccuuuugauuuucaacaaugguauccauugaaauaaaauaaagugagaauuuggaaagcugucaaagagggugauuuuauuuuauuuauuuauuuauuuauuuuuauuuuugagacagugucucacuguguugccaaggcuggagugcaguggcgcaaucucagcucacugcauccuccaccucuuggguucaaaugauucuccagccucagccucucgaguagcugggauuacaggcacaugccaccaugcccagcuaauuuuuauauuaaagagggugauuuucuaucauaucccuuuucucuccuagaaaauauaauuugacaucaugcccaagaaauaugaaauauguacuuaguugcauuuguuaccaaggcaagucccucaaaugcucaggacuccuuugugauucuuugugcugguguuugaguuggcaggaauacagcccuagggucuucugggccuggaggugacauguauaccuuucuagcucccucuaagauccaaaagcucuccaacaucuguaacuauagagacagcuacauuuugcuuuggauauaggcugagacuuuuucagucuccagguccccauuugagucccacacauauuacagauguuuccuguagcauuuuauauauuggauguagaccuuuuacaaaagacagaauuucuugguguguuaugguagagcaagugugggacucugauagaacugaguucaggcccggcgcgguagcucacgccuguaaucucagcacuuugggaggccgaggcgggcagaucaggaggucaggagcucgagaccauccuggcuaacacggugaaacuccgucucuacuaaaaaaaaaaaaaauacaaaaaauuagccgggcaugguggcggaugccuguagucccagcugcucgggaggcugaagcaggagaauggcgugaacccgggaggcggagcuugcaaagugagccgagaucgcgccacugcacucugggcugggagccacagcgagacuccgucucaaaaaaaaaaaaaaaaaaaaaaaaaaagaacugaguucaaacuccugcucugcuacgcacauaugcuauaaccugcaggaaaggauuuaaaugugcagagcuucaguuuccucaucuaaaaguagagauacuuccgcucacuucccaagcuugagugaagacaccagggauggcagugcccagggcaaugaugcugcccauugagggugcucaauuaaugcaucugcuucuauaaaacccagguucauccuuaaaagaaauaagcuucuauacaucuaucuagguggugaaauuuuauucuccagucagaggagugggaauuagaaagaucuugguguuacugaaagaguuuaaauuccaacucagccauuucuuaggcaugucacuuuaucugucucucucucucucucuuucucucucucuuucuuugccuuauucuguaacccaggcuggaguugcaguggugugaucuugacucacugcaaccucaaccgcugcaggcucaguauauccucccaccuaagcuucucagguagcugggacuauaggcauacgccaccacacccgacuaauuuuuuuuuguauuuuuuuguagagacaggguuuugccauguugcccaggcuggucucaaacuccugggcucaagcaauccaccugccccagccugcuaaaguguugggauuacaggcaugagccaccgagccuggcuagccaugucucuuuuaaaaaguuacuuaauccaucccuacuucaauucucuuaccuguaaaaugcggaaauuaauauuuguuuagcauuuacuguuuaguagggacuguuauuacugcuacugaaauguaauaguauugucuuuuuuuuuuuuucauuucuuucuuucuuuuuuuuuuuuuucaagauauggucuuacucuuuuacccaggcuagagugcaauggcacgaucauaguucauugcagccucaaacuccugggcucaagcaauccuccugccuuggcuucccaaagugcuaggguuacaggccuuacagccacugugcucagccuaauuuuuuuuaauuuuuaauuuauuuuauuuuauuauuauuauuuuuuaagaugaagucucgcuuugucaaccaggcuggagugcaguggcaugaucucagcucacugcauccuccgccuccugguucaagugauucuccugucucagccuccugaguagcugggauuauagguccccaccacgacaccuggcuuuauuuauuuauuuauuuauuuuuaguagagaugggauuucaccauguuggccaggcuggucuagaacuccuacccucaagugauccacccaccuuggucucccaaagugcugggauuacaagcgugagccacugcaccccuggcugauuuuuuguagagacaggauauugcuuuguuucccagucuggucacaaacuccugggcucaagcaauccuccuaccucgauuucccaaacugcugagguuacagguguuagcugcugcacauggccugccuacuuucuuuuauuggccacauuuucugggaaaucuggcacaccuggacucuggcaucuagugggaaugaauguuagcagauguuagggggagcgauagugagcaaaguagaagaggguucagagaggauauuugaaggccuccaaaacaaauugaccucuuuuuuuucuucuuuuuuuuuaauauggagccuugcucugucacccaggcuggagugcaguggugcaaucucagcucacugcaaccuucaccuccuggguucaagcgauucuccugccucaaccuccugaggagcugggauuacagguccccaccaccauacccggcuaauuuuucagauuuuuaguagagaugggguuuuaccccauguuggccaggcugguuucgaacuccugaccucaagugauccgcccgccuuggccucccaaagugcugggauuacaggcaugagccacacugcacccagccugacuccauucuugugcuuacagcuuuuaaaucuuggggauuuuggacugucuuggcaaauccuaaguaucaucuucauucuuccuugauguuugugaguaugagaucccugcccaaaacuaugcuggccccccuggggauuggaguuuggaaacugacuucacucagccccagagucaaggucagaagccccucuaccuggauauuuuaagugccugcauucucucuggcccagaaaccaggacguggaccacgccagaagugaccagccccccaccauccccaagaacauuccacacaucaucggcagccauuggaaaccagcuauaugucuuugggggcggagagagaggugcccagcccgugcaggacacgaagcugcauguguuugacgcaaguauggacuggugggcaccuuggggcuggucagggccaucccaguuuacacauuaccuaauauaggaagcagaaguuagaaaaggaaagccugacuaagugucucacuucuagacuucuuuguuauaucucuuagcugauaucuuuuucccacagcaaaauuggcauuuaaaaagggauagugaggccuggcaugguggcucacaccuguaaucccagagcuuuggaaggcugaggcagguggaccgcuuaaggucaggaguucgagaacagccuggccaacauaccuuuucucuacuaaaaacacaaaaauuauccgggcaugaugguaugcaccuguaaucccaguuacucaggaggcugaggcaggagaaucgcuuaaacccaggaggaggaaguuucagugagccaagauugggccacugcacucagccugggcaacagagcaauacuccaucucaaauaaauaaauaaauaaauaaauaaauaaauaaauaaauaaaacuaaaaagguaggccgggaacgguggcucacgucugugaucccagcacuuugugacgcccaggugggaggaucaccugaggucaggaguuugaaaccagccuggccaucauggcaaaaccccaucucuacuaaaaauacaaaaauuggccgggugcagcggugggugccuguaaucccagcuacucgggaggcugaggcaggagaaucacuugaacccgggaggcggagguggcaaugaaccaagaucgugccauugcacuccagccuuggcaacagagcgagacucucucaaaaacuaaauaaaaaaauaaaaagguauaaugaucaaguuaaaaaguuuaaaccauacaauuuauaaaguaaaaaaguaaaagaaagaauaagaaagacaaaaaacaaacagaaguaaaagauuccccuucagccuuuccuuuccccgccucagguacaugccugggugauuuuuuuucuuuuucuuuuuuuuuuuuugagauggagucucgcucuguugcccaggcuggagugcaguugcccgaucucggcucacugcaaccuccgccucccggguucaagcgauucuccugccucggccucccaacuagcugggauuaccagcaugcaccaacauguccaucuaauuuuuugcguuuuuaguagagacaggguuucaccauguuggccaggcuggucuugaagccugaccucagguaaucugcccacuucagccucccaaagugcugggauuacaggcuugagccacugcacccggccagauuuuuguauuuuuauuguagagaugcaguuuugccauguugcccaggcuggucucaaacucaugagcucaagcaaucugccugccucugccugcccaccucugccaccacacucagccaaaauuuuuaccuugcaaaguaaaauugggaaaauuaagagauagcacauucccaagccagaguauuugggaaaaaaaaaaaaaaagacacaucacagugugacuuuucucuuuccagaaagaaugggcuuugugauucuuuuaaagcaguuuuaaaaguuuaaauaauauugguuuugaauauauaaaacuauaaggaacaagaaaaaaaacauauguauguguauauguguguguguguguacauguguauguacuaucaccccaaaauuaaauuacuguuaacaucucaguguauuaucaaucuuuuuuuuuuaagaacagagauaauucaaaccagaugugguggcucacgccuguaaugccaggacuuugggaggcugaggagggcagauuacuugaggucaggaguucaagagcagccugaccaacauagugaaaccucguugcuacuaaaaauacaaaaaauuaacugggcguggugacgcacaccuguaaucccagcuacuugggaggcugaggcaugagaaucacuugaaccccggaggcggagguugcaaugagccgagaucuugccacugcacuccagccugggugagggagcaagacucuguaucaaaaaaaaaaaaaaaaaaaaaaaaggacagagauaauucuauauguuacauuugcauccuauauuuuucacuuaagcauuguuccaugcaaucagaaagucuucaccagcauuuugaaaugaugauuauuauauaaauauuagagucagggucucacugcauugccaaggcuggucucaaacuccuagccucaagugauccuucagcuuuggucccucaaagugcugggauuacaggcauugagccacaccacccggccuucaccaucauuuuuaauaagugcuuaggccaggcgcgguggcucacgccuguaaucccagcacuuugggaggcagaggcggguggaucaugaggucaggaguucgagaccagccuggccaagauggugaaacccugucucuacuaaaaauacaaaaaucagccaggaaugguggcgggcgccuauaaucccagcuacucaggaggcugaggcagcagaauugcuugaacccaggaggcagagguggguggauuaccugaggucagguaauccugggcaacauggugaaacccugucucuacuaaaaauacaaaaaauuagcuggacgugguggcaggugccugccugccacccucugcugcaaucccagcuacuagggaggcugaggcaggagaaucccuugaaccugggagguggagguagcagugagcuaagaucacgccacugcacucuagccugggugacagagcaaggcucugucucaaaaaaauaaauaaauuuuuuaaaaaguguguaauauuuccucauggcuauacuaauaauuaaaccugcucauggacacuuaggcuauuuccaauuuuugucuauuauaaacaauacuguaaugaacaagccagguaugcugacucaugccuauaaucccaucggcucaggaggcuggaggaccgcuugggcccaggaguuugaggauguagugagccauaauugcaccacugcacuccagccuuugcaguagagcgagacccugacucuaaaaaaaaaaaaaaaaaaaaaaugcuauaaggaacauauuuaugcagaaaccauuucagguaauuuuaaauuaaauuccuugggacacuggggacuccuugaacaaccagcaggcauaccauaaacaguaauucaaagacaaauuguuuggcagaccuuuguuucaaagaguuuuugcaggcugggcgcaguggcucaugcccguaauccuuugggaggccacuuugggacaccaaagcagguggaucccuugaggucaggaguucaaaacuagccuugacaacaugaugaaacccuguuucaacugaaaauacaaaaaauuauccaggcauggcggcaggugccuauaaucccagcuacucgggaggcugaggcaggagaaucgcuucuccuggaggaggcagagguugcagugagccaagaucgcaccacugcacuccagccugggcaacagagcaacacucuaucucaaaaaacaaaaacaaaacaaaaaaaaaaaacaacagaguuuuugcaguacuccuuuaagacuuuucugguauauagaaaugauuaauuuuccagaauucuauauauguacagcuuugaagauaagaaggguugccuguaguaaaacguaauaaucaucauauucauaacucucauguauuggguacuuuuuuuuccuucaugcuuuauguauauuaucucauuuaauucauaccucagcucuuaaaaguagguauugucuuuuuuuuuuuuuuuugagaugaagucacgcucuguugcccaggcuggagugcaaugacacaaucuuggcucacugcaaccuccaccucccggguucaagcaauucuccugccucagccucccgaguagcuuggacugcaggcacaugccaccacgccuggcuaauuuuuaaaauauucuuaguagagaugggguuuuacuguguuagucaggauggucucgaucuccugaccucgugauccgcccaucuuggccucccaaagugcugggauuacagucauaagccacugcgcccggccaguauugucuguauccuuauuuuacagccauagaaacugcagcuuagagaaguaauuggugaaaggccacauaguuauauagugagauaaccugguuucagcuccaaaucccauauucuaaccauuauccuauacugccacaucaggagucccugcuaacuuuuauuuaagacuagucuguuuuuuuccccaaccccuucagcaaaucaauuaagucuagcaggaugcaguggugugugccuauagucccagcuacuugggaggcugaggugggaggaccacuugagccuaggaguuccaguccagccuggacaacauagcaagaccccaucucuaaaaauaauaauaagacugggugugguggcugacaccugcaaucccagcacuuugggaggcugagguggguggaucacuugagcccaggaguucaagaccagccugggcaacauggucaaucccuaucucuacuaaaaauacaaaaauuagccaggcaugauggugugcaccuauaaucccagcuauuugaaaggcugaggcaggagaauugcuugaaccugcgaggcagagguugcagugagagccaagaucgugccauugcacuccagccuaggcaacaagagcacaacuccaucucaaaaaaaaaaaaauggcuggaugcaguggcucaugccuguaaucccagcacuuugggaggcccagggggguggaucucuuauggucaggaguuugagacuagccuagccaacauggcaaaaccucagcuuuacuacaaauaugaaaaaauuuaggaugggcgcaguggcucaugccuauaaucccaacacuuugggaggcugagacagguggaucauuuuaggucaagaguuugagaccagguuggccaacauggugaaaccccgucucuacuaaaaauacaaaaauuaagggccaggagugguggcuaacgccuguaaucccagcacuuugggaggccgaggcgggcagaucacgaggucaggagaucgagaccauccuggcuaacacggugaaaccccguaucuacuaaaaaacauacaaaaaauuagccgggcuuggugguaggcaccuguaaucccagcuacuugggaggcugaggcaguugacucacuugaaccugggaggcggagguugcagugagcugagauugcaccauuacacuccagccugggugacagaggaagacucuguuucaaaaaaaaaaaagaaaaagaaaaagaaaaaaaaaaaauuuagcugggcgugguggugcacacuuguaaucccagcuacucaggaggcugaggcaggagaaucgcuugaaccuggaaggcagagguugcagcaagccaagaucgcaccacugcacuccagccuggguaagagaguaagacuuugucucaaaaaaaaaaaaaaaaaauuagcugggugugguuuugggugccuguaaucccaccuacucaggaggcugaggcaggagaaucacuugaaccugggagguggagguugcagugggcgaagaucgcacuugugcauccuagccugagcaacagagcaaaacucugucccccgacccccugcaaaaaaaaaaaaaaaguugagugccacugacauagacaaguaacuuguccaaauauuagucauuaagggaugaaauuguuauugaaacauuacuuauaaaauaaauaaauaacaaggcugggcacaguggcucacaccuauauccuagcacuuugggaugccgaggugggcagauugccugagcucaggaguuugagaccagucugggcaacauggugaaaccccgucucuaugaaaauacaaaauauuagauggggccgggcacgguggcucacgucuguaaucccagcacuuugggaggccaaggugggcgaaucacgaggucaagagaucaagaccagucuggccaacauggugauaccgcgucucaauuaaaaauagaaaaauuagcugggggugguggcauguggcuguagucccagcuacucgggaggcugaggcaggagaauugcuugaaccggggaggcggagguuacaguaagccgagauugugccacugcacuccagccugggcgacagagcgagacucugucugcaaaaaauaauaauaauaaauagaagccaggcguggugacucacgccuguaaucccagcacuuugggaggccaaggugggcagaucaccuaaagucaggaguucgagaccagccugaccaacauggagaaacccugucucuacuaaaaauacaaaaauuagcugcaugugguguugcaugccuguaaucccagcuacucuggaggcugaggcaggagaaucgcuugaaccugggaggcagagguugcaguaagcugagaucaugccauugcacuccagccugggcgacaagaccgaaacuuugucucaaauaauaauaauaauaaugauaauaauaauacauuaaauaaaugaauaacaagaagaugacucugaagggcugucacagaaacagacucauucauuuugacuuuguggcaguuuuaguuugaagcuaaagaggagaucguuuuuauuucauagcgagaaauggcuuccgggugcugaguagaaggggcaggcauguuugguagugggcucuccagcccuagaagcaugcacgcagagccucuguaggacuuuuuuuuuucuuuuuuuuaagacagagucuugcucugucgcccaggcuggaaugcaauggcgcaaucucggcucacuucaaccuccaccucucggguucaagcaauucuccugccucagccucccaaguagcugggauuacuaggcaccugccaccacaccuggcuaauuuuuuuuuuuuuguauuuuuaguagagacaguguuucaccauguuggccaggcuggccucgaacuccugaccucaggugauccaccugucucggccucccaaagugcugggauuacaacugugagccaccgcagcagccuauaggauguaaaaggagggaugccuggauuggcugggggaguuggagugaaugaccccaggguugcuuccugcaugggacagcuccgcuugcuaggaggugcuacagaggcuugggccuguuucucguguucuuuuuuaauaguuuugccauuugauguuauugaauuuacuuuucuagacacucugaccuggucacagccagagacacuuggaaauccuccaucuccccggcauggucaugugaugguggcagcagggacaaagcucuucauccacggaggcuuggcgggggacagauucuaugaugaccuccacugcauugauauaaguaagcagggcaugggggcuugucuguuuaaaauuguuauuuuuauuuauuuauuuauuuuuagacaggaucucugucugucacucaggcuggagugcgguggcaugaucucaguagccucagccuccaggacucaaguaauccuccuaccucauccuccgcaguagcuggagcuacaggugugugccaccaugcuuggcuaauauaaaauuuuauuuugguagagauggggucucaccauguugcccaggcugaucucaaacuucugugcucaagugauuuuuuagugugcuuugaaagaauauggccuugcuuggccaggugcaauggcucaugccuguaaucuuagcaccuugggaggcugaggcaggcauaucaccugagaucaggaguuugagaccagccuggccaacauggugaaaccccgugucuacuaaaaauacaaaaauuagccuauugucauggcacaugugccuguaaucccagcuacguuggugccugagucaggagaaucgcuugaacccaggagguggagguuguggugagcuaagauuacgccacugcacuccagccugggccacagagcaagacuccaucuccaaaaaaaagaaaaaaaaaaaaaagccgggcuuggugacucacaccuguaaucccagcacuuugggaggcugaggcugggggaucaugagguaaggaggucgagaccagccuggccaacauagugaaaccccaucucuacuaaaaauaaaaaaaauuagccaagugugguggcacucgccucuaguccuagcuacuugggaggcugaggcaggagaauugcuugaacccgggaggcagagguugcagugagccgagaccacaccauugcacuccagccugggugacagagugagacuccaucucagaaaaaagagcugggcacaguggcucaugccuguaaucccagcacuuugggaggccaaggcagguggaucaucugaggucaggaguucgagaccagccuggccaacauggugaaaccccaucucuacuaaaaauauaaaaauuagccaggcgugguggugcaugccuguaaucccagcuacucgggaggcugaggcaggagaauugcuugagcccaggaggcagagguugcagugauccaagaucaugccacugcacuucauccugggcgacacagcaagacuccgucuccaaaaaaaaaagaaaaaaagaaaaaaaaaaucagccaggcuuggugacaggcaccuguaguccuggcuacgugggaggcugaggcaggagaaucgcuggaaccugggagguggagguugccgugagcugauugcaccccugcacuccagccuagacgacagagugagacuccgucucaaagaaaagaaaaaagaaaaagaaaauauagccuugcucuuauguguagguaacuugaccagcuggcagaaucuucaucagauucuguuaccucuggacagaauacuaauaauaaaaaaucauagcacuaaauaaucuccugagugcuuacuauggacccagccauuuauugucucuuaaccuuccaacagugcucuccuuucauuacaacccauuaugcuuuguguuggccuacuggauuucuuucugguguuagccauuaacccaugaaggaucuggauaauguggauguagaugacuagaguuucaugcuuuucauguuaaaugguugaaaacagugggaagaggaagguuagagagaacaugagaaauauccuuuaaguaucugaagggcugauaugcuguggagagacccuggacucauucugggcaauuccuucaagcugugagguccauuaugguagggaacuugucuauuuuguucuccaguacauuucuagcacuuagcacagugucuggcagauagugggugacagguacuuucuuuuuuuugagauagugucucacuugguugcccaggcuggaaugcacugaugcgaucuuagcucauggcagccucugccucucaggucaagugauucuccugccucagccucccggguagcugggacaacaggcacgugcuacaacacccagauaauuuuuuuauuuucuguagagaugagguuucaccauguugcccaggcuggucuccaacuccaggacucaagggauccacccgccuuggccucucaaagugcugggauuauaggcgugaaccacugcucccggcucauaccuguuauugaguggagggaugaagaaaugaacauguucugcauugcuccagacuacaagaacuggaacaaugggcagaaggcaugggaaguccuguguaguguaucgggcugacuucccaagcccugaauuaucuggcuccaugacagcugaggccaggggacacuggcuuuguauucuugcauuggcuagaauuuuggccacaccgggugauucucccuucuuacucugagaugcugggccccugccuugcauugacagauggaaacuauuuuuuuuuuuuuuugagauggagucucgcucuguugcccaggcuggagugcaguggugcaaucuuggcucacugcaagcucugccucccggguucaugccauucuccugccucagccuccugaguaguugggacuacagguguccaccaccacgcccggcuaauuuuuuguauuuuuaguagagacaggguuucaccguguuagccaggauggucucaaucuccugaccuugugauccgcccaccucggccucccaaagugcugggauuacaggugugagccacugcgcccggccgacagauggaaacuauuuacacaaaaccauuccuugcgggcagucagauggggucuuaaugcuuauuuuuaaaaagagccuuuuucugguguuaggaacuacuuguugacuauuuuuccugccuacccaaguaguucucuaaaucuaaaauccagugauagcuugccuuauuuaaaugcuuguuuuggcugggagcaguggcucaccccuguaaucccagcacuuugggaggccgagguggacggaucaccugaggucaggaguuugagacuagccuggccaacauggugaaacccugucucuacuaaaaaugcaaaaauuagccggguguggcggcacgugccagcuacucuggaggcugaggcaggagcaucgcuugaauccgggagguggagguugcagugagcugagaucgcgccacugcacuccagccuggguaacagagugagacucugucucaaaagaaaaaaaaaugcuuguuugaaaagaugcaaguuucccugcaaaaauaggugggaaguaggcgcuaaggcagcacauuaucguguagagauuuuggagacacaggcuuuggagccacaccuaagugcagucuugcugugccacuuacaagcuauagggucucggacaagucucuuuccuucucuauucuuguuugcucauuuguaagaagaaaggggaggccaggcaccaggccauggcucccgccuguaaucccagcacucugggaggccgagguggguggaucacgaggucaggaguucaagaccagccuggccaagauggugaaacaccgucucuacuaaaaauacaaaaaauuagccagacccgguggcaggugccuguaaucccagcuacucgggaggcugaggcagagaauugcuugaaccugggagucaagaucaagccacugcacuccaggcugggcaacagagcggaaaaaaaaagaauaagaaaggggauaggcagaaguaauagaaauuucauagggcuguuaugaaaauuaagugagcaaaauuuguuguuuagccagcacuuacaaaaucgcuaaggaacuguauuuuuuuuuuuuuuuuuuuuuugagacggagcuucgcucuuguugcccaggcuggagugcaauggugugaucucagcucagcgcaaccuccgccucccagguucaagcgauucucaugccucagccuccugaguagcugggauuacaggcaugcaccaccaugccuggcuaauuuuguauuuuuaguagagacgggguuucuccauguuggucaggcuggucucgaacucccgaccucaggugauccgcccgccucggccucccaaagugcugggauuacaggcgugagccaccgugcccggcccaggaacuguauuuaaaguacacacacacacacacacacacacacacagagacagagagagagagagagagaaacugagcuaauucgaggcaguuaauagugaaugguugaaggugacuguuauuauaaagguuguaucacauuucugugugauccaaagacugccuacaucagaaucgccugagauucugggaaucacugagccccucccugccuuccucccuggacuacccaaucauaaugucagaguuccccaaauaauucuuaugugcacuaaaccucucagagcucuuggugaaugacuuucagugauuggugugcaaacuacaguagauagauaaguuugaaagcacaucuuagcccaugcugcgccaaagcucuuucuuucucuuggcaggugacaugaaauggcagaagcuaaaucccacuggggcugcuccagcaggcugugcugcccacucagcuguggccaugggaaaacauguguacaucuuugguggaaugacuccugcaggagcacuggacacaauguaccaguaucacacaggugagcagguguccaugggggaucuuuaaacaaaucuaaacauucuuugaaacgugaugcgguggcucacgccuguaaucccagcacuuugggaggccgaggcaggcagaucacgaggucaggagaucgagaccauccugaccaacauggugaaaccccaucucuacuaaaauacaaaaaauuagccaggcgugguggcgggcgccuguagucccagcuacucgggaggcugaggcaggggaauugcuugaacccaggaggcagagagguugcagugagcugagaucacaccacugcacuccagccuggugacagagcgagacucugucucaaaaaaaaaaaaaaaagaaagaaagaaaaaagugaugcagugcuuccaauuugguuccucuauaucuaaauccaaaagaaugaaaacucuguaggggaugacaucaggaaagcagcaaugcugccauaagguuuuuuuccuuuuacuccuguuuguuaggacucggcugcuacaguaaaucacugagcauuucuagaaauuucauuacuuuuuaaauuuuauucagauuuuggcuuucacuaucuggaaauuguuuuuuuuuuuuuuuuuuuuuuugucugagauggagucucacucugucgcccaggcuguagugcggugacgugaucuuggcucacugcaaguuccaccuccuggguucacgccauucuccugccucagccucccgaguagcugggacuacaggugcccgccaccaugcccagcuaauuuuuuuuuuguauuuuugguagagacgggguuucaccguguuagccaggauggucuccaucuccugaccucgugauccacccgcuucggccucccaaagugcugggauuacaggcgugagccaccgugcccggccuaucuggaaauuucuuaacaugaagccuuuucccuccccaacauagaagagcagcauuggaccuugcuuaaauuugauacucuucuacccccuggacgauuggaccauuccauguguaucauuccauggccagugacgugugcuucugagaaagaagauuccaacucucucacucugaaccaugaagcugagaaagaggauucagcugacaaaguaaugagccacaguggugacucacaugaggaaagccagacugcuacacugcucuguuugguguuuggugggaugaauacagaaggggaaaucuaugacgauuguauugugacuguaguggacuaauaaaacccacauuuuuauuaccugucaguuacuuucagaauaguuaaguaaaacauuagcuguuuuauaccuccaaaauaucuucugcauuauauaucuguuuuucuccuacuuugguaggugaagaaacuaaugcaaauaauucuuaugugcacuaaaccuugcuauauugccucuca

SEQ ID NO: 191196 - RNA, 90351 nt, Homo sapiens
acuuuccaguuucucuuuuauacuuuuuugaaagauuacuuuuuaggaacauuugguaugauaugcauaaaauuauuuauccauuuaugggcaaaaugauacaaguagcaucuugauugaacaucauuuaccucagauauucaaccagcaguacguuuuuuaugcagucucaacccauaucccauuuguuaccucucagaauauugguaagcaguuauuuucgcuuuacucuguauuucuuguguuuugggcacagguuauuguacuacugucaaaucguacuugcuauuuuuucugcaaguauuuaacagaaagcuuaaaauccccauaaaaccccaccuuggauaagugauuguuaaauauuguacaaauaaaauguaugcuauccccauuccauccccaaguuaaauaaaaaaaugaauacgguaugauuugcauaugcaguuuuucuuuagcuauguuuuuuuuuuuuuuuauacuuuaaguuuuaggguacaugugcacauugugcagguuaguuacauagguauacaugugccaugcuggugcgcugcacccacuaacucgucaucuagcauuagguauaucuccuaaugcuaucccucccccauccccccaccccacaacaguccccagagugugauauuccccuuccuguguccaugugaucucauuguucaauucccaccuaugagugagaauaugcgguguuugguuuuuuguucuugugauaguuuacugagaaugaugauuuccaauuucauccaugucccuacaaaggacaugaacucaucauuuuuuauggcugcauaguauuccaugguguauaugugccacguuuucuuaauccagucuaucauuguuggacauuuggguugguuccaagucuuugcuauugugaauaaugccacaauaaacauacgugugcaugugucuuuauagcagcaugauuuauaguccuuuggguauauacccaguaaugggauggcugggucaaaugguguuuccaguucuagaucccugaggaaucgccacacugacuuccacaaugguugaacuaguuuacagucccaccaacagugugaaaguguuccuauuucuccacauccucuccagcaccuguuguuuccugacuuuuuaaugauugccauucuaacuggauaaaauacuggcaaaacgaauccagcagcacaucaaaaagcuuauccaccaugaucaagugggcuucaucccugggaugcaaggcugguucaauauacgcaaaucaaugaauguaauccagcauauaaacagagccaaagacaaaaaacacaugauuaucucaauagaugcagaaaaagccuuugacaaaauucaacaacccuucaugcuaaaaacucucaauaaauuagggauugaugggguguauuucaaaauaauaagagcuaucuaugacaaacccacagccaauaucauacugaaugggcaaaaacuggaagcauucccuuugaaaacuggcacaagacagggaugcccucucucaccacucguauucaacauaguguuggaaguucuggccagggcaauuaggcaggagaaggaaauaaaggguauucaauuaggaaaagaggaagucaaauuguccguuugcagacgacaugauuguauaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaagcuacugcucaaggaaauaaaagaggauacaaacaaauggaagaacauuccaugcucuuggguaggaagaaucaauauugugaaaauggccauacugcccaagguaauuuacagauucaaugccauccccaucaagcuaccaaugacuuucuucacagaauuggaaaaaacuacuuaaguucauauggaaccaaaaaagagcccacaucgccaaggcaauccuaagcuauguguucuuaaagaggggagugguagcuuuguaacuuacagugaggcuuacaccuugacaacugcaagaaugaggauaguggugagugaagggagauuuguuaauuauggcauuucccucuauuaucgucuaaacagauuauauucccacuaaaguauguguguugguccugccaguauuagaaaccagaggcuuguuggcauugugucacacaguacacaccaauggauucucagauuuucuaggguaaaggugaaggauggggcagcacuuagguuauggugguuugaaagaaacugaauugcuuucuaaaccagaugaggaucagagugcgaaccauggugaaauaugcauggaaacuacagaaagacugaaguguuucuuacgguguuuucugcaaaacgugauucauuaggacauuaacagguauuacguuuucaacauauacagcauuaugauacaguaaguuuggaccaaacagguauucauuccccagagccuuucacaugcacgagaaucagucauuuuaacaagaauuccguuucugcugggccacuuggaucccuuggauucagauguaaaaacacacugaaauauuccuccuuucaccugcuuuucaguuugagguaaucagauugaaaagcaggaguucaugcauuuuuugguucuauuuuuccuccucuaguaaaugaagaaaauaagcuauauguauaaguuuacauuauucuugaaccgcuuuuuaaacuaggguuuuucauauuuguuuuuauugaugacaauuaaagcaauuuaagagacgaaguuagcucaaaacucuugcgaauagauuuuagcauuuuuguaugagggaauauggaaaggccaacaagcagcacuguuccuccccacaaaaaugccuugggaauauaauaggcguacacuucauuuguguaacuuuuccuaauguauuuuuuuuuaauuugcuuuauaacgguuucauguuuaccucaauugguacuuagucuuaaaaucuuucuuuauacuugguuauugauggaucuucugcagcucuuauguagccaaugagacagaugagggcugucagcuuuuaagugacaucuuaagcuaauaagaaauuggaauccucaagucauuucaugaggcuguuacccuuuaagacaaauaauacuuuccucaaauaguucagaaaauuuuuaaaaggaucacuuagagcauaaguguaaaauucuugcuucuaguauauaauagugauguuaccaugucaaguauuuuggugaaauauccccuaaaaauguguagacuacggcacagauugaguaugcaagccuuagcuugaaugagacugcugagaaguaaaugacagggaucugaauacuuagcaggcuuaacuuuuugcagggaaggaaaggcuauguaugcaaaagaauagguuguaacuacugaagagcuacuuuaugcucagaaaccuuuuauuccacuuuguauccaagauuucauuaaaacauuguuccuuagagcauacuuuaaaaacuauuugguaaggaauccacuguugaacuucaggucuuaauagcacuggcuuuggugcuaaacugaguugaauuccaagccuguuggccauucccagcauugccacugcuguguuaguuuucucaucuguaaauaacugccuacaucucacagggccucuaauaguuaaauagauuguaagcugcacaagcauagggacagucugucuuuuguaaaccucccaugcacacaauaggaaaucaaauauucuugaacaaaugaagucacuaagugcucauuaaauuucauuuuaaauauaugccucuguuaauucauggaucuuggaacuuacuuaaaagacaaugcuuugacggacauuuccacauuccucauagggauuuacuuuuuaauacaaacagguucaguuaacauugccauacacaucucauuacuuuugggagugcuuuuccagaaaucucugguagucacgucacuucaugauggggcuacguucugagaaaugugucuuugggugauuucaucacuguaugaacaucacagaguauacuuacacagacccugaugauauguauauagccuguuacacacuuaggcuauacagauagccuagccuauuacucuucagcuauagcacuguacagaauguuacuguaaucauacuguaggcaacuguaacacaaugguaaaacauuuguauauuuagacauagaaaagguacaguaaaaauaugguauaaucuuaugagaccacccuuuauacaaugucauugaccaaaauguuacguggugccaugacuauacuuguuaagaaggaaaauuccaguccuuuugaccuaugguaggcucaacaaucuguaauuuuagaaaauccuacaagggauucugauguggaugguaugaguaccacauuuugagaugucuagaagaaaaaucuucaaacuccuuggccuuuuucuuccauggaaccaucuucugacuaagcugguuagucuucugaacuagaaaaccugggucugggauagaauccaaaauuugcauguggacagaaaaaaacacugcagcaaaccugcuguaccaaagguuacuuauuauacuucagugcuuaccauuguuuuuuuuacuccuuugguuuaagguuuguaaagacaucuagcuguuagguugaagugagcucuucaaauagaccauuauauauauaaguguuaaaaaagcacauggucuagucccuaaaacagucauauuuuauucuucugaacagcuacuuacaaaguaaucucaaucagugaaauuauaaaucauguaacuguucaugauuaaaaggcaagacacagccaagacaguagaugggcaagucucacauaaauacaagaauguuuauagaauguuuagcauaucauguuaauggacaauaguuuuccguucucuacagaaguaugaaugaaaugccaaaguugaagucacugguuauauucauaaccagcuuagugaggauguugcccacugccucacaucuguaggacaguugggauauuucugcagagcauucauaauuugaguauuauccaaaagcaguuucaucagcugguacucucucugugaauuuccugaaguucuuuccaugggcuuuauuaauucuaauugcugcaaguguucaaaagccugaaagaugaaagaaauaguuuagguugaauaggagaggagagugacaacucuccuguucucucccagagaacaguuagcauuuuggucagcugcagaacagaguacugggaagcaaaauguaacaacaaucaauaggauuaaaaaaacucucacaaccccaugaaaacucauauuaucagguaaaacagugucagugcacacuuacuuguccauauauuguugaauguaaacacggcaaacuuuaauucaauauauacaauaugguuuucuuccuagccucauucucuaucauagcuccuccuaguacuuuaauaaauaguuuccaguucucuguaaaaaccuaagaaucagauaagacuuucugaucaauucccuaggcuacucagauuugcauuuauauuuugucugucucuauuuuugcuuugcuauguaaaaagguaacacagcuguaacagagggaggcagaaaaagacccuugagucaacuagacauauucagcugauccuguaaguaaaggauucagcaggcuaguauggacauggaggagaagggacaggcuccuguuuccucuaagaagucugacugagacugucacaaccuucuuccaucuuccccaucuuaauagggcucuuucuugucuacuuccucuuauccuuaauauucaccuauuauaucuuuucuaaccuugaguguuguguuagguacguuauuagguuaugaaaaaaaaaaccauuaaaucaugauauacuaaccauuaaauaaugauacacugaaauagauuccugaggauucuauuauauucuuacaacucacuguaaaaaacaucacuggaacauauucucuauguaucacauaaauucuucugauagagaaacagcucagauaccuucauaucugaacaugagaaaauacuggaggcugcagguguuaagagcugaauagaacugugcagauuuaaaacauuucuaaauagcaaaauacuucauaauugaaaauucagaaaugagcagcuacaaauuauugagaauuuaaaugcaggcugggcgcaguggcucacgccuguaaucccagcacuuugggaggccgaggugggcggaucaugaggucaggaguuugagaccagccugaccaacauggugaaacacugucucuacuaagaauacaaaaauuagaugggcauaguggugcacgccuguaaucccagcuauucaggaggcugaggcaggagaaucgcuuaacuugggaggcagagguugcagugagccaagauugcgcccgccacuguacuccagcguaggcgacaggagacuccaucucaaaaaaaaaaaaaaaaaaaaaauuuaaauacuuggguaaccuuuccauuuucacagcucucacaaaauaagacuauuaggggaaaaaaacccuccaguauuguaaaauacuuuuccuguuucuuugaagaaauggcaaugcucuguacucauuuuuguugcuacaagaaaugaaauucugguuacuagggccuauaagggaugccaauggacuuggggaauccacuguuuuaaaaguuucuuuccuuaaaaucuucaagagcugcacuguccacgcuaggcuacugagcacuucaaugugugacucaauuuuuuuuuaaacuuaaaaauggauauuuaguucuauuagaaaauucugagcauguuuagaacaauuucaaaauguaaauuuacuuucucagcuauacauuuuauggaaucuaaacagcaagaauuuccaguaaacauuuaggccauugagaugugcuuaaauauaauguacaccaaauguuaaagacuuaauucaaaagaauguaaaauaccuuacuguucuucuauaaugauuauagaaugacacauuuuugauauguugcauuaaauauauaauuaaaauuaaaccuuuuuauuuuucuuacagguacuagaaaauuuaaaacuacauuacauggcucacauuaucuuuguaguggacaaugguaaucuacaugaaguccugaaguuguaaaacucaugacucagcccccaaauaacacuuucucuguaugcccucacaggccaauaagauuuugucuuuuaaguuucuuaauggcucuaauuuucauuguuuucuccuuuuacugcugagauuauaaaagccaauccuuggguuggaaagggaaagguuauaucacacacuauacugaauaguuguuuucgggaugcaagugcucugaagagacagcagagggcaguauaccuccacaaacuaaaacaaccggucacuuccucagauuuuuccaaaauauuucauuuuuagauaauuuucuuguuuugaaaaaaaucucuauaauacuuaauguuuaaaaaugaaagugcaauuuuaauacauaaucaaauuggauguaaaaaauauacuugucuguagaaaaaugacagcaaacuaaaucuuaccuucaugacaacagguuuuucaaaauuauaaacggaaugugcuuuccuuugaacaaacuucugaaacucugaguagaaagcaaugacaacauuauaccuucaaauaagcaguggggaagagucagaaaaaagcuacuuaagucucaucucaccauuauagaccauuugaaaauuaaauggcucuuccucauagaugucauuuaaauguuucauugcuauuauaagacagauuuccaagacugauagaccuacaguaaaagggaaaaaaaacuaucaguuuaaugacauauaagacugaaauaacuguucuccaaagaauacaauauagugaaagaucuaugguucugaggggugaagaaggucaagauucuucuagauuucaauguguuucaauuaucuauauaaauuuaaguuacuuaaccucccugagcuuaguuuuuuuccuaucugcaaaauaaggauauuuuuaaacuuuuagaaaugucacaaagauuggcgaaauauuaucaggcacucaccauauggcccacaguaaacaaaauaaacuucaauuguuaugugacuuuaaaucacacagggccuuugcguaggauuuaucuagagacuuccuaaacuccuggaaauuauauccaaaucuguguauuccuuuuuuccccggagaggaaaagguucauuacauuuggaaaaggaaauaacaaacccaaaaugacugaaacccagagaaugcucuucaguaguucuugauacaaugauaacaucagcaacacagucuuaccuggauuuccaauguggcaaaagaggcagagcgucaaauuuuuuuuucacuuuaaaugggagugauaguaccuuuaaaaggacuaaguuaaaggcuauauggauacgaaaguauuuuauaaagcauuaugcccacguuaauuguaauuuuaaaaacauuccauuaucuaaauucaaaguuuuaaaaaccacaauuuaaaaaauaaggcuggguucucaccauguacaauauuugcuuucgaguccaugcuacacaguuggcuugcuuccauuagaucuacggcagucauaaaugggugcgaugcuguuacucgauuuaaagcaagcaucuagggaaagacagaucagaaaaacaauuacguauuuacaugggcauuuuggagauacugugcaaaacuucugaauuuguauaguuaauucuuaagggagaguaaauauuaaugcuuaggaagguauucucaaauucaguuguauuaaaauacaguauuucaauuugugugucacauaacugcagauguaaagcauaaaaaaaguuccugcugcucucucuaacccaucccaguugcauaacuuguuuacuuacugcuuggaagaacaauguuuaaagaggaguaggucaaggagaagaaacugaaaauaauuaagaauacuuacuaauaaaagccccaaacacaagcccaaaaggcagaucuacgccuuacuuguuaacuuuuucaccacccaaucauccagccagguuaguauuaauuuagacagaaguuagcuguuuuauguucaauuguacaaaaaagaaaagaaaauagcacauuuauacucaggaauaacucuccuugaaagcacagucuccuucucuugugcugcuucucuguucaaaaaugaacagagguccuggaccagaguugcuacucaaguauuugaagauuuccuuccuuccuucuuuauuuguauuuuucaugaaaguuaaauuuggucauuuaggguuacaagauuuagcagauaaaaaugcaugaccucugguuaaauuucaauuucaaauaaacaauaaauaguuucuuaguaguaugugccaugcaauauuugggauauaauuauccaagaaacucuccuucaccuuaacaagggcgcaacugauuagcugggcagagaguuuggcaauccuuguccuucauucuccuacugguugggaccuagauugccagugcucccucccuuucucucuccuuuccuuuuuccuuuaguuauuaauuuuuuaauuuuuauuuuuuaacuucauuuuuccauaaguuauugugguaugggugguauuugguuacaugaguaaguucuuuaguggugauuugugagacuuuggugaaugcaucacuugagcaguauacacugcaucauauuuguagucuuuuaucccucgccccacuggaaaacaauguggagauuccuuaaagaacuaaaaguagaacuaccauuugauacagccaucccacuacagggcaucuacccagaggaaaagaaguuauuauuugaaaaagaaagaagucauuauuugaaaaagaugcuugcaugugcauguuuauagcagcaaaacucacaauugcaaaaucguagaaccaacccaaaugcccaucaaucaacgaguggauaaagaaacugugguauauauauacuauggauauggauaaagaaacugugguauauauauacuauggauauauggauauauauauauaugugguauauauauacuauggauacuacacagucauaaaaaggaaugaacuaacagcauuugcagugaccuggaugagacuggagacuauuauucuaagugaaguaacucaggaauggaaaaccaaacaucguauguucucacugauaugauaugugggagcuaagcuaugaggacacaaaggcauaaauuuuuuuuaacauauacaaaggcaacagagaauaauaaauaucuaugacuacuuuaccugcuuaagaaauaugauuuuagaguugaagcccaucuccuccggauuggacucuacucuuccccacauaaaacaaccaaguaugucuauacuauuagguuggugcaaaaguaauugccauuuugggcacugaaaguaaugguaacuuuugcaccaaccuaauacuucuacuacauauacauguauuauacaacagaguaauuuucaacuuuuauauaaauauauuguaucuucacaacucucuucacugugagguuuuacccauguugaggcaguaucaauucugguuuauucauuuuuucauuauauuucuuuguauauauccacgauuauucauuuccuaauuuccuauugacagacaucuuucauuucuuuuuuuuucccaauuauaaacaagacugcaauaaacaaccuuggacaugucuuccugugcauuagguaacuagacuuucucuaauuaguauguuucucuaguuaccuaauuugcuaaauaaauugcucuccaaagcacuuacacauauuuacauuggcagcagcaauaaauauuaauagucacagucaugauaccaucaagcauaaucuuuaacacccacuagauuggcaagaaaaaaaaaguuuaauuguaguauuucucugguuacuggagaggcugaaaaucuguaaucuauaaugagcuuccacaguaagacaaugacaacaaauaaugggaugagcuaagaauaugaguaagcagcccucaaaguagaaucccauaugacaaaaaacaagccauuauuuaauucauuaccaugaauuaaaaauguaauagaaaaauggcagaacaauggccguuaauauugacaauacugaggcagagauauuuucccagauggagauguguguguauauauauauacauacacacauacacacacacaccccuccucuaaaaauuacuaguccccaaauuccuucaugauaugcugaaaauggcaguaugcuuuugacaauagaagaaaaguaaauagggauaaaaagacuuaaauuccucagcagaagcagcaaugaggaaagaaaacuuguauauaaacaugggugaaccauacagccaaguaggacacaaacuugaagccagagagcuuuggauuaaguccuggcuuuguuaucuacuaguagugugaccuucggcaaguuacuuagcuuuaaggagccucaauuucuuuagggguaagaauaaaaaauaagauuauuccaauggccagacauaauauagguacuacuagcaucaacaguacuuggcucauaugccaguccauaaaugguagcuacugucauuauuauucuauuauuauuaaaaaugaccuuucuaugaaaccaaaacuaucuugucuuucaaagguauuugccauaauuuucuagaaauauuagacuaaaaccaaauacucuuagugaagaaaguuaauuuucagaacaauuaaguacuucuuguuugauauugguauuauguaagcuuaagauauaauuacuuggcaaaacaucauaaccagguaggauuuauuccagguauauaaggcugguucaacacucaaaaaauaacauaaucaaauauaucaacagguuaaagagaaacauggucaugcgaaacgaucgagaauaagcauuugacaaaauccaacacccauuuauaagaaacucucagcaaguuacaaacagaugaggauuaccucaaccugauaaugaacauguauaaaaaaccuacagcuaacauuauacuuaaugguaaaaguuugaauccuuucuuccuaagacugggaacaagaaaggauguccacucucacugcucuaauucaacauaacacuggaaauucuagccauugcaaaaaagcaagaaaagaaauaaaaggcauacagauuggaaagaaaaaaaaaaccgucacuauuugugaaaaauguaauggucuacaucaaaagucccaaggaaucuauuaaaaaaccucuuagaauaagugaguucagcauagacuauaagucaaucacauuucuauauauuaauguguauauauauaaucaaucacauauucuauauguaaugaauaugugggaaauguaaugaauaugugggaaaccaaaauuucaaaacccauuuacaauuguucuaacaaauuaaauauugguauacacauuaaauaaguacaucaucuguguaguaagagcuauaaaaugcugaugaaaguaaucaaacaagaaaucaaauaaaaggagauaugaacccuauucagagauuggaacacucgauguaguguuccaaugcaugucgauucucccaaaauuuaccuacagguuuaaucaauucccauaaaaacuuaauuaucuaaugaaagauagaaaaugauaaaaguaggcugggcacagugguugaugcuuguaaugucagcacuuagggaggcagaggugggaggauggcuuaaggccaggaguucgcaaccagucugagcaacaaagugagaccccgucacuauuaaaaacaaaaacaaagcaacaagcaauaaaacaaaacuaauacaaaccaauagcauguguaaugaccgcagguuuuugcugauauugaaaugcuucuguaguacuucuugcacacuucuaucuucugagagauacuaaaaggaaaaaaaaaaaaaaagccaaaauugaggaaagauguaguuuaaaaccuaaauauaauccugugccuuacugguugguguaccuuaguaacucuaucuaauauuaauucauuauuaaauagauguuggucuuauuuguagaacacuaaaaccaaaauaaaguuuccagucuacugauuuucuuauccuguucuuuacguuaauucaauaaacacaaugauaaaacaauccuggcuaaccccaaauucguacuugaauaagggaaacuacuacacagucauacuagugaaaugaacaaaaugcagcacaaaaacagaagugcaugaguuacuguaccuagggauacaagguaaaguauuacaaagaaugcuuaaacuggaugagacaagagauuuaaaaaagaaggaagaacauuccaguuacagggaacagcaugaguagcaggaaaauuaucacauuggcagaaaaugaguagucacguacuggaguuucaauuacuggcaaagugaauguacaaaaagaaaaggcagaaaaaccuaacuggagguagcuguccagacaagagguaaagugggucggaauuaucugaguguuaugaagaaaaaagaauuaagacguuuauaggaguacaucugguagagaauuaacugguagcagaagagaaggaaggguuugaaagguagaagauaaaaaucaaacaugaucuaugggaaacaaaauggccugugaaaagugaaauguggucaaaaaaugaaucuuggauuauuaauauuuaaguaguaggugggaaaagagaaaaacuaagaaauuaagaaagauaccaaagacuggaagagaaucuaagacagaguagagaucuagaaaacaagggaacaaaguuuuaagagagaagugagguucaacaauauaaacuacuuuguaaaaagauauauuugagaagaggcuaauggcuuuagaaauucaaagaucaccacagcccuuugagaaaguaccaucuaaagaggcaagugacugcaguaauuaggguugaauggaaggugaggaacacuggcauugaagaaaagauuagaugaaaaaagaguaaauucagaaguagcagagccaagaaaggccuggaaaagauugucauaauuuuucaaaaaucaucugcauggaauaaggauucuuuuaaaaaaaaaaaaaagcccagaaaacuaagcauuucuguauuuucuagagcuguaauuauaugucuuuacuuuguccacucuaagaagaccagauucagaaguaaguucuagucuacuggaauaaaauuuuauacucucaggaaauauauuaucuuaauuauaguucccacucccuugcuauuguuucuagucuucucuuuguauuuuaaaggacuucugguuacuauaucuuuuucuaucacaaacacgguagaauauccuuggaaguacacagggugaacauaaaaaaaacaaaguaauaccuuuuggaaauuaaaaaaaaauuuguuuagcuuuuccaguuuuaaaauugcaauauggaagauauguggcuaaauaucacaggcaaacuauagucuugguuucuguaaucuguaaguuguaaaaguugaugugguaaaaucggagcacuuaggaaaacuaaagaaaaucaccugggacaaaauugaagaaauuuucucugcaagaaucaauuauuuuuaaaaccugcauuugccucucuuugacaugaugcuucaaagguuaaucuucuauacuccaccuuccuacuuuaucucuuuauuuuuuagugguuugacuccaauucccccucuuucuaaaagcuaucgccuucuugcuucuauaauuacuuauucugcuuuuuaaaaugccuaccuuaucuacaugagccauuuaaacaaaaaaaauugucuaaccucguucauuauauuuuuaauuccaucuugauucaaacacuauacucuauuugaggauaaggcuauuaucaacaaccacauaagcuacaguacuuugggagauuucauuugaggagaauaagguaugauucuuuuaaauguucuuuucaaaggaucccucuuauacugccaugcuaagauagagucuacuuugcuuauuugacucauuugaaguagggcuaaaacaaaccuucaaauuaggcaggauaucaagguucaaucuuauccugaagauauuucuuggaugagauuccaugugugaccuguuaucuguaucacugcuauuggcuuaauccugccauucaaaauagcuuccuggauaaucggcacuaagagaaagaauagcucccuuaaugcagcuaccacccuacuccacaaggcagggacucugaccauggugcugacagauuuuucaagugaagcucauuuuauucacauaccaaagacaggcacaagaugaucaggauaggggaagaaaauauuagaacucagagacacaaacaccagugaugcugguucuacuuaaugaaacugacuauuaagacuaucaaaaugaugacaagacagugcucacaugcaggggauuuaaggucugcaacaaaaguccagaaaguagauuaguuaugcuacuaacacaugguuaucauuuucuaagucacgcaguuauacuucuucaccaguaacucccagcauccucuuuauuuauagacucaauuugagaugcucagaaugcaacacaguugggaaggaaaguggaugaaaaauggcacagugcaaccuagaccauguaguuaccuuaagaagauuaagugugagcagguauggaaaaaaaaaagcccauggaaaguacagacauuuaaauacuaugaaagacuacauuugaaucucuaaaacagccagaaaaacauacugguggaauaagacaaucaguucaggaguuguagaagaugaaagucugugaggcacugaaaaguagaucuaaaagcugaagauccagaggucugguucacaccagaccccaguaaaaggggacaaugugggaguaccaacuacaaagaaggugcuccuauagauggaauccuauaauuagaaauaguaucaaagacacuuggucagguaauugaaauacccgagucucaggaaagauugaguggaagggaggauccauaccuaauuauaucaaggcauaauaucugaauuuuaaagauaaugucagcuauuuuuacauacaauuauguauaguuguauuaagaaaaagaacagggaauuauuaaucauaacaaugggaaaaaaguaauauaaaaauauguaggcuuugaguccuuuauguaaaaacaacauauuuagcauguauauaaacucugcaauguuguagaccaaguaauuauuccauaguagaagaaaggagaauugauauagucuuaagggaaacuuccacuguuuaucauguauucuuuugcacuaauuacauuuuguucaauaaacuuuuaugauauuuuaaaaaaaugaaaugugucaaaauacugcuuacaugagcagacuauauuuuauaaucaaacaauaaucauuuaaagaacaaacuaaaugcaaaacgcuuccaauuuaguauuaguauuuaaaaauucacgguaaaaauacaaucuaccacuauugcuuuaaaauaaaaugauccuuuuuauagagucagugaauauagacuguguaauucuauucaaagaucuaauuauccuuaccgguauuuuaacauuauaaaucaguuuuucccaauuccuucagagccagggacucuauauuauuuuccacucucacgaggccaauauuuuuugagauucuagcauaagggacuuauucauuaaugauguuuuucaauuauauuauuaaauacacacacauaugcauacuuccuccuuucucuuugccaacugaaacuuuuugacagcguaagauuaaaaugcuaguguguugagaauauuuuaagcacagguaaauuuauagucucaaagguguggcaaaucuuuaaaacaacauaugaaccugccuuuguaucuaagacucucaagucuccagggacugugagaugugaucaccuauuagauaauauaacuggaggugccacagucuguacugccucuuaaggcccaacaaaauaaaagcugaaguugcuaaugaaaacuggaagaaaaaaaauauccacacauaauagguaugagucauuaacauuuauuuaucauuauuuacuauuuauuauuauugcuaaauauguaaaauauauaaaauaaaauuaucuaaaauauaaaccacauacagauaaaacuaaagccucauuaaaguuuacuucaaacuaauaacauaaauccuaaagcuuaacugugauguucuuuugagauagaauuuaggagaaaugacauuucaacugucuaagaagaaaauuuuuaaaaaguauauaauuuguauuacugcagcauuauccuucagcaauauuagaaacuuuguguuaauuuacuaauuucuaaaauuuguguuuuaauugcuuuaaaucauauagcaaggaacauuuagcuuuauugccuuuuaagauaccugaacauuuucauuccacuucucagcaaaaaccuugucuggaaacucugcagguagagauaacuguucuuuaaauauuuuaacauacuguggaaaaccaaaugaauucauuaaguguaucugccggugagaaaaucuugacuucacucuuuuuucuaagaguuccaaaauauccuuaaaaacaaacagaaaucucuauaaggaagaugaauguuuuuaaaaaaacaaaaacacuguaccaauguuagagguauaaguaaacuaucaccuauaauuaguaauguuuagucuacaauacauaauuaaacauuuaaaacauuuuaugcaaacuaaauaauccaccuccaggcauuugcuggcuuggugaugucaugccuuuuucccaccauguuacucucagcuaaucuguaacauuccaagacccaacaugacuguuuaaaaaaacugacaauauugaauagcuauaugucacaauaacaccaagagugucaauaaggaauucuguacauucuaugaagaacugagauuaaaaaauuaauagcaugauaggcagcaggaaccaacuuuaggagaggaaaguggcagaaaugcaacauggcauucguaaguuaucuuccggcuuuuuuuuuuuuauaguaaugcuuuuagacucuauuuguauuugugcuauuuuuccuuaaaaagaaaucaggaaucaaauuuacugucaaagaacacuaaaaaccaaaggauaacuaauauguacugcuuguaaggacauacgaaguguucuuaaaugaagaaaauacuuccacaaaacugauaggcauucaaacuauccaagacaucaaaagcacaauagguaagcugucuuccuaagucacauauauugcaggaacugucauuccuaaaucucuuuuuaauaaugaacuugagcaauuuuucaaaauauauuauaguacacagcauauuauauauaauauauauaauuuauauuauauauguauauauacaucuauauauauacaguauaguauaauauauauuuauuacuuaaguuacacuccaagguauacaaccaagacaaaugaaaccagauaaccacaaaaaaaguguaugugaauguuugcagcaguauuauuuuuaauagcuuaagaaauauaaacaacccaaauguccaucaacugaugaauggauaaacaaagugugguauaucuacacaacagaauauuauuugguaauaaaaaggaauaaagggcugauauaugcuguaacacagaucaacucugaaaacauguuaaagaagccagucacacaaaacuauacguuguaugauucaaaaauuacuaaacagucagaaaguggauuagcagauuagugguugcauagggcuggggagggaacaggggauuuggggugaucacuaaaagguacguggcucuuaaacuguggugauaaaugcacaacucuaugaauaaacaaaaacccuguuaauuguauaauuuaaaugagugaguuguaugguauaaauuacaucucaauaaagcuguuuuaaaaacagugacaugauauuugaugacuuuaaggaauuacagcuaauauaacaauuauauuagggaaauauauuuuuaaagagcucuuaucuccuaaaaauacauucuaaaauacuuacugauaaaaugauauaauaccuaguuuuugccucaaaauaauacaggaaugaaaggagauguugaggauaaauaaaauuagucuguaguaauugaaucuuggcaaugaguggagaagggaauucagggcucauuauuuauucuuuccuauguauauuguugaaauguuauaaagauuuuuaaaaggggaguaguuuaagcccagaaauauacaucuccacaucuagccagaugacucucauaauaccuacgugaagaaaucaugauauagaggaaagaauucaagugaucaaaaugggaucaugguuaguuugggaagguggacaggaaagacuaauagccugagguaggaggugggagggugaauaaaaaauuuugaauguuuuuaugaggucaaagaaaaguauagugccagcaugagaacuaaaagacaagaaagguuauauucagagauucagauauuguacauuuauuuucuauuaagaaagaguucuaggucacccauauagguagacaguggaaguaauaaucuauacaagcaacaauucagacccuaaauuugggaaugaaaagagauggaaguaaauacugucuuuguaguaggcaguaaugacagaaguuggcaaugugggcauacaggaacuaguaaaaacaaaacaaaaccaaaaaacaaaaauggaauuacucccaauggggaagaagaugcuugcuggcaaagucacuacucccucuauacuuuuguucucucccuauaaacguggauacacagauaaaauuauacuugaggccaggcgcaguggcucacgccuguaaucccagcacuuugggaggccaagggggguagaucacgaggucaggaguucgagagcagccugggcaacauggugaaaccccaucucuacuaaacauacaaaaauuagccaggcauggcgguguguggcuguaaucccagcuacucgggaggcuaaggcaggagaauugcuugaaccccgaagguggagguugcagugagccgagauuaugccauuguacuccagccugggcgacagagcaagacuccaucucaaaaaaaaaaaaaaagaaaaagaaaaaaaauuacacuugaaagaacuacacaguuggagaauuauauauauacaauaaaaaagaacaucugauaacacugcuaagaaguuacuggcauuuuauuugguccguuauugggucaacaacacucaccacagccacuuccacccaaaggaagauuuuuuuuuuuuuggcaagaaggaggaugcuucuuugauccuugucaucgccugcugcuuuuggcaaggaggaauaaagauauguggagcaccagccagugauguaugagggauguuuauacuaaagccauguaucauaagcucuagagcacaggaaaggaggggcaaaugacagucacucuauagagaaacagcacuggaaggaggacuguugaaauaugaauuagaaaaaaguuucacuuuucugaaaaagaaaaaggguuguaggaaaggagaugugaacauguaaaugugccugacacaucugccgagaauggagggggaagaggauugcaagaaagcuauggaggcauggcagucauagcaugagaaaagagacaacuuugcuaugguuuggauaugguuuguccccaccaaaucucauguugaaauuuaauugccagugcaacagugggaagucacuggaguggacccucauaaauagauuuaaugccuucuuacuggagugaguucuuguucucauggggauagauuaguucuugagacagugaguuguuauaaauugagguuccaacuccuaucugguucguuuuugcacauuucgguuccccauuugaccuuccaccaugucaugcagcaugaaaacccuugcaacaaagccagugccaugcgcuugaauuuuucagccugcagaacugugagauaaauaaacuucuuuucuuuaaaaauuaccaagucucagguauuauguuauagcaacacaaaaugggccaaggcacucuucaauaccaguuuuaucugaauucaguaaguuaauacuacaugcguguaagaagguaaacacaaaaaggccuguacugcuguccaaagguacacaugguucaauauguacagagccuucacaaggcaaagugauagugauauugagacuauaguuaaaaucauucuaaaauaucccauggaaugaagaagccacuaucuacugucagugcuugguagaaucuuuuccauuucuggagauguguacuuugaaaguuggaauaguauuacuuagaguugauuucaagccuuuucaaaauauggaaaaaaaucuuaaaauaaaaacuauuaccaaguuuucucaaauauuggugagauuuaaccgccucauuacuugauaauguagaaauuauauuuauuagcauaaucugauuucauacuuuuuucuucaguaauuucacugggaggagggagguauucauuaaugggcuaagguaacuacuaaacuguuuuccucaauuugaguugaaagcaggauaaauacaccaggcacugcugaaacaaaauuuuuaaaaugaccuaaauaagugaaaaaaacuagcagugucagcaauuaagcuugaauuuuaaaauauuauaaucaauuuuuuuaaugaacagaaagacuuaccaaucuacauguaagaccaauaacugcuauuggggucugugcagacugagaaaugucaaaaagauuauagagaaguguuugguuuuuaugaugagcaaaaagaucaaauucaucuaauaugaagaucacugggcaacugcuaguucggucaccuaagauaaaauaagagcauuacauuaauaagaaauuauauccaccuuuccuaaauuuccaaaccauuuacuauauuucaguuuuuaaaacucaauucuguaaacauucugauagccuacuuuggguaggggauuuacugaugcauauacguucauucaacagaaaaaaauuauucaaaggacaaacacagccccgacugcucucaagaaguucagucuaggcugggcgugguggcucaugccuguaaucccagcacuuugggaggcugagguggguggaucaccugaggucgggaguucgagaccagccugacaaacauggagaaaucccaucucuacuaaaaauacaaaauuagucaggugugguggcgcaugccuguaaucccagcuacucgggaggcugaggcaggagaauugcuugaacccaggaggcagagguuguggugagccaagaucgugccacugcacuccagccugggcaacgagagugaaacuccaucucaaaaaaaaaaaguucagucuaggccgggcauggugacucacgcuuguaaucccagcacuuugggaggccgagguagguggaucaccuaaggucagggguuugagaccagccuggccaacaugguaaaaccccaucucugcuauuaaaaaaaaaaaaaaaaauuagcuacuugggaggcugaggcaggagaaucucuugaacugcggaggcagagguugcagugagcugagaucacaccauuguauucuagccugggcaacaagagugaaacuccaucuccaaaaaauaaaaagugcagucuaguuccuagacucuaguagaguuuguuguugaaaaaugucaaaaaucauuuaaaugacuaaagacuauuauuuuuauaauuacguaaauauaauucuuauuuaaugauuauaaaauugacagaguuuucuauaccuacacagaaccaaaacacuuuaagauuaaaauauaaggggagucacuaauuaaugaacaaaacuaaugcuuuaaaagagaguuguuuauuuaguagaaauacaagguacauuucuuguagaaauacuuuuuauaaacaaacuuguagauuauaaaguucaacuaaagccacuuaaacucccuugaagcacaacuuuuagcauuucaacuacaaugcuuuucauggggaaaguuccacaucacccucugguuacauuuuucucacuucaauaauggaaacaacuuuaguaaaagaaucccuuuuaccuuaggcuuaacgccuuuauauuuguguuaaaaagugaaacaaauaucugauaaaagaaagacuuauuucaacaaauaacaaauacaguagccuaaaugacuuaauacugguacaaaaccaaagggauuacucaaaagucuagaaagagacuuauguacuaauauagaauuuuaguauuugauaaaauauugcauuauacaucaguggggaaaauuagucuauucaaagucagaucccuacuuuacagguaaaaucagaauaaauuccaaacaaauuauaaauuacaaauauauauauauauuaaauaaaaagauggaucaaugaauguuuuuauaaucugaaggagagaaaaaacuuucuagauaaacuuaacuauguggaaaacauaaaacuuuagaucagcagaaaaguccaaaccaaacuuaagggaagagaaaaauaaaacacaaaaauuccgauaaauaagcauaacauaaacauuaccacaauaggucaaagacccaacaggaaauacagucgugugucccuuaaugacagagauacguucugagaaauguauuguuaggugacugcaucguuguacaagcauccuaacaguguacuuacccaagccuagaugguauagccuacuagacaccuaggcuauauggcauagccuauugcuccuaggcuaugaaccuaugagcaugugauaguguagacaacuguaacacaaugcgaaguauuuguguaucuaaacauaucuaaacacaggaaagguacaguaaaaauaugguuuuauaaucuaauaggaccacugucacauauguggucuaucauugaauuaaagguuguuauguggcacaugacuguacauaaaccaggaaauuucaaaggucaauaaaaauaugaaaugacaagcaucaccacuaucagaauuaugcaaauuaaguaaccagaauuaugcaaauuaaagaacaaaauuauucaaauuaaacuaagagcugaaaguuuuucuauuauaugggcaaacauaaaaauaauaauuguuuuugagguugugaagaaaaagguauuaucaaauauuuuuacaaauuaaaccuuuaggguaguuuuuaaauguuaaagauggugccuuuuaacccagaauucuacccacagaaauuuaucccaggaaauaucuggaugaucaucaaaguaucucuucuuaauuauaaaaaauuagaaacaaaagcccauaauuggugauuaauaaauagcaccuuauaaaacaagaaccauaaaaaugaugaugcagaucaaaaucuuauuacaaaauagguaaaauaauuuuauuguuguaaaaaaucacauuuaucucuaucaauaauauacugauauaaagaucaguauaucauugaauaaagauaagaaaccaaaugcuaauugagauaaucacuguuauaguggugggaauacagugaacauuguauucuuuuuaauguuucuguauuuuaugagagcuuuuuuuuuuggcaaaagcuuguauuaccuuuauaaucagggaaaaaauaaaguuaaaacagaucuucugaaacggcugaauauguuaauauuuaccuuuuuuuaaagcuuccagaagaaaugaaagguuuucagcaaagcuucccugaacaacaaaaugagauaaaaugauuaaaaguuuagugaaauaaagaacaaaagauggcugucugauucucaaauuuuauauaaacacuguauaucuucuaguuauuagagucauugcccagacucugcugagugucucuauacuuccuaucuaaaacuuaaauacuuaagcaaagauggcacaucacugaaaauggcaauuacaaugucaucuuugaaauuuuauauuuuagaacuugaggauaaaacggucaaagaagaaaaagaaaaguaagaaauuuuauauuuuccggaaaaaaucugaaagaauguuaaauuuauuugaagguaguuuuguagaauugccauauucuaaauauaguuugagaccuagaaauggauucuacuuugugucuucaaacacaauggggucuugcaagucucuaauuuguacugguaaagaaauaaccaugaauuuaaaugagaaacaaaaagaaaaggcuuuuuugaaacauuagauacuauaacaguguuugucuauucaagaguauacugaagaauuuauguauaucauaucauguuuggcuauguuuacuuggaauauagccaaaacauuuuuggauacuauuaaauauucuugaugaaacuuaguguaguagaugcauuauccaggugcuccagauuguggguagaagccccauuaaaauauuuguuucauuaaaauuauuaacuuuuacuucauucagaguucauaacuaaaagaaacagccaacuuuaaauuugaggagauauaaaggagaaaagaaacacacuuauucacucuccaguugagagaucuaacauaaaaauagcauaaagguuuuaaaacuuucacauauugugauguuguuaugcuauuuccaaggcaggcagaccaagagguguuauccauaauuuaccguaauauaacaaauccucaaagagacaaucuguugggaaaucaguggucaguuacucaaagguagcuugucuuucaggcuuuuugcuuaaaagauuauuacaucugauacuaaguauaugcuucuauaaauacguauuugugcauguauaauauacauauauaugucuguuuauaucaaaccagaaaagcuguggguugaauuaagugacuuagguucuuauaauguccaggcucugccauuuuaugaccuucggcaaccuaauuaugcucucugagcagaagccaaauuuauauaaugaaggaauuaaacuauuaauuucuauagcaguauuucucuauucaagaguacauugaagaauuuauguauaucguaucauguuuggcuaugcuuacucggaacacagccaaaacauuuuuggguacaacuuaaacuaauaaucucuauauaugauaauaauagcgaagauuagaacagaaugauaaaaaauugucauuuuuauuauuucacauaaaaccaauaugaauauguaacauuuaaaaaugucagaaacaccuacccagaucaacugggaaccaaaagccaaacugagcauacuuaacaagaacugucuuuggcucaguauaggccacuagcuucaacaucacauucuaaacaggagguagaauauuagauuuauagauggggcauuuugaaacugcacuucaaagaccuacagacuuuggaagggacaaauuuacucaaccuuuuagauuagauuaacauuuuauauuaauauuuuuauagauuaauauauuauauuaauaauuuagauuauaaucuauaauuacauauaauaaacuauaauuauauauaaucuauuagauaauuauauagauauaaccuauuauagaauuacauagauuauauaauuauauaauuauauaauuaauaauuuuauagaguauauaauuauauaauuaauaauuuuauagauugauuauuaaagaaagaaacucauaaaugcuaggagucuuacacaacuauggcggugucauugcagcacaaagcacacaguucagaaauuagagcgaugccaccgcauggucaccaguaaccagaaaaugaaguuggaauguguauaauccacuccaacugcauaagcaguaugaggcuagguaauuucaucaugaaaauucagguaggugcaaaauuaaauuaucauguuuuccuuaggcccuauauauuaggugaaagguaaaaguuuaauacaaguuucaaaacauuucaagucaguuucuuuuacugauguuguucacugcccugagacuauaagaugauaugauaaugaaguaugaauaaauuucugaaaacagaauaacugacauuuguacagcacauuaccauccagcaaauuauuuuuuaaguuaaaugauguguaauguuuucuuucuucuucaaaauaauccugugaaguauggauaauaaaauaacgcccaauuaacauguaaagaaucugaauucagagauacuuguuagcucaggauuaucaggcagucaaaggguuguaaggcaugacugaaacccaccuauugcagccucaaauuuagcacauuuucuacuauacacaggcuacucaagucucaaaaaaguagaaauaggcugcuggagcaugguauuuuuaaaaauguguuaaucuaucuccagagauacagaaucaaaguauucaccuuacagaaaaugaaauaaacucagaauaucuacauaaacuuggguuucuuagcuauuuuacagcuacuauaaccuacuauggaaaaauccaaguauuguagacuuaaugacuaaauguauccuauacauuacacauuuuuaugaaagaaucucauauauuucaauuaagaauuucugaaccucucccuacccuuccagaaauauaaaaauauacaugguauaaagacauuaccuuaaaagucuauuuaauaaaauaacugaaaugauacuuacaaaaacuuuaucuccaacuacauuuuccagauuuaacugccuugugauuuccuuuagggcgauuuugucauugaucugcagcaguccuaaaauaaaguccauuuaaaaguauuuaauuaaaauuaaacauguauuugauacagcagguuguuuuccaguuaaguaaaucuucccagucaaagccugugaguucauaucacuuucuucuuaaaacuuagcaauaaagacauucgguagaaucaaaaaacaauccuccuugggauuagaaugauuaaaaaaaaaaaaaccaaaaaacccacaaaaaccagaguccuucugcgacuccuucauuauuauuauuuuaauuucuaaaaauacugcauauggugugcuaaguaaaacauggaucuaguuuucaaaaucuaacuauuaaaauggauuugaaauauacaagucauauaaaaaccccacaaaguuuacauaaucuccaauggcaaaauaauggcauacuuaccauuuaagugaacuuguaauacauuuucacucacuucuucuauuuccaugaguucuuucaaagcaugauuuauuaacuaaauaugaaaaguuuaugaaauaauaauagguaaaagauaaaaauaaguccauauucguuuuuaaacuacaagcaguaagaacagaauauaaauaaauugaccucuuuaacaaguaaguuuucaaauucuuuacagauaaaagguuuaacuagaacaucucauaucugacucuuuuuaagaaacaagagccaggacugauacaauauucucucaaucaccuacccgaacuuuuaauacaaauuuagaaacaaccaaguuuuaaaauaaauauuucucuacaugucacauuaaacaugugacauggcccuuauaaacuucaugucucaguuaguacauuacacaucucucugacaauuacucuacuaaauaucauuguaaucaguuaaaagcccauugaauuaaagguuucuaugaagcauacuuuuuuaaauaacauuguauugcucuuguacugugauaucauacauaucucuucauauuaccaaugcauucuuuuuuuuaaagaauuugaaaaugaauguaauuaagaaaagccaaaaaccuauuuaaagaguaaagauggacuguuccuuccaauauuaaaauauagguacuaucauaaauaagugaacugggaaaagcaguuguauacacaaaauauuaauagagauggcaucaaaacuuaggacaaaaaguauuacucaacgaaggcacugggacaacugguaaacuauuuuccaaaacaaaauacuguuuguauuugcaauaugcuacuuauuugucauugcaacaccuuaucuaaaaagaaaaaagcaaauaugauccucauuuuaaauuacauauguuucauaacaagacaacaaaaauaaaaaaaauuuccuguuauaccugcaugguuuuuaaagcauagggaauuccagguccucugaaaaggagacaaucucaagauaucaccugucauacuaccaguaauagcccaacugagaagugacauuuaaugagaagugacauuuaaugagaaguaacauuaaaggacugcauagagguacuucuucaccucuggaucaggucagacacuauaauaagaguacaucccuagaugauacagaguuggucucucaaaacagugcuuucagcaaaaauuuuuuauuuuuuauuuuuuuugcaauccaugguauuuucuuucuuccaucucuugauauuuugcuuaauauauuuuuuccuagguuaugauuuuguuuuaauucauacaauguuuuauguuuugaugaauuauucaaaaccauuucaaauccuuugcuaaaaggaauggggauuuuaauaauaccuuccauuuuauauaugcauaaggagaguuguaacagauuuauagcuuucuuuccacucaacuuacuuuaaacaccaacuuaugcuuugcuuggaucagcccacuaauauuuuauggguuguguguauggucugaaaugauaaauauauuagcaagugagucuucaaauaauguuaguucuaaucuggguauugcuaaaauuuauuguuuaugcaaucaaccauuuaaguuagcuuuuuucuugaauauguuaucauuucaaauauuuaaacuacauuauacacuaaaaauauuuaguugguuauuaauaucacacugaccaacauaaccaaauuuggucaucuccuuuccacauucuuugugccuaaaauuuaauuuuacaaacauacuaagauaauuuucuuagaccucccaacauccaguaauuuuuaugcucaccaacuuauacuauucccaaauauuauaauaaacacagguuucaccaauaugcaacuaggagaaauauccuauuuaaccaucuagcaaauuugucuacaguaaauugcauguguaagagcauuuucuaagggucgguacagugggucacaccuguaaucugagugcuuugagaggcagaggcaggaggacugccugagcccaggagguugaggcuuuagugagcuaugauugagccgcugggcgccagcaugggugacagagagccugucucuuaaaacaaaaaaagguauuuucuaggggucaaucugucacuugaagccauaucaauuuuuuuuuuaaauaaaaugcuuguaauauuauaagccacacuauugccuuuuucaauuaacuauagaguuagcauuuuuguauuucagacaguuuggccaaguauaguguuuuaaauauacuauaaucuuaggguuaggauuagggguuaaaacaaacaaacauaagacuacagucuuauguuuuaaaauuugaauuuauauaauuauacuaaugaggcuaggcacaguggcucaugccuguaaucccagcacuuuggaaggccaagguggguggaucacuugagcacagcaguuccagacaaaccugguaaacauggugaaaccccaucucuacuaaacauaaaaaacuuagcugggugugguggcacaugccugucccagcuacucgggaggcaaaugugggaggauugcuugagcccgcgaggcagagguugcagugagucuagaucgugccacugcacuccagccugggcaacagagugagacucugucaaagaaaaaaaaaaaaagaaaagaaaaagaaaaaaauuauacuaucgagaguuauugucuaaaaauaaauuauaucugacaauuuauucaaucuauauuuucucucaggauacucccacacauacaacaaauuacaaaaguagcacaagucaaacaaugcucaucucuucaaccugccagcaucagaguacaucaggaauauaugaaacuauaucaaaauggaaugccaugcaagggacucuuccagauuccacuauagugaaaauaaaugacugcaaggcaccacaauagggcucugguuuaaaaagcaaaaaguagauaaacugucaguguggccaagaauaacugauccauuuuauuaacugauaaauacuaugauuuaaugcuuuugccuuuaaauuucaguacauugauuaaaccuauagggguuuaugaaaaggugcuauaacguggaagggaacaacaagcagauuaaaaagauuaaguucagauuuaaaauauuaagcaagauggcugauuagagacuccuggugcucguacucccaacaagaaaggaccacagcaaugaaugaacagcuaagauuugacuggcguguugaagggagaguacuggagugcagcagggaaggggaaauguguagugacugaaaauccaggaggguaguguguaggcaccuggccucugcagcuacaucuccugcaccccgaucaaaucuucccguagucaggagggacuucccguucuggggaaaagguaagcagaagauccccaccaguccucaccgccaucacaaacaccuacaguccuuaccacaggagaaucccauaguccuagcaagcccuaagucaagguggacagcugcugggaauucaagcaguugcauugcuccagaucaugagaauaagguaugcacucuccaacccucacccaccuguaggccaaccugcccugcugcagcauggcaccauugaggccagagccaccucuguugugcgccccgcucugugggccaguagucacugcaccuuuccaguacuagggguccaucuucauuccaccaagcccacauagguggcugaacacacaacucuagcugcacagagacugagccuauaauugguuaugacucugguccuacacagcaaggaaaccaaccccuugcugccacacuuccagccagagaaccaaucuggcagucccacccagggcaaacucucacuugaggugaccaaaccaggguggggcucucucccaagaaggagaggcccccgagcauccaagcagcugauacaccccuugcacuggcagagcggcuaugcacccacacucagaaccugagaaacagccccacaauaccgugcaccccucccucccgcagacauaccccuagcuugcccagugguccugugcccacaaucagagccugaaaaauagcccagaagguuaccccuggcaggcaugcccccagcccagccgagcagccaugagccaugaccuguaccugagaaacagcccuaugggccacccauggugaauacaccucccacaggguggccaagcaucccugugaacacauacuaggccugagaaguagcccuucaggccauucuugagccugccaagcagucuugugcucaccucccaaaccugacaaacagcacagccucccuauaacuccaucagacaugccccaggaccagccaagcaaucaugugcccacgucgcuaaccugagaaguacacuugccaacugccccuaacagacacauuacccuagcuggcugagcagcauuacaccuuaggccuacaaaucagcccugaggguugccucuggcagacacucuuuugggccagucgagcaacccugcuccuacuucccaggucuacaaaaugguccagugggccaucugcugcagaaaaguucccaggccagccaagcagcagugucacaggccugagaaacagccucacaggacgccucuagugggcaugcccauaagccagcugaauagccuugugccugcauccuaaaccugagaaacaauccuguggaaccccucagcagauacggcccuaagccagucgaggaacuguaucccuacaccucuguugggaucaagcagccuugcaccuggaucccaggcaucuccugggccugagaaacaaaccagugaguuguuccuggcaaacauucaccaagacuggcuaagcaaccacaugacuaugcuccuggccacauuaauagccccaucugccagugugucagaucccaaggugauugacccaccauaugcaugcauaugcccccaaacugagaaccagcccagcaaacccaccccuugcaaagcuguacaacugccaccacaaacaacucucagccuaggccacugagacacuuguaaaugacacuaguguggauuacagcugaaaaaacuacacaaagaccacacuacuguauccaacuagaaccaaggccaaugaaccacaucaaacugacaccucgagacacauugacacaaaucaguacuuccuuacgagaucaauucuguaagauuggaaaagacaauuuuacuuuucuaccugaggcguaucaaucaacauagggacacauuaaacauaaaaaagcaagaaaacaugacacuuccaaaggaaaacaauaauuccucuaguaacagacaagaaucauaaagaaauacagaaaaugccagaagaauuuaaaauaauaaucuugacaacacucagugaaauucaaaagaauacagauagaaaauugaacaaaaucagaaaaacaacuugugauucgaauaagaaauuaacagagauaccauaaaaaaacaaacagaaauccuacagcugaagaaguuaaugaaugaaauagaaaauacaacugagaccuucaauaacagacuacaucaagcauaagcauuucuuaaauugaagacaaauuguuugaaauaacacaggcagacaagaaaaaaaauagaaugaagaaagucuacaggauuuauaagacuucaauaagugaacaaauauuuguauuauuguacuuucaggaggagaaaagaaggaaaaggugagaaaaacauauuuaauaaaaccauaguugaaaacuucccaguucuugagagaggaauggacauccaaaggaagcucaaaacuccaaacagacucaacacaaacagaaggucuucucugaggcauauuauagucaaauuguuaaaagucacagacaaauaauuaaagcagcaaaaguaaagugucaagucacuauaagggaaucccuauuauacuaacaguagauuucuucuucuuuauagcagauuucuuuuuuuuaauuaaaaauuuuaaacuaucauuuuuuuaaaugauauuuuaaaacaucuuucauccuucuuguuuacauuuuagcugauugucagaauauacaacagcagauuucuuaagagaaaccugacaggacagaggggaaugggaugauacaaucaaagcucagaaugaaagaacugucagcuaagaauauaauacccagcagcuucagaaauaaaggagaaauaaaaucuuucacagacaagcaaaaacuaaagcaauccgucaucacuagaccagaccuauaagaaauguucaagggagucuaacauccacaaaugcaaagaugaugaccaccaucaugaaaacagggaaaacuauaaaacucacugguacugcggauacauaaaggagaaagagaaaggaucaagccuuaucacuacagagaggcacccaacuggaaaaauaaaugagaggaaguaagaaacaaaggauauaugaaacaaccagaaaacaaucacuaaaaugacaggguaaguccucacuuaucaauaauaaucuugaauauaaaccaauuaaguuucccauuuaaaaaauacagaacagauaaaaaaaaaaacucaauuauaugcugcuacaagaaacucaccucaccuguauagacacacagacuuaaagguaugaaaaagauauccuaugaaaauggaaaauaaaagugauaagaaaguuguaaaaacaaagaacauuauauaauaauaaaaggaucaauucaacaacagaauauaacaguuguacauauaaauguacccaacacugaaacacucagauguauaaagcaaguauuauuagaucuaaagagagauaaauugcaauaaaauaauaggaacuucaacacccuauucucagcauuggacagauaauuuagacagaaaaucaacaaagagacauugaauuugaacuucaccauagaccaaauggaccuaaaauacaucuauagaacauuucacccaacaacugcagaauguacauucuucucaucagcacacagaagauucuccaagacugaccucauguuaggacacaacagaagucuuaaaacauuuuuuuaaaaaaagcaaaauccuaucaaguaucugaucuggccacaauggaauaaaacuagauaucgauaauaaaaacaacuggcuaggugugguagcucacaccuguaaccccaacacuuugagacgccaaggugggaggaucccuugagcccaggaguuugagaccagccugggcaaaauagggagaccuggucuauauuuuuuuuaaaaaguaauaauaaugacaggaacauuaaaaacuauacaaaaauauggaaauuagacaacaugcccaugaacaaugggcaaaagaaauuaagaauauuacagauuccuagaaacaaaagaaaauagaaacacaacuuacuaaaacuuaaggaacacacagcaaaagcagaauuaagaggcaaguuuauaucaauauaugccuacaucaaaaaacuagaaaaauuucaaauaaagaaucuaacaaugcaauccaaaaaauuagaaaaauuuuaaauuaaaaaaucuaacaauguauuccaaagagcuagaaaagaacaaaccaaaccccaaauuagucaaaggaaauaaauaucagagaaggaauaaacaaaauugagacuaaaacaauacuacaaaaaaucacugaaacaaaaguugcuuagcuagacuaagaaagaccaaaauaaauaaaugagaaaagaaaaaggagacaucaaacugaauaucacagaaauaaaaaggaucauuagggacuacuaugaagaacuauacaucaauaaauuacaaaaccuaaaggaaaugguuaaguuccuggacacauacaaccuuucaauauugaagcaagaagacacagaaaaccuggagagaccaauaacaaauaaugagguagaaucaggaauaaaaagucuuccaacaaaggaaaauccaguacuggauggcuuugcugcugaauucuacuaaacccuuaaggaauuaaugccaauucuucuaaaacuauuccaaaaaauucaagcagagaaaauucuuccuaauucguucuaugaggccagcauaacccugacaucaaaacuagacaaggacaaaacagcaacaaaaacuacaggucaacaucucugaugaauauagaugcaaaagucuucaauaaaguauuaguaagcugaaugcaaaaagaucauucaccaugaucaagugggauuuaucccagggaugcaaggaugguuuaauauacgcaaaucaauaaacaucauacaccacaucaauagaauggaggccagaaacuauaucaucucaauggaugcagaaaaaaacacgugauaaaauucaacaucccuucaugauagaaacugucaaaaagguauagaaaaaaaacaccacaacacaguaaaggccauauaugacaaacccaaaaccaacaucacaccaaauggggaaaaacuaaaaguuucuccuguaagaacuggaacaauacaaggauguucacucuccccauucuuauucaauauaguacuagauguucaagccaaagcaaugggaaaggaagaagucaauucauuccuuuuugcagaugacauaaucuuauauauagaaaaaccuagagacucuaccaaaaaacucuuagaauuucaguaaaguugaaggcuacaaaaucaauauacaauaaccaguacuguuuguauauacuaacaacaaacuacccgaaaaaaaaaaaucaagaaggcaaucccauuuauaagagcuaccaaaaaaacguaauuacugaggaauaaauucaauuaaggaggugaaagguacaguuuuguacaaggaaaacuacaaagcacugaagaaagaaauugaggaggauacacacaaaugaaaagacacccauacucacaugauagaaagaaugaauauuguuaaaauuacuauauuaccagaagcaaucuacaguuucaaugauauuccuaucauaacacuaaugauauucuucacagagauagaaaaaaaauccuaaaauucauaugaaacaacaaaagaugccaaaucgcuaaagcaaucuugagcacaaggaauaaggcuggagucaacauacugccuuacuucaaauauacuacaaagcuguaguaaccaaaacagcaugguacuggcauaaaaacagacauguagaccaauagaacagaauagagaacccagaaauuaaucugcuuaucaacagccaacugauuuuuacaaaggccaagaacacucacucaucagggaaagggcaauuucuucaauaaauggugcugagaaaacuggauaugcagaagaauuaaacuagauucccaucucucauccuguacaaaaaucauuucauaauagaucaaagaccucaauguuaagaccugaaacuauaaaacuacuagaagaaaacauagggguaauacuucaggacacuagucuaggaaaauaucuuaugaauaaaaacugcaaaucacagacaacauaaaaaaauagacaaaucugcuaacaucaaacucaaaagcuucugcauagcaagggaaacaaucaacagcaugaaaagacaaucuacagaauaaaugaaaauaucugcaaaguauucaucucauagggauucauauccagauuacacaaggaacuccaguaucucaaaagcaaaaaaccaauuugcuuaaaaaacaggcaaauuaucugaacagacauuucugaaaggacauacauauagccaacgaauacaugaagaaaugcuuaacaucaucaaucaucagggaaaugcaaauagaaaccacagugagguaucaucucacuccaguuaggaugucuauuuucagaaaaacaaaaaauaauaaaugcuggugaagaugcaaaaaaaaggaacuuuuauacaccauuggugggaauguaaacuagccaauauugaaaacaguacaaagguuccccaaaaaccacuacaaauagaacuaccauaugguccagcaaucacacuacugagaauuuauauaaaggaacggaaaucauuacaucagagagacaucugcagcccguauuuauuguuguacuauucacaauagccaugauauggaucaaccuaguuguccaacaacagaugaauggauaaagaauauguguauauacacacaauggaauacuguucagccauuaaaaaaagaaaugaaauucugucauucacagcaacauagauggaacuggaagaaguuauauuaaaugaaauaagccaggaaaagaaaguuaaacaccaugcguuuucacucaucuauggaagccaagaaaaguaggucuuacagaagucaaaaguagaagagaggauaggguaggaaggguaggaggaaaggagggauagugagagauucaauaaugaacacaaaauuacagcaagauaggaggaguaaguaacaguguuguacuaucauuuuucuguaacuauaggaugacuauaauuaacaauaauauuuuccaauagcuagaagaaggauacuggauguuccccacauaaauaaaugauaaauguuugagaugauugauaugcuaauuauucugauuugaucacuauacacuauaugcaucaaaacaucacuauauaucccaugaaaguguauaauuauuaugagucaauuuaaaaauaaaguauaaaaagguuaauuacuaccuaaaaugacuauuuuaugaaauaaauguuuugagcuauuuaagccagacuuagacaagaagaaaagauucuuagaaaacugaaaugcaauaucagauuagaagaagcaaaugacagcacuggcaguaaagaaaaucacauuggccauaugacagaaugcugagagagggggaaaaaacaugaaaaagaugguagacauggaaaaaugaaaacaaagauuuaagaacugaauauucuaauauuggauauucauuuuuucuaaucauaagaaaaaaugaaagaauauucaaaaauaaaagaauauuauucuuuagugaacaauacccucuaaauuuauacuaaaucaguaugcagaguauuagugaauuuuaugauuaacuguuagacauagucuaugaauaacuaaugcaauaaaagaagaaaaggaauagaaguauggagauagggaaggaauaauuaaaacugucuuuguugacagauaacauaacugucuaaguaaaaaaaucucaaagaacugacaaaaaaacuaauggaauugagaagcaauuauagcaagguugcagaauacaagcaaauauagaaaagccaaguguuuagcuaucuacuagcaaugaagacuuagaaaaggaaauaaaaaacacaguacuauucgcacuagaaccaaaaaaaugaaaaauuagguauaaaucuaacgaaacauguguaagaucuuuauuaagaaaacuacaaaaacugacaaaagucuuaaauaaauagauacuccaagaacgggaagacuaaauauaguuaagauguccauucuuccuauugugauguauaaauuuaacucaaaaucuagcaauucacaaagauucccagaauuuucuggauauguacaaagugauucuaaaguuaauaugaaaaggcaaaguaugcagacagccaacacaauacugcagaagaacgaggucagaagacugacaguacuuaccuuaaagacucacuaaaaaucuacaguaaucaaaacaaugugauauuggcaaaagacagacaaagcaagggaauagaaagagaaccuaaaaacagaaccacauaaacauagucaacugaucuuugacaaagaagcaaaggcaauucaauggauaaaagauagucuuucuccaauugggcauucauuugcaaaaaaaaaaaagaaaaaaaaacgaaucuaaacacagaccuuacaucuuucacaaaaauuaacucaaaaugaaucacagaccuauauauaaaaugcaaaacuauaaagcuuguagaagauacauaggaaaaaaucuacaugacuuucgguuuggugaugaagcuucagauacaauaccaaaaucauaauacaugauagaaaaaacugacaaauuagauuauuaagaucaaagacuucaguugggcacaguggcucaugucuguaaucccagcacuuuggaaagcuaaggcaggauugcuugagcucaggguucaggaccagccugggaaacauggggagaccucgucucuacacaaaauuaaaaaaaaaaaauuagccaggugugauggugcaugcuugcagucccauguacucaggaggcugaggugggaggacugcuugagcacaagaggccaaggcuacagugagcugugaucaugccacugcacuccggccugggugaaagagcaagacccuauucuuguaaguaaguaaguaaaauaaauaaauaaaaacuacucuaccaaagauacaguuaauaguaugaaaagacauagcaacaucccaucucaaaaauaaauaaauaaauaaaugaaaucuucugcucugccaaagacaauguuauuauuaauaguaugaaaagaauaauauucuuuuaauauuaugaaauaauauuaauaguaugaaaagaaaagccacagacuguaagaaaauacuugcaaaacaaaacugaaaaucagaaauauaaaggacuccuaaaaccuaucaauaagaaaacaaauaacccaaauuaaaaaugggcauaagacaccucaccaaacauauauagaugaaaaagaaguguaugaaaagaugcucaacagcauaugucauuagagaauuacaaguacaaacaaugagacaccaauauauaccuauuagaaugguuaaaauaaaaaguuucuuaaauuuaaaaauuuaaaaauuugaaauuuaaaaacauuucacauagcccucuugugaaaacuacccaaaauaacagugaauucaaaugcaaagaaaaaccauaauaaaaaacucaagaaugaagaaauagugauuauagaagcugaguaugaggacuaaaacaaauuaaacauagauuugaaacuaaaaaauuacugcaaauaugauuauauauaaaugugacaauuugugaaauauugaaagaaauuaccuagaucuaaauucucaauuuauauuaaacaauacuucagaugugauaacaguaaaauccuaacguacucaucuuaauaauguaauuucaauauacauugcuuaaauguuaaaaaaaauuuugcuucucauccauuuuuuuaaaguacauuggucaaaaauugaaauuuauuguauauaauacaugagaacagauuuuacacagacuacuuagcauugaaauuaauugcuuucaaaaguuaacacccauaauuugucuccuauauugcauaaaggauaucaaagaaaagaguaaagggaaauaaguaagaauaucuuuuugagguaacuaagcaaauaugauaaagagcaaaaggagacaagaaugauauaagaugugagcaugcacugaaaaacuguguaaguuaggguuaaacaaauaguaaugauguaggaaaaauaaaaagaaugcaugauaugauaguucccuaaccuauaacaaagggaaaaacccuaccgugcaguguugauguaaagaauaaaugagagaacacaauaaaaagacacauaguacaugcucaauacaugcuauuuucuuuuuccacuggaaaucucuacuucuuuaaggacaaaagaccauguuggaacaaacaucaauugacaauuuuucacuaggaggacaaauaagggggaaaaaggucugcuacacucaaauauaccacccuaaguuuauaaaguuuuacaugucuucugugauuaaaaaagaaaaaaacaaaaaaguaaaacauuacaaaauaaugaaaaguauuuucaguauuacauaaaauaagauuuauauaugaauuuauuuauucuuauauaaaauaagaaucaucacaugccaacaaacaccagaaaucaacagcuuuuaccauaguuuuuccugauccucgggguccgauaauaaggacagaguuacucucuccauggagagcaguucuuuucagcagcucacuuaagugucuaaaaugauauaaauaggacaaaauuuuaaaaaugaagcuggaauacuuuguuauguuguaguuuuuaaaaggcauauuugaauaugcacagaaauuuccucucuucucucccucuggguacuuggccuagcuucugaaugguccuaaauagaaaaauacaaaagaaauaguagggcaguauugauucucugaaaucuucaggugaaaacguagucagauuggaauauauugauuuauacgauaguaggggacaagggacaauaguggcaacucucgggacccuuggauucaaaucucuuuuccuacuaauacucuggacuuuuacuccauagcuggcugcuggguauuaagggcaagauggcuagaauucucuccacaguaucagauaacagaaacaaaacaaaauugaaaguuaaagugcuauugcauuauggaaauauuuguaucugcuccugcuucaugcuaugugguguuucuauucacaaagcaaaauuuuuuauuucuauaaaaguguuuguuagcuuuauuuaauaucaaauuuguacaauaauuuuugcaaaaccuggaaggcaucuguaaguagguccauaacagucaagaggacagcuagacuuacuuguauuguacuugcacuccaaauagguuacuauguggacucugacgacaaaaucuuucacguaaaauucuuuguaccugaugaaaauaaagugaauaaauauaaauaaaaauauuacacaugauauaaaaaauaaauaagaaagcacauuuacaauagucagaauuagguauuaaugaaucaauucaacccucccuaaauucuuauccucuagaguucuggcaccauuuucauauguuaaaaaauuaauggauuucuuaccuaucucaagucccauaggaagaaugagaauuuaguugugaagguuucaacaagagggagaaucacugacuuuagcuauauuagcaacuuaagggccauuguaaugcaugugaacgaguuaagaaaagaauucuuguaagcagcuauauuuugaggucaucuuagaacuaaggccuuagacuuagucaugaaaaauuaugucagauaaucuaccauacucuuuaaaaagauggaccauuaaagucguuccuuuuuuggaucugcagcuaauacagaggucuuucaaggacaacaaccugagggugcuaucucagauuuggccccaugaacuggaauaaaaaggcuccaagaauauuugcuucuccuagacugacagcauggaacuaauccuucauguaccaaagaaguaaaucugaguucuuguuccauguacagaggcaaagcaaagaaaaugauucauuagggacaaaacaauacauacuuguucauuaucgaggaaguuaaagaguaaggacauuggcuccagaagagucuauuauaugaauuuuaaaagguuaagucuguucuaaauuuuaauuucuguaucuauaaaauagggacaauaacaucuuauggcaggccuguuugaaagauuaaaaaagggggcuggccgcuguggcucacgucuguaaucccaacacuuugggaggucgagaugggcagaucgcuugagguuaggaguucaagaccagccuggccaacaugguugaaaucccuucucuaauaaaaauucaaaaauuagccagacguggugguggaugccuguaauaccagcuacuugggaggcugaggcaggagaauugcuugaacccaggaggcagagguugcagugagccaagacugcaccacugcacuccagcuggggcaacagagcaagacuuggucucaaaaaaaaaaaaagguuuaaaaaaggcaauuauuuguaacacaaauaggcuuuguacagguaauagcuaauaucuguaaaaauacauaaaagaacauauauaugccucaacuaaucauaauguguauuccucuaccuagaugagaucaaaagaaaaaacucaaucuuuuccuuaaaaaaaaaaaaaaaaaaacccagaaaaccucauuaaaauaucuuagaggcaguaacgggguauaaaauauaagcuagauaaagcuacagugacuagucagaagguucacaaaucucaaagugaucuggcauagaaguuaaauagguauacacauguauugauauuaagucagcuguacauggaggauucgugcacuuuacauacaaagguauguaaagcauauuucaguuaaaaauuuuuuuagaaagagaguuaaacuacuuccuucaaaaagaaagccaagucguauaaaagaauaccaguaacacuuaauuuuuauuuaaaaacuacauggaguucaggucaagcuagauaaauacaaaugccaggguagaaauaccaugcucauuucccuacuaaucuauaagcuucuuaaggaagagacauacagauagaugcucagcacuuggaauacaauauacacuucuuauaacauucauuauaaaaacacucaacagaugaggaaacguaacggaacuuccucaacuuaauaaagggcaucuacaaaaaaauccuacaguuaacaucauauauaacagugacagacugaaugcugcuguuucucuaagaugaaaacauagacaagaauguccauucuucccaauccuauucaacauuuuaaagaaaguucaagccagggcaauuaggcaagaaaagggaaaaaaaaaaaaaggcaucuagauuggaaagaaaaaaguaaaagcuagaauucugacuacccagacuuaauaaggauaaaauuaaauuacaguauaaaacacuaauauuaaaaaaaauauaugaacugacaaaaagggcagagaacaaucauaacaacaaaaucuguugguccacauuuaauuuugacagaguuuggaaaauuuugcuuccagaugauuguucuuacgaccuugugcuggcaucucguuaaggucucguacugauaucucccuaagguuagaaagagugauucuuccuaaaugcuaaagggaaaauucagguuaagaagauaacuauuucucugaacagcuuuacaggguaaaauaucuugagauuaaugaaaauacauacuaaccugugaaaggcacucugugugaauuaagcuguuacucuuugauuuacgacugcucauuucaacaaauucaaauccuuuaaaaaaauuggcauaaauauuauaaacguagugacuuaaagagauuacuuaagaauuuacuguucuagaauuaaaauaaauacaaguuuuuaaaaguaaaaaaugcucaaacccuaagaccuucaaaaucuucgauggcuucauuuugucuaaguacaggcugauucaacacucucauaccacacuuuaggcacacuuuguuuuacugugcuuugcagauggugcauuuuuuuuuuaaaguaaacugaagguuuguagcaacucuguguccaacaagucgauaggcaccauuuuucaaacaccauguccccauuuugugucugucagcauuuuuuagcaauaagguauuuucaaauuaagguauguacauuuuuuagacaugcuacuacugcacacuuaguagacuaguauacuguaaauauaaauuuuauaugcacugagaaaaguuuugggugauucacuuuauugugauauuugcuucacugcaauggucuggaacugaaccuacaauaccuccaggccuguaugugguucuuacagcuacuccucccuuucgauuaaaucuucuauucaccuucccuuucuuccuuuuucuuuuuuuaacuuacaugcuuccuuuaugauucucccacccauccaucccacaggaucaucccuuauagaaaaccuucccuuucuugcuccacucaccaacaauacacaaauaaucauuacagacuagguuaaaugccucuuccuuaaacacucauaagugccuguauuuugcuuuauuauugaauuauuuuaaacaaaauugucuguuuaauugcuacuguuuccaaauugagauuuuuuauauucuaagcauuguagcauaaugcccaaaacaaaguuggcaaugaauaacuggaaugaaaaaaaaauuaaugaaaaaauuauauuuuuuguaaaauucuccucaaguguaccauacucauagacaaaugacuaaaagaccuuugacuaaaagaccuaauuuucuuagcacugauuuccuauaggaauaaauuuuaacagauagacaguaacagcuuaagcaguguuuagguaucaggaauuguuacaaaugcuuugcauuuaucaacucauuuaauccucaaaacuaucauguggaauaacuacuauuauaauccucuuuuaagguuagaagacacagauaggcuagguauguugaccaaaaucaaacaguauauaaauggaagagccaggauuuggauccaaccaaguuaaccacuuuuuuaaaaaaguguauucuggucucaucuaaucuccagaaggaacacagcuuugcuaacacccugaauuuagcucagugaaagacauuuuggaacuuuuuuacugccagaacucauaaaacucaaaaaaagcugacuuaucaucaaaucaccaaugauuaacauuauaauaaugcgagaaugacagcagcaagaugaaauaggaggcccuucagcuuguguccccaaauagcaacaauaauuucacagccacccacggacaaaauggucuuuguguuagcguugagauucaggcaggcgucugugaaaccccaguggggcccaagaccuggaaaagucaauuggagggcagaucuucauucacgugacagauuccccaacugugguccaggcuucagacuuggaaagggcccuguccucccgauaggaccuuguuaccaggggcuguagcaggauaugaacccuaucuggucccuuggcggacuggacuuuuucuaggaccucggucuguacaguggaugaagauaugcagagaaaagaccuguuaccagguguguggaugguuuggcuuucucugggaaccugggagggcuccuacuggaucacugaguagauuccuuaacaggcaguacugcccuaguccacagcugaguggggcuggaacuaagcuacaggguugcuucagggccuacagucaagacuuaggucuucaggccuaaggugucacaaaccugcaugucucccuucagguccuuaaguuagcgggccugcuguauugagaggggcuggagccacuuuucagggguguuucagggacugaugagggaccuaggucagguggccuguuugcagggcuauggacagccccaucucccuccaggaugcuggguaggcagaacugcucucugaccacagcugagaggggcuuaugccaagauucaggguuguuucaggaccugcugugggacugaaaucugccugccuguccugaggacacagaaggauguaucuccugacuacaggaggauuucugugcaggauuucuguaagacuguggcugaguggagcugaauccccgauucagagcuuuuucagcauaugcuaugggacagagauuggcaagucuguacugauggcacagacaggugagucuccuagcaguuccuugugcaggcaggguugcucucaggcugcaaccaacaguggcaggagcugagcuucagggcuguuucaguauuuaaugcaggaccaaguucagaaagcuugacccagggauucagacaguuuugucuucuuguggguccuugaacugaucucagaccauagccaaguuaaagugucuuaucaggguccgcaguugggacugaggacaguggacuuauuuucugagguaccagugugcaugaauuuucccaggccucuuggugaacaguuucgguagcaggccaauauccuugaugaauauaggugcaaaaauccucaacaaauacuggcaaaucuaauucaacaguacauuagaucaauuaccaugaucaagugggauuuaucuuuggaaugcaaagacgguucaacauauguaaaucuauaaaugugauauaaugcauuaacagaaugaaggacaaaaaucacaugacugacucaacagauacagaaaaagcuucuaacagaauucaauauuccuucagguuuaaaaacugucaauauauuagguauaaaaggaauauacuucaacacaauaaaggccauauauaacaaacucacagcuaacaucacaccccaaagguaaaaaguuggaagcuuucccucuaagaucaagaacaugacaagaaugcccacuuuggccauuuauauucaauauaguacugcaaguccuagccagaggaauuagguaagaaaaaauaaauaaaaggcauccaaaucaaaaaagagaaaguuaaauggucuguuugcagauaacauaauuuuauauagagaaaauccuuaagacucuaccaaaaaacuguuaguacuaauacauacaguaaaguggcaggauacaaaaucaacauaaaaaaaucaauaagauuucuccacacuaauaacuauuugauaaaauuaaaaaccaguccuaauuacaauagcaucaaaaacaaauuagaaagaaauguaacaaaagaggugaaaggucugucacugaaaacuauacaauauugaugaaagaaagugaagacacaaauaaauggaaauauacuccauguucauggacugaaagaaucaauguuauuaaaaugucccuacuacuggaagugaagguucaaaguaauccauaucaaaauucuaaugacauuuuucauagaaauagaaaaaaauccuaaaauucauauggacccacagagacauuuaauagcuaagacaaucaugagcuaaagaacaaugcuggagguaucagacuaccugauuucaauaccuagugcaaaacuaagauaauucaaaacaacaugguucuggcauaaaaacaaacauacagaccccagaauacagagucgagaaauaaauccauacuuuuacaguugacuuauguucaacaaaagugccaagaacacacaacggaguaaggacagucucuucaagaaaugguguuaggaaaacuggauauccacaggcagaagaaugaaauugaacccuuauugcacaccauauacaaagaucaacuaaaaauggauuaaagacaaacauaagaccugaaacauaggggaagaaaacacagggggaaagcuuuuugacacuggacucggcaaagauuuuuuugggauaugacuccaaaagcagaagcaagaauaaugaaaacagacauaaaacuaaaaagcuucaaucaacagagugaagagacaaccuucagaauaagugaaacuauuugcaaaucuuacaucugcuaacagguuaaaauccaaaauauguagucgcuccucaucagcagauucaaccaacuuaagagagagaaaauuuagaggggaaaaaaaaugcaacaauaaaaauuaauauaaauuuuaaaaacaauacauuauaauagcuauuuacaaagcacuuacauuguauuagaaauuauaaguaaucuagugaugauuuaaagaauaugggauauguguagguuauacgcuaauaccaugccaauuuauagaaaggacuugagcaucuacagauuuugguaucucaggggaguccuggaaccaguuucccguggauacagagggaugacuguauaaggaacuaaaaaaaacaaaaacaaaaacaacaacaaaaaaaacuuaauagcaaggaaacaacccaauuuaaaaaauggucaaaaagauuucucacaggacauaaaaaugucaaauagguauuugagaaaauucucaguguuacuaauugucagggauuuucagggaaguacaaacaaaaccacaaugagauaacauuucacaccugcuaggaaggcuauugucaaaaaaaggcaaaagaugaugaguguuguugaggauuaugaagaaaggaaacucuuguacacuguugguaaaaauguaaauuaguauaaucauuauggaaaacaguauggagguucuugaaaaaauuagaagucaaauuacaugaccgguaaucccacuccugaauauccaucaauauauacaaaggaaaugaaaucaauaugucaaagauauauccucacucccauauacacuccagcauuauucacagccaaaauacggaaucaaccuaaguguccaucaauggaugaaaagauaaagaagaugugguauauauacacaauagaacacuaacucagccuuaaacaaaaaagaaauccugucauuugcagcaacauagaugcauuugggagauauucuguuagcugaaauaagccaggcacagaaagacaaacaccacauaaucuaauuuauacaguagucucuccuuauccaugggagaugaauuccaaggcgccccucgcaugucugaaaucauggauaguacccaacucucucuauauacuauguucuuuuaaucugauaaccuagauggcuacugagugauuaugggacacaugcaauacacagcauggauacgcuggacgaagaaauuauguaugucccaggcaagacagagcaggacacugcaagauuucaucacauuacucagaguggcaugcaauuuaaaacucaugaauuauuuauuucuggaguuuuccauuuaauauuuuggaacuucagcugaccaaaaguaacugaaacaauggaaagugaaacugaggauaagggagggacuacaauagguggaaccucuaacaggggaacucauagaaugaaagcagauuuuaaauuuucuuacuacaaaaaaaugguaugugagguaacagauauauuaauaggcuuaauuuugucauuccacaauguauaccuauauuaaaacauuaugcuguauaccauaaauggauaagauuuuuauucaucaauuagaaaaaaaacauauaaaauauacaucaaaaagcaaguaagugcagagccaggauuugaaugauuugaacccaaauaaguuguacucuuaugaaauuguuacguauuuagcaaacuuuuuugaaaaaagaaguacaaacacauuucaauaaccugaaggaagaucagccaauauauuuuacauucacauuuauuaauuucauauagugacaauuagaaagcaaaccaugguaaugcuguuuucuucucuagaaauguuaacagguccuuagcugagccaggccuugacagacagacagcaagcaaaucuguguccuccuuaauguguaagccagguagcuaaggccucagccaccaaaaguccucuggcuccaggcuuccuaauugaaaauuaaauaacagaguacucaauuauugucuugacccuuaagcaucuucuuucuuagaagaaaaguggucuucucagcugucuuaggauaccuucuagcagucuuuuauaucuaaaguuuuaucuuauucuauuuuuuauuuuuccuaaucaguguuaugagagggaaaaaccuuuuuagcuaauaaaauauccucaacucugguuuaugaugcucuugacuaucagccaaaaucuaaaaucacaaagaacuauguaauaauugucuccuagauuauaagacuaauuaaaauguaaaaaggagaaagggcuuuugcaguauguuuuauuuuguagaacuacauuagcuaucuuacaguauuguuagaauuaaaagauauuuuuuacccacuucaugaauuaagaaagaauuacucaaaaaagcuaaauaaauguccacaguuccaaggcagguaucuaaucugccccuuugcaucauauauaaaucagguaagcuauuaagauaauucauuuuuucuucauguggggccagcauucauaaaagaaacaacaaacaugccacuaugguaucuaccuuauaaccuacauaaauuuugacuguaaauaaaguuuuaguccaaagguuauuuugacaucuucccccuucauguaauggucaaauaucuacuauauaauaaagaauauuucaaagacaauucuaauaguacagaugagacaagcuucagacugggagaaaauaccugcaaaccacauaucugacaaaagaucuguaucuaaagaacccucaacacucaauaauaaaaaaggaaucccauuagaaaauaggcaaaauacauaaguagacauuucaccaaagauaugcagguggcaaauaagcauaugcaaagauguuuaauaucauuauccgcuaggaaaaugcaaaguaaaaccauaguaagauaccaccacacacugauuaaggcagcuaaaauaacacaaagauggugaggauguaaagaaaaugaaucuuucauuuaaccacuggugggaauguauaauggcauggcuacucugaaaaguuucuugacagcaguuucuuagaaaacuacaaauacucuuaccaagccacauagcaauugcacucuuggguacuuaccugacagaaaaacuuauguucacacaaaaaccuguaacacguauguucaugauaaauuuauucguaauagucaaaacacuggaaccgauucacucaaugagccaaugggguuaaugaauuaguuccacugaugcuuugucacugaagucaggaaguacccagacaguaagggacugccuuuugaaguucuucugauauuggacaaugccccuggcuacccagaaucccaugaguucaacaccgaaggcuuuuguccaagugguccacugguccccaaacacaaacucucuaauucagccuguagaucagggggucauagggaccuuuaagguucauuacacacagaacucuauggaaacgaaugucaacacuauggaaaaaccuccacagacagaacaugaugaaagucugggaggauuaucccauugaagaugcccuguugucauagaaaaagccaugaaagccaacaagacugaaacaaauuucugcugaagaaaucuauguccagauguugugcaugacuucacaggauuuacuacaaagccaaucaagaaaaucaugaaagagauuguagacacggcaaaaaggguggggagugauguguuucaacauaugggucuuagagaaauucaagagcuaacagauaccacaccagaggaauuaacagaagacaagguggagauagaugcuucugaaccacugccagacagugagaaagaugcagaacagugccagaaaacaaacugacauuagacaaucuggcagaacgguucugaauauacaagacuacucuugacuucuuuuacgacauggacccuucuaugauacagguacuggaaucaaagcaaaugguugaggaaggguugauacuguauagaaacauuuuaaaagaaauuagaaaccaaaagagauagacagaaauuaccuguuuaguuacacccagugugccuaaccugucuugucuccccuucuaccuccuccaccucuucuaccccuaggcaacaagaucaaccccuccucuuccuccucagccuacucaacaggaagacaaguaggaugcagaccuuuacaaugagccacuucaacuuaaugaauaguaaauauauuuucuauauauaguagauauauuuucuaaauaucuuuucuuuaccuuacuuuauuauaauaauacaauauauaauacauacauaaaauauauauuaauugacuauguuaccagcaaggcuuccagucaaguaggcuauuaacaguuaaguuuuuggggaggcaaaaguuauaugcagauuuucaacugcuuuugguagggaggggguguuucgaccccuaacccuuacauuguucaagagucaacugcguauggaggaaauucucauuacugcaguuccagagcacuacuauacaucagagagcuacugaccauuuuaaauuuacuucuguauugacaaaggacaaaaauuauaggaauuguaaaaaugugucaucuaaagcugucugcucucuaaauugccuaugugcauuuccccaugacaguaaguccccuacaaucuauaccuuuacaaaggaagggaugaauucugaaauauauucacugaccacuacuuacuguaucuguauuugaaauuuuauaguuacaugcuaacuaaagcaggaugacuaaauaaucucaagacucaaucacauguauauucauacucccauuuuucaacugagguggcuuauuuauuguaauucuccauuccuaugcuuuccaaggguugcuuguugauaaauucuaaaaauuaugaaguacauccuuuacugcucuugagguuucaugaguacuuauaacucuucuuucucaugaugccuuccucagauccaaacccucacucagagccucuuugucuaccacacugauucugcauaauguauuuuagacuaacucuguuuggccaacaauaaugauaacuauucaguaaacucucuguuuuuuuuguuuuuuuguuuuuuugagacagagucucgcucuguugcccaggcuggagugcaguggcgcuaucucggcucacugcaagcuccaccucccggguucacaccauucuccucccucagccuccugaguagcugggacuacaggcgccugccaccaugcccggcuaauuuuuuguauuuuuaguagagacgggguuucaccauguuagccaggauagucucgauuuccugaccucgugauccgccugccucggccucccaaggugcugggauuacaggcgugagccaccgugcccagccuuaguaaacucucuuaacaucuaaagacagaauuagaaaauagcugacacuaacaacuuauuccuacauauagcucaauagccauucagaugucaaauguuuuccuaccuuagaaauagaacauaaaagcccuccauuuaguuugcacaacuaacuuaagcuccucaucuuagguuaguucuaaucacuguuuuuuagacuaacauaauccuaaacuuugugggagaagcaaccuggaugaacuccuggugacaguccuucaugucaaauuugaaguuuggucaauuuaccaaauaccucucugcuugcugacuagcaaugguauacaaugaccugcccaagaugacauagcuuacuuaacagcagcaguagcuguuaggucuauugacucccaaucagagguugguuagucucaacuggcaugaaaaaaaacccugcaaacaucagaaaguucaucaaaaucaucacugggcuuuucuuuaggagacaaaacauagcagaggaauacauucugaaagaacacgguuauuauaacagauguucaauaccaacaauucacuucucuuugaaugucuauguguacaauuuguauuuuuuucuguacacaucuuuauuuuuaagaucauaaacuuucuucccaucgcuaaaaaggaauacauguuucguacagaaacucuggaauuuuaauuaggaauugugcagauaaaaugguaaaaaauggaaucagagaaucuuucuccucuaauaaaacaaaacaaaaaacuguuaaacagaaauacuuuagcaguaacuaaacaaagagacaaguuaauaauaaacaagccuagaaaauucuacaggaguucuccauaguuccuaacuuuaaccucacucuuaaaagcuauacuugcaucaauaaaaucuccuaaacucucaucaauguaucaaauaugaaaagaagaaaacugauaaaaacuguaauucaauuauuaaauuucaagccuaaaaaaaagaauucacugggacucagccugaaaaacaccuacaagggagaaaaaaaugcuaaaauauggugucauaauaucuacaaaguucugagagagagaccaagacucauaccuagcaaagaugucacucacauauaaagguaacagguauagccuuaucaaauaagaaugaacuuauuuaguacacagagccaauaaagccuuguguggaguguguguguugcaggaggauauggggaacucaaugacaaaauccagccaacuaaagcauaauuaaaaacacaauuuuauacagacacacacacacauacacacacacacacacacacacacuagugaccuuugaauccacuaaaauaaaaaacuaaaaccaaaaaaagguaaauaauuauaguagcagguggaaacauaagucguuacacagugaaaauaaucauucaacaaaaaaaugaaaaaaaaguggcaugaaugcauacgguugcuaauuucauucuucagaguagaaagaaaaugucuaaacuuaaaacaugaaguguaaaaaaggaacuuaaaacuauuuuuuuuuuagacccagggucucacuguauugcacaagcuggauuugaauuccugggcucaagagauccuuccgucucagccuccuaaguagcugggucaacaccuugagcagcuugaaacuuuuuuuaaccuaagauugagaucuuuaaaaaaaaaaaaaucucuuggguuuaauaaauaucuaaaguccagcaauuccuauaauuuuuauuagguuaaaaauguggccugccuacacacacacauacuuuuucaaccaaaaugggcucuauuucauaauauuugucauuuaaaagaacaagaacuuuccauauauagauauauauauguguguguguguguguauauauauacacacacacacacacacacaaaaaguaacauauuuuaaauuauuuuuucuacagcuaccauaagguaaaaaacaaaaauaagaauuaguggaucaaauuguuuaagaaaaagaaccauguaccucagcuggauaaucaaaaguacucuaguauuaugagcaucuuacuaguaauuacgacgccaggagcuguaacacuguguacccaaaaaaaagcauuuaaggagaaaacaggugugaacauguccgauuuauuuaguuucaaaguuguccaagcacaggucaaagagguaacaacaaacaauuuuuccuaucuuucauauaaauggucaguaagguggcuggugcaaaauaacccucuggaauaagaaaguauuguaggcugggcacaguggcucccaccuguaaucccagcacuuugggaggccgaggcgggcagaucaugaggugaggagaucgagaccauccuggcuaacaugaugaaaccccaucucuacuaaaaauacaaaaaauuagccaggugugguggccggcgccuauagucccagcuacuugggaggcuuaggcaggagaauggugugaacccgggaggcggagcuugcagugagccaagauagagccacugcacuccagccugggcaacagagcgagacucugucucaaaaaaaaaaaaaaaagaaaguauuguaauauguuuaccuauaaauaucuauccaaaaaauaagagcuaaauuaaacuuaacuaauauuuaauauauacauugacaaauuuuacuuggucucuguaucagcaggucaagucauguuacucaacccagacgcccuaaggaaagggaagaguucaagaucaauaacaagaagggguuccgaguggcaccaucacauauucauuuacugucagcucauuaauacacaauguagguauaugaauccaguuuggagacauuacugaauccagcugacuuacugaauuuuuuuuuuuuuuugagacagaaucucgcucugucgcccuggugggagugcaagguugcaaucuuggcucacugcaaccuccgccuccuggguucaagcuauucuccugccucaggagauaggagcugggauuacaggcaugugccaccaugccuggcuaauuuuugcauuuuuaguagagauggggguuucaccauguuggccaggcuggucucgaacuccugaccucaagugauccacccaccuuggccucaguugggauuacaggccugaaucaccacgcccagccucacuugcugaauuuaaagauguuauuauuuuuaaaauguaagugaaauaaucucagcuguuccaacugcagcuuuuuccuggaaugaaaaauggcugccugucaacagcaugcugcuuaguaaauaaaaaacaaaaagcaaaaaaaaaaaaaagauuuacuucaucuggaauuuuaaaauaaaaguaggaaagaaacugcuuuuuagaagaaauuuguguuauagggcauuuugaaaauguuuccaacacugauuuuauagccaaaaauuagguguuaccuauaaaaauucucauaucuauacacuuaaaacauuuauaaacauaacuuuuuauucuauucacaaauauuucuguaaauaauguaaguuuuauauguguugaccuaaaaggaaagaaguugaggcaaaauuaauaacauacauagagaguucauuugagccaagcuugaggguugcaaccaaggagcauaaauucaaguugcccugaauaugcucauuagcagcaguaacaaguagauuuuuaaagagaaaaagaaaaauaaaaaggcacgcucugaguuguucaccaagaaucuacauuaaaauaacaaacuauccauuggcuacagaguggcaggggguagggaguugggguggaguaugggggcauaacugaagucccauacuacucacaucucucugggccugcauaccucagagcucagacuguucugagcauuuuuuguuuucucauacccauuuguuaaaaauauaaaaacauaccacuuuucggcugggcgcaguggcucacaccuguuauaccagcacuuugggagacugaggugggcagaucacuugaggucaggaguuugagacgagccuggccaacauggugaaacuccaucucuacuaaaaauacaaaaauuagccaggugugguggcacgugccuguaaucccagcuacucaggagacuugaggcaggagaacugcuugaacccaggaggcggagguugcagugagccaagaucgccaacacugcacucccaccagggcaauagggcgagacucaucucaaaaacaacaacaauaggaacaacaacaacaagaaacaaaaaccaugcaccacuuuccaagaacacuaauuuauaucaaguuuuucuuaguuuggaauaagaacuaacacaucaagagaagaugaaauuggcuaacaacuccuacaaaaaccuugguaaaauuaguggaugagacuagaaaauauaauucaaaaauacacaaaugaucauguauuauuuucucuaauacccuuacuuugaggcaaaaccuuacagcuccagcagaugggggcauuacuuugugaaaagaacucuuaguaaauuaaaaagauguuuaauacugcuuucuuuccagaugguggcagaagaaaacaccgaaaacaauaccacuaccccacucccuuuauuagaaaaaaguuaaaauacaaauucuauuacuguuuaccuaggaccuaacuucacacggcugacauuucucaaagauagguaaguauggacaaaauuucagaacuuugccucucuucaguucgauaaaauguucuugauuugcuagcuaaacagucaaauaacguaaaaugaaagguauuuuaggagaaauuugaaggugguuuccauguuuuguuacuguccuuugagaugaaacugaggcaagaaaaauacauuuaagcuguuuuucaguccaucagaauuaguuuucauucuuuuuucucccccaguuggauuguuuguacagagguaaagauuaaaauagaguuaaaagaaugguugaguguggggagaaauaagggccaauacugauauauauuccaaguuagaaaauaaguaaacucuguuaguucuuccuaaagagaucagcucaaaaaugcuaucuauaucaaguuggggcacagccucuggugagauguuuccuugaguucuccagagcugaagaauaauuccacacaaaucaacuuuuggaccacaggugaauaaaccaugguaauuacugacaguuuuguaaaaucuuuuuuuccuccucauuuguugccagugaauauuaaaaggacacaauuuacuuaaggacacauucagauuaaaugauuccaagguuugauaaccuuuaguuaaguaauaugaugccaugauauuuucucauugauauuaaaaugaagaaaaauauuuuauaaugucuugguacuuaaacugauuaaauaauugaaaaggcuugcaauucuccagaaaagccauguucucucuaaccucugaauuucaguaaucuucacuaguacauggcaguaugucuggaaucauauauacacagacacacacaaccacacauacauauauauacacacauaugaauauaaacguauauacauauauaucuuuuuuuuuuuuuuuugagcuggacuuucacucugucgccuggcuggagugcaguggcaccaucucagcucacugcaaccuccaccuccaggguucaagcgauucuccugccucagccuccugaguagcugggauuacaggcaugcgccaccacgcucggcuaauuuuuguauuuuuaguagagaugggguuucaccauauuggccaggcuggucucgaacuccugaccuggugauccgcccaccucagccucccaaagugcugcugggauuacaggcgugagccacugcaccccauacauauauaucuuuuaauaaguguacuuacuuuauaaaguaccuauuagagccuugauauucaugaauaagccaauaaaguuguuuucaagaacaugggagguaaauaguuaugaaauaaacaacccccagaaggauaaucagagaguuaauacuaugauauguucaguaaagaaagacauuuagaaauuacuacaguuggccgggcaugguggcucacaccuguaaucccagcacuuugggaggcugaggcggguggaucaccugaguucaggaguuugagaccagacuagacaacauggugaaaccccgucucuacuaaaaauacaaaauuagccaggugucguggugcguaccuguaaucccagauacucgggaagcugagacaggagaaucgcuugaaccggggaggcggaggcugcaguaagcggagauugcaccacugcacuccaaccagggcaagacagagcaagacuccgucucacaaaaugaaaaaaagacauuacuacaguuguuuugauuauuaaccauggaauacaccuuguaaaugauacaaaguaucaauucugcaguaguguugaugaaugaauaaaaaagaaauacuaguuggaggacuucuuuaaaguauacgucuuaaaaugcauuuacuucugaauuauauaggcuaacaaaagaacuaacacaaauuugcaacguauuuagaaauccuuuagaagcuuuggaaaugcauuauaugaucuuacuggcacugacauaacuacaucuuaaauauuauagugaucaacaguagucuauguucucugagcacauggaaguaggcuaccuucaggauuuaagcuugugaauccaagcuaauguguuuaauuggauggauaaauaguauaagggcgacagacacuugaaucaacgaaaacuuuuuuuuguuuuugguuuaagagauggggcuucccucugucaacuagggcaguggcacgauaauagcucacugaagucaugaacuccuggccucaagcaauccuccugacucagccuccuaaauagcugggauuacaagugugagguacugccccugacaaaaauaucauuuuugugaaggaugguugcauuauaugggacacaagauuuaagacuagggcacuaaaauuggugggugagaaggcacauguagacaaauuuuccuugaaaagccccaaacuacacauaaauuacagaacuguacuuucuugcaauaucaauuacuucaggguauauguucauuugagaagaauaaugaauagaauacuguccacuauucaaauaaauuuuuccuuugccacguuuacagacuugaguuuacuuaaauguaaguaugauacugcuagggcuaaggaaaugauacuccaaaauaaaguccuccaaagcagcucucucugaccaucuccuaacuuccugucucuggccucucauucuccugaggcuagccacugaaacuaccaucccucguccccaagguaguccacagaaaccagaacucccuuuccccaaagccagccacagaaccuaaauauauuacucuaauguucccugcccucaucuuucuguguaaaaacuaacuauaaagacauaucugaccuauucuguuugauuguaggucauaggauccccauuccagaaagggugcuguuccauacccggaaggaaagaaugcugcacagagaggccaagaagaaucuauacagacaggcaggccuugcuggguuuccccacucaguauauggcuguccagacuuugcugaaccuaagcauaccaaugggcaguuuucuccuauaucuuuaggucuuuauucugaaggcucccaugucacguaacaccaagaucaaauaaaaucauaugcccuuucuccuauuaaucugccuuuuuucagcugauuuucaaagaaccuucagaggcugaaagggaaguuuuuucuuggccccuacaauaugcuacaacuccaguaaguuaauuaguaaauauuaaacuauuuuuggaaggaaaaaaaacugaaaauaacauugcuuuagagauaaauuauuuaagaauugcuagaaauuacccuagaaauuauccuagaaaaaucuuaaaauuuucccuaaaaacuuuuaggaauaauacauuguuucuaaugagacccuucagcuuaugcaaaaagcacaggagacuaaauucuagagucaacgaaacgauauucuccaauucuguuuugcuaaugaauauguuguccauccccccaucagcaugcuuagguaaucuugcaaggauaaauggaaaugucaguugacauuuacaaugaaauaggauuuuuagacaguugugcuuuuugggugggaaaaggagagcuaaaaauuaggggguugggggcuuaaaaaagacagcauuauauggcuuagaacuuugguacccuaccuucauccuuuucugcaaucccuuuuacuccccaaaguuaaaaggcuaucaaugggacaauaauugaugaucaacuaugaagaaauaggcucaaauacacuguuuuauuauauuuuuaucauucuuuauauaccuuuucucaucauucuuugucccaauaguaugcuaugauuaugcacguagaaaaucccaaaauaacaacaaaaucacuggaacuaauaaacuacuguagaaagguugcaggauacaagguuaauauacaaauugucaacuuccuuccuauguaucaguaaugaacaacugaaauuagaaauuaaaauaauaccauauacauuagcaacaacaacaaaaaacauucaccaaaaauguagauauaaaucuaacaaaauauguacaagaucucuaugaggaucacuauaaaacucugauucaagaaaucaaagaaagucuaaauaaaugagaucauucaagaguagaaaaaaauucguauuguuaaaugucaguucuuccaaccuugaucuauaaauucaaugcaaucccaaucaaaauucuggauaguuauuuuguggauaugacaaacugauuuuaaaguauacacagaaagacccaggagaaccaacacgauaccgaaggagaacaaaguuggaggacaaaaccuacccaacuucaagacauuauaaaacuauacuaaucaauacagugugauaauggugaaagaacagacaaaucaagggaacaaaacagagcccagaaauaggcccacauaaacauagucagcuggucuuuuacgaauaagcaaaggcaauucaauggagaaaagaacaaucuuugcaacaaaugguaauggaaaaacuagacauacacaugccaaaacaugaauugacacagaccuuacaaguuucacacacaaaaaaucuaaaaauggaucacagaccuaaauauaaaaugcaaaacuauaaaacuccaaaaauggccgagcacaguggcucacgccucuaaucccagcacucugggacaccaaggcagguggaucaccugaggucaggaguucgaaaccagcccgaccaacauggugaaacccugucucuacuaaaaauacaaaaauuagcugggcauuguggcaggcuccuguaaucccagcuacuuggugacaggugaagccagcuggacuuccugggucgaguggggacuuggacaacuuuucugucuagcuagaggacuguaaaugcaccaaucagcacucaauaaaaaaacgcaccacucagcgcucuguggauuaaaggauuguaaaugcaccaaucagcacucuauaaaaacgcaccaaucagcgcucugugucuaaaggacuguaaaugcaccaaucagcacucuguaaaaaugcaccacucagcauucugugucuagcuaaaggauuguaaaugcaccaaucagcacucuauaaaaacgcaccaaucagcacucugugucuaaaguauuguaaaugcaccaaucagcacucuggucuagcuaaaggauuguaaaugcaccaaucagcacuguguaaaaacgcaccacucagcgcucuguaaaauggaccaaucagcaggauguguguggggccaaauaagggaauaaaaguuggcauggaccaaucagcaggaugugcguggggccaaauaagggaauaaaagcuggccacccgagucagcaguggcaaccugcugggguccccuuccacgcuguggaagcuuuguucuuucgcucuucacaauagaucuugcugcugcucacucuuuggguccgcacugccuuuaugagcuguaacacucaccaggagggucugcggcuucauuccucaagugagcaagacacaaacccacugggaggaacaaacaacuccagacgcgccaccuuuaagagcuguaacacucacugcgaagguccgcugcuucacucccgaaguuagcgagaccacgaacccaauggaaggaagaaacuccggacacaucugaacaucugaacaaacaaacuccagacacaccaucuuuaagagcuuuaacauucacugcgagggucugcggcuucauucuugaagucagcgagacgaagaacccaauggaaggaauaaauuccagacacaucgggaagcugaagcaggagaaucgcuugaacccaggaggcagagguugcagugagccgagaucacgccauugcacuccagccugggcgacagagcaagacuccaucucaaaaaaaaaaaaaacaaaaaacaggccaggugcgguggcuuacgccuguaaucccagugcuuugggaggcagaggcugguggaccaugaggucaagagauccgagaccauccuggccaauguggugaaaccccgucucuacuaaaaauucaaaaauuagcugggcaugguggugugugccuguaguuccagcuacuugggaggcugaggcaggagaaccacuugaacccgggagguggaaguuguagugagccaagauugugccacugcacucaagccuggugacagagugagacuccaucucaaaaaacaaacaaacaaacaaacaaaauuccaaaaauguaacacaaaagaaaaucuaggugaccuugguuauggccauguguuuuuagauacaacaccgaaaguacaauccaugaaagaaaauaaaaaauugauuuagacuucauuaaaauuaaaaacuucugcucuaccaaauggcacuacuaagaaaauuaaaacacaaaauacacauggggauaaaauaugugaaaaacacuuauuuuguuacacaaaauauacaaagaacucaacaaggaaauaacccaguuuaaaauuggcauccaaauaaacaucucaccaaauaagauacagagguggcaaauaagcauaugaaaagaugcucaacaucauaugucaauagggaauuacauaaucaaacaaugagauaccauugcacaccuauuacaauggcuaaauccaaaacaaugacaauaccaaauacuagugagaagguagagcaaugggaacucucauucauggcucauggaaaagcaaaauggcacagacacuuuggaaaacaguuuggcagcuucuuauaaaacuaaacauauuuguuuuacauaaucuagcaaucauguacccugguuacacccaaaugaguugaagacagguccacacaaagaccuguaccuuccuguuuacagcaguuuuauuuauaauugccaaaacuuggaaguaagcaagaguguccuucaauaugugaauggauaaaccaacugugguacauccauacaauggaaucuuacucagcauguaaaagaaauaaagccaugaaaagacaugaaggaaacuuagauguauacugcuaagugaaagaagccaaucugaagagacuaccuacuguauguuuccaacuauaugauauucuggaauaggcaaaacuacagaaauagauguuuuagugaucuuuucacuaaaagaucagugguugucaagaaaagagaaguauggaacaugagauuuuuagggcaauuaaauuauucugaaugauacuguaauaauggaucauuauauauuuaucaaaauccauagaauguacaaaacaaagaaugaauuuauucauauguuugucguuuuuaaagaaauaagacauuucaagaacauuuauauaccaaaguaagaaaauuuuuuauaucuuaucuuucuuugucaacaccaaucaucacacuauucaagagcauaauuccuaaugguugagaagagacucuugcaauauaaagcaaacaaacauauuguuauuuuguaaguauuuaauauaaugaaaacauguuaucuaugauuauuucuucucaaaguacaugacaaagcucuaugaucucaugcugccauuaaauguauaaaaacauagcuuaaaaagacuaauauuacacauauuagcaucuuggaauuauuucugggugcaaagguuauagguaauuuucauuuuuuaaucacuuuuauacugaauguauauuauguuuguaacuuuaaaaauuuucuugcacauuuaaaucaaaucuuguacuuuacaauuugaauauauaaauuucuaaguguaaauuaugaugcuaaaauucuauuuuaacuuuuaaacauguuacaaacauaaaauguguuuuaacauaaaauuuuaaaaacaugaugcucaccagauauugcagcaguguugguauaacaugcuggacauaauuaaaaaaacaccaaagucuaauggauauuagcugaaacccagcuuuuuagggaaaauaguuuugguauuuacucauuauaaaguaaguugacugagacauaaacaaaccauacaaguggucauauuaagagugcauuuaagacugacaugucuggguuaucuguauuagauauuuuuguaaacaauacaaaaaagaaacaaaggagaaagugaaaaugugcaagugaaaagccaacagaucagaacuuaauucuugaaaaagucugaccucacuuuggucaugcuauaauuuggauuugguuucuuuaucaccaccaaagcuaauguggaaauuugaaccccagcguggcaauauugaaaggugaggccuagagggaggugucuggguucuacggguagaugccucauaaauggcucagugcuauucuggaguuaguguguucuggcucucaugagacuggauuaguucucuggcgaauggcuuaguuccuucccacaagaguggguuguuauaaggccacuaugcacuccucagauuuuccucucuuugaauguuucuuuuucuccuuugaccuuguccaccguguugugaaguaugaaagaucuugccagaagccaggucuaugcucuugaacuucucagucugcagaacugugagcuauaaaaccucauaucuuuauaaauuacccagucuuagguauucuuuuauagcaauacaaaacagacuaaggcaggucaaaauuucacacuauucucaauuccccuauuaaucaaaaaaguaguauaggacuaagaauuuguuauguuuuauuggaggugaggagagauaugggagaauauaagauaaagguuaaaaagagauuaggaaaagguagcaaccccaaagcauguuuaagaucagugcuuugagcaagaucaggaaugaaaagagagaauaaaacagaaaugaaaggaugggaacagcugucaauuccagguuucaucuaccuuuugguuuauaaucuucaacucaugucuuauuuuucuacuuaugcauuuaguaaaauauacaaagccauccagucucgucagcuaauacucuaaauaauauaaacauacaacaaguucacuaaauaacuggucuuuuaauuugggcuagaauucaaugagaaaaccauuucuaaaagacuugcagugcuaacauggcucaaauuaaacagaagccucuaacccacuucaucagaggccaugaggcuuauuuucuacacaggguaagacagaagaaaucuacccugaggacacaagacacagcagaaggugaggguaucagacaaaaagguuuugagggggaggagaggauuaagagaguguuuauauauugaacguugaggcccccuagcucucuucuuucacauaguucucauacuacuggcaaucagacuuauacccuaaagcaggguuucucaggauaacauuuuaaacuugauuguucuucguuguuggagcuguccuaugcacuguaggauguaacaagacccccagauucuaugcaucaguuuucaggagcaaccuaucuguggcaaucaaauaagucucuagacacugcuaaauuucucuuagggggccaaauugucccacuugagaaucacugaccuaaaggcagaagcuuggagaacucuucuuauuagacucuuauuaacccuagaaaaaagguuuccaaacuuaaagauaaugacaccagggguuuccacccacaaaaugcccagccauauucacagagcucuaaaauagcuuucuaaugaaucuaacauaaauuugaacaugcaaucaaugauugcuacauagcugaggaaagccucgauuaaaaagaugaaaacauauuaacagaaagaauaauuuggaaaaaguagagaaagcaggaagcaauaaauuucaaaaccaaacaauaauuuuaauucauaaaaagaaaacauaacaggauauaauaagaaaauuauacagagaucaaaaaaggccuuggaaauuaaaaguaugauagcagaaaucaaagucucaaaaguuugaaaaagguaaauuuuccagaaaguaugaagaaaaaaaaaacauaaaaaaugacagaaaaaaaauagguccaggagguagaauguuuaauuagaguuccagaaccaaaaacaaaggcaagaaaauuaaagaaaaaacaugaggaauuuucccagaguugauggacacaaauugucagacugaaaggacccauaaaaugcauggcaaaaugaaagacuauagacucauaauaaguaacauggcugugacauuucagaacucuagauacaacaaagagaaacauuugauaaguuucaaaaugagaucguauaaucuuccacagaggagacaaaagugaucugaagagugauggaaguaagaagggcuucuaauuuuacaacagaugcuaugaauuccuucaaagcucuuaagaacaauuucaccuuuauaauuugaaagccagcuaaacuaauaguugggguaaaauaaagacacuuauauaaauauaauaccacagaacacuugccuuucagaaagcuacuagaaaauggaauaaaccaagagaauacacaagccaaaggauuacauaggauauaggaaacagaggaacuagcauaggauagagacugcaccagcagcaacuauaucaagcaaugggcuaaaacugcagcacauaagaaugcucugggagaaauuucuugaugauggauaaacugauaaaaauacuugauaccucugaauauauggaaaggcuguuuugacaaccagcagauaguuugggucuaaaugacuaauaaauauuuagaacuauacaaaugcucaauggucguauaugaaaaauuaaacuaucaaugggaagauggggggaauggaugggauguuuguggaaaaaggcuaaaucuacaucaccuauaguaagucaagagauaaugccuaaaacugaaaaaacaggagguagcaauauaaaauguuauuuagagauacagaaguauauaccaaaagaauaagccaaaaaaaguuuuagaaguauuucccucuauuuggggaaaacugggguagugacagcuaccuuguccaacaucacagccuuccugggauuaagcaaauaaggcgauaaaggcccaaucauuucguugcaccaugguaucaaucugaaggaaaauauucuggagaaccuaaccugugacaaagaaguaagaacuguuuuuaaucauaagcuauggagaagcaguuaaaaacuuaagcauguguucuuuuaccuuugcaacaguuaaaagaaaaagagaaagagaagaaacaggcugcuuaaauauauuuucuaauuucauuaacuuggcuucuuauacugcagagccgaauguuauuuuagaaauuuaaagcccaucagacuaacaacggaucucucugcaggagcccuauaagccagaagagaguaggggccaauagucaacauucuuaaagaaaagaauuuucaacacagaauuucauauccagccaaacuaagcuucauaagugaaggauaaauaaaauccuuuauagacaagcaaaugcugacagauuuugucaccaccaggccugccuuacaagagcuccugaaggaagcacuaaauauguaaaggaaaaacugguaacagccacuggaaaaacauaccaaauuguaaagaccauugacacuaugaagaaacuacaucaacuaacgggcaaaauaaccagcuagcaucauaaugauaguaccaaauucacacauaacaauauuaaccuuaaauguaaaugggcuaacuggcccaauuaaaagacacagacuggcaaauuggauaaagagucaagacccaucggugugcuauauucaagagacccaccucacuugcaaagacacacaaagguucaaaauaaagggauggaggaauauuuaccaagcaaauggaaagcaaaaaagagcagggguugcaauccuagucucugauaaaacagacuuuaaaccaacaaagauaaaaaaagacaaagaaggacauuacauaaugacaaaguuaucaaugcaaaaagaagugcuaacuauccuaaauauauaugcacccaauaagggagcacccagauucauaaagcaaguucuuagagaccuacaaagagacuuagacccccccacaacaauagcagugggagacuuuaacaccccacugucaauauuagacagaucaacaagacagaaaauuaacaaggacacucaggacuugaacucagcuauggaccaaguggaccuaauagacaucuacagaacucuccaccccaaaucaacagaauauacauucuucucagcaccacaucgcacuuauucuaaaauugaccacauaauuggaaguaaaacacuccucaacaaaggcaaaagaaugaagucauaacaaacagucucccagaccauagugcaaucaaauuagaacucaggauuaagaaacucacucaaaacugcacaacuauguggaaacugaacaaccugcuccugaaugaauacuggguaaauaacaaaauuaaggcagaaauaaauacauucuuuaaaaccaaugagaacaaagacacaauguaccagaaucucugagacacagcuaaagcaguguguagagggaaauuuauagcacuaaaugcccacagaagaaagcagaaaagaucuaaaaccaacacccuuacaucacaauuaaaaaaacuagagaagcaagagcaaacaaauucaaaagccagcagaagacaagaaauaacuaagaccagagcagaacugaaggagauagagacacaaaaacccccucaaaaaaauaaaugaauccaggagcugcuuuuuugaaaacuuuaacaaaauagguagaccgcuagccagacuaauaaagaaaagagagaagaaucaaauagacacaauaaaaaaugauaaaggggauaucaccacugaucccacagaaauacaaacuaccaucagagaauacuauaaacacuucuacacaaauaaacuagaaaaucuagaagaaauggaugaauuccuggacacagacaccaucccaagacuaaaccaggaagaagucgaaucccuaaauagaccaauagcaaguucugaaauugaggcaguaauuaauagccuaccaaccaaaaaaaagcccaggaccagauggauucacagacaaauucuaccagagguacaaagcggagcugguaccauuccuucugaaacuauuccaaauaaaagaaaaagagggacuccucucuaacucauuuuaugaguccagcaucauccugauaccaaaaucuggcagagacacaacaaaaaaagaaaauuccaggccaauaucccugaugaacaucaaugcaaaaauccucaauaaaaugcuggcaaacugaauccagcagcacaucaaaaaguuuauccaccaugaucaaguuggcuucaucccugggaugcaaggcugguucaacauaugcaaaucaauaaauguaauccaucacauaaacagaaccaaugagaaaaaccacgauuaucucaauagauguagaaaacgccuucgacaaaauucaacaccccuucaugcuaaaaacucucaauaaacuaagaaucgauagaacguaucucaaaauaauaagagcuauuuaugacaaacccacggccaauaucacacugaaugggcaaaaacaggaagcauucccuuugaaaaccggcacaagaaaaggaugcccucucucaccacuccuauucaacauaguauuggaaguucuggccagggcaaucaggcaagagaaagaaauaaaagguauuugaauaggaagagaggaagucaaauugucuguuugcagaugacaugauuguauauuuagaaaacccuguugucucagcccaaaaucuccuugagcugauaagcaauuucagcaaagugucaggauacaaaaucaaugugcaaaaauaacaagcauuccuauauaccaauaauagacaaacagagagccaagucaugagugaacucccauucgcaauuccuacaaagagaauaaaauacauaggaauacaacuuauaagggaugugaaggaccgcuucaaggagaacuacaaaccacugcucaaggaaauaagagaggacacaaacaaauggaaaaacauuccaugcgcauggauaggaaggaucaauaucaugaaaauggccacaccgcccaaaguaauuuauagauucaaugcuaaacccaucaagcuaccacugacuuucuucacagaauuagaaaaaaaacuacuuuaaauuucauauggaaccaaaaaagagcccgcauaagccaagacaaugcuaagcaaagagaacaaagcuggaggcaucacgcuaccugacuucaaacuauacuauaaggcuacaguaaccaaagcagcauaguacugguaccaaaacagauauacagaccaauggaacagaacagaguccucagaaauaacaccauacaucaacaacaaccaucugaucuuugaaaaaccugaugacaacaagcaauugggaaaggauucccucccuauuuaauaaaugguguugggaaaacuggcuagccauauggagaaaacugaaacuggcccccccuuccuuacaccuuauacaaaaauggauuaaagacuaaaacauaagaccuaaaaccauaaaaacucuauaagaaaaccuaggcaauaucauucaggacauaggcaugggcaaaaauuucaugacuaaaacaccaaaagcaauggcaacaaaaggauacgaacagacacuucucaagagaagacauuuauguggccaacaaacaugugaaaaaaagcuuaucauuacuggucaugacagaaaaggaaaucaaaaccacaaugagauaccaucucaugccagcuggaauggugaucauuaaaaagucaggaaacaacagauacuggagaggauguggaaaaacaggaacgcuuuuacacuguuggugggaacauaaauuaguuaaaccauuguggaagacaauguggcgauuccucaaggaucuagaaccagaaauaccauuugacccagcaaucccauuacuggguauauacccaaaggauuauaaaucauucuacuauaaagacacaugcauacguauguuuauugcagcacuguucacaauagcaaagacuuggaaccaauccaaauguccuucaaugauagaccagauaaagaaaauguggcacauauacgccauggaauacuaugaagccauaaaaaaggaugaguucauguccuuugcagggacacggaugaagcuggaaaccauuauucucagcaaacuaauacaggaacagaaaaccaaacaacgcauguucccauaagugggagcugaacaaugagaacacauggacacagggagggcaacaucacacacuggggccugcugggggaugggggggcuaagggagggauagcauuaggaaaaauaccuaauguagaugacagguuaaugacacguguauaccuauguaacaaaccuacauguucugcacauguaucccagaacuuaaauuauaauaaaaaagaaaaauuuaaaauagacauuguuuuuccuugcagaggaggcagaacaagauugcugaagagaaucccccaggaaucaucccguagcaggaacaccaaacugaacaacuauccaugcaaaaaaaaaaaaaaaaaaaaaaaacaaccuucauaagaaucagcuggcacagugguacaugcccauaaucucagcacuuuggaaggucaaggcgaguggaucauuugaucucaguucaagaccagucugggcaaccugaugaaacccugucuuuacaaaauaugaaaaaauuagcugggcaugguggcaugugccuguagugccagcuacucgggaggcugaggugggaggaucacuucagcccaggaggucaauugaggcuggaaugaguugagaucacgccaugcacuccagccugggugacagagugagacccugccucaaaacaaacaaauaaacacacuaacaaacaaacaaaaaauccaaaaucaggugaguaaucacggcaccugguuuuaacauaauaucaaggaaagaagcaucgaagaggguaggaaagacagucuugcgcugacuacaccaacccuccuccaaccccaggcagcacagcacugagauagaaucugugugcuugggagagagagcgaaaguaaguaugggacuuugcgcuggaacucagugcugcucuguaacagcagaacacaacacagggcauucugcuggugcccacagaaggagcauuuagcuuaguccugggccagagagaaauccuccccccaaggagaguaauugguuuucaucacauucugacuaaaguagucuagggcccggaauaaauuggagugacaggccacaaggacugcauccuuuggcaagccuugguacugcacuggccuuggagguaauggacuuaagauaaaacccagugcaauaccacccguggcagcuaagggaaucccugaggcaccccuccccaacuacuucagcuugggguaaggaaaaggaagaguagacagaacuuuguuuugcaaccggaguauugguucagucacaguaaaauaaagcaaaagacagauuucugaagcuuuugauagcaagcuuuugcuccgggauggcauuuauagauugacccuaggcaggaagggaauggcugccaugaugggauggacucagucuuggcagaauucaccaccugcuaacuaaaguggccuuuggccuugaauaaccaguggcagucacgcaggacuggccguggaccuugggugagccccaauacugugcuggucugcaaugcuucagaggcaacucagcauaguuccaacugugguggcuacaggaaugccuguaucaccccccaccaacacugggcaggccaguacagagaaagacuccugauugaaggaaagggaagguagagagcaagagacucugccugguaacccagggaauucucccaauuaucuucccaaguccaucaggacuguguauguaggagucugcaagacucacagcguuccugugcuuuggaugcuccuuaaugccaaaauggcugcagugacuacaggcuuaggucacaacacucaaucugcuuugauuuccuggaaagcccccuggagagugacaggaaugaacaaacccaaacugugaagacuagcucuucgaugccuagacaucaaugaauauccacaauuaucaagaacaucuaggaaaacaggaccucaccaaacagacuaauccuggagcaauaaagauacgugaccuuuuagaugggaaauucaaaauagcggucuugagaaagcucaauuuaauucaagauaaaagagauaaaaaauucagaauuauaucagagaaacuuaacaaagagacuaaaaugaugaacaagcagaaauucugaagcucgaaaauucaacaagcugaaaaugcaucagucucaacagcagaagaauaaauuagugagcuugaagacagguuuaugaaaauacagucagaagagaaaaaauaauaaaacaauaaugaaguaugccuacaaaaucuggaaaauagcccccaaaagucauaaucuaagaguuacuggccuuaaagagggcuuacagaaagagauugagguagaaaguguuuucaaagaaauaauagcagaguacuuuucaaacugagagaaagauaugaauauacagguacaagaaggucaaagaacaccaaauagauucaacccaaauaagauuaccuuaaggcauauaauaauuaaagucucaaaaguaaaggacaaagaaaggauccuaaaagcggcaaaagaaaagaaguaacuucauaugaaggaguuauacuacaucuggcagcaaacuucagcagaaacgcuacaggccagaagagaguaggaugacaaacuuuagcagaaacccuggcaggccagaagagaguagaauaguauuagguuggugcacaaguaaccacgguuuuuguaauuacuuuuaauggcaaaaaccacguuaacuuuugcaccaaucuaauacauccaccgaaauuauccuugaaacagggagacaugaagacucuccuagacuaauaaaagcugagggauuucaucaacaccagacucaucuuucagaaaaugcuaaagggaaguucuucaaucugaaagaaaaggacauuaacaagcaacaagaaaucaucugaagguauaaaacucacuggugaaaguaagugcacagauaaauacagaauacucuaaccgcucauaucuuuagcaggaagauuaaaagacaaaccuauauuguuagaagaguucuaaacucuaccuuaucuagagaaccuucuucuuuuagaaaaucaagcaaaacaacuaagccaagacauguuaagaaaaguuugaaaagaaagcuguaaggaaauacaaggggagggauuguuagauaugaguucuaaauuucuuuucaaagaauuagugugucaguauguucaauucuuugccuucuaguuuuaaacuuaacuuccucguaaagcaaccuuuuucgauuaccuacuccacccugacucauucugaucaucugcuccacccaacauuccaaucaccugcuccacccuaacucauuccaauuaccugcuaccugcucugcccugacucccgccaaagcauucacccugucauucucuuuaaauuagccaauuggaauuaguuuagcccgugcggucuaaccccagccaauaggggaacgacagagcagcaggggccacauacgucagggauuagaaccccuucccaucccuuguccaaaugugcgcucaccauuguuccaucuguaagggugcacccuucuauauagaaguagcuugccuugcugaauauuaaaaagaaaauuuuguauucgagugcuauuucuuuugcagcaucgaaacuuucuauauaacacuaucaaaaaaaaacuacuccaaaacuuaaaauauaaaaauauauagagacaaaaagucaaaaagugaagggauggaguagaaguguacagguuuuuaguuuuuucugugcguguauuuuuucuuuucuuugcaaucagaguugucaucaguugcaaauaauuggcuauaaauuguuauuugcuaaccucauaguaaccacaaaacaaaaaccucuaauaggugcacaaaaaaauaaaaagcaagaaauuaaaacauacuaccaaaaaauaauuaucacaaaggaaaacaaggaaaaaaaugggggaaaagcccuagaaaauaaccagaacaacaauaaaaaggcaguaguaaguccuuaccuaucaauaauaauacugaaugugaauggacuaaauucuucacuauaaaaacauagacuaacaacaaaaagacggaaaaagauacugcaccaaacagaaacccaaaaagagcccaaguagcuuuguaucuauuuuuagauaaaauagauuucaacauaaaaacuaugaagaaagaaaaaaagguuaucauauaauacaaaagguuuuaauucagcaagaggacauaaaaauuauaaauacauaucuauccaacacagaagcaucuagauauauagagucaaguguauuagaguuaaggagacagaacccaauacaguaaugacuugggacuucaacagcccacuuucaccauuggacagaucaucuagacagaaagaaacaaugaauuuaaucugcacuauagauuaaauggaccuaauagacauuuacagaagcugucauccaacagccgcagaauacauucuucuccuuagcacauggaacauuucucaaggauggauccuaaauucuccaaucaaaagacacagaagagcugaagggcuaaacaaaacaaggcccuacuaccugcuacauauaagaaacccacuucauuuauaaaaacauagauagaccaaaagauggaaagagacauugcaugcaaacagaaauccaaaaagagcaccaucauguuaggccgcaaaacaagucugauaaaaaguauauuuucuaaccacaauggaauaaaaguagaaauaaauaacaaguggaacuuuggaaacuauacaaacauauaagaauuaaacaauacgugccugaacaaccaaugaaguaauuaaggaaauuaaaaaaugucuugaaacaaaugaaaauggaaacacaaccuacuaaaacuuaugagauacaguuaaagcuaacacuaaagggaauguuuauagcaauaaaugugcaaaucaaaaaguagaaaaccaagaaauaaacaaccuaguaaugcaucuuaaagaacuagaaaagcaagagcaugccaagccccaaauuaagaagagaaauaauaaagaaaacaagaaaauaaauaauaaaaaacagaaauaaaauugagacaaaaaaauagaaaagaucaaugaaaugaaaaggguuguuuggaaagacagacaaaaucaaugaaccuuuacccagacuaagaaaagaaaaaaaagaagauccaaauaaaaucagagacaaaaaaggagacauuacaauugauaucacaaaaauucaaaggaucauuggagaccauuugaacaacugcaugccaauaaauuguaaaaccuagaagaaacgaauaaauuccuaggcacauacagccuaagaagaaugaaacauuaagaaaaccaaaaucgaaauagacccauaauaaguuucaagauagaaacaauaauaaaaagucccccaucacagaaaaggccaggacuucauggcuucacugaguucuaccaaacauuuaaagaagaacuaacaucaauccuacucaaaucauucuccaaaaucaaggaggaucuccaaauucauuuuaugaggccagauuuauucuuuuuuuuuuuuuuuuuuuuuuugagacagagucucacucuguugcccaggugaucugcaaccuccaccuacuggguucaagcgauucuccugccucagccuccagauuagcugggauuacaggcauaagccaccaugcccagcuaauuuuuguauuuuuuguagagaugggguuucaccaugucggccaggcuggucucaaacuccuggcuucaagagaucugccugccucagccucccaaaguucugggauuacuggcgugagcuaccaugccuggccccagauuuauucugauaccaaaaccagacaacgauacaacaacaacaaaaaagaaacuacaggccaguaucucugaugaaaauagauauaaaaaucuucaacaaaacacagcaaaccaaauucaacagcacauuaaaaagaucaucauaaucaagugggauucaucccagggauguaaggaugguucaacauauguaaaucaaucagugugauacaugguaucaacagaaugaaggacacaaaguguauugucauuucaauagaugccaaaaaaaucuuuuuugauaaaauucaauaucccuucauaaaaacucucagcaaacuggggacagaaggaucaucccucaacaugauaaagccauacacaacaaacccacaguuaguaucagacugaaugggggaaaaacugaaagccuuuauucuaggaucuagaagaaggaugggcacuuucaccacuauuacucaaguuaguaacagaaguccuagccagaguaaacagacaagagaaugaaauaaagggcauuuaaauuggaaaggaguaaguaaaauuaucauuguuugcagcucaugugaucuuauacuaaccuaaagacuccaacaaacgacuauuagaacuaauaaauucaguaacauugcagaauacaaaaucaacacacaaaaauccauagaauuucucuaugccaacagugacaaccuaucugaaaaagaaaucaagaaggugaucccauuuacaauagcuacaaauaauauuaaauaucuagaaauaaacuuaaccaacuacaaugcaaacuaucaaacauugaugaaauuaauugaagaggacacaaacaaaugaaaagacaucccaugcucauggguugaaaaaaauuguauuguuaaaaugacaauacuucccacagcaaucuacagauucaaagccaucccuaucaagagcaaugacauucuucacagaaauagaaaaaaaaaauccuaaaauuguauggaagcacaaaagaccccaaauagccaaaacaauccugaccaaaaagaacagagcugguaacugguagacuuaccacacuaccaaaccucaaaauauacuacaacgcuauaguaaccaaaauagcacgauaguggcauaaaaacagacauguagaacaacagaacagagaguccagaaauuaaucuguguauuuaaagccaauuaguuuuuuacuaaggugccaaaaacacucauugggaaaggacagucucuucaauaaaugguguugggaaaacuggaugcccacauucagaacaacaaaaguagaccccaacucuugccauauacaaaaaucaaagaaaaaugcauuaaagacuuacaucuaugaaacuaaucaaggaaaccauuaggcaaaaacuccaggacauuggucuaggcaaagacuucuuaaauaagaccucaaaaacacaagcaacuaaagcaagaaaauaaaauaaaauaacaacaaaugagaucucuccaagccaaaaagcuucugcacagcaaugaaaacaauaaaaugaagauauaacauguagaaugggagaaaauauuucaaacuaauaucugacaaaggauuaauaaccagaauauauaagaaucucaaacgacucaauaggaaaaaaaaaucugauuuuaaaaugggcaaaagaucugaggagacauuucucaaaaagacauacaaauggcaaacaggcauaugaaaaaaauguuccacauuauuaauaaucagagaaauacaaaucaaaacuauaaugagguaucaacucacuccaguuaaaauggcuuuuaucgaaaaggcagucaauaucagaugcuggugagaauguggagaaaggggaacccuuguacacuguugguggaaauguaaacuggcacagucacaacagagaacaguauggagcuuccuaaaaacacaacaaauagaacuauaauccagcaaucccacuacuguguauauacccaagagaaaggaaaucaguauauaaaagguaucuguacucccauguuaacugcagcacuauacacaauagccaggauauggaaucaaccuaacugucaaucaauggauggauaaagaaaugugguacauauacacaauggaauguuauucagccauaaaaaaaaaaugaaauccugucauuuucaacaauauggaugugacugacauuauaagggaaauaagccaggcauagaaagacaaguaucacauguucucacccauauguggaagcuucaaaaaaauugaagucauagagauagugaguaaaaagauguuagcagaggcugggaaggguaguguugagaggagaaucaagaggagaugguuaauggguagaaaaauauaguuagauagaaggaauaaaauauaguguucaguagcacaauauaguaauuacagcuaacaauaauuuaguguauguuuuagaacaauuaaaugaguggaaaugaaaugucccuaacacaaagaaaugacaaauacuugagguaauggauaucccaauuaccugauuugaucauuacacauuguaugcuuauaucaaauaucacauacuccccauuuuauguauccauaguaauuaaaaauuaaaauuuuuaaauauaugaguuaaguuaaaaaaauuuuggcucaaagcauaaauauauuaaaaucaaaucucagaaguaaaaaagaaagacaauuaggguuuuauuuaugguaguggcagacaggaccaaccuuucugcugacgccaacaaaaaaacuaaauaaugaaugaaauaaaguaaugugaaauuacuuaccaaauuccaugugaagguaaaccagaaacaaaccauacaccaaguaacuuuuguucugaggacauuuuccugucuagaagaaaaggcugagaaaaaaggcugagcuaauggaagaugugccggucuaugguaaaaaaaucaaagcacaaggccaggugugguggcucaugccuguaauccuauccuuugacaggccaaggcaggaggauagcuugagcccaggaauucaggaugauugugugcaauacagcgagaccucauuuaaaauaaaaauaaacacaaaaaaucaaaaucaaaaauaaaaauaaaagcacauugccuaacaaagcuggggacucagauaaacuacccaauuuauguucagaguuuaaggacaacaucauuaggauaagaggaaauugaaggaaaauagaauucaugaucuuaaagucuuccuuaaugucauguguauaacagaaggaaucccaacucuugaacaugaauagugacuugggacugaaagcacuccuagagaccuuuccuagaaaaauguaccuucuuaaaaaagauacuauuauucuaggacucauauauuccuauaauuuuuuaaauacaacugguacucaaggcacacaagaaaaaaauaucauaagcuagcagacacagacuuagaaaauuuagaaacuggaauuaucuucaacaaacaacaaaugaacuaugaauauagucggcccuucauagccacagauucacucaaccaaggauuaaaaauacauguauauuuuuaaaaacacgacuauaaaaaauaauagaaauuuuuaaaaagccaugacaguauaacaauauuuacauagcaucuacauuguauuagguaccauaagcaaucuagagauuauuuaaaauacgugggaggauguguguaggccguaugcaaacaugauggcauguuauauaaggaauuugagcugccuguggauugugguaucugcacgggguucugaaaccaauuuccagcagauacuaaggagcaacuauacuaggccaauaaaagcaagauuguaauuuucagcagguaaccagaaacaguaagaauaucaccaauaucuuuaaaaagauacugaugcauugaucuaauaaucucgaugaauacagggcaagauaaagaaugccacacgaugauugaacauuuccucuacccccacaaccacacuugacuaggagaaaaaaaaaaaagaagaaaagaauuccacacaaaaagauuagagugaaacagcagaaaaauuacaaccaaaaaaagaaacaaacaaaaaaaaauucuaaaagagagauuuccuucaaagcagcaugaauuauuagguugguacaaaauuaauugugguuuuugcauuguuggaauuugccauuugauauuggaauuuuuuuuuuuuuuuuuuuuuuuuugagauggagucucucucuguugcccaggcugggcugcaguggcgcgaucucggcucacugcaagcucugccuccaggguucacaccauucuccugccucagccuucugaguagcugggacuacaggcacccgccaccacgccuggcuaauuuuuuguauuuuuaguagagacagggucucaccauguuagccaggaugguaucgaucuccugaccucgugauccgcccaccucagccucccaaagugcugggauuacaggugugagccaccacacccggccuggaauacauucuuaaauaaaugugguuauguuauaugucauuuuaaugggcauuucuugcuuuuuuuuuuuggcuaaugacuuauuacuugcuguuuauauuuauuuuggacuauggaaaugaugcuagacaaaaagcaaaguugagugauuuucuuauuuaaguucaaagugggucguaaaacagcagagacaacuugcaauaucaacaaugcauuuggcccaggaacugcuaaugaacguacagugcaguggugguucaagaaguuuugcaaaagauaccagagccuugaggaugaggaguguaguggcaggccacuggaaguugacaacaaccaauugagagcaaucauugaagcagauugauccucuuacaauuacaugagaaguugcugaagaacucaacguaagaacucaacgucaaccauuccacaguuguucaguauuugaagcaaauugaaaaggugaaaaagcucgauaagugggugccucaccagcugagcaaaaauuuaaaaaaacaccguuuugaaguguugucuucucuuauucuccacaacaacgaaccauuucucaaucggacugugaggugcaacaaaaacuagauuuuauaugacaagcaaugaccagcucaguggcuggaccgcgaagaagcuccaaagcacuucccaaagccaaacuugcaccaaaaaaggccaugguaacuguuugcuggucugcugccggucugauccacuacagcuuucugaauccuggagaaaccauuacaucugagaaguaugcucagcaaaucaaugagaugcacuuaaaacugugaugccugcagccagcaugggucaacagaaagggcccaauucuccacaguaacacccaaccgcacacugcacaaccaacacuucaaaaguugaacgaacugggcuacaaaguuuugccucaucugccauauucaccugaccucucaacugacuaccacuccuucaagcaucucuacaacuuuuuucagggaaaaugcuuccacaaccagcaggaugcaggaaaaagcuuuccaagaguuuguggaauccugaagcauggauuuuuacauuacaggaaaaaacaaacuuauuucuugucggcaaaaauguguugauuguaaugaccuauuuuaauuaauaaagauauguuagagccucguuauaaugauuuaaaauucgcugucccaaaccacaauuucuuuuguaccaaccuaaugcauugacagcugauuucucaaaaucaauaaugaaaaccaaaaacagugaaauguuaucuucaagguacaaguaaaacaaccacaaaucuguaauaucccccaaaacauucuucaagauugaaggcaaaacaaaaaauuaagacaaagcaaaaaaauuaagagaacugaccaucagaaugucugcauuaugaaacuucuacugagugugcuaaaguaaaaguuaaaagauuccaaaagaaaagucagagacgcaggaagaaauuaagacaugguaaacacauaggaacaucuagcucaaaguacuguccagcagcaauacaguaaaagugacauaaguaauuuaaaauuuucuauuguucacacuaaaagaaaacaaggugaaaucaauuauaauuucaacauguaaucauaaugaaaagcugagguauuuuacauuguuuucauacugucuuugaaauaugguguuuauacaacauuacaaugcagaugcuaaauuaaaacugccauauaaaauacuugaucuauauuuuuauauaauuugcagcuaaugccgggugcaguggcucacgucugugaucccaucacuuuggaagcccaagguggguggaucacuugaggucaggaguuugagaccagccuagccaaaauggugaaacuuugccucuacuagaaauaaaaacauuagccaggugugguggcacaugcuuguaaucccagcuacuagggaggcugaggcaggagaaucacuugaacuugggaggcggagguugcagugagccaagaucaugccacuggacuccagccugggcaacagagcgagacuccaucuccaggggggaaaaaaucuccaaaaauuaaaaaauaauaauuuaauaauuugcgguuaagaaagguuuauguauccgaguuguuccaaacauacagguuuuacaguaacugaaucaagugucaguuuuuaaacuuaauugaacacuaaauaaaacuaaaaauucaguuccucagucauacuagccacauuucaagugcucaaaagccacacgcagcuaguagcuacugcaaugaauagcacaagcauagaacuuguuaucuggaguuuaaacuacguauacaauucaaagaacaaugacagccuauaagaccuacaugaagauaaaaguugccaucccagaagagaguaaugcuccaagcacagagaagauauuggccauacugcuagaaaucccugaguaaaacagacaacccaauuaaaacaaaaaacaaacaaacaaaaaaaccucccaaaaagauuuaaaaagacaaugcacaaaagauuuaagaauuaaaaagacaauucuagaaagaggaaauucaaauagccgguaaguuuuugaaaaagugcucaaacucuuuaguguccugggcagaauaaauuaaaacaacaauaagauaaagccacauucaucaaguugggaaaaaggaaaaauaacucuuggugagacaguaaaaguaaagggaucuaccauauacugcugucgggguauacauugguguaucuacuuuggaaaaggcauaacuagugaaguugaagauaaacauacguacucuacaaaaacccaugguaauguacauuaagaauacauguacaagaacauucauaauagcauuguucauaacuacuaaaaacggaacacaauccaaauguuuauuaauauuagacuaaacuguggcucauuuccauuaagacuuuuuauacuauacuuauuauacuauagauuacuacaauccaauauaagaacuagagcuaaauguacuaauagaguuauaucccagcugcaugagagaaaaagauacauaaugauauguaauauauaauccacuuacauacaauuaagaaacaggcaaaacgaaccuaaauugcuuaggaaugcugacauaggugguuaagaaauacuaagaaagaaagcaguaaaugauugccauaaaaaucaguauaguguuaaccacugaaaagaauugaggaaagggaugaucaggaauagaauggagaggggagcuucucaggugccacagacguucuaguucuugacuguggcagcgcuuacauagaguucacacuuuauaguuuuucauuauacuauguaucgauguuuguaugcuuaaauacuaaauguauggaaaaagacacaaaauauuuaaaauuguagcuaaggcacauuaacugccuugcugguauuuuuuuuuuucauuacaaaguggcagacaauugguuacacuauaaagacagacaauugguuacacuacaaagaaaauuuuaaagcacaggagucuaguuuugauuccaucggacaugauuaccguacacaauacagaagauacuaagggcuaagcaaugaugcauaaacgggguccacugcccaaacuuacagaaagcaaaacguggaaaauuaguaacuuuaacugauaguguacaccuaaagaaccuacaccggccgggcgcgguggcucacgccuguaaucccagcacuuugggaggccgaggcgggaggaucauuugaggucaagagaucgagaccagccugaccaacauggugaaaccccgucccuacugaaaacacaaaaaaauuagccaggcgugguggcacaugccuguaguuucagcuacucgggagggugaggcaggagaacugcuugaacccaggagacagagguugcagugagccgagaucgcgccacugcacucgucugggagacagagcgagacuccgucucaaaacaaaaaacaaacaaaaagaacccacccaacagaauuaaguaccaacauaauaaauacgaagaauuuuagauucuugguuuuuaaaaaacauacaaagaugauauuccuucaaaauaucuuuacaaaacauauugagacugugaugcuuuauauugauuguaugaaaacaaugaaaaagaaccagcacuguuucacuauaaaagcuuuacuaauguaaauuuauaaauccuuucuuaaauauuuugaguuaauucuaauuuuaugauagaaauucauuauuuucagcaaaaacagcuggcauuugggaaaccaaaggcucaaaaacuaagaauaguaaccaaagaaacuugacaaaacaguccuuuuaaaacucucaucuacacuauaaggggaaacuuugaucacgucccuucuccuucaucaaucguagaacucaacauuaaggacuacacaaucccacaucccucuccgagaaaaagcaaaggcuuuguguuguagcaacaacgcaagacauggagggaagcuccacucaagacuucccugccugcuccuuccccaaagccacuccagaauaccagggaggguugagagguaaggcaugaagggcgcaauauccaauaugagcaacgcgugugaugcaucuggucaaaaugcauacagaggacuugucucugucccuagauagaaguccuccguccugcagucaugagggucaauugcugaggcuucacaguucccuucucucuuacacucggaccgucacgcuccucaccuacuaccccgaugcagagguagacucaggaucccugcacuugucaaggauuccucggcaagcucacggggcgggaguggccacaagacggagcucgccugguccuggccuucccggccuauacaagccugcccccuucccaauucccaaucuccacagccuuccauccucccacuuucgauucaccuugcgccaccgacgccccuggccuucguuugcagcaaguuuacccccaccauuaccucucgcauaaaagccugcauuuaccaggucaaagaggggaaccaacgccugcaggaaucgcuucaccgaaucgccuggccgcguccucugcuagacuucaccugccgcugcggaccguacacaaccacucccggcaugc

SEQ ID NO: 191197 - RNA, 90351 nt, Homo sapiens
gcaugccgggagugguuguguacgguccgcagcggcaggugaagucuagcagaggacgcggccaggcgauucggugaagcgauuccugcaggcguugguuccccucuuugaccugguaaaugcaggcuuuuaugcgagagguaaugguggggguaaacuugcugcaaacgaaggccaggggcgucgguggcgcaaggugaaucgaaagugggaggauggaaggcuguggagauugggaauugggaagggggcaggcuuguauaggccgggaaggccaggaccaggcgagcuccgucuuguggccacucccgccccgugagcuugccgaggaauccuugacaagugcagggauccugagucuaccucugcaucgggguaguaggugaggagcgugacgguccgaguguaagagagaagggaacugugaagccucagcaauugacccucaugacugcaggacggaggacuucuaucuagggacagagacaaguccucuguaugcauuuugaccagaugcaucacacgcguugcucauauuggauauugcgcccuucaugccuuaccucucaacccucccugguauucuggaguggcuuuggggaaggagcaggcagggaagucuugaguggagcuucccuccaugucuugcguuguugcuacaacacaaagccuuugcuuuuucucggagagggaugugggauuguguaguccuuaauguugaguucuacgauugaugaaggagaagggacgugaucaaaguuuccccuuauaguguagaugagaguuuuaaaaggacuguuuugucaaguuucuuugguuacuauucuuaguuuuugagccuuugguuucccaaaugccagcuguuuuugcugaaaauaaugaauuucuaucauaaaauuagaauuaacucaaaauauuuaagaaaggauuuauaaauuuacauuaguaaagcuuuuauagugaaacagugcugguucuuuuucauuguuuucauacaaucaauauaaagcaucacagucucaauauguuuuguaaagauauuuugaaggaauaucaucuuuguauguuuuuuaaaaaccaagaaucuaaaauucuucguauuuauuauguugguacuuaauucuguuggguggguucuuuuuguuuguuuuuuguuuugagacggagucucgcucugucucccagacgagugcaguggcgcgaucucggcucacugcaaccucugucuccuggguucaagcaguucuccugccucacccucccgaguagcugaaacuacaggcaugugccaccacgccuggcuaauuuuuuuguguuuucaguagggacgggguuucaccauguuggucaggcuggucucgaucucuugaccucaaaugauccucccgccucggccucccaaagugcugggauuacaggcgugagccaccgcgcccggccgguguagguucuuuagguguacacuaucaguuaaaguuacuaauuuuccacguuuugcuuucuguaaguuugggcaguggaccccguuuaugcaucauugcuuagcccuuaguaucuucuguauuguguacgguaaucauguccgauggaaucaaaacuagacuccugugcuuuaaaauuuucuuuguaguguaaccaauugucugucuuuauaguguaaccaauugucugccacuuuguaaugaaaaaaaaaaauaccagcaaggcaguuaaugugccuuagcuacaauuuuaaauauuuugugucuuuuuccauacauuuaguauuuaagcauacaaacaucgauacauaguauaaugaaaaacuauaaagugugaacucuauguaagcgcugccacagucaagaacuagaacgucuguggcaccugagaagcuccccucuccauucuauuccugaucaucccuuuccucaauucuuuucagugguuaacacuauacugauuuuuauggcaaucauuuacugcuuucuuucuuaguauuucuuaaccaccuaugucagcauuccuaagcaauuuagguucguuuugccuguuucuuaauuguauguaaguggauuauauauuacauaucauuauguaucuuuuucucucaugcagcugggauauaacucuauuaguacauuuagcucuaguucuuauauuggauuguaguaaucuauaguauaauaaguauaguauaaaaagucuuaauggaaaugagccacaguuuagucuaauauuaauaaacauuuggauuguguuccguuuuuaguaguuaugaacaaugcuauuaugaauguucuuguacauguauucuuaauguacauuaccauggguuuuuguagaguacguauguuuaucuucaacuucacuaguuaugccuuuuccaaaguagauacaccaauguauaccccgacagcaguauaugguagaucccuuuacuuuuacugucucaccaagaguuauuuuuccuuuuucccaacuugaugaauguggcuuuaucuuauuguuguuuuaauuuauucugcccaggacacuaaagaguuugagcacuuuuucaaaaacuuaccggcuauuugaauuuccucuuucuagaauugucuuuuuaauucuuaaaucuuuugugcauugucuuuuuaaaucuuuuugggagguuuuuuuguuuguuuguuuuuuguuuuaauuggguugucuguuuuacucagggauuucuagcaguauggccaauaucuucucugugcuuggagcauuacucucuucugggauggcaacuuuuaucuucauguaggucuuauaggcugucauuguucuuugaauuguauacguaguuuaaacuccagauaacaaguucuaugcuugugcuauucauugcaguagcuacuagcugcguguggcuuuugagcacuugaaauguggcuaguaugacugaggaacugaauuuuuaguuuuauuuaguguucaauuaaguuuaaaaacugacacuugauucaguuacuguaaaaccuguauguuuggaacaacucggauacauaaaccuuucuuaaccgcaaauuauuaaauuauuauuuuuuaauuuuuggagauuuuuuccccccuggagauggagucucgcucuguugcccaggcuggaguccaguggcaugaucuuggcucacugcaaccuccgccucccaaguucaagugauucuccugccucagccucccuaguagcugggauuacaagcaugugccaccacaccuggcuaauguuuuuauuucuaguagaggcaaaguuucaccauuuuggcuaggcuggucucaaacuccugaccucaagugauccacccaccuugggcuuccaaagugaugggaucacagacgugagccacugcacccggcauuagcugcaaauuauauaaaaauauagaucaaguauuuuauauggcaguuuuaauuuagcaucugcauuguaauguuguauaaacaccauauuucaaagacaguaugaaaacaauguaaaauaccucagcuuuucauuaugauuacauguugaaauuauaauugauuucaccuuguuuucuuuuagugugaacaauagaaaauuuuaaauuacuuaugucacuuuuacuguauugcugcuggacaguacuuugagcuagauguuccuauguguuuaccaugucuuaauuucuuccugcgucucugacuuuucuuuuggaaucuuuuaacuuuuacuuuagcacacucaguagaaguuucauaaugcagacauucugauggucaguucucuuaauuuuuuugcuuugucuuaauuuuuuguuuugccuucaaucuugaagaauguuuugggggauauuacagauuugugguuguuuuacuuguaccuugaagauaacauuucacuguuuuugguuuucauuauugauuuugagaaaucagcugucaaugcauuagguugguacaaaagaaauugugguuugggacagcgaauuuuaaaucauuauaacgaggcucuaacauaucuuuauuaauuaaaauaggucauuacaaucaacacauuuuugccgacaagaaauaaguuuguuuuuuccuguaauguaaaaauccaugcuucaggauuccacaaacucuuggaaagcuuuuuccugcauccugcugguuguggaagcauuuucccugaaaaaaguuguagagaugcuugaaggagugguagucaguugagaggucaggugaauauggcagaugaggcaaaacuuuguagcccaguucguucaacuuuugaaguguugguugugcagugugcgguuggguguuacuguggagaauugggcccuuucuguugacccaugcuggcugcaggcaucacaguuuuaagugcaucucauugauuugcugagcauacuucucagauguaaugguuucuccaggauucagaaagcuguaguggaucagaccggcagcagaccagcaaacaguuaccauggccuuuuuuggugcaaguuuggcuuugggaagugcuuuggagcuucuucgcgguccagccacugagcuggucauugcuugucauauaaaaucuaguuuuuguugcaccucacaguccgauugagaaaugguucguuguuguggagaauaagagaagacaacacuucaaaacgguguuuuuuuaaauuuuugcucagcuggugaggcacccacuuaucgagcuuuuucaccuuuucaauuugcuucaaauacugaacaacuguggaaugguugacguugaguucuuacguugaguucuucagcaacuucucauguaauuguaagaggaucaaucugcuucaaugauugcucucaauugguuguugucaacuuccaguggccugccacuacacuccucauccucaaggcucugguaucuuuugcaaaacuucuugaaccaccacugcacuguacguucauuagcaguuccugggccaaaugcauuguugauauugcaaguugucucugcuguuuuacgacccacuuugaacuuaaauaagaaaaucacucaacuuugcuuuuugucuagcaucauuuccauaguccaaaauaaauauaaacagcaaguaauaagucauuagccaaaaaaaaaaagcaagaaaugcccauuaaaaugacauauaacauaaccacauuuauuuaagaauguauuccaggccgggugugguggcucacaccuguaaucccagcacuuugggaggcugaggugggcggaucacgaggucaggagaucgauaccauccuggcuaacauggugagacccugucucuacuaaaaauacaaaaaauuagccaggcgugguggcgggugccuguagucccagcuacucagaaggcugaggcaggagaauggugugaacccuggaggcagagcuugcagugagccgagaucgcgccacugcagcccagccugggcaacagagagagacuccaucucaaaaaaaaaaaaaaaaaaaaaaaaauuccaauaucaaauggcaaauuccaacaaugcaaaaaccacaauuaauuuuguaccaaccuaauaauucaugcugcuuugaaggaaaucucucuuuuagaauuuuuuuuuguuuguuucuuuuuuugguuguaauuuuucugcuguuucacucuaaucuuuuuguguggaauucuuuucuucuuuuuuuuuuuucuccuagucaagugugguuguggggguagaggaaauguucaaucaucguguggcauucuuuaucuugcccuguauucaucgagauuauuagaucaaugcaucaguaucuuuuuaaagauauuggugauauucuuacuguuucugguuaccugcugaaaauuacaaucuugcuuuuauuggccuaguauaguugcuccuuaguaucugcuggaaauugguuucagaaccccgugcagauaccacaauccacaggcagcucaaauuccuuauauaacaugccaucauguuugcauacggccuacacacauccucccacguauuuuaaauaaucucuagauugcuuaugguaccuaauacaauguagaugcuauguaaauauuguuauacugucauggcuuuuuaaaaauuucuauuauuuuuuauagucguguuuuuaaaaauauacauguauuuuuaauccuugguugagugaaucuguggcuaugaagggccgacuauauucauaguucauuuguuguuuguugaagauaauuccaguuucuaaauuuucuaagucugugucugcuagcuuaugauauuuuuuucuugugugccuugaguaccaguuguauuuaaaaaauuauaggaauauaugaguccuagaauaauaguaucuuuuuuaagaagguacauuuuucuaggaaaggucucuaggagugcuuucagucccaagucacuauucauguucaagaguugggauuccuucuguuauacacaugacauuaaggaagacuuuaagaucaugaauucuauuuuccuucaauuuccucuuauccuaaugauguuguccuuaaacucugaacauaaauuggguaguuuaucugaguccccagcuuuguuaggcaaugugcuuuuauuuuuauuuuugauuuugauuuuuuguguuuauuuuuauuuuaaaugaggucucgcuguauugcacacaaucauccugaauuccugggcucaagcuauccuccugccuuggccugucaaaggauaggauuacaggcaugagccaccacaccuggccuugugcuuugauuuuuuuaccauagaccggcacaucuuccauuagcucagccuuuuuucucagccuuuucuucuagacaggaaaauguccucagaacaaaaguuacuugguguaugguuuguuucugguuuaccuucacauggaauuugguaaguaauuucacauuacuuuauuucauucauuauuuaguuuuuuuguuggcgucagcagaaagguugguccugucugccacuaccauaaauaaaacccuaauugucuuucuuuuuuacuucugagauuugauuuuaauauauuuaugcuuugagccaaaauuuuuuuaacuuaacucauauauuuaaaaauuuuaauuuuuaauuacuauggauacauaaaauggggaguaugugauauuugauauaagcauacaauguguaaugaucaaaucagguaauugggauauccauuaccucaaguauuugucauuucuuuguguuagggacauuucauuuccacucauuuaauuguucuaaaacauacacuaaauuauuguuagcuguaauuacuauauugugcuacugaacacuauauuuuauuccuucuaucuaacuauauuuuucuacccauuaaccaucuccucuugauucuccucucaacacuacccuucccagccucugcuaacaucuuuuuacucacuaucucuaugacuucaauuuuuuugaagcuuccacauaugggugagaacaugugauacuugucuuucuaugccuggcuuauuucccuuauaaugucagucacauccauauuguugaaaaugacaggauuucauuuuuuuuuuauggcugaauaacauuccauuguguauauguaccacauuucuuuauccauccauugauugacaguuagguugauuccauauccuggcuauuguguauagugcugcaguuaacaugggaguacagauaccuuuuauauacugauuuccuuucucuuggguauauacacaguagugggauugcuggauuauaguucuauuuguuguguuuuuaggaagcuccauacuguucucuguugugacugugccaguuuacauuuccaccaacaguguacaaggguuccccuuucuccacauucucaccagcaucugauauugacugccuuuucgauaaaagccauuuuaacuggagugaguugauaccucauuauaguuuugauuuguauuucucugauuauuaauaauguggaacauuuuuuucauaugccuguuugccauuuguaugucuuuuugagaaaugucuccucagaucuuuugcccauuuuaaaaucagauuuuuuuuuccuauugagucguuugagauucuuauauauucugguuauuaauccuuugucagauauuaguuugaaauauuuucucccauucuacauguuauaucuucauuuuauuguuuucauugcugugcagaagcuuuuuggcuuggagagaucucauuuguuguuauuuuauuuuauuuucuugcuuuaguugcuuguguuuuugaggucuuauuuaagaagucuuugccuagaccaauguccuggaguuuuugccuaaugguuuccuugauuaguuucauagauguaagucuuuaaugcauuuuucuuugauuuuuguauauggcaagaguuggggucuacuuuuguuguucugaaugugggcauccaguuuucccaacaccauuuauugaagagacuguccuuucccaaugaguguuuuuggcaccuuaguaaaaaacuaauuggcuuuaaauacacagauuaauuucuggacucucuguucuguuguucuacaugucuguuuuuaugccacuaucgugcuauuuugguuacuauagcguuguaguauauuuugagguuugguagugugguaagucuaccaguuaccagcucuguucuuuuuggucaggauuguuuuggcuauuuggggucuuuugugcuuccauacaauuuuaggauuuuuuuuuucuauuucugugaagaaugucauugcucuugauagggauggcuuugaaucuguagauugcugugggaaguauugucauuuuaacaauacaauuuuuuucaacccaugagcaugggaugucuuuucauuuguuuguguccucuucaauuaauuucaucaauguuugauaguuugcauuguaguugguuaaguuuauuucuagauauuuaauauuauuuguagcuauuguaaaugggaucaccuucuugauuucuuuuucagauagguugucacuguuggcauagagaaauucuauggauuuuuguguguugauuuuguauucugcaauguuacugaauuuauuaguucuaauagucguuuguuggagucuuuagguuaguauaagaucacaugagcugcaaacaaugauaauuuuacuuacuccuuuccaauuuaaaugcccuuuauuucauucucuugucuguuuacucuggcuaggacuucuguuacuaacuugaguaauaguggugaaagugcccauccuucuucuagauccuagaauaaaggcuuucaguuuuucccccauucagucugauacuaacuguggguuuguuguguauggcuuuaucauguugagggaugauccuucuguccccaguuugcugagaguuuuuaugaagggauauugaauuuuaucaaaaaagauuuuuuuggcaucuauugaaaugacaauacacuuuguguccuucauucuguugauaccauguaucacacugauugauuuacauauguugaaccauccuuacaucccugggaugaaucccacuugauuaugaugaucuuuuuaaugugcuguugaauuugguuugcuguguuuuguugaagauuuuuauaucuauuuucaucagagauacuggccuguaguuucuuuuuuguuguuguuguaucguugucugguuuugguaucagaauaaaucuggggccaggcaugguagcucacgccaguaaucccagaacuuugggaggcugaggcaggcagaucucuugaagccaggaguuugagaccagccuggccgacauggugaaaccccaucucuacaaaaaauacaaaaauuagcugggcaugguggcuuaugccuguaaucccagcuaaucuggaggcugaggcaggagaaucgcuugaacccaguagguggagguugcagaucaccugggcaacagagugagacucugucucaaaaaaaaaaaaaaaaaaaaaaagaauaaaucuggccucauaaaaugaauuuggagauccuccuugauuuuggagaaugauuugaguaggauugauguuaguucuucuuuaaauguuugguagaacucagugaagccaugaaguccuggccuuuucugugaugggggacuuuuuauuauuguuucuaucuugaaacuuauuaugggucuauuucgauuuugguuuucuuaauguuucauucuucuuaggcuguaugugccuaggaauuuauucguuucuucuagguuuuacaauuuauuggcaugcaguuguucaaauggucuccaaugauccuuugaauuuuugugauaucaauuguaaugucuccuuuuuugucucugauuuuauuuggaucuucuuuuuuuucuuuucuuagucuggguaaagguucauugauuuugucugucuuuccaaacaacccuuuucauuucauugaucuuuucuauuuuuuugucucaauuuuauuucuguuuuuuauuauuuauuuucuuguuuucuuuauuauuucucuucuuaauuuggggcuuggcaugcucuugcuuuucuaguucuuuaagaugcauuacuagguuguuuauuucuugguuuucuacuuuuugauuugcacauuuauugcuauaaacauucccuuuaguguuagcuuuaacuguaucucauaaguuuuaguagguuguguuuccauuuucauuuguuucaagacauuuuuuaauuuccuuaauuacuucauugguuguucaggcacguauuguuuaauucuuauauguuuguauaguuuccaaaguuccacuuguuauuuauuucuacuuuuauuccauugugguuagaaaauauacuuuuuaucagacuuguuuugcggccuaacaugauggugcucuuuuuggauuucuguuugcaugcaaugucucuuuccaucuuuuggucuaucuauguuuuuauaaaugaaguggguuucuuauauguagcagguaguagggccuuguuuuguuuagcccuucagcucuucugugucuuuugauuggagaauuuaggauccauccuugagaaauguuccaugugcuaaggagaagaauguauucugcggcuguuggaugacagcuucuguaaaugucuauuagguccauuuaaucuauagugcagauuaaauucauuguuucuuucugucuagaugaucuguccaauggugaaagugggcuguugaagucccaagucauuacuguauuggguucugucuccuuaacucuaauacacuugacucuauauaucuagaugcuucuguguuggauagauauguauuuauaauuuuuauguccucuugcugaauuaaaaccuuuuguauuauaugauaaccuuuuuuucuuucuucauaguuuuuauguugaaaucuauuuuaucuaaaaauagauacaaagcuacuugggcucuuuuuggguuucuguuuggugcaguaucuuuuuccgucuuuuuguuguuagucuauguuuuuauagugaagaauuuaguccauucacauucaguauuauuauugauagguaaggacuuacuacugccuuuuuauuguuguucugguuauuuucuagggcuuuucccccauuuuuuuccuuguuuuccuuugugauaauuauuuuuugguaguauguuuuaauuucuugcuuuuuauuuuuuugugcaccuauuagagguuuuuguuuugugguuacuaugagguuagcaaauaacaauuuauagccaauuauuugcaacugaugacaacucugauugcaaagaaaagaaaaaauacacgcacagaaaaaacuaaaaaccuguacacuucuacuccaucccuucacuuuuugacuuuuugucucuauauauuuuuauauuuuaaguuuuggaguaguuuuuuuuugauaguguuauauagaaaguuucgaugcugcaaaagaaauagcacucgaauacaaaauuuucuuuuuaauauucagcaaggcaagcuacuucuauauagaagggugcacccuuacagauggaacaauggugagcgcacauuuggacaagggaugggaagggguucuaaucccugacguauguggccccugcugcucugucguuccccuauuggcugggguuagaccgcacgggcuaaacuaauuccaauuggcuaauuuaaagagaaugacagggugaaugcuuuggcgggagucagggcagagcagguagcagguaauuggaaugaguuaggguggagcaggugauuggaauguuggguggagcagaugaucagaaugagucaggguggaguagguaaucgaaaaagguugcuuuacgaggaaguuaaguuuaaaacuagaaggcaaagaauugaacauacugacacacuaauucuuugaaaagaaauuuagaacucauaucuaacaaucccuccccuuguauuuccuuacagcuuucuuuucaaacuuuucuuaacaugucuuggcuuaguuguuuugcuugauuuucuaaaagaagaagguucucuagauaagguagaguuuagaacucuucuaacaauauagguuugucuuuuaaucuuccugcuaaagauaugagcgguuagaguauucuguauuuaucugugcacuuacuuucaccagugaguuuuauaccuucagaugauuucuuguugcuuguuaauguccuuuucuuucagauugaagaacuucccuuuagcauuuucugaaagaugagucugguguugaugaaaucccucagcuuuuauuagucuaggagagucuucaugucucccuguuucaaggauaauuucgguggauguauuagauuggugcaaaaguuaacgugguuuuugccauuaaaaguaauuacaaaaaccgugguuacuugugcaccaaccuaauacuauucuacucucuucuggccugccaggguuucugcuaaaguuugucauccuacucucuucuggccuguagcguuucugcugaaguuugcugccagauguaguauaacuccuucauaugaaguuacuucuuuucuuuugccgcuuuuaggauccuuucuuuguccuuuacuuuugagacuuuaauuauuauaugccuuaagguaaucuuauuuggguugaaucuauuugguguucuuugaccuucuuguaccuguauauucauaucuuucucucaguuugaaaaguacucugcuauuauuucuuugaaaacacuuucuaccucaaucucuuucuguaagcccucuuuaaggccaguaacucuuagauuaugacuuuugggggcuauuuuccagauuuuguaggcauacuucauuauuguuuuauuauuuuuucucuucugacuguauuuucauaaaccugucuucaagcucacuaauuuauucuucugcuguugagacugaugcauuuucagcuuguugaauuuucgagcuucagaauuucugcuuguucaucauuuuagucucuuuguuaaguuucucugauauaauucugaauuuuuuaucucuuuuaucuugaauuaaauugagcuuucucaagaccgcuauuuugaauuucccaucuaaaaggucacguaucuuuauugcuccaggauuagucuguuuggugagguccuguuuuccuagauguucuugauaauuguggauauucauugaugucuaggcaucgaagagcuagucuucacaguuuggguuuguucauuccugucacucuccagggggcuuuccaggaaaucaaagcagauugaguguugugaccuaagccuguagucacugcagccauuuuggcauuaaggagcauccaaagcacaggaacgcugugagucuugcagacuccuacauacacaguccugauggacuugggaagauaauugggagaauucccuggguuaccaggcagagucucuugcucucuaccuucccuuuccuucaaucaggagucuuucucuguacuggccugcccaguguugguggggggugauacaggcauuccuguagccaccacaguuggaacuaugcugaguugccucugaagcauugcagaccagcacaguauuggggcucacccaagguccacggccaguccugcgugacugccacugguuauucaaggccaaaggccacuuuaguuagcagguggugaauucugccaagacugaguccaucccaucauggcagccauucccuuccugccuagggucaaucuauaaaugccaucccggagcaaaagcuugcuaucaaaagcuucagaaaucugucuuuugcuuuauuuuacugugacugaaccaauacuccgguugcaaaacaaaguucugucuacucuuccuuuuccuuaccccaagcugaaguaguuggggaggggugccucagggauucccuuagcugccacgggugguauugcacuggguuuuaucuuaaguccauuaccuccaaggccagugcaguaccaaggcuugccaaaggaugcaguccuuguggccugucacuccaauuuauuccgggcccuagacuacuuuagucagaaugugaugaaaaccaauuacucuccuuggggggaggauuucucucuggcccaggacuaagcuaaaugcuccuucugugggcaccagcagaaugcccuguguuguguucugcuguuacagagcagcacugaguuccagcgcaaagucccauacuuacuuucgcucucucucccaagcacacagauucuaucucagugcugugcugccugggguuggaggaggguugguguagucagcgcaagacugucuuuccuacccucuucgaugcuucuuuccuugauauuauguuaaaaccaggugccgugauuacucaccugauuuuggauuuuuuguuuguuuguuaguguguuuauuuguuuguuuugaggcagggucucacucugucacccaggcuggagugcauggcgugaucucaacucauuccagccucaauugaccuccugggcugaagugauccucccaccucagccucccgaguagcuggcacuacaggcacaugccaccaugcccagcuaauuuuuucauauuuuguaaagacaggguuucaucagguugcccagacuggucuugaacugagaucaaaugauccacucgccuugaccuuccaaagugcugagauuaugggcauguaccacugugccagcugauucuuaugaagguuguuuuuuuuuuuuuuuuuuuuuuuugcauggauaguuguucaguuugguguuccugcuacgggaugauuccugggggauucucuucagcaaucuuguucugccuccucugcaaggaaaaacaaugucuauuuuaaauuuuucuuuuuuauuauaauuuaaguucugggauacaugugcagaacauguagguuuguuacauagguauacacgugucauuaaccugucaucuacauuagguauuuuuccuaaugcuaucccucccuuagcccccccaucccccagcaggccccagugugugauguugcccucccuguguccauguguucucauuguucagcucccacuuaugggaacaugcguuguuugguuuucuguuccuguauuaguuugcugagaauaaugguuuccagcuucauccgugucccugcaaaggacaugaacucauccuuuuuuauggcuucauaguauuccauggcguauaugugccacauuuucuuuaucuggucuaucauugaaggacauuuggauugguuccaagucuuugcuauugugaacagugcugcaauaaacauacguaugcaugugucuuuauaguagaaugauuuauaauccuuuggguauauacccaguaaugggauugcugggucaaaugguauuucugguucuagauccuugaggaaucgccacauugucuuccacaaugguuuaacuaauuuauguucccaccaacaguguaaaagcguuccuguuuuuccacauccucuccaguaucuguuguuuccugacuuuuuaaugaucaccauuccagcuggcaugagaugguaucucauugugguuuugauuuccuuuucugucaugaccaguaaugauaagcuuuuuuucacauguuuguuggccacauaaaugucuucucuugagaagugucuguucguauccuuuuguugccauugcuuuugguguuuuagucaugaaauuuuugcccaugccuauguccugaaugauauugccuagguuuucuuauagaguuuuuaugguuuuaggucuuauguuuuagucuuuaauccauuuuuguauaagguguaaggaagggggggccaguuucaguuuucuccauauggcuagccaguuuucccaacaccauuuauuaaauagggagggaauccuuucccaauugcuuguugucaucagguuuuucaaagaucagaugguuguuguugauguaugguguuauuucugaggacucuguucuguuccauuggucuguauaucuguuuugguaccaguacuaugcugcuuugguuacuguagccuuauaguauaguuugaagucagguagcgugaugccuccagcuuuguucucuuugcuuagcauugucuuggcuuaugcgggcucuuuuuugguuccauaugaaauuuaaaguaguuuuuuuucuaauucugugaagaaagucagugguagcuugauggguuuagcauugaaucuauaaauuacuuugggcgguguggccauuuucaugauauugauccuuccuauccaugcgcauggaauguuuuuccauuuguuuguguccucucuuauuuccuugagcagugguuuguaguucuccuugaagcgguccuucacaucccuuauaaguuguauuccuauguauuuuauucucuuuguaggaauugcgaaugggaguucacucaugacuuggcucucuguuugucuauuauugguauauaggaaugcuuguuauuuuugcacauugauuuuguauccugacacuuugcugaaauugcuuaucagcucaaggagauuuugggcugagacaacaggguuuucuaaauauacaaucaugucaucugcaaacagacaauuugacuuccucucuuccuauucaaauaccuuuuauuucuuucucuugccugauugcccuggccagaacuuccaauacuauguugaauaggaguggugagagagggcauccuuuucuugugccgguuuucaaagggaaugcuuccuguuuuugcccauucagugugauauuggccguggguuugucauaaauagcucuuauuauuuugagauacguucuaucgauucuuaguuuauugagaguuuuuagcaugaagggguguugaauuuugucgaaggcguuuucuacaucuauugagauaaucgugguuuuucucauugguucuguuuaugugauggauuacauuuauugauuugcauauguugaaccagccuugcaucccagggaugaagccaacuugaucaugguggauaaacuuuuugaugugcugcuggauucaguuugccagcauuuuauugaggauuuuugcauugauguucaucagggauauuggccuggaauuuucuuuuuuuguugugucucugccagauuuugguaucaggaugaugcuggacucauaaaaugaguuagagaggagucccucuuuuucuuuuauuuggaauaguuucagaaggaaugguaccagcuccgcuuuguaccucugguagaauuugucugugaauccaucugguccugggcuuuuuuuugguugguaggcuauuaauuacugccucaauuucagaacuugcuauuggucuauuuagggauucgacuucuuccugguuuagucuugggauggugucuguguccaggaauucauccauuucuucuagauuuucuaguuuauuuguguagaaguguuuauaguauucucugaugguaguuuguauuucugugggaucaguggugauauccccuuuaucauuuuuuauugugucuauuugauucuucucucuuuucuuuauuagucuggcuagcggucuaccuauuuuguuaaaguuuucaaaaaagcagcuccuggauucauuuauuuuuuugaggggguuuuugugucucuaucuccuucaguucugcucuggucuuaguuauuucuugucuucugcuggcuuuugaauuuguuugcucuugcuucucuaguuuuuuuaauugugauguaaggguguugguuuuagaucuuuucugcuuucuucugugggcauuuagugcuauaaauuucccucuacacacugcuuuagcugugucucagagauucugguacauugugucuuuguucucauugguuuuaaagaauguauuuauuucugccuuaauuuuguuauuuacccaguauucauucaggagcagguuguucaguuuccacauaguugugcaguuuugagugaguuucuuaauccugaguucuaauuugauugcacuauggucugggagacuguuuguuaugacuucauucuuuugccuuuguugaggaguguuuuacuuccaauuauguggucaauuuuagaauaagugcgauguggugcugagaagaauguauauucuguugauuugggguggagaguucuguagaugucuauuagguccacuugguccauagcugaguucaaguccugaguguccuuguuaauuuucugucuuguugaucugucuaauauugacagugggguguuaaagucucccacugcuauuguugugggggggucuaagucucuuuguaggucucuaagaacuugcuuuaugaaucugggugcucccuuauugggugcauauauauuuaggauaguuagcacuucuuuuugcauugauaacuuugucauuauguaauguccuucuuugucuuuuuuuaucuuuguugguuuaaagucuguuuuaucagagacuaggauugcaaccccugcucuuuuuugcuuuccauuugcuugguaaauauuccuccaucccuuuauuuugaaccuuugugugucuuugcaagugaggugggucucuugaauauagcacaccgaugggucuugacucuuuauccaauuugccagucugugucuuuuaauugggccaguuagcccauuuacauuuaagguuaauauuguuaugugugaauuugguacuaucauuaugaugcuagcugguuauuuugcccguuaguugauguaguuucuucauagugucaauggucuuuacaauuugguauguuuuuccaguggcuguuaccaguuuuuccuuuacauauuuagugcuuccuucaggagcucuuguaaggcaggccugguggugacaaaaucugucagcauuugcuugucuauaaaggauuuuauuuauccuucacuuaugaagcuuaguuuggcuggauaugaaauucuguguugaaaauucuuuucuuuaagaauguugacuauuggccccuacucucuucuggcuuauagggcuccugcagagagauccguuguuagucugaugggcuuuaaauuucuaaaauaacauucggcucugcaguauaagaagccaaguuaaugaaauuagaaaauauauuuaagcagccuguuucuucucuuucucuuuuucuuuuaacuguugcaaagguaaaagaacacaugcuuaaguuuuuaacugcuucuccauagcuuaugauuaaaaacaguucuuacuucuuugucacagguuagguucuccagaauauuuuccuucagauugauaccauggugcaacgaaaugauugggccuuuaucgccuuauuugcuuaaucccaggaaggcugugauguuggacaagguagcugucacuaccccaguuuuccccaaauagagggaaauacuucuaaaacuuuuuuuggcuuauucuuuugguauauacuucuguaucucuaaauaacauuuuauauugcuaccuccuguuuuuucaguuuuaggcauuaucucuugacuuacuauaggugauguagauuuagccuuuuuccacaaacaucccauccauuccccccaucuucccauugauaguuuaauuuuucauauacgaccauugagcauuuguauaguucuaaauauuuauuagucauuuagacccaaacuaucugcugguugucaaaacagccuuuccauauauucagagguaucaaguauuuuuaucaguuuauccaucaucaagaaauuucucccagagcauucuuaugugcugcaguuuuagcccauugcuugauauaguugcugcuggugcagucucuauccuaugcuaguuccucuguuuccuauauccuauguaauccuuuggcuuguguauucucuugguuuauuccauuuucuaguagcuuucugaaaggcaaguguucugugguauuauauuuauauaagugucuuuauuuuaccccaacuauuaguuuagcuggcuuucaaauuauaaaggugaaauuguucuuaagagcuuugaaggaauucauagcaucuguuguaaaauuagaagcccuucuuacuuccaucacucuucagaucacuuuugucuccucuguggaagauuauacgaucucauuuugaaacuuaucaaauguuucucuuuguuguaucuagaguucugaaaugucacagccauguuacuuauuaugagucuauagucuuucauuuugccaugcauuuuauggguccuuucagucugacaauuuguguccaucaacucugggaaaauuccucauguuuuuucuuuaauuuucuugccuuuguuuuugguucuggaacucuaauuaaacauucuaccuccuggaccuauuuuuuuucugucauuuuuuauguuuuuuuuuucuucauacuuucuggaaaauuuaccuuuuucaaacuuuugagacuuugauuucugcuaucauacuuuuaauuuccaaggccuuuuuugaucucuguauaauuuucuuauuauauccuguuauguuuucuuuuuaugaauuaaaauuauuguuugguuuugaaauuuauugcuuccugcuuucucuacuuuuuccaaauuauucuuucuguuaauauguuuucaucuuuuuaaucgaggcuuuccucagcuauguagcaaucauugauugcauguucaaauuuauguuagauucauuagaaagcuauuuuagagcucugugaauauggcugggcauuuuguggguggaaaccccuggugucauuaucuuuaaguuuggaaaccuuuuuucuaggguuaauaagagucuaauaagaagaguucuccaagcuucugccuuuaggucagugauucucaagugggacaauuuggcccccuaagagaaauuuagcagugucuagagacuuauuugauugccacagauagguugcuccugaaaacugaugcauagaaucugggggucuuguuacauccuacagugcauaggacagcuccaacaacgaagaacaaucaaguuuaaaauguuauccugagaaacccugcuuuaggguauaagucugauugccaguaguaugagaacuaugugaaagaagagagcuagggggccucaacguucaauauauaaacacucucuuaauccucuccucccccucaaaaccuuuuugucugauacccucaccuucugcugugucuuguguccucaggguagauuucuucugucuuacccuguguagaaaauaagccucauggccucugaugaaguggguuagaggcuucuguuuaauuugagccauguuagcacugcaagucuuuuagaaaugguuuucucauugaauucuagcccaaauuaaaagaccaguuauuuagugaacuuguuguauguuuauauuauuuagaguauuagcugacgagacuggauggcuuuguauauuuuacuaaaugcauaaguagaaaaauaagacaugaguugaagauuauaaaccaaaagguagaugaaaccuggaauugacagcuguucccauccuuucauuucuguuuuauucucucuuuucauuccugaucuugcucaaagcacugaucuuaaacaugcuuugggguugcuaccuuuuccuaaucucuuuuuaaccuuuaucuuauauucucccauaucucuccucaccuccaauaaaacauaacaaauucuuaguccuauacuacuuuuuugauuaauaggggaauugagaauagugugaaauuuugaccugccuuagucuguuuuguauugcuauaaaagaauaccuaagacuggguaauuuauaaagauaugagguuuuauagcucacaguucugcagacugagaaguucaagagcauagaccuggcuucuggcaagaucuuucauacuucacaacacgguggacaaggucaaaggagaaaaagaaacauucaaagagaggaaaaucugaggagugcauaguggccuuauaacaacccacucuugugggaaggaacuaagccauucgccagagaacuaauccagucucaugagagccagaacacacuaacuccagaauagcacugagccauuuaugaggcaucuacccguagaacccagacaccucccucuaggccucaccuuucaauauugccacgcugggguucaaauuuccacauuagcuuugguggugauaaagaaaccaaauccaaauuauagcaugaccaaagugaggucagacuuuuucaagaauuaaguucugaucuguuggcuuuucacuugcacauuuucacuuucuccuuuguuucuuuuuuguauuguuuacaaaaauaucuaauacagauaacccagacaugucagucuuaaaugcacucuuaauaugaccacuuguaugguuuguuuaugucucagucaacuuacuuuauaaugaguaaauaccaaaacuauuuucccuaaaaagcuggguuucagcuaauauccauuagacuuugguguuuuuuuaauuauguccagcauguuauaccaacacugcugcaauaucuggugagcaucauguuuuuaaaauuuuauguuaaaacacauuuuauguuuguaacauguuuaaaaguuaaaauagaauuuuagcaucauaauuuacacuuagaaauuuauauauucaaauuguaaaguacaagauuugauuuaaaugugcaagaaaauuuuuaaaguuacaaacauaauauacauucaguauaaaagugauuaaaaaaugaaaauuaccuauaaccuuugcacccagaaauaauuccaagaugcuaauauguguaauauuagucuuuuuaagcuauguuuuuauacauuuaauggcagcaugagaucauagagcuuugucauguacuuugagaagaaauaaucauagauaacauguuuucauuauauuaaauacuuacaaaauaacaauauguuuguuugcuuuauauugcaagagucucuucucaaccauuaggaauuaugcucuugaauagugugaugauugguguugacaaagaaagauaagauauaaaaaauuuucuuacuuugguauauaaauguucuugaaaugucuuauuucuuuaaaaacgacaaacauaugaauaaauucauucuuuguuuuguacauucuauggauuuugauaaauauauaaugauccauuauuacaguaucauucagaauaauuuaauugcccuaaaaaucucauguuccauacuucucuuuucuugacaaccacugaucuuuuagugaaaagaucacuaaaacaucuauuucuguaguuuugccuauuccagaauaucauauaguuggaaacauacaguagguagucucuucagauuggcuucuuucacuuagcaguauacaucuaaguuuccuucaugucuuuucauggcuuuauuucuuuuacaugcugaguaagauuccauuguauggauguaccacaguugguuuauccauucacauauugaaggacacucuugcuuacuuccaaguuuuggcaauuauaaauaaaacugcuguaaacaggaagguacaggucuuuguguggaccugucuucaacucauuuggguguaaccaggguacaugauugcuagauuauguaaaacaaauauguuuaguuuuauaagaagcugccaaacuguuuuccaaagugucugugccauuuugcuuuuccaugagccaugaaugagaguucccauugcucuaccuucucacuaguauuugguauugucauuguuuuggauuuagccauuguaauaggugugcaaugguaucucauuguuugauuauguaauucccuauugacauaugauguugagcaucuuuucauaugcuuauuugccaccucuguaucuuauuuggugagauguuuauuuggaugccaauuuuaaacuggguuauuuccuuguugaguucuuuguauauuuuguguaacaaaauaaguguuuuucacauauuuuauccccauguguauuuuguguuuuaauuuucuuaguagugccauuugguagagcagaaguuuuuaauuuuaaugaagucuaaaucaauuuuuuauuuucuuucauggauuguacuuucgguguuguaucuaaaaacacauggccauaaccaaggucaccuagauuuucuuuuguguuacauuuuuggaauuuuguuuguuuguuuguuuguuuuuugagauggagucucacucugucaccaggcuugagugcaguggcacaaucuuggcucacuacaacuuccaccucccggguucaagugguucuccugccucagccucccaaguagcuggaacuacaggcacacaccaccaugcccagcuaauuuuugaauuuuuaguagagacgggguuucaccacauuggccaggauggucucggaucucuugaccucaugguccaccagccucugccucccaaagcacugggauuacaggcguaagccaccgcaccuggccuguuuuuuguuuuuuuuuuuuuugagauggagucuugcucugucgcccaggcuggagugcaauggcgugaucucggcucacugcaaccucugccuccuggguucaagcgauucuccugcuucagcuucccgaugugucuggaauuuauuccuuccauuggguucuucgucucgcugacuucaagaaugaagccgcagacccucgcagugaauguuaaagcucuuaaagauggugugucuggaguuuguuuguucagauguucagauguguccggaguuucuuccuuccauuggguucguggucucgcuaacuucgggagugaagcagcggaccuucgcagugaguguuacagcucuuaaagguggcgcgucuggaguuguuuguuccucccaguggguuugugucuugcucacuugaggaaugaagccgcagacccuccuggugaguguuacagcucauaaaggcagugcggacccaaagagugagcagcagcaagaucuauugugaagagcgaaagaacaaagcuuccacagcguggaaggggaccccagcagguugccacugcugacucggguggccagcuuuuauucccuuauuuggccccacgcacauccugcugauugguccaugccaacuuuuauucccuuauuuggccccacacacauccugcugauugguccauuuuacagagcgcugaguggugcguuuuuacacagugcugauuggugcauuuacaauccuuuagcuagaccagagugcugauuggugcauuuacaauacuuuagacacagagugcugauuggugcguuuuuauagagugcugauuggugcauuuacaauccuuuagcuagacacagaaugcugaguggugcauuuuuacagagugcugauuggugcauuuacaguccuuuagacacagagcgcugauuggugcguuuuuauagagugcugauuggugcauuuacaauccuuuaauccacagagcgcugaguggugcguuuuuuuauugagugcugauuggugcauuuacaguccucuagcuagacagaaaaguuguccaaguccccacucgacccaggaaguccagcuggcuucaccugucaccaaguagcugggauuacaggagccugccacaaugcccagcuaauuuuuguauuuuuaguagagacaggguuucaccauguuggucgggcugguuucgaacuccugaccucaggugauccaccugccuuggugucccagagugcugggauuagaggcgugagccacugugcucggccauuuuuggaguuuuauaguuuugcauuuuauauuuaggucugugauccauuuuuagauuuuuugugugugaaacuuguaaggucugugucaauucauguuuuggcauguguaugucuaguuuuuccauuaccauuuguugcaaagauuguucuuuucuccauugaauugccuuugcuuauucguaaaagaccagcugacuauguuuaugugggccuauuucugggcucuguuuuguucccuugauuugucuguucuuucaccauuaucacacuguauugauuaguauaguuuuauaaugucuugaaguuggguagguuuuguccuccaacuuuguucuccuucgguaucguguugguucuccugggucuuucuguguauacuuuaaaaucaguuugucauauccacaaaauaacuauccagaauuuugauugggauugcauugaauuuauagaucaagguuggaagaacugacauuuaacaauacgaauuuuuuucuacucuugaaugaucucauuuauuuagacuuucuuugauuucuugaaucagaguuuuauagugauccucauagagaucuuguacauauuuuguuagauuuauaucuacauuuuuggugaauguuuuuuguuguuguugcuaauguauaugguauuauuuuaauuucuaauuucaguuguucauuacugauacauaggaaggaaguugacaauuuguauauuaaccuuguauccugcaaccuuucuacaguaguuuauuaguuccagugauuuuguuguuauuuugggauuuucuacgugcauaaucauagcauacuauugggacaaagaaugaugagaaaagguauauaaagaaugauaaaaauauaauaaaacaguguauuugagccuauuucuucauaguugaucaucaauuauugucccauugauagccuuuuaacuuuggggaguaaaagggauugcagaaaaggaugaagguaggguaccaaaguucuaagccauauaaugcugucuuuuuuaagcccccaacccccuaauuuuuagcucuccuuuucccacccaaaaagcacaacugucuaaaaauccuauuucauuguaaaugucaacugacauuuccauuuauccuugcaagauuaccuaagcaugcugauggggggauggacaacauauucauuagcaaaacagaauuggagaauaucguuucguugacucuagaauuuagucuccugugcuuuuugcauaagcugaagggucucauuagaaacaauguauuauuccuaaaaguuuuuagggaaaauuuuaagauuuuucuaggauaauuucuaggguaauuucuagcaauucuuaaauaauuuaucucuaaagcaauguuauuuucaguuuuuuuuccuuccaaaaauaguuuaauauuuacuaauuaacuuacuggaguuguagcauauuguaggggccaagaaaaaacuucccuuucagccucugaagguucuuugaaaaucagcugaaaaaaggcagauuaauaggagaaagggcauaugauuuuauuugaucuugguguuacgugacaugggagccuucagaauaaagaccuaaagauauaggagaaaacugcccauugguaugcuuagguucagcaaagucuggacagccauauacugaguggggaaacccagcaaggccugccugucuguauagauucuucuuggccucucugugcagcauucuuuccuuccggguauggaacagcacccuuucuggaauggggauccuaugaccuacaaucaaacagaauaggucagauaugucuuuauaguuaguuuuuacacagaaagaugagggcagggaacauuagaguaauauauuuagguucuguggcuggcuuuggggaaagggaguucugguuucuguggacuaccuuggggacgagggaugguaguuucaguggcuagccucaggagaaugagaggccagagacaggaaguuaggagauggucagagagagcugcuuuggaggacuuuauuuuggaguaucauuuccuuagcccuagcaguaucauacuuacauuuaaguaaacucaagucuguaaacguggcaaaggaaaaauuuauuugaauaguggacaguauucuauucauuauucuucucaaaugaacauauacccugaaguaauugauauugcaagaaaguacaguucuguaauuuauguguaguuuggggcuuuucaaggaaaauuugucuacaugugccuucucacccaccaauuuuagugcccuagucuuaaaucuugugucccauauaaugcaaccauccuucacaaaaaugauauuuuugucaggggcaguaccucacacuuguaaucccagcuauuuaggaggcugagucaggaggauugcuugaggccaggaguucaugacuucagugagcuauuaucgugccacugcccuaguugacagagggaagccccaucucuuaaaccaaaaacaaaaaaaaguuuucguugauucaagugucugucgcccuuauacuauuuauccauccaauuaaacacauuagcuuggauucacaagcuuaaauccugaagguagccuacuuccaugugcucagagaacauagacuacuguugaucacuauaauauuuaagauguaguuaugucagugccaguaagaucauauaaugcauuuccaaagcuucuaaaggauuucuaaauacguugcaaauuuguguuaguucuuuuguuagccuauauaauucagaaguaaaugcauuuuaagacguauacuuuaaagaaguccuccaacuaguauuucuuuuuuauucauucaucaacacuacugcagaauugauacuuuguaucauuuacaagguguauuccaugguuaauaaucaaaacaacuguaguaaugucuuuuuuucauuuugugagacggagucuugcucugucuugcccugguuggagugcaguggugcaaucuccgcuuacugcagccuccgccuccccgguucaagcgauucuccugucucagcuucccgaguaucugggauuacagguacgcaccacgacaccuggcuaauuuuguauuuuuaguagagacgggguuucaccauguugucuagucuggucucaaacuccugaacucaggugauccacccgccucagccucccaaagugcugggauuacaggugugagccaccaugcccggccaacuguaguaauuucuaaaugucuuucuuuacugaacauaucauaguauuaacucucugauuauccuucuggggguuguuuauuucauaacuauuuaccucccauguucuugaaaacaacuuuauuggcuuauucaugaauaucaaggcucuaauagguacuuuauaaaguaaguacacuuauuaaaagauauauauguauggggugcaguggcucacgccuguaaucccagcagcacuuugggaggcugaggugggcggaucaccaggucaggaguucgagaccagccuggccaauauggugaaaccccaucucuacuaaaaauacaaaaauuagccgagcgugguggcgcaugccuguaaucccagcuacucaggaggcugaggcaggagaaucgcuugaacccuggagguggagguugcagugagcugagauggugccacugcacuccagccaggcgacagagugaaaguccagcucaaaaaaaaaaaaaaaagauauauauguauauacguuuauauucauauguguguauauauauguaugugugguugugugugucuguguauauaugauuccagacauacugccauguacuagugaagauuacugaaauucagagguuagagagaacauggcuuuucuggagaauugcaagccuuuucaauuauuuaaucaguuuaaguaccaagacauuauaaaauauuuuucuucauuuuaauaucaaugagaaaauaucauggcaucauauuacuuaacuaaagguuaucaaaccuuggaaucauuuaaucugaauguguccuuaaguaaauuguguccuuuuaauauucacuggcaacaaaugaggaggaaaaaaagauuuuacaaaacugucaguaauuaccaugguuuauucaccugugguccaaaaguugauuuguguggaauuauucuucagcucuggagaacucaaggaaacaucucaccagaggcugugccccaacuugauauagauagcauuuuugagcugaucucuuuaggaagaacuaacagaguuuacuuauuuucuaacuuggaauauauaucaguauuggcccuuauuucuccccacacucaaccauucuuuuaacucuauuuuaaucuuuaccucuguacaaacaauccaacugggggagaaaaaagaaugaaaacuaauucugauggacugaaaaacagcuuaaauguauuuuucuugccucaguuucaucucaaaggacaguaacaaaacauggaaaccaccuucaaauuucuccuaaaauaccuuucauuuuacguuauuugacuguuuagcuagcaaaucaagaacauuuuaucgaacugaagagaggcaaaguucugaaauuuuguccauacuuaccuaucuuugagaaaugucagccgugugaaguuagguccuagguaaacaguaauagaauuuguauuuuaacuuuuuucuaauaaagggagugggguagugguauuguuuucgguguuuucuucugccaccaucuggaaagaaagcaguauuaaacaucuuuuuaauuuacuaagaguucuuuucacaaaguaaugcccccaucugcuggagcuguaagguuuugccucaaaguaaggguauuagagaaaauaauacaugaucauuuguguauuuuugaauuauauuuucuagucucauccacuaauuuuaccaagguuuuuguaggaguuguuagccaauuucaucuucucuugauguguuaguucuuauuccaaacuaagaaaaacuugauauaaauuaguguucuuggaaaguggugcaugguuuuuguuucuuguuguuguuguuccuauuguuguuguuuuugagaugagucucgcccuauugcccuggugggagugcaguguuggcgaucuuggcucacugcaaccuccgccuccuggguucaagcaguucuccugccucaagucuccugaguagcugggauuacaggcacgugccaccacaccuggcuaauuuuuguauuuuuaguagagauggaguuucaccauguuggccaggcucgucucaaacuccugaccucaagugaucugcccaccucagucucccaaagugcugguauaacaggugugagccacugcgcccagccgaaaagugguauguuuuuauauuuuuaacaaauggguaugagaaaacaaaaaaugcucagaacagucugagcucugagguaugcaggcccagagagaugugaguaguaugggacuucaguuaugcccccauacuccaccccaacucccuacccccugccacucuguagccaauggauaguuuguuauuuuaauguagauucuuggugaacaacucagagcgugccuuuuuauuuuucuuuuucucuuuaaaaaucuacuuguuacugcugcuaaugagcauauucagggcaacuugaauuuaugcuccuugguugcaacccucaagcuuggcucaaaugaacucucuauguauguuauuaauuuugccucaacuucuuuccuuuuaggucaacacauauaaaacuuacauuauuuacagaaauauuugugaauagaauaaaaaguuauguuuauaaauguuuuaaguguauagauaugagaauuuuuauagguaacaccuaauuuuuggcuauaaaaucaguguuggaaacauuuucaaaaugcccuauaacacaaauuucuucuaaaaagcaguuucuuuccuacuuuuauuuuaaaauuccagaugaaguaaaucuuuuuuuuuuuuuugcuuuuuguuuuuuauuuacuaagcagcaugcuguugacaggcagccauuuuucauuccaggaaaaagcugcaguuggaacagcugagauuauuucacuuacauuuuaaaaauaauaacaucuuuaaauucagcaagugaggcugggcguggugauucaggccuguaaucccaacugaggccaagguggguggaucacuugaggucaggaguucgagaccagccuggccaacauggugaaacccccaucucuacuaaaaaugcaaaaauuagccaggcaugguggcacaugccuguaaucccagcuccuaucuccugaggcaggagaauagcuugaacccaggaggcggagguugcagugagccaagauugcaaccuugcacucccaccagggcgacagagcgagauucugucucaaaaaaaaaaaaaaauucaguaagucagcuggauucaguaaugucuccaaacuggauucauauaccuacauuguguauuaaugagcugacaguaaaugaauaugugauggugccacucggaaccccuucuuguuauugaucuugaacucuucccuuuccuuagggcgucuggguugaguaacaugacuugaccugcugauacagagaccaaguaaaauuugucaauguauauauuaaauauuaguuaaguuuaauuuagcucuuauuuuuuggauagauauuuauagguaaacauauuacaauacuuucuuuuuuuuuuuuuuuugagacagagucucgcucuguugcccaggcuggagugcaguggcucuaucuuggcucacugcaagcuccgccucccggguucacaccauucuccugccuaagccucccaaguagcugggacuauaggcgccggccaccacaccuggcuaauuuuuuguauuuuuaguagagaugggguuucaucauguuagccaggauggucucgaucuccucaccucaugaucugcccgccucggccucccaaagugcugggauuacaggugggagccacugugcccagccuacaauacuuucuuauuccagaggguuauuuugcaccagccaccuuacugaccauuuauaugaaagauaggaaaaauuguuuguuguuaccucuuugaccugugcuuggacaacuuugaaacuaaauaaaucggacauguucacaccuguuuucuccuuaaaugcuuuuuuuuggguacacaguguuacagcuccuggcgucguaauuacuaguaagaugcucauaauacuagaguacuuuugauuauccagcugagguacaugguucuuuuucuuaaacaauuugauccacuaauucuuauuuuuguuuuuuaccuuaugguagcuguagaaaaaauaauuuaaaauauguuacuuuuuguguguguguguguguguguauauauauacacacacacacacacauauauauaucuauauauggaaaguucuuguucuuuuaaaugacaaauauuaugaaauagagcccauuuugguugaaaaaguauguguguguguaggcaggccacauuuuuaaccuaauaaaaauuauaggaauugcuggacuuuagauauuuauuaaacccaagagauuuuuuuuuuuuuaaagaucucaaucuuagguuaaaaaaaguuucaagcugcucaagguguugacccagcuacuuaggaggcugagacggaaggaucucuugagcccaggaauucaaauccagcuugugcaauacagugagacccugggucuaaaaaaaaaauaguuuuaaguuccuuuuuuacacuucauguuuuaaguuuagacauuuucuuucuacucugaagaaugaaauuagcaaccguaugcauucaugccacuuuuuuuucauuuuuuuguugaaugauuauuuucacuguguaacgacuuauguuuccaccugcuacuauaauuauuuaccuuuuuuugguuuuaguuuuuuauuuuaguggauucaaaggucacuaguguguguguguguguguguguguaugugugugugugucuguauaaaauuguguuuuuaauuaugcuuuaguuggcuggauuuugucauugaguuccccauauccuccugcaacacacacacuccacacaaggcuuuauuggcucuguguacuaaauaaguucauucuuauuugauaaggcuauaccuguuaccuuuauaugugagugacaucuuugcuagguaugagucuuggucucucucucagaacuuuguagauauuaugacaccauauuuuagcauuuuuuucucccuuguagguguuuuucaggcugagucccagugaauucuuuuuuuuaggcuugaaauuuaauaauugaauuacaguuuuuaucaguuuucuucuuuucauauuugauacauugaugagaguuuaggagauuuuauugaugcaaguauagcuuuuaagagugagguuaaaguuaggaacuauggagaacuccuguagaauuuucuaggcuuguuuauuauuaacuugucucuuuguuuaguuacugcuaaaguauuucuguuuaacaguuuuuuguuuuguuuuauuagaggagaaagauucucugauuccauuuuuuaccauuuuaucugcacaauuccuaauuaaaauuccagaguuucuguacgaaacauguauuccuuuuuagcgaugggaagaaaguuuaugaucuuaaaaauaaagauguguacagaaaaaaauacaaauuguacacauagacauucaaagagaagugaauuguugguauugaacaucuguuauaauaaccguguucuuucagaauguauuccucugcuauguuuugucuccuaaagaaaagcccagugaugauuuugaugaacuuucugauguuugcaggguuuuuuuucaugccaguugagacuaaccaaccucugauugggagucaauagaccuaacagcuacugcugcuguuaaguaagcuaugucaucuugggcaggucauuguauaccauugcuagucagcaagcagagagguauuugguaaauugaccaaacuucaaauuugacaugaaggacugucaccaggaguucauccagguugcuucucccacaaaguuuaggauuauguuagucuaaaaaacagugauuagaacuaaccuaagaugaggagcuuaaguuaguugugcaaacuaaauggagggcuuuuauguucuauuucuaagguaggaaaacauuugacaucugaauggcuauugagcuauauguaggaauaaguuguuagugucagcuauuuucuaauucugucuuuagauguuaagagaguuuacuaaggcugggcacgguggcucacgccuguaaucccagcaccuugggaggccgaggcaggcggaucacgaggucaggaaaucgagacuauccuggcuaacauggugaaaccccgucucuacuaaaaauacaaaaaauuagccgggcaugguggcaggcgccuguagucccagcuacucaggaggcugagggaggagaauggugugaacccgggagguggagcuugcagugagccgagauagcgccacugcacuccagccugggcaacagagcgagacucugucucaaaaaaacaaaaaaacaaaaaaaacagagaguuuacugaauaguuaucauuauuguuggccaaacagaguuagucuaaaauacauuaugcagaaucagugugguagacaaagaggcucugagugaggguuuggaucugaggaaggcaucaugagaaagaagaguuauaaguacucaugaaaccucaagagcaguaaaggauguacuucauaauuuuuagaauuuaucaacaagcaacccuuggaaagcauaggaauggagaauuacaauaaauaagccaccucaguugaaaaaugggaguaugaauauacaugugauugagucuugagauuauuuagucauccugcuuuaguuagcauguaacuauaaaauuucaaauacagauacaguaaguaguggucagugaauauauuucagaauucaucccuuccuuuguaaagguauagauuguaggggacuuacugucauggggaaaugcacauaggcaauuuagagagcagacagcuuuagaugacacauuuuuacaauuccuauaauuuuuguccuuugucaauacagaaguaaauuuaaaauggucaguagcucucugauguauaguagugcucuggaacugcaguaaugagaauuuccuccauacgcaguugacucuugaacaauguaaggguuaggggucgaaacacccccucccuaccaaaagcaguugaaaaucugcauauaacuuuugccuccccaaaaacuuaacuguuaauagccuacuugacuggaagccuugcugguaacauagucaauuaauauauauuuuauguauguauuauauauuguauuauuauaauaaaguaagguaaagaaaagauauuuagaaaauauaucuacuauauauagaaaauauauuuacuauucauuaaguugaaguggcucauuguaaaggucugcauccuacuugucuuccuguugaguaggcugaggaggaagaggagggguugaucuuguugccuagggguagaagagguggaggagguagaaggggagacaagacagguuaggcacacuggguguaacuaaacagguaauuucugucuaucucuuuugguuucuaauuucuuuuaaaauguuucuauacaguaucaacccuuccucaaccauuugcuuugauuccaguaccuguaucauagaaggguccaugucguaaaagaagucaagaguagucuuguauauucagaaccguucugccagauugucuaaugucaguuuguuuucuggcacuguucugcaucuuucucacugucuggcagugguucagaagcaucuaucuccaccuugucuucuguuaauuccucuggugugguaucuguuagcucuugaauuucucuaagacccauauguugaaacacaucacuccccacccuuuuugccgugucuacaaucucuuucaugauuuucuugauuggcuuuguaguaaauccugugaagucaugcacaacaucuggacauagauuucuucagcagaaauuuguuucagucuuguuggcuuucauggcuuuuucuaugacaacagggcaucuucaaugggauaauccucccagacuuucaucauguucugucuguggagguuuuuccauaguguugacauucguuuccauagaguucuguguguaaugaaccuuaaaggucccuaugacccccugaucuacaggcugaauuagagaguuuguguuuggggaccaguggaccacuuggacaaaagccuucgguguugaacucaugggauucuggguagccaggggcauuguccaauaucagaagaacuucaaaaggcagucccuuacugucuggguacuuccugacuucagugacaaagcaucaguggaacuaauucauuaaccccauuggcucauugagugaaucgguuccaguguuuugacuauuacgaauaaauuuaucaugaacauacguguuacagguuuuugugugaacauaaguuuuucugucagguaaguacccaagagugcaauugcuauguggcuugguaagaguauuuguaguuuucuaagaaacugcugucaagaaacuuuucagaguagccaugccauuauacauucccaccagugguuaaaugaaagauucauuuucuuuacauccucaccaucuuuguguuauuuuagcugccuuaaucaguguguggugguaucuuacuaugguuuuacuuugcauuuuccuagcggauaaugauauuaaacaucuuugcauaugcuuauuugccaccugcauaucuuuggugaaaugucuacuuauguauuuugccuauuuucuaaugggauuccuuuuuuauuauugaguguugaggguucuuuagauacagaucuuuugucagauaugugguuugcagguauuuucucccagucugaagcuugucucaucuguacuauuagaauugucuuugaaauauucuuuauuauauaguagauauuugaccauuacaugaagggggaagaugucaaaauaaccuuuggacuaaaacuuuauuuacagucaaaauuuauguagguuauaagguagauaccauaguggcauguuuguuguuucuuuuaugaaugcuggccccacaugaagaaaaaaugaauuaucuuaauagcuuaccugauuuauauaugaugcaaaggggcagauuagauaccugccuuggaacuguggacauuuauuuagcuuuuuugaguaauucuuucuuaauucaugaaguggguaaaaaauaucuuuuaauucuaacaauacuguaagauagcuaauguaguucuacaaaauaaaacauacugcaaaagcccuuucuccuuuuuacauuuuaauuagucuuauaaucuaggagacaauuauuacauaguucuuugugauuuuagauuuuggcugauagucaagagcaucauaaaccagaguugaggauauuuuauuagcuaaaaagguuuuucccucucauaacacugauuaggaaaaauaaaaaauagaauaagauaaaacuuuagauauaaaagacugcuagaagguauccuaagacagcugagaagaccacuuuucuucuaagaaagaagaugcuuaagggucaagacaauaauugaguacucuguuauuuaauuuucaauuaggaagccuggagccagaggacuuuugguggcugaggccuuagcuaccuggcuuacacauuaaggaggacacagauuugcuugcugucugucugucaaggccuggcucagcuaaggaccuguuaacauuucuagagaagaaaacagcauuaccaugguuugcuuucuaauugucacuauaugaaauuaauaaaugugaauguaaaauauauuggcugaucuuccuucagguuauugaaauguguuuguacuucuuuuuucaaaaaaguuugcuaaauacguaacaauuucauaagaguacaacuuauuuggguucaaaucauucaaauccuggcucugcacuuacuugcuuuuugauguauauuuuauauguuuuuuuucuaauugaugaauaaaaaucuuauccauuuaugguauacagcauaauguuuuaauauagguauacauuguggaaugacaaaauuaagccuauuaauauaucuguuaccucacauaccauuuuuuuguaguaagaaaauuuaaaaucugcuuucauucuaugaguuccccuguuagagguuccaccuauuguagucccucccuuauccucaguuucacuuuccauuguuucaguuacuuuuggucagcugaaguuccaaaauauuaaauggaaaacuccagaaauaaauaauucaugaguuuuaaauugcaugccacucugaguaaugugaugaaaucuugcaguguccugcucugucuugccugggacauacauaauuucuucguccagcguauccaugcuguguauugcaugugucccauaaucacucaguagccaucuagguuaucagauuaaaagaacauaguauauagagagaguuggguacuauccaugauuucagacaugcgaggggcgccuuggaauucaucucccauggauaaggagagacuacuguauaaauuagauuaugugguguuugucuuucugugccuggcuuauuucagcuaacagaauaucucccaaaugcaucuauguugcugcaaaugacaggauuucuuuuuuguuuaaggcugaguuaguguucuauuguguauauauaccacaucuucuuuaucuuuucauccauugauggacacuuagguugauuccguauuuuggcugugaauaaugcuggaguguauaugggagugaggauauaucuuugacauauugauuucauuuccuuuguauauauugauggauauucaggagugggauuaccggucauguaauuugacuucuaauuuuuucaagaaccuccauacuguuuuccauaaugauuauacuaauuuacauuuuuaccaacaguguacaagaguuuccuuucuucauaauccucaacaacacucaucaucuuuugccuuuuuuugacaauagccuuccuagcaggugugaaauguuaucucauugugguuuuguuuguacuucccugaaaaucccugacaauuaguaacacugagaauuuucucaaauaccuauuugacauuuuuauguccugugagaaaucuuuuugaccauuuuuuaaauuggguuguuuccuugcuauuaaguuuuuuuuguuguuguuuuuguuuuuguuuuuuuuaguuccuuauacagucaucccucuguauccacgggaaacugguuccaggacuccccugagauaccaaaaucuguagaugcucaaguccuuucuauaaauuggcaugguauuagcguauaaccuacacauaucccauauucuuuaaaucaucacuagauuacuuauaauuucuaauacaauguaagugcuuuguaaauagcuauuauaauguauuguuuuuaaaauuuauauuaauuuuuauuguugcauuuuuuuuccccucuaaauuuucucucucuuaaguugguugaaucugcugaugaggagcgacuacauauuuuggauuuuaaccuguuagcagauguaagauuugcaaauaguuucacuuauucugaagguugucucuucacucuguugauugaagcuuuuuaguuuuaugucuguuuucauuauucuugcuucugcuuuuggagucauaucccaaaaaaaucuuugccgaguccagugucaaaaagcuuucccccuguguuuucuuccccuauguuucaggucuuauguuugucuuuaauccauuuuuaguugaucuuuguauauggugugcaauaaggguucaauuucauucuucugccuguggauauccaguuuuccuaacaccauuucuugaagagacuguccuuacuccguuguguguucuuggcacuuuuguugaacauaagucaacuguaaaaguauggauuuauuucucgacucuguauucuggggucuguauguuuguuuuuaugccagaaccauguuguuuugaauuaucuuaguuuugcacuagguauugaaaucagguagucugauaccuccagcauuguucuuuagcucaugauugucuuagcuauuaaaugucucuguggguccauaugaauuuuaggauuuuuuucuauuucuaugaaaaaugucauuagaauuuugauauggauuacuuugaaccuucacuuccaguaguagggacauuuuaauaacauugauucuuucaguccaugaacauggaguauauuuccauuuauuugugucuucacuuucuuucaucaauauuguauaguuuucagugacagaccuuucaccucuuuuguuacauuucuuucuaauuuguuuuugaugcuauuguaauuaggacugguuuuuaauuuuaucaaauaguuauuaguguggagaaaucuuauugauuuuuuuauguugauuuuguauccugccacuuuacuguauguauuaguacuaacaguuuuuugguagagucuuaaggauuuucucuauauaaaauuauguuaucugcaaacagaccauuuaacuuucucuuuuuugauuuggaugccuuuuauuuauuuuuucuuaccuaauuccucuggcuaggacuugcaguacuauauugaauauaaauggccaaagugggcauucuugucauguucuugaucuuagagggaaagcuuccaacuuuuuaccuuuggggugugauguuagcugugaguuuguuauauauggccuuuauuguguugaaguauauuccuuuuauaccuaauauauugacaguuuuuaaaccugaaggaauauugaauucuguuagaagcuuuuucuguaucuguugagucagucaugugauuuuuguccuucauucuguuaaugcauuauaucacauuuauagauuuacauauguugaaccgucuuugcauuccaaagauaaaucccacuugaucaugguaauugaucuaauguacuguugaauuagauuugccaguauuuguugaggauuuuugcaccuauauucaucaaggauauuggccugcuaccgaaacuguucaccaagaggccugggaaaauucaugcacacugguaccucagaaaauaaguccacuguccucagucccaacugcggacccugauaagacacuuuaacuuggcuauggucugagaucaguucaaggacccacaagaagacaaaacugucugaaucccugggucaagcuuucugaacuugguccugcauuaaauacugaaacagcccugaagcucagcuccugccacuguugguugcagccugagagcaacccugccugcacaaggaacugcuaggagacucaccugucugugccaucaguacagacuugccaaucucugucccauagcauaugcugaaaaagcucugaaucggggauucagcuccacucagccacagucuuacagaaauccugcacagaaauccuccuguagucaggagauacauccuucuguguccucaggacaggcaggcagauuucagucccacagcagguccugaaacaacccugaaucuuggcauaagccccucucagcuguggucagagagcaguucugccuacccagcauccuggagggagauggggcuguccauagcccugcaaacaggccaccugaccuaggucccucaucagucccugaaacaccccugaaaaguggcuccagccccucucaauacagcaggcccgcuaacuuaaggaccugaagggagacaugcagguuugugacaccuuaggccugaagaccuaagucuugacuguaggcccugaagcaacccuguagcuuaguuccagccccacucagcuguggacuagggcaguacugccuguuaaggaaucuacucagugauccaguaggagcccucccagguucccagagaaagccaaaccauccacacaccugguaacaggucuuuucucugcauaucuucauccacuguacagaccgagguccuagaaaaaguccaguccgccaagggaccagauaggguucauauccugcuacagccccugguaacaagguccuaucgggaggacagggcccuuuccaagucugaagccuggaccacaguuggggaaucugucacgugaaugaagaucugcccuccaauugacuuuuccaggucuugggccccacugggguuucacagacgccugccugaaucucaacgcuaacacaaagaccauuuuguccguggguggcugugaaauuauuguugcuauuuggggacacaagcugaagggccuccuauuucaucuugcugcugucauucucgcauuauuauaauguuaaucauuggugauuugaugauaagucagcuuuuuuugaguuuuaugaguucuggcaguaaaaaaguuccaaaaugucuuucacugagcuaaauucaggguguuagcaaagcuguguuccuucuggagauuagaugagaccagaauacacuuuuuuaaaaaagugguuaacuugguuggauccaaauccuggcucuuccauuuauauacuguuugauuuuggucaacauaccuagccuaucugugucuucuaaccuuaaaagaggauuauaauaguaguuauuccacaugauaguuuugaggauuaaaugaguugauaaaugcaaagcauuuguaacaauuccugauaccuaaacacugcuuaagcuguuacugucuaucuguuaaaauuuauuccuauaggaaaucagugcuaagaaaauuaggucuuuuagucaaaggucuuuuagucauuugucuaugaguaugguacacuugaggagaauuuuacaaaaaauauaauuuuuucauuaauuuuuuuuucauuccaguuauucauugccaacuuuguuuugggcauuaugcuacaaugcuuagaauauaaaaaaucucaauuuggaaacaguagcaauuaaacagacaauuuuguuuaaaauaauucaauaauaaagcaaaauacaggcacuuaugaguguuuaaggaagaggcauuuaaccuagucuguaaugauuauuuguguauuguuggugaguggagcaagaaagggaagguuuucuauaagggaugauccugugggauggaugggugggagaaucauaaaggaagcauguaaguuaaaaaaagaaaaaggaagaaagggaaggugaauagaagauuuaaucgaaagggaggaguagcuguaagaaccacauacaggccuggagguauuguagguucaguuccagaccauugcagugaagcaaauaucacaauaaagugaaucacccaaaacuuuucucagugcauauaaaauuuauauuuacaguauacuagucuacuaagugugcaguaguagcaugucuaaaaaauguacauaccuuaauuugaaaauaccuuauugcuaaaaaaugcugacagacacaaaauggggacaugguguuugaaaaauggugccuaucgacuuguuggacacagaguugcuacaaaccuucaguuuacuuuaaaaaaaaaaugcaccaucugcaaagcacaguaaaacaaagugugccuaaagugugguaugagaguguugaaucagccuguacuuagacaaaaugaagccaucgaagauuuugaaggucuuaggguuugagcauuuuuuacuuuuaaaaacuuguauuuauuuuaauucuagaacaguaaauucuuaaguaaucucuuuaagucacuacguuuauaauauuuaugccaauuuuuuuaaaggauuugaauuuguugaaaugagcagucguaaaucaaagaguaacagcuuaauucacacagagugccuuucacagguuaguauguauuuucauuaaucucaagauauuuuacccuguaaagcuguucagagaaauaguuaucuucuuaaccugaauuuucccuuuagcauuuaggaagaaucacucuuucuaaccuuagggagauaucaguacgagaccuuaacgagaugccagcacaaggucguaagaacaaucaucuggaagcaaaauuuuccaaacucugucaaaauuaaauguggaccaacagauuuuguuguuaugauuguucucugcccuuuuugucaguucauauauuuuuuuuaauauuaguguuuuauacuguaauuuaauuuuauccuuauuaagucuggguagucagaauucuagcuuuuacuuuuuucuuuccaaucuagaugccuuuuuuuuuuuuucccuuuucuugccuaauugcccuggcuugaacuuucuuuaaaauguugaauaggauugggaagaauggacauucuugucuauguuuucaucuuagagaaacagcagcauucagucugucacuguuauauaugauguuaacuguaggauuuuuuuguagaugcccuuuauuaaguugaggaaguuccguuacguuuccucaucuguugaguguuuuuauaaugaauguuauaagaaguguauauuguauuccaagugcugagcaucuaucuguaugucucuuccuuaagaagcuuauagauuaguagggaaaugagcaugguauuucuacccuggcauuuguauuuaucuagcuugaccugaacuccauguaguuuuuaaauaaaaauuaaguguuacugguauucuuuuauacgacuuggcuuucuuuuugaaggaaguaguuuaacucucuuucuaaaaaaauuuuuaacugaaauaugcuuuacauaccuuuguauguaaagugcacgaauccuccauguacagcugacuuaauaucaauacauguguauaccuauuuaacuucuaugccagaucacuuugagauuugugaaccuucugacuagucacuguagcuuuaucuagcuuauauuuuauaccccguuacugccucuaagauauuuuaaugagguuuucuggguuuuuuuuuuuuuuuuuuuaaggaaaagauugaguuuuuucuuuugaucucaucuagguagaggaauacacauuaugauuaguugaggcauauauauguucuuuuauguauuuuuacagauauuagcuauuaccuguacaaagccuauuuguguuacaaauaauugccuuuuuuaaaccuuuuuuuuuuuuugagaccaagucuugcucuguugccccagcuggagugcaguggugcagucuuggcucacugcaaccucugccuccuggguucaagcaauucuccugccucagccucccaaguagcugguauuacaggcauccaccaccacgucuggcuaauuuuugaauuuuuauuagagaagggauuucaaccauguuggccaggcuggucuugaacuccuaaccucaagcgaucugcccaucucgaccucccaaaguguugggauuacagacgugagccacagcggccagcccccuuuuuuaaucuuucaaacaggccugccauaagauguuauugucccuauuuuauagauacagaaauuaaaauuuagaacagacuuaaccuuuuaaaauucauauaauagacucuucuggagccaauguccuuacucuuuaacuuccucgauaaugaacaaguauguauuguuuugucccuaaugaaucauuuucuuugcuuugccucuguacauggaacaagaacucagauuuacuucuuugguacaugaaggauuaguuccaugcugucagucuaggagaagcaaauauucuuggagccuuuuuauuccaguucauggggccaaaucugagauagcacccucagguuguuguccuugaaagaccucuguauuagcugcagauccaaaaaaggaacgacuuuaaugguccaucuuuuuaaagaguaugguagauuaucugacauaauuuuucaugacuaagucuaaggccuuaguucuaagaugaccucaaaauauagcugcuuacaagaauucuuuucuuaacucguucacaugcauuacaauggcccuuaaguugcuaauauagcuaaagucagugauucucccucuuguugaaaccuucacaacuaaauucucauucuuccuaugggacuugagauagguaagaaauccauuaauuuuuuaacauaugaaaauggugccagaacucuagaggauaagaauuuagggaggguugaauugauucauuaauaccuaauucugacuauuguaaaugugcuuucuuauuuauuuuuuauaucauguguaauauuuuuauuuauauuuauucacuuuauuuucaucagguacaaagaauuuuacgugaaagauuuugucgucagaguccacauaguaaccuauuuggagugcaaguacaauacaaguaagucuagcuguccucuugacuguuauggaccuacuuacagaugccuuccagguuuugcaaaaauuauuguacaaauuugauauuaaauaaagcuaacaaacacuuuuauagaaauaaaaaauuuugcuuugugaauagaaacaccacauagcaugaagcaggagcagauacaaauauuuccauaaugcaauagcacuuuaacuuucaauuuuguuuuguuucuguuaucugauacuguggagagaauucuagccaucuugcccuuaauacccagcagccagcuauggaguaaaaguccagaguauuaguaggaaaagagauuugaauccaagggucccgagaguugccacuauugucccuuguccccuacuaucguauaaaucaauauauuccaaucugacuacguuuucaccugaagauuucagagaaucaauacugcccuacuauuucuuuuguauuuuucuauuuaggaccauucagaagcuaggccaaguacccagagggagagaagagaggaaauuucugugcauauucaaauaugccuuuuaaaaacuacaacauaacaaaguauuccagcuucauuuuuaaaauuuuguccuauuuauaucauuuuagacacuuaagugagcugcugaaaagaacugcucuccauggagagaguaacucuguccuuauuaucggaccccgaggaucaggaaaaacuaugguaaaagcuguugauuucugguguuuguuggcaugugaugauucuuauuuuauauaagaauaaauaaauucauauauaaaucuuauuuuauguaauacugaaaauacuuuucauuauuuuguaauguuuuacuuuuuuguuuuuuucuuuuuuaaucacagaagacauguaaaacuuuauaaacuuagggugguauauuugaguguagcagaccuuuuucccccuuauuuguccuccuagugaaaaauugucaauugauguuuguuccaacauggucuuuuguccuuaaagaaguagagauuuccaguggaaaaagaaaauagcauguauugagcauguacuaugugucuuuuuauuguguucucucauuuauucuuuacaucaacacugcacgguaggguuuuucccuuuguuauagguuagggaacuaucauaucaugcauucuuuuuauuuuuccuacaucauuacuauuuguuuaacccuaacuuacacaguuuuucagugcaugcucacaucuuauaucauucuugucuccuuuugcucuuuaucauauuugcuuaguuaccucaaaaagauauucuuacuuauuucccuuuacucuuuucuuugauauccuuuaugcaauauaggagacaaauuauggguguuaacuuuugaaagcaauuaauuucaaugcuaaguagucuguguaaaaucuguucucauguauuauauacaauaaauuucaauuuuugaccaauguacuuuaaaaaaauggaugagaagcaaaauuuuuuuuaacauuuaagcaauguauauugaaauuacauuauuaagaugaguacguuaggauuuuacuguuaucacaucugaaguauuguuuaauauaaauugagaauuuagaucuagguaauuucuuucaauauuucacaaauugucacauuuauauauaaucauauuugcaguaauuuuuuaguuucaaaucuauguuuaauuuguuuuaguccucauacucagcuucuauaaucacuauuucuucauucuugaguuuuuuauuaugguuuuucuuugcauuugaauucacuguuauuuuggguaguuuucacaagagggcuaugugaaauguuuuuaaauuucaaauuuuuaaauuuuuaaauuuaagaaacuuuuuauuuuaaccauucuaauagguauauauuggugucucauuguuuguacuuguaauucucuaaugacauaugcuguugagcaucuuuucauacacuucuuuuucaucuauauauguuuggugaggugucuuaugcccauuuuuaauuuggguuauuuguuuucuuauugauagguuuuaggaguccuuuauauuucugauuuucaguuuuguuuugcaaguauuuucuuacagucuguggcuuuucuuuucauacuauuaauauuauuucauaauauuaaaagaauauuauucuuuucauacuauuaauaauaacauugucuuuggcagagcagaagauuucauuuauuuauuuauuuauuuuugagaugggauguugcuaugucuuuucauacuauuaacuguaucuuugguagaguaguuuuuauuuauuuauuuuacuuacuuacuuacaagaauagggucuugcucuuucacccaggccggagugcaguggcaugaucacagcucacuguagccuuggccucuugugcucaagcaguccucccaccucagccuccugaguacaugggacugcaagcaugcaccaucacaccuggcuaauuuuuuuuuuuuaauuuuguguagagacgaggucuccccauguuucccaggcugguccugaacccugagcucaagcaauccugccuuagcuuuccaaagugcugggauuacagacaugagccacugugcccaacugaagucuuugaucuuaauaaucuaauuugucaguuuuuucuaucauguauuaugauuuugguauuguaucugaagcuucaucaccaaaccgaaagucauguagauuuuuuccuauguaucuucuacaagcuuuauaguuuugcauuuuauauauaggucugugauucauuuugaguuaauuuuugugaaagauguaaggucuguguuuagauucguuuuuuuuucuuuuuuuuuuuugcaaaugaaugcccaauuggagaaagacuaucuuuuauccauugaauugccuuugcuucuuugucaaagaucaguugacuauguuuaugugguucuguuuuuagguucucuuucuauucccuugcuuugucugucuuuugccaauaucacauuguuuugauuacuguagauuuuuagugagucuuuaagguaaguacugucagucuucugaccucguucuucugcaguauuguguuggcugucugcauacuuugccuuuucauauuaacuuuagaaucacuuuguacauauccagaaaauucugggaaucuuugugaauugcuagauuuugaguuaaauuuauacaucacaauaggaagaauggacaucuuaacuauauuuagucuucccguucuuggaguaucuauuuauuuaagacuuuugucaguuuuuguaguuuucuuaauaaagaucuuacacauguuucguuagauuuauaccuaauuuuucauuuuuuugguucuagugcgaauaguacuguguuuuuuauuuccuuuucuaagucuucauugcuaguagauagcuaaacacuuggcuuuucuauauuugcuuguauucugcaaccuugcuauaauugcuucucaauuccauuaguuuuuuugucaguucuuugagauuuuuuuacuuagacaguuauguuaucugucaacaaagacaguuuuaauuauuccuucccuaucuccauacuucuauuccuuuucuucuuuuauugcauuaguuauucauagacuaugucuaacaguuaaucauaaaauucacuaauacucugcauacugauuuaguauaaauuuagaggguauuguucacuaaagaauaauauucuuuuauuuuugaauauucuuucauuuuuucuuaugauuagaaaaaaugaauauccaauauuagaauauucaguucuuaaaucuuuguuuucauuuuuccaugucuaccaucuuuuucauguuuuuucccccucucucagcauucugucauauggccaaugugauuuucuuuacugccagugcugucauuugcuucuucuaaucugauauugcauuucaguuuucuaagaaucuuuucuucuugucuaagucuggcuuaaauagcucaaaacauuuauuucauaaaauagucauuuuagguaguaauuaaccuuuuuauacuuuauuuuuaaauugacucauaauaauuauacacuuucaugggauauauagugauguuuugaugcauauaguguauagugaucaaaucagaauaauuagcauaucaaucaucucaaacauuuaucauuuauuuauguggggaacauccaguauccuucuucuagcuauuggaaaauauuauuguuaauuauagucauccuauaguuacagaaaaaugauaguacaacacuguuacuuacuccuccuaucuugcuguaauuuuguguucauuauugaaucucucacuaucccuccuuuccuccuacccuuccuacccuauccucucuucuacuuuugacuucuguaagaccuacuuuucuuggcuuccauagaugagugaaaacgcaugguguuuaacuuucuuuuccuggcuuauuucauuuaauauaacuucuuccaguuccaucuauguugcugugaaugacagaauuucauuucuuuuuuuaauggcugaacaguauuccauuguguguauauacacauauucuuuauccauucaucuguuguuggacaacuagguugauccauaucauggcuauugugaauaguacaacaauaaauacgggcugcagaugucucucugauguaaugauuuccguuccuuuauauaaauucucaguagugugauugcuggaccauaugguaguucuauuuguagugguuuuuggggaaccuuuguacuguuuucaauauuggcuaguuuacauucccaccaaugguguauaaaaguuccuuuuuuuugcaucuucaccagcauuuauuauuuuuuguuuuucugaaaauagacauccuaacuggagugagaugauaccucacugugguuucuauuugcauuucccugaugauugaugauguuaagcauuucuucauguauucguuggcuauauguauguccuuucagaaaugucuguucagauaauuugccuguuuuuuaagcaaauugguuuuuugcuuuugagauacuggaguuccuuguguaaucuggauaugaaucccuaugagaugaauacuuugcagauauuuucauuuauucuguagauugucuuuucaugcuguugauuguuucccuugcuaugcagaagcuuuugaguuugauguuagcagauuugucuauuuuuuuauguugucugugauuugcaguuuuuauucauaagauauuuuccuagacuaguguccugaaguauuaccccuauguuuucuucuaguaguuuuauaguuucaggucuuaacauugaggucuuugaucuauuaugaaaugauuuuuguacaggaugagagaugggaaucuaguuuaauucuucugcauauccaguuuucucagcaccauuuauugaagaaauugcccuuucccugaugagugaguguucuuggccuuuguaaaaaucaguuggcuguugauaagcagauuaauuucuggguucucuauucuguucuauuggucuacaugucuguuuuuaugccaguaccaugcuguuuugguuacuacagcuuuguaguauauuugaaguaaggcaguauguugacuccagccuuauuccuugugcucaagauugcuuuagcgauuuggcaucuuuuguuguuucauaugaauuuuaggauuuuuuuucuaucucugugaagaauaucauuaguguuaugauaggaauaucauugaaacuguagauugcuucugguaauauaguaauuuuaacaauauucauucuuucuaucaugugaguaugggugucuuuucauuuguguguauccuccucaauuucuuucuucagugcuuuguaguuuuccuuguacaaaacuguaccuuucaccuccuuaauugaauuuauuccucaguaauuacguuuuuuugguagcucuuauaaaugggauugccuucuugauuuuuuuuuuucggguaguuuguuguuaguauauacaaacaguacugguuauuguauauugauuuuguagccuucaacuuuacugaaauucuaagaguuuuuugguagagucucuagguuuuucuauauauaagauuaugucaucugcaaaaaggaaugaauugacuucuuccuuucccauugcuuuggcuugaacaucuaguacuauauugaauaagaauggggagagugaacauccuuguauuguuccaguucuuacaggagaaacuuuuaguuuuuccccauuuggugugauguugguuuuggguuugucauauauggccuuuacuguguugugguguuuuuuuucuauaccuuuuugacaguuucuaucaugaagggauguugaauuuuaucacguguuuuuuucugcauccauugagaugauauaguuucuggccuccauucuauugaugugguguaugauguuuauugauuugcguauauuaaaccauccuugcaucccugggauaaaucccacuugaucauggugaaugaucuuuuugcauucagcuuacuaauacuuuauugaagacuuuugcaucuauauucaucagagauguugaccuguaguuuuuguugcuguuuuguccuugucuaguuuugaugucaggguuaugcuggccucauagaacgaauuaggaagaauuuucucugcuugaauuuuuuggaauaguuuuagaagaauuggcauuaauuccuuaaggguuuaguagaauucagcagcaaagccauccaguacuggauuuuccuuuguuggaagacuuuuuauuccugauucuaccucauuauuuguuauuggucucuccagguuuucugugucuucuugcuucaauauugaaagguuguauguguccaggaacuuaaccauuuccuuuagguuuuguaauuuauugauguauaguucuucauaguagucccuaaugauccuuuuuauuucugugauauucaguuugaugucuccuuuuucuuuucucauuuauuuauuuuggucuuucuuagucuagcuaagcaacuuuuguuucagugauuuuuuguaguauuguuuuagucucaauuuuguuuauuccuucucugauauuuauuuccuuugacuaauuugggguuugguuuguucuuuucuagcucuuuggaauacauuguuagauuuuuuaauuuaaaauuuuucuaauuuuuuggauugcauuguuagauucuuuauuugaaauuuuucuaguuuuuugauguaggcauauauugauauaaacuugccucuuaauucugcuuuugcuguguguuccuuaaguuuuaguaaguuguguuucuauuuucuuuuguuucuaggaaucuguaauauucuuaauuucuuuugcccauuguucaugggcauguugucuaauuuccauauuuuuguauaguuuuuaauguuccugucauuauuauuacuuuuuaaaaaaaauauagaccaggucucccuauuuugcccaggcuggucucaaacuccugggcucaagggauccucccaccuuggcgucucaaaguguugggguuacaggugugagcuaccacaccuagccaguuguuuuuauuaucgauaucuaguuuuauuccauuguggccagaucagauacuugauaggauuuugcuuuuuuuaaaaaaauguuuuaagacuucuguuguguccuaacaugaggucagucuuggagaaucuucugugugcugaugagaagaauguacauucugcaguuguugggugaaauguucuauagauguauuuuagguccauuuggucuauggugaaguucaaauucaaugucucuuuguugauuuucugucuaaauuaucuguccaaugcugagaauaggguguugaaguuccuauuauuuuauugcaauuuaucucucuuuagaucuaauaauacuugcuuuauacaucugaguguuucaguguuggguacauuuauauguacaacuguuauauucuguuguugaauugauccuuuuauuauuauauaauguucuuuguuuuuacaacuuucuuaucacuuuuauuuuccauuuucauaggauaucuuuuucauaccuuuaagucugugugucuauacaggugaggugaguuucuuguagcagcauauaauugaguuuuuuuuuuuaucuguucuguauuuuuuaaaugggaaacuuaauugguuuauauucaagauuauuauugauaagugaggacuuacccugucauuuuagugauuguuuucugguuguuucauauauccuuuguuucuuacuuccucucauuuauuuuuccaguugggugccucucuguagugauaaggcuugauccuuucucuuucuccuuuauguauccgcaguaccagugaguuuuauaguuuucccuguuuucaugaugguggucaucaucuuugcauuuguggauguuagacucccuugaacauuucuuauaggucuggucuagugaugacggauugcuuuaguuuuugcuugucugugaaagauuuuauuucuccuuuauuucugaagcugcuggguauuauauucuuagcugacaguucuuucauucugagcuuugauuguaucaucccauuccccucuguccugucagguuucucuuaagaaaucugcuguuguauauucugacaaucagcuaaaauguaaacaagaaggaugaaagauguuuuaaaauaucauuuaaaaaaaugauaguuuaaaauuuuuaauuaaaaaaaagaaaucugcuauaaagaagaagaaaucuacuguuaguauaauagggauucccuuauagugacuugacacuuuacuuuugcugcuuuaauuauuugucugugacuuuuaacaauuugacuauaauaugccucagagaagaccuucuguuuguguugagucuguuuggaguuuugagcuuccuuuggauguccauuccucucucaagaacugggaaguuuucaacuaugguuuuauuaaauauguuuuucucaccuuuuccuucuuuucuccuccugaaaguacaauaauacaaauauuuguucacuuauugaagucuuauaaauccuguagacuuucuucauucuauuuuuuuucuugucugccuguguuauuucaaacaauuugucuucaauuuaagaaaugcuuaugcuugauguagucuguuauugaaggucucaguuguauuuucuauuucauucauuaacuucuucagcuguaggauuucuguuuguuuuuuuaugguaucucuguuaauuucuuauucgaaucacaaguuguuuuucugauuuuguucaauuuucuaucuguauucuuuugaauuucacugaguguugucaagauuauuauuuuaaauucuucuggcauuuucuguauuucuuuaugauucuugucuguuacuagaggaauuauuguuuuccuuuggaagugucauguuuucuugcuuuuuuauguuuaaugugucccuauguugauugauacgccucagguagaaaaguaaaauugucuuuuccaaucuuacagaauugaucucguaaggaaguacugauuugugucaaugugucucgaggugucaguuugaugugguucauuggccuugguucuaguuggauacaguaguguggucuuuguguaguuuuuucagcuguaauccacacuagugucauuuacaagugucucaguggccuaggcugagaguuguuugugguggcaguuguacagcuuugcaagggguggguuugcugggcugguucucaguuugggggcauaugcaugcauauggugggucaaucaccuugggaucugacacacuggcagauggggcuauuaauguggccaggagcauagucaugugguugcuuagccagucuuggugaauguuugccaggaacaacucacugguuuguuucucaggcccaggagaugccugggauccaggugcaaggcugcuugaucccaacagagguguagggauacaguuccucgacuggcuuagggccguaucugcugagggguuccacaggauuguuucucagguuuaggaugcaggcacaaggcuauucagcuggcuuaugggcaugcccacuagaggcguccugugaggcuguuucucaggccugugacacugcugcuuggcuggccugggaacuuuucugcagcagauggcccacuggaccauuuuguagaccugggaaguaggagcaggguugcucgacuggcccaaaagagugucugccagaggcaacccucagggcugauuuguaggccuaagguguaaugcugcucagccagcuaggguaaugugucuguuaggggcaguuggcaaguguacuucucagguuagcgacgugggcacaugauugcuuggcugguccuggggcaugucugauggaguuauagggaggcugugcuguuugucagguuugggaggugagcacaagacugcuuggcaggcucaagaauggccugaagggcuacuucucaggccuaguauguguucacagggaugcuuggccacccugugggagguguauucaccauggguggcccauagggcuguuucucagguacaggucauggcucauggcugcucggcugggcugggggcaugccugccagggguaaccuucugggcuauuuuucaggcucugauugugggcacaggaccacugggcaagcuagggguaugucugcgggagggaggggugcacgguauuguggggcuguuucucagguucugagugugggugcauagccgcucugccagugcaagggguguaucagcugcuuggaugcucgggggccucuccuucuugggagagagccccacccugguuuggucaccucaagugagaguuugcccugggugggacugccagauugguucucuggcuggaaguguggcagcaagggguugguuuccuugcuguguaggaccagagucauaaccaauuauaggcucagucucugugcagcuagaguuguguguucagccaccuaugugggcuugguggaaugaagauggaccccuaguacuggaaaggugcagugacuacuggcccacagagcggggcgcacaacagagguggcucuggccucaauggugccaugcugcagcagggcagguuggccuacaggugggugaggguuggagagugcauaccuuauucucaugaucuggagcaaugcaacugcuugaauucccagcagcuguccaccuugacuuagggcuugcuaggacuaugggauucuccugugguaaggacuguagguguuugugauggcggugaggacugguggggaucuucugcuuaccuuuuccccagaacgggaagucccuccugacuacgggaagauuugaucggggugcaggagauguagcugcagaggccaggugccuacacacuacccuccuggauuuucagucacuacacauuuccccuucccugcugcacuccaguacucucccuucaacacgccagucaaaucuuagcuguucauucauugcugugguccuuucuuguugggaguacgagcaccaggagucucuaaucagccaucuugcuuaauauuuuaaaucugaacuuaaucuuuuuaaucugcuuguuguucccuuccacguuauagcaccuuuucauaaaccccuauagguuuaaucaauguacugaaauuuaaaggcaaaagcauuaaaucauaguauuuaucaguuaauaaaauggaucaguuauucuuggccacacugacaguuuaucuacuuuuugcuuuuuaaaccagagcccuauuguggugccuugcagucauuuauuuucacuauaguggaaucuggaagagucccuugcauggcauuccauuuugauauaguuucauauauuccugauguacucugaugcuggcagguugaagagaugagcauuguuugacuugugcuacuuuuguaauuuguuguaugugugggaguauccugagagaaaauauagauugaauaaauugucagauauaauuuauuuuuagacaauaacucucgauaguauaauuuuuuucuuuuucuuuucuuuuuuuuuuuuucuuugacagagucucacucuguugcccaggcuggagugcaguggcacgaucuagacucacugcaaccucugccucgcgggcucaagcaauccucccacauuugccucccgaguagcugggacaggcaugugccaccacacccagcuaaguuuuuuauguuuaguagagaugggguuucaccauguuuaccagguuugucuggaacugcugugcucaagugauccacccaccuuggccuuccaaagugcugggauuacaggcaugagccacugugccuagccucauuaguauaauuauauaaauucaaauuuuaaaacauaagacuguagucuuauguuuguuuguuuuaaccccuaauccuaacccuaagauuauaguauauuuaaaacacuauacuuggccaaacugucugaaauacaaaaaugcuaacucuauaguuaauugaaaaaggcaauaguguggcuuauaauauuacaagcauuuuauuuaaaaaaaaaauugauauggcuucaagugacagauugaccccuagaaaauaccuuuuuuuguuuuaagagacaggcucucugucacccaugcuggcgcccagcggcucaaucauagcucacuaaagccucaaccuccugggcucaggcaguccuccugccucugccucucaaagcacucagauuacaggugugacccacuguaccgacccuuagaaaaugcucuuacacaugcaauuuacuguagacaaauuugcuagaugguuaaauaggauauuucuccuaguugcauauuggugaaaccuguguuuauuauaauauuugggaauaguauaaguuggugagcauaaaaauuacuggauguugggaggucuaagaaaauuaucuuaguauguuuguaaaauuaaauuuuaggcacaaagaauguggaaaggagaugaccaaauuugguuauguuggucagugugauauuaauaaccaacuaaauauuuuuaguguauaauguaguuuaaauauuugaaaugauaacauauucaagaaaaaagcuaacuuaaaugguugauugcauaaacaauaaauuuuagcaauacccagauuagaacuaacauuauuugaagacucacuugcuaauauauuuaucauuucagaccauacacacaacccauaaaauauuagugggcugauccaagcaaagcauaaguugguguuuaaaguaaguugaguggaaagaaagcuauaaaucuguuacaacucuccuuaugcauauauaaaauggaagguauuauuaaaauccccauuccuuuuagcaaaggauuugaaaugguuuugaauaauucaucaaaacauaaaacauuguaugaauuaaaacaaaaucauaaccuaggaaaaaauauauuaagcaaaauaucaagagauggaagaaagaaaauaccauggauugcaaaaaaaauaaaaaauaaaaaauuuuugcugaaagcacuguuuugagagaccaacucuguaucaucuagggauguacucuuauuauagugucugaccugauccagaggugaagaaguaccucuaugcaguccuuuaauguuacuucucauuaaaugucacuucucauuaaaugucacuucucaguugggcuauuacugguaguaugacaggugauaucuugagauugucuccuuuucagaggaccuggaauucccuaugcuuuaaaaaccaugcagguauaacaggaaauuuuuuuuauuuuuguugucuuguuaugaaacauauguaauuuaaaaugaggaucauauuugcuuuuuucuuuuuagauaagguguugcaaugacaaauaaguagcauauugcaaauacaaacaguauuuuguuuuggaaaauaguuuaccaguugucccagugccuucguugaguaauacuuuuuguccuaaguuuugaugccaucucuauuaauauuuuguguauacaacugcuuuucccaguucacuuauuuaugauaguaccuauauuuuaauauuggaaggaacaguccaucuuuacucuuuaaauagguuuuuggcuuuucuuaauuacauucauuuucaaauucuuuaaaaaaaagaaugcauugguaauaugaagagauauguaugauaucacaguacaagagcaauacaauguuauuuaaaaaaguaugcuucauagaaaccuuuaauucaaugggcuuuuaacugauuacaaugauauuuaguagaguaauugucagagagauguguaauguacuaacugagacaugaaguuuauaagggccaugucacauguuuaaugugacauguagagaaauauuuauuuuaaaacuugguuguuucuaaauuuguauuaaaaguucggguaggugauugagagaauauuguaucaguccuggcucuuguuucuuaaaaagagucagauaugagauguucuaguuaaaccuuuuaucuguaaagaauuugaaaacuuacuuguuaaagaggucaauuuauuuauauucuguucuuacugcuuguaguuuaaaaacgaauauggacuuauuuuuaucuuuuaccuauuauuauuucauaaacuuuucauauuuaguuaauaaaucaugcuuugaaagaacucauggaaauagaagaagugagugaaaauguauuacaaguucacuuaaaugguaaguaugccauuauuuugccauuggagauuauguaaacuuugugggguuuuuauaugacuuguauauuucaaauccauuuuaauaguuagauuuugaaaacuagauccauguuuuacuuagcacaccauaugcaguauuuuuagaaauuaaaauaauaauaaugaaggagucgcagaaggacucugguuuuuguggguuuuuugguuuuuuuuuuuuuaaucauucuaaucccaaggaggauuguuuuuugauucuaccgaaugucuuuauugcuaaguuuuaagaagaaagugauaugaacucacaggcuuugacugggaagauuuacuuaacuggaaaacaaccugcuguaucaaauacauguuuaauuuuaauuaaauacuuuuaaauggacuuuauuuuaggacugcugcagaucaaugacaaaaucgcccuaaaggaaaucacaaggcaguuaaaucuggaaaauguaguuggagauaaaguuuuuguaaguaucauuucaguuauuuuauuaaauagacuuuuaagguaaugucuuuauaccauguauauuuuuauauuucuggaaggguagggagagguucagaaauucuuaauugaaauauaugagauucuuucauaaaaauguguaauguauaggauacauuuagucauuaagucuacaauacuuggauuuuuccauaguagguuauaguagcuguaaaauagcuaagaaacccaaguuuauguagauauucugaguuuauuucauuuucuguaaggugaauacuuugauucuguaucucuggagauagauuaacacauuuuuaaaaauaccaugcuccagcagccuauuucuacuuuuuugagacuugaguagccuguguauaguagaaaaugugcuaaauuugaggcugcaauagguggguuucagucaugccuuacaacccuuugacugccugauaauccugagcuaacaaguaucucugaauucagauucuuuacauguuaauugggcguuauuuuauuauccauacuucacaggauuauuuugaagaagaaagaaaacauuacacaucauuuaacuuaaaaaauaauuugcuggaugguaaugugcuguacaaaugucaguuauucuguuuucagaaauuuauucauacuucauuaucauaucaucuuauagucucagggcagugaacaacaucaguaaaagaaacugacuugaaauguuuugaaacuuguauuaaacuuuuaccuuucaccuaauauauagggccuaaggaaaacaugauaauuuaauuuugcaccuaccugaauuuucaugaugaaauuaccuagccucauacugcuuaugcaguuggaguggauuauacacauuccaacuucauuuucugguuacuggugaccaugcgguggcaucgcucuaauuucugaacugugugcuuugugcugcaaugacaccgccauaguuguguaagacuccuagcauuuaugaguuucuuucuuuaauaaucaaucuauaaaauuauuaauuauauaauuauauacucuauaaaauuauuaauuauauaauuauauaauuauauaaucuauguaauucuauaauagguuauaucuauauaauuaucuaauagauuauauauaauuauaguuuauuauauguaauuauagauuauaaucuaaauuauuaauauaauauauuaaucuauaaaaauauuaauauaaaauguuaaucuaaucuaaaagguugaguaaauuugucccuuccaaagucuguaggucuuugaagugcaguuucaaaaugccccaucuauaaaucuaauauucuaccuccuguuuagaaugugauguugaagcuaguggccuauacugagccaaagacaguucuuguuaaguaugcucaguuuggcuuuugguucccaguugaucuggguagguguuucugacauuuuuaaauguuacauauucauauugguuuuaugugaaauaauaaaaaugacaauuuuuuaucauucuguucuaaucuucgcuauuauuaucauauauagagauuauuaguuuaaguuguacccaaaaauguuuuggcuguguuccgaguaagcauagccaaacaugauacgauauacauaaauucuucaauguacucuugaauagagaaauacugcuauagaaauuaauaguuuaauuccuucauuauauaaauuuggcuucugcucagagagcauaauuagguugccgaaggucauaaaauggcagagccuggacauuauaagaaccuaagucacuuaauucaacccacagcuuuucugguuugauauaaacagacauauauauguauauuauacaugcacaaauacguauuuauagaagcauauacuuaguaucagauguaauaaucuuuuaagcaaaaagccugaaagacaagcuaccuuugaguaacugaccacugauuucccaacagauugucucuuugaggauuuguuauauuacgguaaauuauggauaacaccucuuggucugccugccuuggaaauagcauaacaacaucacaauaugugaaaguuuuaaaaccuuuaugcuauuuuuauguuagaucucucaacuggagagugaauaaguguguuucuuuucuccuuuauaucuccucaaauuuaaaguuggcuguuucuuuuaguuaugaacucugaaugaaguaaaaguuaauaauuuuaaugaaacaaauauuuuaauggggcuucuacccacaaucuggagcaccuggauaaugcaucuacuacacuaaguuucaucaagaauauuuaauaguauccaaaaauguuuuggcuauauuccaaguaaacauagccaaacaugauaugauauacauaaauucuucaguauacucuugaauagacaaacacuguuauaguaucuaauguuucaaaaaagccuuuucuuuuuguuucucauuuaaauucaugguuauuucuuuaccaguacaaauuagagacuugcaagaccccauuguguuugaagacacaaaguagaauccauuucuaggucucaaacuauauuuagaauauggcaauucuacaaaacuaccuucaaauaaauuuaacauucuuucagauuuuuuccggaaaauauaaaauuucuuacuuuucuuuuucuucuuugaccguuuuauccucaaguucuaaaauauaaaauuucaaagaugacauuguaauugccauuuucagugaugugccaucuuugcuuaaguauuuaaguuuuagauaggaaguauagagacacucagcagagucugggcaaugacucuaauaacuagaagauauacaguguuuauauaaaauuugagaaucagacagccaucuuuuguucuuuauuucacuaaacuuuuaaucauuuuaucucauuuuguuguucagggaagcuuugcugaaaaccuuucauuucuucuggaagcuuuaaaaaaagguaaauauuaacauauucagccguuucagaagaucuguuuuaacuuuauuuuuucccugauuauaaagguaauacaagcuuuugccaaaaaaaaaagcucucauaaaauacagaaacauuaaaaagaauacaauguucacuguauucccaccacuauaacagugauuaucucaauuagcauuugguuucuuaucuuuauucaaugauauacugaucuuuauaucaguauauuauugauagagauaaaugugauuuuuuacaacaauaaaauuauuuuaccuauuuuguaauaagauuuugaucugcaucaucauuuuuaugguucuuguuuuauaaggugcuauuuauuaaucaccaauuaugggcuuuuguuucuaauuuuuuauaauuaagaagagauacuuugaugaucauccagauauuuccugggauaaauuucuguggguagaauucuggguuaaaaggcaccaucuuuaacauuuaaaaacuacccuaaagguuuaauuuguaaaaauauuugauaauaccuuuuucuucacaaccucaaaaacaauuauuauuuuuauguuugcccauauaauagaaaaacuuucagcucuuaguuuaauuugaauaauuuuguucuuuaauuugcauaauucugguuacuuaauuugcauaauucugauaguggugaugcuugucauuucauauuuuuauugaccuuugaaauuuccugguuuauguacagucaugugccacauaacaaccuuuaauucaaugauagaccacauaugugacagugguccuauuagauuauaaaaccauauuuuuacuguaccuuuccuguguuuagauauguuuagauacacaaauacuucgcauuguguuacaguugucuacacuaucacaugcucauagguucauagccuaggagcaauaggcuaugccauauagccuaggugucuaguaggcuauaccaucuaggcuuggguaaguacacuguuaggaugcuuguacaacgaugcagucaccuaacaauacauuucucagaacguaucucugucauuaagggacacacgacuguauuuccuguugggucuuugaccuauugugguaauguuuauguuaugcuuauuuaucggaauuuuuguguuuuauuuuucucuucccuuaaguuugguuuggacuuuucugcugaucuaaaguuuuauguuuuccacauaguuaaguuuaucuagaaaguuuuuucucuccuucagauuauaaaaacauucauugauccaucuuuuuauuuaauauauauauauauuuguaauuuauaauuuguuuggaauuuauucugauuuuaccuguaaaguagggaucugacuuugaauagacuaauuuuccccacugauguauaaugcaauauuuuaucaaauacuaaaauucuauauuaguacauaagucucuuucuagacuuuugaguaaucccuuugguuuuguaccaguauuaagucauuuaggcuacuguauuuguuauuuguugaaauaagucuuucuuuuaucagauauuuguuucacuuuuuaacacaaauauaaaggcguuaagccuaagguaaaagggauucuuuuacuaaaguuguuuccauuauugaagugagaaaaauguaaccagagggugauguggaacuuuccccaugaaaagcauuguaguugaaaugcuaaaaguugugcuucaagggaguuuaaguggcuuuaguugaacuuuauaaucuacaaguuuguuuauaaaaaguauuucuacaagaaauguaccuuguauuucuacuaaauaaacaacucucuuuuaaagcauuaguuuuguucauuaauuagugacuccccuuauauuuuaaucuuaaaguguuuugguucuguguagguauagaaaacucugucaauuuuauaaucauuaaauaagaauuauauuuacguaauuauaaaaauaauagucuuuagucauuuaaaugauuuuugacauuuuucaacaacaaacucuacuagagucuaggaacuagacugcacuuuuuauuuuuuggagauggaguuucacucuuguugcccaggcuagaauacaauggugugaucucagcucacugcaaccucugccuccgcaguucaagagauucuccugccucagccucccaaguagcuaauuuuuuuuuuuuuuuuuaauagcagagaugggguuuuaccauguuggccaggcuggucucaaaccccugaccuuaggugauccaccuaccucggccucccaaagugcugggauuacaagcgugagucaccaugcccggccuagacugaacuuuuuuuuuuugagauggaguuucacucucguugcccaggcuggagugcaguggcacgaucuuggcucaccacaaccucugccuccuggguucaagcaauucuccugccucagccucccgaguagcugggauuacaggcaugcgccaccacaccugacuaauuuuguauuuuuaguagagaugggauuucuccauguuugucaggcuggucucgaacucccgaccucaggugauccacccaccucagccucccaaagugcugggauuacaggcaugagccaccacgcccagccuagacugaacuucuugagagcagucggggcuguguuuguccuuugaauaauuuuuuucuguugaaugaacguauaugcaucaguaaauccccuacccaaaguaggcuaucagaauguuuacagaauugaguuuuaaaaacugaaauauaguaaaugguuuggaaauuuaggaaagguggauauaauuucuuauuaauguaaugcucuuauuuuaucuuaggugaccgaacuagcaguugcccagugaucuucauauuagaugaauuugaucuuuuugcucaucauaaaaaccaaacacuucucuauaaucuuuuugacauuucucagucugcacagaccccaauagcaguuauuggucuuacauguagauugguaagucuuucuguucauuaaaaaaauugauuauaauauuuuaaaauucaagcuuaauugcugacacugcuaguuuuuuucacuuauuuaggucauuuuaaaaauuuuguuucagcagugccugguguauuuauccugcuuucaacucaaauugaggaaaacaguuuaguaguuaccuuagcccauuaaugaauaccucccuccucccagugaaauuacugaagaaaaaaguaugaaaucagauuaugcuaauaaauauaauuucuacauuaucaaguaaugaggcgguuaaaucucaccaauauuugagaaaacuugguaauaguuuuuauuuuaagauuuuuuuccauauuuugaaaaggcuugaaaucaacucuaaguaauacuauuccaacuuucaaaguacacaucuccagaaauggaaaagauucuaccaagcacugacaguagauaguggcuucuucauuccaugggauauuuuagaaugauuuuaacuauagucucaauaucacuaucacuuugccuugugaaggcucuguacauauugaaccauguguaccuuuggacagcaguacaggccuuuuuguguuuaccuucuuacacgcauguaguauuaacuuacugaauucagauaaaacugguauugaagagugccuuggcccauuuuguguugcuauaacauaauaccugagacuugguaauuuuuaaagaaaagaaguuuauuuaucucacaguucugcaggcugaaaaauucaagcgcauggcacuggcuuuguugcaaggguuuucaugcugcaugacaugguggaaggucaaauggggaaccgaaaugugcaaaaacgaaccagauaggaguuggaaccucaauuuauaacaacucacugucucaagaacuaaucuauccccaugagaacaagaacucacuccaguaagaaggcauuaaaucuauuuaugaggguccacuccagugacuucccacuguugcacuggcaauuaaauuucaacaugagauuugguggggacaaaccauauccaaaccauagcaaaguugucucuuuucucaugcuaugacugccaugccuccauagcuuucuugcaauccucuucccccuccauucucggcagaugugucaggcacauuuacauguucacaucuccuuuccuacaacccuuuuucuuuuucagaaaagugaaacuuuuuucuaauucauauuucaacaguccuccuuccagugcuguuucucuauagagugacugucauuugccccuccuuuccugugcucuagagcuuaugauacauggcuuuaguauaaacaucccucauacaucacuggcuggugcuccacauaucuuuauuccuccuugccaaaagcagcaggcgaugacaaggaucaaagaagcauccuccuucuugccaaaaaaaaaaaaaucuuccuuuggguggaaguggcuguggugaguguuguugacccaauaacggaccaaauaaaaugccaguaacuucuuagcaguguuaucagauguucuuuuuuauuguauauauauaauucuccaacuguguaguucuuucaaguguaauuuuuuuucuuuuucuuuuuuuuuuuuuuugagauggagucuugcucugucgcccaggcuggaguacaauggcauaaucucggcucacugcaaccuccaccuucgggguucaagcaauucuccugccuuagccucccgaguagcugggauuacagccacacaccgccaugccuggcuaauuuuuguauguuuaguagagaugggguuucaccauguugcccaggcugcucucgaacuccugaccucgugaucuaccccccuuggccucccaaagugcugggauuacaggcgugagccacugcgccuggccucaaguauaauuuuaucuguguauccacguuuauagggagagaacaaaaguauagagggaguagugacuuugccagcaagcaucuucuuccccauugggaguaauuccauuuuuguuuuuugguuuuguuuuguuuuuacuaguuccuguaugcccacauugccaacuucugucauuacugccuacuacaaagacaguauuuacuuccaucucuuuucauucccaaauuuagggucugaauuguugcuuguauagauuauuacuuccacugucuaccuauaugggugaccuagaacucuuucuuaauagaaaauaaauguacaauaucugaaucucugaauauaaccuuucuugucuuuuaguucucaugcuggcacuauacuuuucuuugaccucauaaaaacauucaaaauuuuuuauucacccucccaccuccuaccucaggcuauuagucuuuccuguccaccuucccaaacuaaccaugaucccauuuugaucacuugaauucuuuccucuauaucaugauuucuucacguagguauuaugagagucaucuggcuagauguggagauguauauuucugggcuuaaacuacuccccuuuuaaaaaucuuuauaacauuucaacaauauacauaggaaagaauaaauaaugagcccugaauucccuucuccacucauugccaagauucaauuacuacagacuaauuuuauuuauccucaacaucuccuuucauuccuguauuauuuugaggcaaaaacuagguauuauaucauuuuaucaguaaguauuuuagaauguauuuuuaggagauaagagcucuuuaaaaauauauuucccuaauauaauuguuauauuagcuguaauuccuuaaagucaucaaauaucaugucacuguuuuuaaaacagcuuuauugagauguaauuuauaccauacaacucacucauuuaaauuauacaauuaacaggguuuuuguuuauucauagaguugugcauuuaucaccacaguuuaagagccacguaccuuuuagugaucaccccaaauccccuguucccuccccagcccuaugcaaccacuaaucugcuaauccacuuucugacuguuuaguaauuuuugaaucauacaacguauaguuuugugugacuggcuucuuuaacauguuuucagaguugaucuguguuacagcauauaucagcccuuuauuccuuuuuauuaccaaauaauauucuguuguguagauauaccacacuuuguuuauccauucaucaguugauggacauuuggguuguuuauauuucuuaagcuauuaaaaauaauacugcugcaaacauucacauacacuuuuuuugugguuaucugguuucauuugucuugguuguauaccuuggaguguaacuuaaguaauaaauauauauuauacuauacuguauauauauagauguauauauacauauauaauauaaauuauauauauuauauauaauaugcuguguacuauaauauauuuugaaaaauugcucaaguucauuauuaaaaagagauuuaggaaugacaguuccugcaauauaugugacuuaggaagacagcuuaccuauugugcuuuugaugucuuggauaguuugaaugccuaucaguuuuguggaaguauuuucuucauuuaagaacacuucguauguccuuacaagcaguacauauuaguuauccuuugguuuuuaguguucuuugacaguaaauuugauuccugauuucuuuuuaaggaaaaauagcacaaauacaaauagagucuaaaagcauuacuauaaaaaaaaaaaagccggaagauaacuuacgaaugccauguugcauuucugccacuuuccucuccuaaaguugguuccugcugccuaucaugcuauuaauuuuuuaaucucaguucuucauagaauguacagaauuccuuauugacacucuugguguuauugugacauauagcuauucaauauugucaguuuuuuuaaacagucauguugggucuuggaauguuacagauuagcugagaguaacauggugggaaaaaggcaugacaucaccaagccagcaaaugccuggagguggauuauuuaguuugcauaaaauguuuuaaauguuuaauuauguauuguagacuaaacauuacuaauuauaggugauaguuuacuuauaccucuaacauugguacaguguuuuuguuuuuuuaaaaacauucaucuuccuuauagagauuucuguuuguuuuuaaggauauuuuggaacucuuagaaaaaagagugaagucaagauuuucucaccggcagauacacuuaaugaauucauuugguuuuccacaguauguuaaaauauuuaaagaacaguuaucucuaccugcagaguuuccagacaagguuuuugcugagaaguggaaugaaaauguucagguaucuuaaaaggcaauaaagcuaaauguuccuugcuauaugauuuaaagcaauuaaaacacaaauuuuagaaauuaguaaauuaacacaaaguuucuaauauugcugaaggauaaugcugcaguaauacaaauuauauacuuuuuaaaaauuuucuucuuagacaguugaaaugucauuucuccuaaauucuaucucaaaagaacaucacaguuaagcuuuaggauuuauguuauuaguuugaaguaaacuuuaaugaggcuuuaguuuuaucuguaugugguuuauauuuuagauaauuuuauuuuauauauuuuacauauuuagcaauaauaauaaauaguaaauaaugauaaauaaauguuaaugacucauaccuauuauguguggauauuuuuuuucuuccaguuuucauuagcaacuucagcuuuuauuuuguugggccuuaagaggcaguacagacuguggcaccuccaguuauauuaucuaauaggugaucacaucucacagucccuggagacuugagagucuuagauacaaaggcagguucauauguuguuuuaaagauuugccacaccuuugagacuauaaauuuaccugugcuuaaaauauucucaacacacuagcauuuuaaucuuacgcugucaaaaaguuucaguuggcaaagagaaaggaggaaguaugcauauguguguguauuuaauaauauaauugaaaaacaucauuaaugaauaagucccuuaugcuagaaucucaaaaaauauuggccucgugagaguggaaaauaauauagagucccuggcucugaaggaauugggaaaaacugauuuauaauguuaaaauaccgguaaggauaauuagaucuuugaauagaauuacacagucuauauucacugacucuauaaaaaggaucauuuuauuuuaaagcaauagugguagauuguauuuuuaccgugaauuuuuaaauacuaauacuaaauuggaagcguuuugcauuuaguuuguucuuuaaaugauuauuguuugauuauaaaauauagucugcucauguaagcaguauuuugacacauuucauuuuuuuaaaauaucauaaaaguuuauugaacaaaauguaauuagugcaaaagaauacaugauaaacaguggaaguuucccuuaagacuauaucaauucuccuuucuucuacuauggaauaauuacuuggucuacaacauugcagaguuuauauacaugcuaaauauguuguuuuuacauaaaggacucaaagccuacauauuuuuauauuacuuuuuucccauuguuaugauuaauaauucccuguucuuuuucuuaauacaacuauacauaauuguauguaaaaauagcugacauuaucuuuaaaauucagauauuaugccuugauauaauuagguauggauccucccuuccacucaaucuuuccugagacucggguauuucaauuaccugaccaagugucuuugauacuauuucuaauuauaggauuccaucuauaggagcaccuucuuuguaguugguacucccacauuguccccuuuuacuggggucuggugugaaccagaccucuggaucuucagcuuuuagaucuacuuuucagugccucacagacuuucaucuucuacaacuccugaacugauugucuuauuccaccaguauguuuuucuggcuguuuuagagauucaaauguagucuuucauaguauuuaaaugucuguacuuuccaugggcuuuuuuuuuuccauaccugcucacacuuaaucuucuuaagguaacuacauggucuagguugcacugugccauuuuucauccacuuuccuucccaacuguguugcauucugagcaucucaaauugagucuauaaauaaagaggaugcugggaguuacuggugaagaaguauaacugcgugacuuagaaaaugauaaccauguguuaguagcauaacuaaucuacuuucuggacuuuuguugcagaccuuaaauccccugcaugugagcacugucuugucaucauuuugauagucuuaauagucaguuucauuaaguagaaccagcaucacugguguuugugucucugaguucuaauauuuucuuccccuauccugaucaucuugugccugucuuugguaugugaauaaaaugagcuucacuugaaaaaucugucagcaccauggucagagucccugccuuguggaguagggugguagcugcauuaagggagcuauucuuucucuuagugccgauuauccaggaagcuauuuugaauggcaggauuaagccaauagcagugauacagauaacaggucacacauggaaucucauccaagaaauaucuucaggauaagauugaaccuugauauccugccuaauuugaagguuuguuuuagcccuacuucaaaugagucaaauaagcaaaguagacucuaucuuagcauggcaguauaagagggauccuuugaaaagaacauuuaaaagaaucauaccuuauucuccucaaaugaaaucucccaaaguacuguagcuuaugugguuguugauaauagccuuauccucaaauagaguauaguguuugaaucaagauggaauuaaaaauauaaugaacgagguuagacaauuuuuuuuguuuaaauggcucauguagauaagguaggcauuuuaaaaagcagaauaaguaauuauagaagcaagaaggcgauagcuuuuagaaagagggggaauuggagucaaaccacuaaaaaauaaagagauaaaguaggaagguggaguauagaagauuaaccuuugaagcaucaugucaaagagaggcaaaugcagguuuuaaaaauaauugauucuugcagagaaaauuucuucaauuuugucccaggugauuuucuuuaguuuuccuaagugcuccgauuuuaccacaucaacuuuuacaacuuacagauuacagaaaccaagacuauaguuugccugugauauuuagccacauaucuuccauauugcaauuuuaaaacuggaaaagcuaaacaaauuuuuuuuuaauuuccaaaagguauuacuuuguuuuuuuuauguucacccuguguacuuccaaggauauucuaccguguuugugauagaaaaagauauaguaaccagaaguccuuuaaaauacaaagagaagacuagaaacaauagcaagggagugggaacuauaauuaagauaauauauuuccugagaguauaaaauuuuauuccaguagacuagaacuuacuucugaaucuggucuucuuagaguggacaaaguaaagacauauaauuacagcucuagaaaauacagaaaugcuuaguuuucugggcuuuuuuuuuuuuuuaaaagaauccuuauuccaugcagaugauuuuugaaaaauuaugacaaucuuuuccaggccuuucuuggcucugcuacuucugaauuuacucuuuuuucaucuaaucuuuucuucaaugccaguguuccucaccuuccauucaacccuaauuacugcagucacuugccucuuuagaugguacuuucucaaagggcuguggugaucuuugaauuucuaaagccauuagccucuucucaaauauaucuuuuuacaaaguaguuuauauuguugaaccucacuucucucuuaaaacuuuguucccuuguuuucuagaucucuacucugucuuagauucucuuccagucuuugguaucuuucuuaauuucuuaguuuuucucuuuucccaccuacuacuuaaauauuaauaauccaagauucauuuuuugaccacauuucacuuuucacaggccauuuuguuucccauagaucauguuugauuuuuaucuucuaccuuucaaacccuuccuucucuucugcuaccaguuaauucucuaccagauguacuccuauaaacgucuuaauucuuuuuucuucauaacacucagauaauuccgacccacuuuaccucuugucuggacagcuaccuccaguuagguuuuucugccuuuucuuuuuguacauucacuuugccaguaauugaaacuccaguacgugacuacucauuuucugccaaugugauaauuuuccugcuacucaugcuguucccuguaacuggaauguucuuccuucuuuuuuaaaucucuugucucauccaguuuaagcauucuuuguaauacuuuaccuuguaucccuagguacaguaacucaugcacuucuguuuuugugcugcauuuuguucauuucacuaguaugacuguguaguaguuucccuuauucaaguacgaauuugggguuagccaggauuguuuuaucauuguguuuauugaauuaacguaaagaacaggauaagaaaaucaguagacuggaaacuuuauuuugguuuuaguguucuacaaauaagaccaacaucuauuuaauaaugaauuaauauuagauagaguuacuaagguacaccaaccaguaaggcacaggauuauauuuagguuuuaaacuacaucuuuccucaauuuuggcuuuuuuuuuuuuuuuccuuuuaguaucucucagaagauagaagugugcaagaaguacuacagaagcauuucaauaucagcaaaaaccugcggucauuacacaugcuauugguuuguauuaguuuuguuuuauugcuuguugcuuuguuuuuguuuuuaauagugacggggucucacuuuguugcucagacugguugcgaacuccuggccuuaagccauccucccaccucugccucccuaagugcugacauuacaagcaucaaccacugugcccagccuacuuuuaucauuuucuaucuuucauuagauaauuaaguuuuuaugggaauugauuaaaccuguagguaaauuuugggagaaucgacaugcauuggaacacuacaucgaguguuccaaucucugaauaggguucauaucuccuuuuauuugauuucuuguuugauuacuuucaucagcauuuuauagcucuuacuacacagaugauguacuuauuuaauguguauaccaauauuuaauuuguuagaacaauuguaaauggguuuugaaauuuugguuucccacauauucauuacauuucccacauauucauuacauauagaauaugugauugauuauauauauacacauuaauauauagaaaugugauugacuuauagucuaugcugaacucacuuauucuaagagguuuuuuaauagauuccuugggacuuuugauguagaccauuacauuuuucacaaauagugacgguuuuuuuuuucuuuccaaucuguaugccuuuuauuucuuuucuugcuuuuuugcaauggcuagaauuuccaguguuauguugaauuagagcagugagaguggacauccuuucuuguucccagucuuaggaagaaaggauucaaacuuuuaccauuaaguauaauguuagcuguagguuuuuuauacauguucauuaucagguugagguaauccucaucuguuuguaacuugcugagaguuucuuauaaauggguguuggauuuugucaaaugcuuauucucgaucguuucgcaugaccauguuucucuuuaaccuguugauauauuugauuauguuauuuuuugaguguugaaccagccuuauauaccuggaauaaauccuaccugguuaugauguuuugccaaguaauuauaucuuaagcuuacauaauaccaauaucaaacaagaaguacuuaauuguucugaaaauuaacuuucuucacuaagaguauuugguuuuagucuaauauuucuagaaaauuauggcaaauaccuuugaaagacaagauaguuuugguuucauagaaaggucauuuuuaauaauaauagaauaauaaugacaguagcuaccauuuauggacuggcauaugagccaaguacuguugaugcuaguaguaccuauauuaugucuggccauuggaauaaucuuauuuuuuauucuuaccccuaaagaaauugaggcuccuuaaagcuaaguaacuugccgaaggucacacuacuaguagauaacaaagccaggacuuaauccaaagcucucuggcuucaaguuuguguccuacuuggcuguaugguucacccauguuuauauacaaguuuucuuuccucauugcugcuucugcugaggaauuuaagucuuuuuaucccuauuuacuuuucuucuauugucaaaagcauacugccauuuucagcauaucaugaaggaauuuggggacuaguaauuuuuagaggagggguguguguguguauguguguauguauauauauauacacacacaucuccaucugggaaaauaucucugccucaguauugucaauauuaacggccauuguucugccauuuuucuauuacauuuuuaauucaugguaaugaauuaaauaauggcuuguuuuuugucauaugggauucuacuuugagggcugcuuacucauauucuuagcucaucccauuauuuguugucauugucuuacuguggaagcucauuauagauuacagauuuucagccucuccaguaaccagagaaauacuacaauuaaacuuuuuuuuucuugccaaucuaguggguguuaaagauuaugcuugaugguaucaugacugugacuauuaauauuuauugcugcugccaauguaaauauguguaagugcuuuggagagcaauuuauuuagcaaauuagguaacuagagaaacauacuaauuagagaaagucuaguuaccuaaugcacaggaagacauguccaagguuguuuauugcagucuuguuuauaauugggaaaaaaaaagaaaugaaagaugucugucaauaggaaauuaggaaaugaauaaucguggauauauacaaagaaauauaaugaaaaaaugaauaaaccagaauugauacugccucaacauggguaaaaccucacagugaagagaguugugaagauacaauauauuuauauaaaaguugaaaauuacucuguuguauaauacauguauauguaguagaaguauuagguuggugcaaaaguuaccauuacuuucagugcccaaaauggcaauuacuuuugcaccaaccuaauaguauagacauacuugguuguuuuauguggggaagaguagaguccaauccggaggagaugggcuucaacucuaaaaucauauuucuuaagcagguaaaguagucauagauauuuauuauucucuguugccuuuguauauguuaaaaaaaauuuaugccuuuguguccucauagcuuagcucccacauaucauaucagugagaacauacgauguuugguuuuccauuccugaguuacuucacuuagaauaauagucuccagucucauccaggucacugcaaaugcuguuaguucauuccuuuuuaugacuguguaguauccauaguauauauauaccacauauauauauauauccauauauccauaguauauauauaccacaguuucuuuauccauauccauaguauauauauaccacaguuucuuuauccacucguugauugaugggcauuuggguugguucuacgauuuugcaauugugaguuuugcugcuauaaacaugcacaugcaagcaucuuuuucaaauaaugacuucuuucuuuuucaaauaauaacuucuuuuccucuggguagaugcccuguagugggauggcuguaucaaaugguaguucuacuuuuaguucuuuaaggaaucuccacauuguuuuccaguggggcgagggauaaaagacuacaaauaugaugcaguguauacugcucaagugaugcauucaccaaagucucacaaaucaccacuaaagaacuuacucauguaaccaaauaccacccauaccacaauaacuuauggaaaaaugaaguuaaaaaauaaaaauuaaaaaauuaauaacuaaaggaaaaaggaaaggagagagaaagggagggagcacuggcaaucuaggucccaaccaguaggagaaugaaggacaaggauugccaaacucucugcccagcuaaucaguugcgcccuuguuaaggugaaggagaguuucuuggauaauuauaucccaaauauugcauggcacauacuacuaagaaacuauuuauuguuuauuugaaauugaaauuuaaccagaggucaugcauuuuuaucugcuaaaucuuguaacccuaaaugaccaaauuuaacuuucaugaaaaauacaaauaaagaaggaaggaaggaaaucuucaaauacuugaguagcaacucugguccaggaccucuguucauuuuugaacagagaagcagcacaagagaaggagacugugcuuucaaggagaguuauuccugaguauaaaugugcuauuuucuuuucuuuuuuguacaauugaacauaaaacagcuaacuucugucuaaauuaauacuaaccuggcuggaugauuggguggugaaaaaguuaacaaguaaggcguagaucugccuuuugggcuuguguuuggggcuuuuauuaguaaguauucuuaauuauuuucaguuucuucuccuugaccuacuccucuuuaaacauuguucuuccaagcaguaaguaaacaaguuaugcaacugggauggguuagagagagcagcaggaacuuuuuuuaugcuuuacaucugcaguuaugugacacacaaauugaaauacuguauuuuaauacaacugaauuugagaauaccuuccuaagcauuaauauuuacucucccuuaagaauuaacuauacaaauucagaaguuuugcacaguaucuccaaaaugcccauguaaauacguaauuguuuuucugaucugucuuucccuagaugcuugcuuuaaaucgaguaacagcaucgcacccauuuaugacugccguagaucuaauggaagcaagccaacuguguagcauggacucgaaagcaaauauuguacauggugagaacccagccuuauuuuuuaaauugugguuuuuaaaacuuugaauuuagauaauggaauguuuuuaaaauuacaauuaacgugggcauaaugcuuuauaaaauacuuucguauccauauagccuuuaacuuaguccuuuuaaagguacuaucacucccauuuaaagugaaaaaaaaauuugacgcucugccucuuuugccacauuggaaauccagguaagacuguguugcugauguuaucauuguaucaagaacuacugaagagcauucucuggguuucagucauuuuggguuuguuauuuccuuuuccaaauguaaugaaccuuuuccucuccggggaaaaaaggaauacacagauuuggauauaauuuccaggaguuuaggaagucucuagauaaauccuacgcaaaggcccugugugauuuaaagucacauaacaauugaaguuuauuuuguuuacugugggccauauggugagugccugauaauauuucgccaaucuuugugacauuucuaaaaguuuaaaaauauccuuauuuugcagauaggaaaaaaacuaagcucagggagguuaaguaacuuaaauuuauauagauaauugaaacacauugaaaucuagaagaaucuugaccuucuucaccccucagaaccauagaucuuucacuauauuguauucuuuggagaacaguuauuucagucuuauaugucauuaaacugauaguuuuuuuucccuuuuacuguaggucuaucagucuuggaaaucugucuuauaauagcaaugaaacauuuaaaugacaucuaugaggaagagccauuuaauuuucaaauggucuauaauggugagaugagacuuaaguagcuuuuuucugacucuuccccacugcuuauuugaagguauaauguugucauugcuuucuacucagaguuucagaaguuuguucaaaggaaagcacauuccguuuauaauuuugaaaaaccuguugucaugaagguaagauuuaguuugcugucauuuuucuacagacaaguauauuuuuuacauccaauuugauuauguauuaaaauugcacuuucauuuuuaaacauuaaguauuauagagauuuuuuucaaaacaagaaaauuaucuaaaaaugaaauauuuuggaaaaaucugaggaagugaccgguuguuuuaguuuguggagguauacugcccucugcugucucuucagagcacuugcaucccgaaaacaacuauucaguauagugugugauauaaccuuucccuuuccaacccaaggauuggcuuuuauaaucucagcaguaaaaggagaaaacaaugaaaauuagagccauuaagaaacuuaaaagacaaaaucuuauuggccugugagggcauacagagaaaguguuauuugggggcugagucaugaguuuuacaacuucaggacuucauguagauuaccauuguccacuacaaagauaaugugagccauguaauguaguuuuaaauuuucuaguaccuguaagaaaaauaaaaagguuuaauuuuaauuauauauuuaaugcaacauaucaaaaaugugucauucuauaaucauuauagaagaacaguaagguauuuuacauucuuuugaauuaagucuuuaacauuugguguacauuauauuuaagcacaucucaauggccuaaauguuuacuggaaauucuugcuguuuagauuccauaaaauguauagcugagaaaguaaauuuacauuuugaaauuguucuaaacaugcucagaauuuucuaauagaacuaaauauccauuuuuaaguuuaaaaaaaaauugagucacacauugaagugcucaguagccuagcguggacagugcagcucuugaagauuuuaaggaaagaaacuuuuaaaacaguggauuccccaaguccauuggcaucccuuauaggcccuaguaaccagaauuucauuucuuguagcaacaaaaaugaguacagagcauugccauuucuucaaagaaacaggaaaaguauuuuacaauacuggaggguuuuuuuccccuaauagucuuauuuugugagagcugugaaaauggaaagguuacccaaguauuuaaauuuuuuuuuuuuuuuuuuuuuugagauggagucuccugucgccuacgcuggaguacaguggcgggcgcaaucuuggcucacugcaaccucugccucccaaguuaagcgauucuccugccucagccuccugaauagcugggauuacaggcgugcaccacuaugcccaucuaauuuuuguauucuuaguagagacaguguuucaccauguuggucaggcuggucucaaacuccugaccucaugauccgcccaccucggccucccaaagugcugggauuacaggcgugagccacugcgcccagccugcauuuaaauucucaauaauuuguagcugcucauuucugaauuuucaauuaugaaguauuuugcuauuuagaaauguuuuaaaucugcacaguucuauucagcucuuaacaccugcagccuccaguauuuucucauguucagauaugaagguaucugagcuguuucucuaucagaagaauuuaugugauacauagagaauauguuccagugauguuuuuuacagugaguuguaagaauauaauagaauccucaggaaucuauuucaguguaucauuauuuaaugguuaguauaucaugauuuaaugguuuuuuuuuucauaaccuaauaacguaccuaacacaacacucaagguuagaaaagauauaauaggugaauauuaaggauaagaggaaguagacaagaaagagcccuauuaagauggggaagauggaagaagguugugacagucucagucagacuucuuagaggaaacaggagccugucccuucuccuccauguccauacuagccugcugaauccuuuacuuacaggaucagcugaauaugucuaguugacucaagggucuuuuucugccucccucuguuacagcuguguuaccuuuuuacauagcaaagcaaaaauagagacagacaaaauauaaaugcaaaucugaguagccuagggaauugaucagaaagucuuaucugauucuuagguuuuuacagagaacuggaaacuauuuauuaaaguacuaggaggagcuaugauagagaaugaggcuaggaagaaaaccauauuguauauauugaauuaaaguuugccguguuuacauucaacaauauauggacaaguaagugugcacugacacuguuuuaccugauaauaugaguuuucaugggguugugagaguuuuuuuaauccuauugauuguuguuacauuuugcuucccaguacucuguucugcagcugaccaaaaugcuaacuguucucugggagagaacaggagaguugucacucuccucuccuauucaaccuaaacuauuucuuucaucuuucaggcuuuugaacacuugcagcaauuagaauuaauaaagcccauggaaagaacuucaggaaauucacagagagaguaccagcugaugaaacugcuuuuggauaauacucaaauuaugaaugcucugcagaaauaucccaacuguccuacagaugugaggcagugggcaacauccucacuaagcugguuaugaauauaaccagugacuucaacuuuggcauuucauucauacuucuguagagaacggaaaacuauuguccauuaacaugauaugcuaaacauucuauaaacauucuuguauuuaugugagacuugcccaucuacugucuuggcugugucuugccuuuuaaucaugaacaguuacaugauuuauaauuucacugauugagauuacuuuguaaguagcuguucagaagaauaaaauaugacuguuuuagggacuagaccaugugcuuuuuuaacacuuauauauauaauggucuauuugaagagcucacuucaaccuaacagcuagaugucuuuacaaaccuuaaaccaaaggaguaaaaaaaacaaugguaagcacugaaguauaauaaguaaccuuugguacagcagguuugcugcaguguuuuuuucuguccacaugcaaauuuuggauucuaucccagacccagguuuucuaguucagaagacuaaccagcuuagucagaagaugguuccauggaagaaaaaggccaaggaguuugaagauuuuucuucuagacaucucaaaaugugguacucauaccauccacaucagaaucccuuguaggauuuucuaaaauuacagauuguugagccuaccauaggucaaaaggacuggaauuuuccuucuuaacaaguauagucauggcaccacguaacauuuuggucaaugacauuguauaaaggguggucucauaagauuauaccauauuuuuacuguaccuuuucuaugucuaaauauacaaauguuuuaccauuguguuacaguugccuacaguaugauuacaguaacauucuguacagugcuauagcugaagaguaauaggcuaggcuaucuguauagccuaaguguguaacaggcuauauacauaucaucagggucuguguaaguauacucugugauguucauacagugaugaaaucacccaaagacacauuucucagaacguagccccaucaugaagugacgugacuaccagagauuucuggaaaagcacucccaaaaguaaugagauguguauggcaauguuaacugaaccuguuuguauuaaaaaguaaaucccuaugaggaauguggaaauguccgucaaagcauugucuuuuaaguaaguuccaagauccaugaauuaacagaggcauauauuuaaaaugaaauuuaaugagcacuuagugacuucauuuguucaagaauauuugauuuccuauugugugcaugggagguuuacaaaagacagacugucccuaugcuugugcagcuuacaaucuauuuaacuauuagaggcccugugagauguaggcaguuauuuacagaugagaaaacuaacacagcaguggcaaugcugggaauggccaacaggcuuggaauucaacucaguuuagcaccaaagccagugcuauuaagaccugaaguucaacaguggauuccuuaccaaauaguuuuuaaaguaugcucuaaggaacaauguuuuaaugaaaucuuggauacaaaguggaauaaaagguuucugagcauaaaguagcucuucaguaguuacaaccuauucuuuugcauacauagccuuuccuucccugcaaaaaguuaagccugcuaaguauucagaucccugucauuuacuucucagcagucucauucaagcuaaggcuugcauacucaaucugugccguagucuacacauuuuuaggggauauuucaccaaaauacuugacaugguaacaucacuauuauauacuagaagcaagaauuuuacacuuaugcucuaagugauccuuuuaaaaauuuucugaacuauuugaggaaaguauuauuugucuuaaaggguaacagccucaugaaaugacuugaggauuccaauuucuuauuagcuuaagaugucacuuaaaagcugacagcccucaucugucucauuggcuacauaagagcugcagaagauccaucaauaaccaaguauaaagaaagauuuuaagacuaaguaccaauugagguaaacaugaaaccguuauaaagcaaauuaaaaaaaaauacauuaggaaaaguuacacaaaugaaguguacgccuauuauauucccaaggcauuuuuguggggaggaacagugcugcuuguuggccuuuccauauucccucauacaaaaaugcuaaaaucuauucgcaagaguuuugagcuaacuucgucucuuaaauugcuuuaauugucaucaauaaaaacaaauaugaaaaacccuaguuuaaaaagcgguucaagaauaauguaaacuuauacauauagcuuauuuucuucauuuacuagaggaggaaaaauagaaccaaaaaaugcaugaacuccugcuuuucaaucugauuaccucaaacugaaaagcaggugaaaggaggaauauuucaguguguuuuuacaucugaauccaagggauccaaguggcccagcagaaacggaauucuuguuaaaaugacugauucucgugcaugugaaaggcucuggggaaugaauaccuguuugguccaaacuuacuguaucauaaugcuguauauguugaaaacguaauaccuguuaauguccuaaugaaucacguuuugcagaaaacaccguaagaaacacuucagucuuucuguaguuuccaugcauauuucaccaugguucgcacucugauccucaucugguuuagaaagcaauucaguuucuuucaaaccaccauaaccuaagugcugccccauccuucaccuuuacccuagaaaaucugagaauccauugguguguacugugugacacaaugccaacaagccucugguuucuaauacuggcaggaccaacacacauacuuuagugggaauauaaucuguuuagacgauaauagagggaaaugccauaauuaacaaaucucccuucacucaccacuauccucauucuugcaguugucaagguguaagccucacuguaaguuacaaagcuaccacuccccucuuuaagaacacauagcuuaggauugccuuggcgaugugggcucuuuuuugguuccauaugaacuuaaguaguuuuuuccaauucugugaagaaagucauugguagcuugauggggauggcauugaaucuguaaauuaccuugggcaguauggccauuuucacaauauugauucuuccuacccaagagcauggaauguucuuccauuuguuuguauccucuuuuauuuccuugagcaguagcuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacgaugggguuuucuagauauacaaucaugucgucugcaaacggacaauuugacuuccucuuuuccuaauugaauacccuuuauuuccuucuccugccuaauugcccuggccagaacuuccaacacuauguugaauacgaguggugagagagggcaucccugucuugugccaguuuucaaagggaaugcuuccaguuuuugcccauucaguaugauauuggcuguggguuugucauagauagcucuuauuauuuugaaauacaccccaucaaucccuaauuuauugagaguuuuuagcaugaaggguuguugaauuuugucaaaggcuuuuucugcaucuauugagauaaucauguguuuuuugucuuuggcucuguuuauaugcuggauuacauucauugauuugcguauauugaaccagccuugcaucccagggaugaagcccacuugaucaugguggauaagcuuuuugaugugcugcuggauucguuuugccaguauuuuauccaguuagaauggcaaucauuaaaaagucaggaaacaacaggugcuggagaggauguggagaaauaggaacacuuucacacuguuggugggacuguaaacuaguucaaccauuguggaagucaguguggcgauuccucagggaucuagaacuggaaacaccauuugacccagccaucccauuacuggguauauacccaaaggacuauaaaucaugcugcuauaaagacacaugcacacguauguuuauuguggcauuauucacaauagcaaagacuuggaaccaacccaaauguccaacaaugauagacuggauuaagaaaacguggcacauauacaccauggaauacuaugcagccauaaaaaaugaugaguucauguccuuuguagggacauggaugaaauuggaaaucaucauucucaguaaacuaucacaagaacaaaaaaccaaacaccgcauauucucacucauaggugggaauugaacaaugagaucacauggacacaggaaggggaauaucacacucuggggacuguugugggguggggggaugggggagggauagcauuaggagauauaccuaaugcuagaugacgaguuagugggugcagcgcaccagcauggcacauguauaccuauguaacuaaccugcacaaugugcacauguacccuaaaacuuaaaguauaaaaaaaaaaaaaaacauagcuaaagaaaaacugcauaugcaaaucauaccguauucauuuuuuuauuuaacuuggggauggaauggggauagcauacauuuuauuuguacaauauuuaacaaucacuuauccaaggugggguuuuauggggauuuuaagcuuucuguuaaauacuugcagaaaaaauagcaaguacgauuugacaguaguacaauaaccugugcccaaaacacaagaaauacagaguaaagcgaaaauaacugcuuaccaauauucugagagguaacaaaugggauauggguugagacugcauaaaaaacguacugcugguugaauaucugagguaaaugauguucaaucaagaugcuacuuguaucauuuugcccauaaauggauaaauaauuuuaugcauaucauaccaaauguuccuaaaaaguaaucuuucaaaaaaguauaaaagagaaacuggaaagu

SEQ ID NO: 191198 - RNA, 67464 nt, Homo sapiens
gaguguuauuaugaucugacauuuguuuuauuaaccauuagaaaagaucugaaaaaacgaauuccauuuuaauagugagacaacacaguagagcuaaucauggaauauuaauguuuugcuauucgggaauuacuaagggggaaauuugcaggaaacuuuaaggcaagaauauugcaaauaaguugccaaaaauauaugcuuauagccauagcaaaaugaagauuuagcaugcuugucuuugcucccaaauauuuuuaaaugcagcuuuauuaaacuauaauguuuuuaaaauuaauacuugugcuuauauaaaauucagugauuuaaguacaugauacucauuuggucacauuuucugcuauuacuguucggcuucccaagaauuucauucaaucagcaaguuuaguucacacaaacguuaaggcacagagucaugaaacgaacugauuuuaauucugaaguguguuaaaguaaucugcuccccucugccccaaacacauauacauagcugcuuauucauaccuguuugcuaaaaacucaugugcaccuccuuacgguuaaauauaauuugggaaauuaaugauguaaaauguaaaucauaauuauaauuccuuuuaaggaaauuaguauuuuucuuuaguuacuucaagccacaauccuuaauucaaugaucccagaauucuuuacaaaaccauccuugguauaugaauaucuuagacccaaaaauaucugugauuaugaugaauuuaugaugaugaaaaaagacaccaacuuuuauagagaucccugaauauacgagagcuaaggaggcacaaggauuaaacuuucuaugacuugcuguagaaugugugccuugcuaaguagggauuagcuucugaauaaaaugugaaaacugagaucacucacucauucuauucaaagaagaagugagauauacugucaguuaaaaagaugaaacaaauaugggaagucaggcacuaauauuaguuggcaaauuuuacaaagguuuuaauuacauaccucuuuaaaaaaagaaaaccuaggcaacacagacauauauuaaaaacaucaguuucaaauuucuuccaaguuugcuuuuaaaugaagguuuaaaaagcagaucaacucuagauuuuguaguccaacuugcugugaaauacugaaacuaacuuuccuuuaagaaaucuuaaggaggcacacuuucuaguggugauacccuccuccaaaccaaaaguaguaagaagguaaggguaugaacagcaaaguuguguaacauuuucuuauuucuauaauuuuacuuauucuggauacuuuuagaaaauaaacucauguuuuaacuaagacuguuaaccaaguacaaaacuauuuguuguugcauuugcagauacaguauccuacaaauaugugcagcaagcccaugaagcacuuccaccgucgauacugauauuucaguauuuaauauauacaaaauguuucuauugaacagaaccaagguauucacaauaagcugcagaaaaacccaugcaauuaacaaagaaugaaauuuauaaauuaaaaacauugucgucuauacauaauguacaaucaugcauuuaaaaaugaauacuauacgucucauaagaauaaauuuucagucaacugcugcugcaugaauauuugcuaaugcaaaugaauaaaaucuuaguaaauucugcauuaauauuuuaaccgccagaaguugaaacuuuucucauuuuucuugaaagcuguccaaaguugacauaugcaggaaaaauucaaauucuuucgcauuucauuugagguuuuuaaccaguaacaaacuuccuaaaccucagucccaacaaacaugaauuaaacaaaccaacaaacaaaaauauaaacaccuuuaucaguucagcaaaaauucaaauaaaaauguucaauuuuacuuaaaguauuuuacauguuucaccagaauaugcacggguuuaagaaagcaugaaauaaaauguaaguucuguuacuaguuuugcuuucacaucucaguaagauaauuaaauuuccugaaaaaccacgcauagcagccaagaauacauauuaugaaaaaaaaaaggaucuuacauaaugaacuuacaaaauugaacuuacauaauaagucacuguccuucaggguuugaaauguuaucaacuuugcaaagagucucuucuuugaaauugugcuauuauuucagaacuuguuuccucaaucaagaaauccagugauguuuaaaaaaaccuucaauuuucucugaaaauacuaaauagaauuuucaugggauggugaucuccaacgugacuguagauuuuuuauuacagaguuugccauacaacuuaguuucucgugcauuucaaauaguuggcuuccugaauaauuaugaagaucuucugaauccagcugaagagcaagagcacuaaucugugccagaagguuuuuggauaauggaauuucuaaagcaacaggaucaauuauaucuaaaagagaaaaaaaaaaccacaauuaaaucuauaccagacaaaaauuaaauuuuuuacaugaucuuuuaaguuaguccaagugccuagguuucaaauugagagagcaggcuuaagucuucaugaggacaagcacacaaaaaaaucuaccagagcugccgcugcugcuuauuauuauuaugagauggagccucauucuauugcccaggcuggagugcaguggcguaaucucagcucacugcaaccucugccucauagguucaagccauucucccgccucagccucccaaguaacugggauuacuggcaugcaccaccacauccagcuauuuuuuguauuuuuaguaggugcuggguuucauguugcccagaguggucucgaacuccugaccucaagcgauccacccaccuuggccucccaaagugcugggauuacaggcgugagccaccauacccaaccuaccacugcuuauuauucugugcuauucucauagauuauucugugcuauuaaagaaauuuaaaaaugguagacuacuucauuuauuaauauaacuagaagagaaaguguauaguuuaaauccuugagaccuugauggagaaguugacaagaaaaacaaguagacacauuugauguccaaucgguuaguuuuucauauacuucacauuaaacauaaaauaauuguugaaauaaggcauggucaaaucagacuaaaaaaaauaacauauuucaagaaagucagcugaucuucuaaauaaaauuaucccacuuuugcuaaaauauaccugagacaagucuuucuucaucaggugacaaagauuuauuuucuauuccauuuacuguuuuuucagaaauaucaaaaacuggaaucucuucuaguccacgagucuucaccuugauuacaguuggagcagaaaaaaacgcaaaacaacaacaacaacaaauugaaacuuuacuuuuaauaggaguaauaguacaaacacuggaaaacauugcauagaaccuauguucuaccacccaucacaauuaagagcuaauacugcuaagaaaguagguucuaacuacacaaaauaaagcauuacaaaguauuuccucaaagagaggguuagaauuuaacaauauuucauaaugguuuucucaggaaauauagccauggcagcuaagaaaauuacauucuauuucccaaguuuaagaaugugguauaaaaaagucuauaccagagauuuccaagcuuaaauaaaauauagaauuuuuuuaaaaaaaagaacacaauuuucuggcugggagcaguggcucaccccuguaauuccagcacuuugggaggccaagguggguagaucacuugaggucaggaguucaagaccagccuggcaaacauagugaaacccccuucuacaaaaaacacaaaaauuacggugccuguaaucccagcuacucgggaggcugaggcaggagaacugcuugaguccaggaggugcagcugcagugggccgagaucaugccccaccugcacucuggccugggugacagugacacuguauuuaaaaaaaaaaaaaaaaaaaaaaggauacaauuuucuuaaguguuccuaggacguauggaccacugauugagaaaauacuaaguucagaaaguuaacuuucugaaaauaauaaguucaguaaccacaugacucagcaauuccacuucuagguauauauacaagagaaaugaaaucaucuauccauauaaaaacuugcagacacagcagcauuauucguaauagcaaaugguggaaacaacccaaaugucugucaacuggauaaacaaaaugugguauauacauauaaugcauauuauucaaccaaaaaaaguccaggaccagaugaauucacagccgaauucuaccagagguacaaagaggagcugguaccauuccuucugaaacuauuccaaucaauagaaaaagagggaauccucacuaacucuuuuuaugaggccaccaucauccugauaccaaagccuggcagagacacaacaaaaaaagagauuuuuagaccaauauccuugaugaacauugaugcaaaaauccucaauaaaauacuggcaaaacgaauccagcagcacaucaaaaagcuuauccaccaugaucaagugagcuucaucccugggaugcaaggcugguucaacauaugacaaucaguaaacguaauccaguauauaaacagaaccaaagaccaaaaccacaugauuaucucaauagaugcagaaaaggccuuugacaaaauucaacaacacuucaugcuaaaaacucucaauaaacuagguauugaugggacguaucucaaaauaauaagagcuauuuaugacaaacccacagccaauaucauacugaaugggcaaaaacugaaagcauucccuuugaaaacuggcacaagacagggaugcccucucucacaacuucuauucaacauaguguuggaaguucuggccagggcaaucaggcaagagaaagaaauaaaggguauucacuuaggaaaagaggaagucaaauuguuccuguuugcagaugacaugauuguauaucuagaaaaccccguugucucagcccaaaaucuccuugggccaauaagcaacuucagcaaagucucaggauacaaaaucaaugugcaaaaaucacaagcauucauauacaucaauaacagacaaacagagagccaaaucaugagugaacucccauucacaauugcuucaaagagaauaaaauaccuaggaauccaacuuacaagggacgugaaggaccucuucaaggagaacuacaaaccacugcucaaugaaauaaaagaggacacaaacaaauggaagaacauuccaugcucauggauaggaagaaucaauauugugaaaaucgccauacugcccaagguaauuuauagauucaaugccacccccaucaagcuaccaaggacuuucuucacagaauuggaaaaaacuacuuuaaaguucauaugcaacgaaaaaagagcccgcauugccaagucaaucagaagcaaaaaagacaaagcuggagacaucaugcuaccugacuucaaacuauacuacaaggcuacaguaaccaaaacagcaugguacugguaccaaaacagagauauaagccaauggaacagaacagagcccucagaaauaauaccacacagcuacaaccaucuggucuuugacaaaccugacaaaaacaagaaauggggaaaggauucccuauuuaauaaaugguguugggaaaacuggcuagccauauguagaaagcugaaacuggaucccuuccuuacaccuuauacaaaaauuaauucaagauggauuaaagauuuaacuguaagaccuaaaaccauaaaagcccuagaagaaaaccuuggcaauaccauuugggacauaggcaugggcaaggacuucacgucuaaaacaccaaaagcaauggcaacaaaagccaaaauugacaaaugggaucuaacuaaacuaaagagcuucugcacagcaaaagaaacuaccaucagagugaacaggcaaccuacagaaugggagaaaauuuuugcaaucuucucaucugacaaaaggcuaauauccagaaucuacaaagaauuauucaaccucaaaacggaaauuuuugaggauaaaccuugaaaacauuaugcuaagugaaagaagccauucacaaaagaucacaaguuguacgaccccacuuuuaugaaauauccagaauaggcaaaucuauagaggaaaaguaggcauuggcuggacaguggaaaugaggagugauagcuaaugggucaguguuucuucucugggugauaaaaaaaaagauucaaaauuagaucauggggaauauuauuuaacucugugaauauauuaaaaacuaacugcacccauaggguaggugaauuuuacacgauguaaaucauaucuuaaugaagcuguuaaaaaaaaccuaauucucauagacuuucccaagacccauggaaacugaguaagaaaauacuuuagaaacuaaauucaaucugugagacagaaaauuacuaguaguauugguuuucugaguaaccaguuaaugaauguuuagaagaucacaaauaaguuaauauaaaaucaaggaccuucaagaauacagcagaagucuucaguggcuggcaaaccccaggucugagaaauucugauucagaacacugcuuauucuauuuuucauuuauucaaaacuucugauacagguugaguaugccuacuccaaaaauggaaucuuuuuuggauggaauggaauccaaaauuugaagcuuuuugagcacugacaugaugcccaaauucucuaaugagcguuuuggauuuacagauuagggcugcuaaacuggcaaguagcugcauaaugcaaauaucucaaaaucgaaauaaaucugaaguccaaaacauuucugguccuaagcaauucagauaaggaauacucaaccuguagugucaauggauagagggucucugaauggguuucaguagucugugaauccuucugaaauuauauacaaaauuuucuauauaguuuuacagcagggaagaaucuuagcuuucaucagaaucuugaaaaaugcccaugacccaaaauguucauaugcacaauacugacaaaaaggaaaaauaagaaaaauaagucacaaaugugguaggcauccaaaccaaaauacugugaccuacaaaucuguaugguuuugguagauguuuggauuugaacaucuagguuuuagcaguagcagccauggaaucaaauaccgaaugguggaaaugaaagagagaaggggaugaacagaauuuaaugaaaaaacaauuuaaaaauuuaucugaggugcaaugcauaaagacaguacaaaauaaaugaaucaauuucccugugccauuaugaagugaucuuuuaacaaacuucuguaacuguacugcuacaucauuuauuaauauacaucauagcuaauaucuaaguuuuuaccugcugcucaugauauauucugagagccuuuuuuacauuggacacuuuuggagaacggauaggaagaguuuuuauuucagaugcuguaagaguacucaaaucaccaauaguuuuuauauucuuagcucuaaugaguugucccaggccucuugcccuaaacaaaacagaaacaggaaauuauaauuauauaguuuuauuuauaugcuauuugcaaggguuuauccaguucaauuuccccauuuaagcucaaucauaacugagguuagcccacagugaagacaggcacauguauguguaauuuaaaacaaaauucgaaucugauguguaugucugguauaagcaacaguacuggcaacugaaugagcccacugcgugccuugugcuucuacauacaucucauuaauagauaauucuuaaguacacauaauccccuccccaacuuuaaucagaaauggacuugguaugucugauacauauuacugcaucauuaaauuccucagagaaguuuaagaauacuucaucuccuauuggggauuaugcuacgacagggcagcuugauaauucaguuaaagagaaacuaucucaaggcaucacaaacuaccugaaauaauucuuuuaaucaagauauagugaacgaucuacaugcacgcauuuaaguuuccaagacuuaaaacaucaaggaaacaaacuuguaauuagaaacaaaacaaaacagcugaugaacaaguuuuauguaugugagucucaugcuucuuacaugugaugacuuaacagcugugugguuuugcugguaaucuuuguaaacuucauccuauaaaguagaaaugauauucauauuccucauaagguuuauauuuggauuaaacaagauaaugauauaaggguucaaugcagcaccugaaauauuaugcauacaucuuacuauacuaaauguuuuucauauugccuuaucuggccuaccuucucaguugcauuuuuauuucaaaaauaaaaugugugugagaguacaugccaaucaauucuaaacaugagaaccaagcaaucagauaaguccucuuaaauaaguggcaucuuggaauauaagcaagaagccuaaauaaccacuuaccacauguuugauguaaucugagguaaaaugaugucaacuggugccacacaguucaccaaugguggguaaacacuuucuguugggcaugguauggauucuuuggccauuucugaaaucuuagaauaaauuucagaagcuguuacacagaggucaacugacugaacaugaaaauauaaagugacaugaaaacuaaagcacuucuuacuaaacacuucuuugagcucuuaaauuuagggcuacgugauccuggggacagaaauccuuuggcugaagugguauuaugcuagauagaagaaaggagagaaaaaaacacucagaacccuagaugacuauaauuucacaauuuuuacaacuuagacugcaaucauuucuuuaaaaguucaaaaaacauaaaaagaguaaucuacuaccuaaucaauuacuugcuggaucauuacugccucuuaccuuucugcuucucuuccuuucugcuuaccguguaccagacaaaagaauauauuuuaaaccaaggaagaaguuuuucacauauauaguucauuuuaugacacaucauguacauguaauucugugucgguauacauauauguauauuuuaaagccuauagcuuaccuuagauuguguaguaggagaaguuuuaacacuuuuuccuaugggagaacuauuggaagaaugggaccuaacaauagagcaccgucuaucaaugucaucugccaauccugcuugguauauuggaucugcaaaggagacacggcgaaccugaaaacacaggucaggauuuuacuuaacaaaauuaaaguuuuuaaaaaauuacaccauaaauuuucauuaugagguuacccaaaaauagaauguggguuuagaaaauuuauuucaccagaagucagcugcacaguuccuagcgacugccuucacagaucacauuaacucaauaccacaauucacucuaauuuucuauauuuuaaacugucucugcauaauaccaaagauugugaaaaaggcacaguaacaaaaacuuaacgaagccagauguggcaguuaaaaguguacgaucugauucuaggaacuuuaugggauuaccagacuagaaagaagacugauguaaaaacagaaaugugccaggcgcaguggcucgcaccuguaaucccagcacuuugggaggccaaggcggguggaucucgaggucaggaguucaagaccagccugaccaacauggugaaaccuuaucucuacuaaaaguacaaaaauuagcugggcuuaguggcacaugccuguaaugccagcuacucaagaggcugaggcaggagaaucgcuugaacccgggaggcagagcaugcagugagccaagaucgugccacugcacuacucugucuuacagacagaguaagacuccaucucaaaaaacaaacaaacaaaacaaaaaacaacuuaaucucuagauucucagcagaagaauuuucaguguaucuugcaaaguucagacacaugaauaagaguaacagggauuuugaaagaacauuuuuuuuucuuuuuuugagagucucgcucugucgccaggcuggagugcaguggcacaaucucagcucacugcgaccucugcauccuggguucaagcaauucuccugccucagccuccugaguagcuguaacuacaggugugcgccaccaggcccagcuaauuuuuguauuuuuaauagagaugggguuucuccauguuggucaggcuggucuugaacucccgacccucaggugauccaccugccuuggccucccaaaucccaugccugggauuacaggugugagcuaccgagccuggccaaaggaauacuuucaaaguguuguuuguugaaggcaaaaaacaaggugucaugucuauauauucaugcuuguauauauaaaauguauucuacaaugaauagcagguucaaguucaaaauuaaggaaugccaacaucauaccuuuucaggauaucuauuuuguuaaguauaagacaaguugaguuacguaaauacauuuaacuuuuccuauuuuuuuauucauucauucaacaaacuaugugcaaggcacaaggccugaagcuaaagcagauauauagauaauccaucuuuucuaaaguaaaagaucuauaauuuagcugaggaaauggggauauaaauaacuaaauaagaucacaucuacaaguugaugaaggcacaugaguuuuuuuuuuuaauuagauauggucuggaacauguauguaaaacguaaaacagcauaauguuccaacacacaacuacuaaaucugcuuuaucaauggcaguguugccugcauuccuaaaucuguuuccucauaugauauuaugguauggggagcagaaaagaugcuaggagccuuaucaauuuugccaaaggugaacaaugugcacagcugcauaaagaucuuuaguguuguaaaaugaaagacuuaucuaaaaggcuucagucuccuuuuuucgaaaccuuuucuucuaccuaccuuuucccuagcaaccauuaugguaaauaaucaaaugaguggccauauaauuguaauauuuugucauucaccagaggucacuguauggccaaaauaucccaaccaaauacuggguuccuuaauauuuagccucauuccccuuaccuuauuaacaggugaugagauuucaucuucuugggaucuuuuuaguccucucuuuaaaaugcucguagacggagaagccaaaggagaccagacacagcgugucugcaugccacuaggacugucauuugcugacacaagugaaggaucaaguucccuuaguuuuugaggagaugcauuauugucuucuauuauuagcucagagauagcuguuccagaugccagacacugugaugguuccuccacuuucugugaaguauggugaucuuccuguaaaauaucacuuuccauuaccauuugauuguuaucuaauuuuucuucagauuuacuauacucaguauuuguuucaguuuuauuagcgucaaugauuccuucuucagugcucauuucaacugugucacaaacaaaguuguccauuucugcagucaacauguuuguuucagcuucaucaggcuuugagguuuugguaguuaugcccucauucucuguuucaccaucauggccaguuucagccauugccucgccgaucaucauuucuucauuauuuuucauuuugguauucguuucuucagaugaguguagaucagauacaucauuuccuccaucuaguuccccagcugcuguuuguucagaaaucucaguuugagcauucaauuuuacagguguaguauuaucagaaagacuaauaucugaauuaaauuccucaguugcuacuucuuuggcauucaguuuagcugugucugcuucagagucaucauuucuuuuauuuucuucuauugcugcuucuucagaaauaccaguuuugguucucucuuguccaugaaagcuagcuucauuuccuacauucaauuccauaguuuuugcuuucucuagauuggauucuguuacuuuacaugcauuuccuucaacaguaacauucucuagacucaguuccauuuuugggguuucuucugguuuuucuucuuuugucuccaaagauuccugugaaacauuuuucgagucuccuaaacacgggccaacaguuuuaaaauuuucauuaggugacuccuggcuuucaagagacauugcuucacuagaauccauaucacaaauuuccucucuaaaguuuacuauuccagaaggaagagauucuugcauaguguuuucuuuugauuugguuucagaaacaauuaaugaaucauuaauaguaucauuauccucuuugagacccaaaugaaaauucacacuaugauguucaucuaaaaauuguccuucagaauauggauuagcuugagaaguuucugaugggcuuacaggugcuugcacaucugccuuuuuuguuucacuaaucucuacgucauuauuuucuguauucuuuaacccaaugagugacuuuuccugagguugugauuuuuccccacagcaaucacaaccuuuagaucuccucacccuccuacuucucuuguguuggcauucaaguguuugaaaaguuuuuucugaaagcgaagaaauaucugauaucccuauuuuugaggauucucccaaacuacaauuaucaaaagagucucgcuuauguaaucucuuaauggcauuucuaguccuuagauuugauucuggcacagguagacuuguaaaggaauauucugcauauuugcuaguuucauuuuuuuccucacacacauuugguaaaucaucaggaacuugcaacaaaucugaaguuacuguagaauccugacauauuacaguauuacuuucaucuuguuuuucgcaaaucggagauuuuaugcuuacaucuucuucagaaguugcuuuauaaucaugugacugauuuucagcuuuuauacauuccuguuucaccacuuucucuucuugaucuugaaugucaacacuuucauugcuuuuguuuuuccauuuuccagaucucuucuuccuagaaccuucuucuuuugccuccgaacuaucagauucugaguuuucaaugcuggaaagcaaacccugagaugcucuucuaguuugauaccguguucggccucugacuaguuucucagaggacuuaucuacaauguccuggguaccaucccccucagacuuaauguucucagggucugccuuuuuuuuauuuuguucaguuucugcauuagcacuaguuuccccaagagucuucucauguaaauuacuuccuuucucaauuaaauucuccuguagaguuuguucagcaaucaguuuuuguuuagguaacacaucaucuuuuauaugcaauggacucuucugaagagguuuuucuucuuccuuacgucguuccuuuuuuugaugacuauuuuccuuaucuuggcuuucagugguagacucuacuacuucugaacgucgccuugaagaccgucuaaggguuuucugauuuggaguuaucugaaccugacuauccucauuuaccauuugaucugcugauauuacuacuggggguguauucucuuuggauuccaaauuaauuucuacauuuuucuccucuacaguauuaguuuccaauaauacagcauuuuccacuguugcugcuuuaagcuuuguauugucaugcuccauuguagauucagaaagaugaaccugauuaucugacacacauucuguuugauuaagcaaaccagguggguuauuuucuaagacuacaaugccuucaacagauuccucaguauuuuucuccggcucagaucucauuaagggcuuagaccuuuuauucccuguuuguucagcuuuaccagcucuccggcuugaucucuuaguuccauucacuauuuuuucagaaucagauuuugaaaaagucccuucucuuugcuuugcuuuugguagaaaaucuguuuuaaucaugguuuccugguuauuuuucacuguaacaguugaugaaauauuauucaagggggauggacuaaaaggucuauuuucugaaccaucaaacuucuccaaaguaauaaagguuugccuccgacuuguaggguaugggggaguuccagcaacagugguauuagaaacugaacuacugcugacaacgaaagaauuuucuguacuagaugcacauucaguugauguuuuccuugaugaaauuaaagcuuuuuuucuuucaucauuauuacuguuugacauuucuggacugguuuugucaagagaaccacacucauuauucgaaagggaggacuuuucaagauguucagccauaccacagucuuccgugacaucuugaggaaugacaaugucacuguccauuugcuccuccugcacagaaauauauacauauauauacacacacagauuaauaaccagcaaacgaguuugacuuucugggaaaacuuuaguguaaaacuucgguaacccaaagauaaucacugacauucaauauauggcaacuauuccaaaguuagugguagauaccuaacaguuuguguuccuaauuguaaauauucaagaaaagccaaguacauuuauuuuauacacacacacacacacacacugacuagugucugcugauauucugcuaguaucugaaugggaguuaaaaggaaaucauacaauaaaucuacaauaaauuuuaaaauuaauaaagggaagaccuacagacauuucagcaguuuaacagacuguauaauggaagggugauucuaaaaagcccaaaauaugaaaugucaaacauaccguaaucaucaucuuagaauccuccuuugguuuucugguuaaaguaggaauuucccugaaauaaauauuaguaagaauauuauuuuuauaauuauuugaaaaugaauaaaacagauauaaaaguuugauggcuucuguacuuacauaggcucuuccugacuauacugaguaaauaagguaucuugggaaacauccagauuauuauacauggcaggaauaucacaccugaaaaaaacuauauauaaguaacuucaaaaaccggaugauauucuuacaauuagaaauuaaacuuauggccagguacgguggcucacgccuguaaucccagcacuuugggagguugaggugggugggcugcuugagcucaggaguucaagaccagcaugggcaacauggcaaaauccuaucucuacaaaaaauaaaaaauuagcugggcaugguggcgugcaucugcagucccagcuacuugggagguugaugcgggaagaucacuugagcccgggaggcagagacugcagugagcagagaucaugccacugcacuccagccuggguaacagagagagacucugucucaacaacauaaaacaaaacauaaaaagaaacgaaaauuacaguucuacuaaauuguuauaaaaucaugaccuaaaugcguauuucccaccucagagaagaaauucaguuuauaaauauuugguacauuacuagguagcuuuauacauuaugaaaugcauuuauguaaaguauaacuuuucgcauuaaaauuuaguacacguggccgggugugguggcucacaccuguaaucccagcacuuugggaggccgaggugggcagaucacgaggucaggagaucaagaccauccuggcuaacauggugaaaccccgucucuacuaaaaguacaaaaaaauuagccgggcgugguggcacaugccuguggucccagcuacucgggaggcugaggcaggagaauagcgugaaccugggaggcggagcuugcagugagccgagauggcaccacugcacuccagccugggcaacagagugaaacuccgugucaaaaaaaaaaaaaaaaaauuaguacacauauuuuaguucuaaacacaaaguuacacuuuucuugcaugaaaucuaagccugaauaccaaauacccaacucaagauaaaaggccuacaaaccgcuuuguuuugagaacuucuuuuugaugaucaguuaauauucuuuccuuugcaucuuuuccuucuggagguauaaacacaaagucaguagacuuuuccucuuccaaaagaauuucacccuuuacuuuuaaagacgaagauucaaguuucagcugcagauuugaaaaaauaagcaaauguacauuuuagcuuccaaauuauuuuccaauauuucuaucacucuccucuaauaaugacaccauuuuucaauagugauuaugaaaguugaugauacucaugauccguaacaaauuaguacaauguuccccacuuucuuucugccucuaauaaauacuaagaaaguagacaguauuaaaccucuuuacgaaguagggaagucugugcuuaacuacaaaguauggacaaaaccgucugucaggcuaacacauggaaaugaacugauuuggcaggaggagaguauauuugcagcucucaaguugaggcaugacuuagugaaagucgccaauacaaaaugcccuacauacaaguaacuuugguacuacaauauuaucuuaauaaauguucauuggaaccauugcuuuaauucuauuuauaguugcuacaagaauguggcagagguauucuuaaaaaauaacacuuuucuuucauuucaccagggccauggucucaagauucuagaauaaccuuuacuggaggucauggaagagagaacuguugucuaaaagucaaguuaacuggcaacuagcaugagcuaguugauaagaacauaggugucuuaucuaggcauuauuuauuucuauucaaaauauuaaguucuaaaauaacaauaauccuaaacaaaaguucuaaaauauuuucucuugugcuaccuauguuagucauucauaacuagucucauuccaucucaagggggcugcugccuggaauaacuacauguaacaguugcuaagcauuacacagaaacuuaccuuuccuaaacaggaaucaucacccaaggcuucuggguuaccaugcuauccuagcagucuuucuacaucaaaugcccucaauuccccugcaaucccaaccuuuauuuagucuuuuauaguucuuucauccaauuuuuaaaguuguauguaaguuacaauauacuuuaucuuaaaauuuuugauuaaacuuuugaaaacauacuuuggcugcugguuucauauuuucuuuuuuauucuuuguuugugccaaaaaugaaucucuuuuuccauuugauuuucucuccaugccacuuaucuucacauuuaguugugaauuuucugucuguuuuauuaaaaaugaaacaauuucauuaaauagaacgguaauauuuugcuuuuccuuuucacguuuugaaaauuccuaauaaauaguaauugcaaauauugucaaaauuuuucuaauuauucaaucccauaaaaaucaaagaaaggaaagccacugucuaauucaacagcaaauggcuuuggugucucuuuaauaguagcuguuuaauaccauucaauuuuaugaauucugaaaaugagacaugucacauaaacacauaaagugaauuaaauuacuacauucaaacacucuaccuguaacugaaaauauuucuaagagaauauucaaagccauagaacuuuaaacauuaaacaacugaggguuaauaaagcauguaugacagagcauauuuccccucaacagaauauauagcuuuuacagaccacauuccacugaacucuuucacaagucuguuaguuaucuaguggaaaauuuuuacuucagccaaaagcaaaugagauacuuaguuggcuauaacagucuuuuuucucccaaagauucuaaacaaaauuagcuauacccuagcugcuccugaauagaaaaagguuuucuaagaacacucuagcucacaagucuauaguacccgugccuuuaacuacuauaucuucaggcaguaaucaaauauuauuagccaaagaaacuuugcuccuaaugccaugugacagcaaagauuuauuuuccugauagaagaauugagaaaaucaauuuuuuaaaaauaagaaaaugaacagcagcucuggcuuagauauggcuuaguaaccauuauuuccaguuuuuccaaagcaacaauuauguauuuuacucuuugugaacagcacagaugagguacccgaguucaaaacaaaugauuaaugacaagaauuagagauuauuuacaugagaaucucuagugaaaaaucacaaaagaaauuucaggccacaccacugacaauguggaaaaagccuauguuacaaaacucuuuucuguucagguucuacuuauuuauaacuuucaacaaauaacuuaaauguccaaaaacaaaugaacaauaaaaccccccaacuuacuccaucagaauaugguccacuggauuccuccaucauuucaacaguuuccaaaccaggcaacaggagcagaaauuuuuguuuggcuuguguuaguacuggucuuuaaaaaaguacauaaaauauauaccuuaagucaaguaguacuggugaacacugaugaucuguuaacaacagcacuuuaauuuuuagagcagcaaaauacaucuuuauuuuuaaauaaagacuguuccuuacuauguguauauaaaacugagaaaaauuaggcaauuuuuauauuuuucccuguacuuuucugaauuccaaauuuuuaucauggaaaauuccaauaagaaguagaauauuauauaaaguauucaugucuagcuuuaauaauuauccaggcagggcacaguggcucacaccuguaaucccagcacuuugggaggcugaggcacgcagauaacgaggucaggagauugagacgauccuggcuaacacagugaaaccuugucucuacuaaaaauacaaaaaauuagccaggcaugguggcacgcaccuucagucccagcuacucaggaggcugaggcaggagaaucgcuugaacccgggaggcagagcuugcagugagcccagaucgcaccacugcacuccagccugggcgacagagugagacucuaucucaaaaaaaaaaaaaaaaaaaaaaaaucaucuauuuccuguccuccuugucucuuuuauuaaggauaauuuaaacugcuuuucuuggcuccugaaaucaagauuauucuaagcaccaaugaaaaggugaaauaauguuuaauaauuaucauguauuccaaaugguaauauuucaacuaaggaauccucuguaacaauaccccauaagaaaagauuauuugaaucaaaguaucaauuuauaugaucacaacagaauaguuaguuguauauaaguuuuguuguuagcauacuuuaacucuucaggauaaaccaacaucaucacuuuggcaaaaguggcauuccagaacugagcacucuguuuucgaaucuguuuauucuugugcagaaauauuaugcauaauaguggggagaguuguucaagaaguucacuaucauaaguuccgguguagcugaauugcagacaagcaauaauuucucccaguagcuuuucuaacuaggaaaaacgaaaaaauaaaagcaaaacauauacuaaauauuaacucacagaauauauguugcuauuucaauuuuuaaaauuaagacaauuuuaaacuaacccccacuguugccuuaaauauauaucccucuuuauaacucgacaaauuaucaggugaauuugcuuugguuauuaauauuacaguucaauuuugaacuuauuuucuauuaacaaaagaaauuauguuuuuguaauaauuauaacaagauaaauaguuaccuacauacguucaccuagaaaacuuuggguccaaucgccaucauauacaaagggaugagcuaagaguugauuaacuaggcugggcucagugguucacgccuguaaucccagcacuuugggaagccaaagcgggcagacugcuugagcucaggaauuugagacgagccugagcaacauggcaaaaccccgccucuacaaaaaauacaaaaauuagccaggaguggugguguaugccuguaguccuagcuacuugggaggcuauggugggagaaucaccuugagcccaggagggcaggggugugguaagccgugaucgugccacugcacucccagcuaggugagauuuugucuccaaaaaaaaguucauuacuuaacaugaauuuaaaguauuaaauccuuaaaaaaaaaaaaacccuauaaauguguucauaugguguuauuaaauguccauuaaaaaugaagaacaggacaagcguguuggcucacaccuguaaucuuagcacuucgggaagccgaggcaggcgaaucacuugaggucaggaguucgagacaagccugcccaacauggugaaacccugucucuacuaaauacacaaaaaaucagcugggugugguagcaugugccuguacucccagcuacucaggaagcugaggugggagaaucacuugaucccaggagguggagguugcagugagccgagauccugccacugcacuccagcuugggugacaagagcaaaaugcugucuccaggaaaaaaagaaagaaagaaggaauaaccccuuuaaaaaucagcagaauuauguuuaagaaaauuaucuaaacucuaucauuuucucaucaugaaaguaugguuuauggagaauugucuauuuuuaccuuguuguucagacaacuauauacuuuaggaacuucaucaagccuaggaaggauaaaauagaauaccauuuauauuucugcaaguuaacacuguacuaucuaucaagcuaauccuaagaaaaagguaauaaagacauaauaaauauaaauugaugauauaaaaaggugcccaaagacuuaacaaguaaaaaacucaaauacuaaauauuaagcauaaaaccaucccaucuuugaaaaaugaaucacagaaaauaucuacaauaaaccucaaaguaauaaucauauuaacugcuuguuucuguacauuucuuuuaggcauuacuuuugaugaaauauagacuuaaagauuugcaaagaaaaguucauggauuuggagguuguaucguacuuuauaaaaucuguuccuaaaacuuuguuaauuuaugaaagauaaacugucuucugaaugaaccacacaagcuugcuauaaagaauauucaugaauccuuucaaaaugcuuguacgaguuuguuacugaggcuuuuuuuuucuuucagguuuuaaagcacugcuugcuucgauucaaauaaagggugaugcaaaauuaauucaauuuuuuggagaccaauucagacacauaaauguguauacccagaaauaguggcaaaugugggcaaugauuuacguauaaauaauguucaauuguuaugagggagaacacuagaaaaacauguauguccaccaaucagaaauuggguaaaaaguuuaacagaaucacauguagacauuuuuaaaaaugagauucucauguauaugguacaaggacagaaaucccucaguauccaugggguauuagcugggcaugguggcggcuaauuccaggaccacccuccugccaagauaccaaaauccauggaugcucaacacucuaauauaaaacaaauuguauuugcauguaaccuacacacauccucccauauguuuuaaaucaucucuagauuccuuauaauaucuaauacaauguaaauaauugucauauuguauuuauuugcauucauuuuauuaauuuuucuaaauaguuucgauccaggguugguugaauccaugaaugcagaacccauggauacaaacagccaacuguauuaagugcauaccauauaauuaauugcaaaacagcaugccaaguaagcuuuccuaucuaucaugcauuuaauagguaugcuuguuugcauaaacaauucugaaaagguaagcauugaaaagcaaagggaaagggaaguaacaggcaaaauagacuuccaauuucucucucauauuucuauacuauuuuaacuaucuuuucaacaaaaguguaguuuauuauccucuccacaaaauugucaagacuaccaucuacaacacagcugauuaaaaaauaaaaguugcuaccuauauuuaaauuguauacauuuaauucaaagcuacuuaguccaaaauacuuacuuugaguuuucauaaaauaaugccagaggucuuguuaaaguugcaaauauuuuucggaucauagaaggcaaagaaauaugcccaaguacacuggaaauaaugccggugauugaguugccaauagugaagaggguaucagaaugugcuuccuugaagcucaguguguggaaagaauagaucacuuucacaauaaguuuaaauaaagaagucaauuucccuaggggcucauucuucuuuuuggaccaaucugaaggucucuguggugcuaaaaacaaaaacugaauuaauuaaaaacucaaauaaauugaaaauaggagucacuguccacuuuuacaauuuauagcucacauuuaaauguuagauacaucaaauacauguccguuugcugacugacaccccaaacaaaucauaacauaauguaccauuaauggauaaguaucacuagaacauuaucuuuacaaaugagaaugggagacgaaaacuacuuggcggaucaugaauaugaauuccagaaaaacaaguucauuuuuucuuaggaauuauaaaaugcaucucaaacuuuaauuuuacauuucauaaaauuucaacaacuaauaugcaagaaaguaccaaauuacauaagauagguuccaaauuuaaauuuugaaaguuaguuuuaaaaacaaaaaauuuccacuaagaaugacggaccauuuuuuugcucaucuauaguacauugaucccuacaaauaacauugaacaagucagagauacaaagcugagaaagaaugcaguaagucuacuauuuccuagauauaaagaaaaagauuuguccuaaaaguacugucugauuuuuuguacccuuagauaaucccucuguaaacaucuaccuagaagaauaaacccacauagcccuugcccaaaaaauuuacccauuccaaaauuacuuguuucucucaaucaauccauucuuuuaaggaaugagaucucaaauuuaacagaaaacgaaugcuuaauuaaaauuaaucucauaugguaacaugaaaaacaaguguugcuacuaaaaggaaguugaucuuucuccuuggaaucaauuuuucagacauuuauguacacugaaaaacuauauccagaaauucccugacagaaugcugaggugaggugacagccauuaugucaggagacugguuacauacaagugaaugaucaaguuguaaauacauugaggguaaugaaaaccagguuucucacuauuagagacaguagagaaaaauacagaaaaggaaugaauagcauaauccaugugauauuagaugguaaaugaaaguguaucuagagaaacaagcaauaauugugccacaguaaguauuuaguaauuaaccuuacaguggaaaaccuggcagaugccauccucaaacaaacaggaaguguuaacaucaccaguaaugggaaaauaaugaauugaaaaagaacuacagcauuauuucugugguacuccaguaaugaauggacccugaaucuaaucuuaaagcaauaugguaaucccagauugagagacucuaagaaaguaaaauugccuuuuuuuuuuuuuuuuuuuuuuugagacagagucuagcucuguugcccaggcugguggagugcaguggcaugaucucagcucacugcaaccucugccuccuggguucaggagauucuccugccucagauucccaaguagcugggacuacaggcgcgcaccaccauggcuugcuaauuuuuguauuuuuaguagagacagguuguagcccuguuggccaggcuggucuagcacuccugaccucaggugauccacccaccucggccucucaaagugcugguauuacaggcgugagccacugcacccagccuaaaguuguuuuuugaaagacauaaaagacaagacugaggaacuguuccagguugucaacuugucuaaaacuauaccuuaaaaugguucagaagggaaaaagaauaaaauguauauucuggggggaggggggagcagauaagauaaaugcaaucaaccauuaauugagaaaccugaguaaaggaauacgaaguuuccacauaaacucuugcaguauuucucuaaauuugaaaucaucacaauguaagucaccaaaaaaucccaaggugauccugauaauaacaauuuccuuucgguuagucuuaacauuguuuccucuucucaacuucuuuuaaaaaucuccccauuacccaaauuuuacagcaagagaacucuggcucuguuuugcauggacacggaguggaaaagacauuuguaacuguggguuccugaauuggauauucgguuaaaucuaauuucagaaguaccaacauagguaaaauuaugucaaaaugagacugaucaucuucgcucuaugaaacuucaguggcuuauaauuucugacaucaucuguuauauaaucuugguaaacuuaugauuuucagagauaagccuauuuuucugacacacugagguaaucauauuagguccuggucagaccaagaggagagcuaagaucaguaugucaagaacaucuauaaccuauauuuccacggcacucaggccgggaugcucugaccuauaauauacuucaggagcuuaacauguuacuccauauugcuacuuaguaaaaauucaaaaaccaaaaaagauucuaagaauguuuuagaaaacucaucaauggcaaaucuuauuguuagauaauuuuaugucccuaaucuuuaaacaagaauaauauaucucaacaucaacuaacauuuuucauuaaugacagauuaucacuaccuauaugguaagaacauauaaacauagguggauauaucugacuucaaugaaucaauuaacagauuuuaaaaacuauuugcuacaaaauaacuuaaaacuaaccaaggcauaugguuuuaaaaaucacgcaacuuguuaugaucccaauuguccaauuuuaaucauuuaauuaccauguuucagguaaacgaugaguuaaacuuuguaacauuucuggaaaaaaauaaccaauuaacugaucccauuguuuucuuuuaaauuauaaugucaauucaaugacuauuuuaaaucaggcuugcaaauaaaaacauuuuaaguuaugucuaaguuucuuguccagguaauccuucauaccagauggaaugaguaaaaccauuuguacuauuaggcaaucucuaauuagaauaguauuuaucuuucugcguuguaaaaaggaguaaagaaauuuugugugauagagauaagagaaugauacagagcauaugaaaauuaaaaagaaaaaagagagagaacauguaugaaagcuccuagcauaguaacuaacaugguuaaacaagaucaaaaguuaguaaaaugagguggcaaagguauuaggacuuccccuggcaaaguucaguacugcuuaugaaauacuggacaaacaaagguuaaaaaauacauacuuacauuuaacuuugggcugauauuuaauauuauauggugagaagucaaugcaaucaaccauuacaguaauaauauaaauaauucuauccacgaacaacaaauucuagggaagaaaguaccacuguuagaaacauucaaguacugggacaguauucaacaaaaguaagcaacaugaaaaaauauaagacuguuacucccauauauccuauguaacacacaugccacagcuuacaguacauuaagugcagccacccacggcuuaacagagauccacugugaaaaaugggucaucaggcaauuucaucuugugagaacacaguguacccacacaaaccuagaugauacagccuacuacacaccuauauagucuguuguuccuaagcuacaaacacauagccuaggcaccuguauagguguguaguuacuauacugaauacucuaggcaacuguaacaaaaugguauguauuuguguaucuaagcaucgaaaagacacaguaaaaauaccguauuauaacguucugcuuaggauauguagcacuagauuugcggucuguuguugacugacacauuguuaugaggcgcaugaccauacaugauuacaaaucuuuuucaguuaacugcugagucaaacacuguacuuucucuuccucaauauuuaagaaaaauaauucacuuuuaagauccccauaaaagccaucauaucaaccaauaaacugagauuggaaauacuaggaucacagauucucuaucaaauuccucuugaaaauuaugaaguaaaaguuuucacuaaacccaguggaaacaaaacauaaaaagaaguugcuggccaggacugguggcucacgccugcaaucccagcacuuugggaggcugagguggguggaucaccugaggucuggaguucgagaccagccuggccaacauggugaaaccccgucucuacuaaaaacacaaaaauuagccaggcgugguggugaaugcuuguaaucccagcuacucgggaggcuggggcaggagaacugcuugaacccgggaggcggaggcugcagugagccgaguucacaccauugcacgccagccugcgacagagcgaggcuccgucaaaaaaaaaaagaaagaauuauugcucaggaugguguuuuuaaagacacauuugacacaaauuuucaagaagguguaauaaauuucaagcuaguagaauuuaagaaaaaggcaguaacaaggaacacauuacaaugaaaacaucaguagucauuaaucucuaauguauaacaauauggcaucaaaguauuuaauaaacauguuaauauacagcaaauucauaaucagggagauaccugaucccaagugucuuauaaauaaacaauuauaaaacuacauuaucacaguuauaacacaggaugaauuccaaaauuagaaguccuagaugauccucucugaucacaauacaguaaaauaaaaaauuaaugauaaaauagcaacacauauccauaaaaaauucucaaauuacaaagcacccuuccaaguucccuggugcuauuaaaaaaaaaagggggggacaucaaaggcugggugugguggcucacaccuguaaucccagcacuuugggaggccaaggcaggcagaaucaccugaggucaggaguucaagaccagccuggccaacauggagaaaccccgucucuacuaaaaauacaaaauuagccaggcgugguggcacacgccuuuaaucccagcuacuagggaggcuaaggcaggagaaucacuugaacccggaggcagagguugcagugagccgagaucgcaccacugcacuccagccuggacaacaagagugaaacucggucucaaaaaaaaaaaaaaaggcaucaaaguagucuauaugaucacugauggcaguaaucaaagucuuacaugcauauguuugaaaaaagcuuuaaaacaaaaccauucaauguauuaaagacaaagaaaaguaaaaagcuguguaguaaugaucaauaaaauaaaacuacauguuguuuuccuugguagacuuagauaagccuuuaauuaccaaguccaaccaagaaaagagaagacuucagaacaaaaagguuggugggcuuggcaucacguaguccaacccacucgggagguugaagcaggaugacugcuugaacccaggagguggaggcuguagugugcauggugccugugaauagccacuauacuccagcuugggcaacacagcaagaccucaucaagaaagaaagaaaagaaagaaaaagagagaaagaaaaaaagaauacaacuguagauauggcauuccuuuuacacuauauaaauuggugaagaacaguuuucugaaucauucuaagaggucacuauugccauaauacaaaaauugaacaaugagaacuccaauaucacuaaugaagauauacaugcagaaaaaaacauuaauccuaugauaauuuaaaagaauagcacuguaaccaagaaguguaucccaaaaacacaugauucaauacaaggaaguauguaagcaacaacuuuuauguccuucagcaacaagcaaguaugagggaagaacagacccauuuauaauguuaaaaaacagcuuaaaaacaauaaucaaguuagguuaacuuuagaagaccuaaauaaacacaaaucccuggaaggaacaauuugauuagaaagacguaaauucuuuuccgaauuaaucugugaauucacccuuaucaaagccaagcaaaaucucaacaggguauuuugugaaauuugacagacuccaaguuucuucuggaaaagaacaaagggagaaagccuaacuaagaccauuuuuuaaaggugauaacugagggucaaccuucuuccgaucaguuauaaaaaccugcacauuguuuauucaguagacagaucccagagauaaucaccaucaugacagacaaugucccuaaccucauggagugugggugaaauaacauaauaaaguacagaaauaaacaauuucgagacaguacuaaaaaggaaauaagaugcuauacaacaaaaauaaacaagcgcgauuagguaaguccuuuggaaaaggaagcagaaaccucauggguaguguaaggagcucagauuuuuauuccaaaucuaacaaaacacuauaauacuucaagagugacaagaucugauuuacauuuuuaaagucacuccgacaaauacaauuagaauugugcuaauaacaaguagaggauauguauauaaauccauuuaaaacacuaaaacaaugaacaucuaacuauggguagugauuauuacugaggagaagacgugugagggggaauuugcuuuguuguuuguaaucuuuuacaauaagaacugucauuuuuggcugggcgcggcggcucacaccuguaaucccaacacuuuggaaggcugaggugggcuaaucaccugaggucaggaguucaagaccagccuggccaacacggugaaacccccucucuacuaaaaauacaaaaauuagccaggcaugguggugcacaccuguagucccagcuacuagggaggagaaucacuugaaccugggaggcagaggucauagugagcccauauugcaccaaugcacuccagccuggguugucguccaacaaucacugugagacucugucucaggggcaagaaaaaaaaaaagaacuguuauuuuuacuuucuuuuauuccucauuaaaauauguguuagauauaagcuauagagaaaacaggcacaacaaauaucauuucaauaaucugcauggaaaaacaacgguuucugugugaaggccauuaccaggaucauacacaguaauaaauaauagaaaaaaacaaaauguccuuaaaauaacagaauuccaggccaggugcaauggcucacgccuguaauccuagcacuuugggaggccaagguggaucaccucaggucaagaauucgagaccagccuggccaacauggugaaaccccaucucuacuaaaaauacaaaauuagcugggcaugauggugugcaacuguagucccagcaacucgggaagcugaggcagaagaaucgcuugaacccagaaggcggaggcugcagugagcugagaucgugccacugcacucaagccugcgcagcagagugagacucugucucaaaaaauaauaaauaaauaaauaauagaauuccaaguaaugguacaaccauacuacagaauacuagacagcaguugaaacaaauaauagagcuauauggauugacuugaaacugagccaagacaguguuuuacgaaaaguuacauaauuacuuuggaauaaaugcaauaaggauuucauuggcaagaauaccauauauucaaaugcauaugcaaggaucaauauacaaaugacaugcguaaacagaaagaggucuauucuggaaugacgcauaucaaucuguucccaacagcuguccuuuccaugaggagggaaagaaagaggccgggcgcgguggcucacgccuguggucccagcacuuugggaggccgaggcgggcggaucacgaggucaggagaucgagaccauccuggcuaacacggugaaaccccgucucuacuaaaaauacaaaaaauuagccgggcgugguggcgggcgccuguggucccagcuacucgggaggcugaggcaggagaauggcgugaacccgggaggcggagcuugcagugagccgagaucgcgccacugcacuccagccugggcgacagagcgagacuccgucucaaaaaaaaaaaaaaaagaaagagaaaagagacuuauauuuucuaagacuacaaacuuucaaagggauugaauuuaaagaucuaacagauacguaugagaaagugagguccaggagagcaaggcccuugaaguguuaaucuagaaugacacaagcacaaggagauaacacaguauaguaaaagaucuucacuauuaaugaucccaaaacugaaucuuagagcccaaagacacaaaacuguuacacaaagcauacuuguuugcaguaucaacuuuaucacauauaaauagaggcaguaauaggugacaguucacaaauauuaucuccauuuacuugaaaagaauccuuuaaaaacaaacaaaaaaagguagcaucaggacaaacucacagaaaagccuucaucuuccaaacuggacauuaucuuggaagaaaguuccucacagcacaaguucucuucugcuguugccaccaaagcagcacaacgagcaaaugcucuauauaauucugaccaaguucuaagcaaagucuucaugguggccuaccaauaacaacaaaaaaagaaguuuuguuaauauauaccuaucuaucaaaguuuauagaaucaauacaucuuuaacauuuuuuaaaaacacugcaacauuuagugugucaaaaaagacacuaacggccgggugcaguggcucacgccuguaaccccagcacucugggaggccgagguugguggaucaccugaggucaggaguucgaggucaacauggcgaaaccccaucucuacuaaaaauacaaaaaaucagccggacgaaguggcggaugccuguaaucccagcuacucgggaggcugagguaggagaauugcuugaacccaggagguagagguugcagugagccaagauugccccacugcacuccagccugggcaacaagagugaaacugucucaaaauaaaaaagagacuaacacaggguaauaaccuuucccccacaucccagaggucuaacugaagagaggaaauaaggccaugauaccaaaaauuaucaaagauccaaaagaacuucucucgcccuucaucauucuccuaagcuaguaauaaagucauaaagaagucuuauuuuagaaauuauugugggcugggcacaguggcucacgccuguaaucccagcacuuugggaggccaaggcagguggaucacuugaggucaggugaaacugaccaauauggugaaacuccauuucuacuaaaaauacaaaaauuagcugggcgcaguggcaugguccuguaaucccagcuacuugggaggcagagacaggagaacugcuugaacccagaaggcagagguugcaguaagcugagauugcaccacuguacuccaagccuggacgacaaugugagacugucucaaaaaaaaaagagaaaaagaaaaagaaaaacaaaucauuguggaagcugauuauaaaggaugaaauaauauuuucagaaaaauacaaaucccucggaaaucaauacuugacaaugccuuaccacuggaaaucucuguucugaaaaaaugugguuuacugguaaagucaaugcaccauagauggcacuaaaauuauguucuaaggcaucaccuugauuuacuucauuggucuaaaacaagaaaaauaaugaaguuagacaaauuaccaucuuauucuaauccuaaguaguaacauaacuuauuuauaaguagugggcaaaacuguguuccccaaugaugagauucaaaauaaguuuaacucuuaaccccucgaaccuacgcauguagucuuauuuggaaauaaagucuuugcauauguucagaugagguccuacuggauuagggucagccccaauccaaugaacagucuuuucuguaagaggaaaauuuggauaggcacagacaacaauaccaugugaagauggaggcauagucaagugaugcagcuacaacccaaggaaggucaaggauugccagcaaccaccagaagcugagaggcaugaacagauucugucucagagcuccaggagaaaccaauccuaccaacuccuugauuuuggauagcuggucuccagaacggugagagaauaaaucccuguaguuuuaagucaccaguuggcuguaauuuguuaauugcaaucuggggaaauuaugcacuauguuuaaguucuaaaaaugaaucccagggccaacuccaaagucuucuacuauacauacacagcauuccagcaaaaacucauacaauaaaaagggccucuggaucauucuaacaguggggagcuauuuaagaauguaaaugacuuuucuuccagaagaauagugugcuagcuugaguagccaaaacaagggcuacguuaacuauaauguaaaaagcugagcacaguggcucacgccuguaaucccagcacuuugggaggcugaggcuaaggucaagaguuugagauccgccugaccaauacagugaaaccccaucuugacuaaaaauacaaaaauuaacugggcuugguggcgugcaccuguagucccagccauuugggaggcugaaacaggagaaucgcuucaaccugggaggcagagguugcagugagccaagaucgugccacuguacucuagccugggugacagagugagauuccaacucaacaacaacaaaaacaacaaaauuccuucgaguuauuucauuuuugaguuacagcacuauuagcccagagaaugcauauucccauuuaaagacugacaaagaggcugacaaaucauaaacagaacuugugccccacagccugccacuauacccacuuuuguuaaauagguaaacauugaggauuuaaguauuuaaauacacagauuauucaacucucaauagauuccugacuuaaggaaaugcuauauggcuuugagguaaucaccaacguggcuuaacuaugggaauauauagccuagucaagauaaccgcuguuauucccuguuaauaaaacuacugaaagaauccaagauacaagaauuuacaucuaugugagccuucuagguuuauaaucacuacugaagaaaaugaagcugauuaguccccauuaaguuauaguuucuuuaccagugagggagaaaugcaauaaaaucaaucaaaaguacaacguuuaccaauuccaccagaaaaaauauuuaccaucuucuauucaaauucaaacuucuauucauuuccccaacugcacuaacaaaaaaaaaaggucuauuauccaaaauacguagcagauuuauuucauaccugauuaaucaauucaguuaauggggugacuauaacacuccacauuuuccagagaugcuccuuauuuuccaacugcuuugcauuuugauuaauaacauuuaaaacugagucacugaaagcuaguggugaaguuggaccagaaagaacacagccuacaagugauuccaaacugagaaagaaccugaacaaaaaauuauaaaaaaugcaucaacuuuuuggcaggaauauauuaauuuaauguuaacaaaauucuaaaauaacugacaaaaaguuaacgaauuuuuuuuaaaaaaacuuaaacuuaugaaauaguacauaaauaaucucauucauuacauaaccuuuccaagacaaaguuucaaguuaaaguacaaacuuaccuuucaucugauacaccacauuccaagaaauuguugaaaauuaauugaauuaagaacaaagcuggaguucccugaaggagaaaaugaagucaaucuucucaguuacaaagaauagaacauuuguuuuuuauaauugguuauuuaagaaauaaaauuguuuuagcaugacaaauuuaacuuuuggcauuacuuaggguaugacaaccauguuaguaaaauuauuuccauauacugcacacaaaaaucaagcucuuggccgggcgcaguggcucacuccuguaaugccagcacuuugggaggccgaggcggguggaucacgaggucaggagaucgagaccauccuggcuaacacagugaaaccccaucucuacuaaauaaaaauacaaaaaaacuagccgggcaggguggcacgcgccuguagucccagcuacucgggagacugaggcaggagaauggcaugagaccgggagaauuagguugcagugagccgagaucacgccacugcacuccagacugcgcaacagccugacucugucucaaaaaaaaaaaaaaaaaaaaaaaaucaagcucuuuauagucuaaucauagcuguuuccucuacacagaaaaucaaggaauuaugagauuccagauauaaaaagaacauagauuuaaaacuuacuggaaucccaaugccuauauccuagagauacuaagugcauuuuacauuagcuuccaauauuuauggcaguaaccaacaguauuaucguauauaaacaacuaggaaacuuuccuuuuggagccauuuauuuaauccaggaaaauaguuuuuucauucacauagcagcauauuuaauucuuuauauuaacuaucaguuuuuccuuuaauuuggucaauauacuucaaauccaauacucucagaauuuuacauaaggucaucuuucuuuuuuuuuuuuuuuuuaaaaaaaagggaaauaugcugggcacaguggcucacaccuguaaucccaggauuuggaagagcaaggcggagggaucacccgagguuaggaguucaagaccagccugaccaacauggagaaaccccgucucuauaaaaauacaaaauuagccgggugugguggcacaugccuguaaucccagcuacucgggagguugaggcaggagaauagcuugaaccugggaggcggagguugcagugagccgagaucgugccacugcucuccagccugggcaacaagagcaaaacuccgucucaaaaauaaauaaaauaaaauaaaauaaaauaaaauaaaauaaaaaagggaaguauaaauguuuuuggccaaucuucaucauauuacauuuaagauacuugcauuaagaauauccauauuagcaaccugauaugcuggugaaccuaauacuuucugaggaaguccuuuaauuguaauuuccaugaggaccuaugagagauaaaagguuuuacaguaaauuagccguaaaaauauuaucuaauaaaaaucugaguguuaacuauaucucuaacaauuacaaguaauguucauucauuaacguaaauauaaucucauuaguuaaaaaagaucaaauacauucauucacuaacaugaauauaucugcauccguuuuagaaguucaaacacagaaauauaaaaagcagguaaagucuuuaaucuccaacgauaauauuuucaguucagagucuauuuuccuagaccuucuaaauuucuguauauguaaguacacagaaaaacacacaacuucuugggcagccaguuauacacacauuccuuuaaaccauuaaagccauuacacuguaaaucacuaaugauauuaaacucugcaacuaaccuucauuuuaccuuguuacggaauuuuugcaucaauauauaaaaauacugcuauaugaauguccauuauuuauucaaccauuuuucuauuaagagaccuuggggcuauuucuauguuuuuuuauacuacuaauagaaauucugcaauuaauuauacugguacccaaagcaaauauucaaaggacugcuaauaguugggucuaagauugcuaaaucaaacugacugagccuaccaaauugcucuccaaaaauacuaccauacugucuuuuuuuucuuuuuugagacagggucucauuguuguccaggcuggauugcaguggcacgaucuuggcucacugcagccucaaccucaugggcucaagugauucucccaccucugcuuccauaaaagcugggacuagaggcaugucagcaugccuggcuaauuuuugcaauuugcccaccuugcccucccaaagugcugggauuacagaugugagccaccaugcccagugguaauauacugguaugaacaugcacuacauaacuuaaaugucauagaagaguuaugucagugaaaauacauuuucacacacugucaccugaaacagauuaguaauaauaauagacaguauuaguuuguuccuggcccauaguacuuuccauguaucaauucacuuagucuuuaacuacugcuacauucccucuuuacauaugggguuaggcaaagccaagggaauagauaaacugcacaaauuuacucagcuaaugaauaguuaggcugguauucaaccuaguaugcuccagagcccuugcuauuaaccacuaugcuauacugcuacagaacaaguaacuaucaaaauacauaaaggaaacaaaaucagaauuuaaggguauuguuuguuccacuggagcuuauuuugagaugcccauauccucaaaaucauauccaauucacuuuucuuccuguacuacacggguuuaaaaaaaaaagggguuuuaauaccaaagucauuaucuugguuaaaaacaguuaauugaaaacaaaguaccaacuauuaguaguuuucagcaaucuugucauaaaauuaaaggacaucugaguuucuucaguucaaguuucauguccuuuacccuaguuuuucucuguauggcggauacuuuuuucuuaccacguugaagacuuuuguggcuguuguuauagucacuauuaaaaagguuucaaaugacucuacaguuaauagaauggcacuuauugcaauaggacuaaacugcugaugaaugcuugauauaaaaaagucuucccaaacuagauuugugcaaauaucuucuauauaaaauuuaacuucagaaaaugguuuuuaaaguccaacauacggguauuauacuuaccagcguuuuugauacaggaaauacuucagacuuuacuaugcuuuccaaagacuuuaauaagagagucaaaacuucagaaccugguuucucuuuuuuguuaccuaucaaaaagcaaaaagaaggguauaguucuuuuuuuuuuuuuuuuuuuuuuugagacagggucuugcucugucacccaagcugggguacaggggcacaaccuuggcucacugcaaccaccacuuccuggguucaagcgauucuccugccucagcuuccugaguagcugggauuacaggugugcaccaccaugccuggcugauuuucauauuuuuaguagagacggguuugcuaggcugguaucaaacuccugaccucaggugauccacccaucucagcuucccaaaguguugggauuacagacgucagccaccaugccuggcugagaaugguguauuuacuuuuuuuuuuuuuuuuugauggaguuucacucuuauugcccaggcuggagugcaauggcgccaucucagcucacugcaaccuccgccucccagguucaagcaauucuccugccucagccuccugaguagcuggggauugauuacaggcaugcaccaccaugucuggcuaauuucguauuuuuaguagaggcaggguuucuccauguuggucagacgggucucaaacuccugaccucaggugauccgcccgccucggccucccaaagugcuggaauuacaggcaugagccaccgcgcccggcuagaaggguguauuucuaagcauguaauuuuagagaugacuauacagagagcuguaaaaauuuauuuuuucuaaaucaacaauacuaaguacaguugacccuugaacgacacggguuuggacggcaugaguccacuccuauucagacuuucuuccaucccggaaacagcaaguuccaccccuccucuucccuccuuaguguacucaacauaaagacaagaauauaacccguuuccacuuaaugauuauguuuucucuuaugauuuuccuaacauucuuuucucuaauuuacuaauauuguuaaugaacacagcauauaaugcacauaacguauaaauaugugcucaucagcuauuuauguuaucagcaaggcuuccaaucgauaguaaguuaucaguaguuaaguucugggggagucugaaguuauauguagauuuuggaccauguggugggucagcacaccuaaccccaguguucuucaaacauuaacuacaaauuaaaaacuggaagcuacgguagugcaagaaauacuuuuaaaauaaauuuuauauagucaaacaauucaccggaugcuauaaaaaucaucugaucaccaccuguuucaaaaaacaacauuugaucaguguaauagugcuuaccugauucaguaacugacuucaccaagcuaauuagcuccuuccagauagcacugacaaccacaucugucaaacaaaauaaacuugaguauuuuaaaugaaguacauaugacuacguacuaugacuaacacucucccuuuacuuccuuacauuaaacaaauaaauugaacaauacuuaauuuaauuuuccucaugauacucaacccuguaguaaguuuauaaaacacuaucacuucguuuuuguuuguagaaacuaaauaugguuuauuuuuuucagacagggucuugcucuguccaggcuggaguacaguggcacaaucauagcucauugucaccucaacaaccugggcucaagcagucuucccacaucagccucccaaguagcuaggacuauagguacacaccacuacacccaucuaauuauuuuuuuuuguaaagauagcacucucacuacauuuccuaggcuggucacaaacaucugccucaagugaaccucccaccuuagccucucccaaacugccaggauuacaggcaugcgcuaccauguccagccauaaauguguuccuuaaaacaacuauaacauguuaacaaugaauuguguaacuaaggguaauuguuuuaucuuuuuuuaaauuaucuuucuuuucugaauugaaugcccacuacuuuuggggcagagauuguucacggagauucagaaggauaucuaacaaccaauagaaaaaauuuaugugauucauugugauucuuuuuccaaccaguuaaagagcaaacaauuuuugaaauuuccuuuccucauuauuugauaggccauguaacacaggaguuuaggcacagaugcuagagccauagagcuugacacgguacuaccacucguaagugacucugcauaacuuauguacuuccuguauaacccauuuucucauuuguaaaaugaacuaacaugguauguuacugcgaaaauuaaaugaauaaauguaaaguucucaaugcacaaucuggccaguagguggcacuauauaaauauuuguuauuuuaucuucauauuuuuuauuuuuuaauagagucuugcucuaucacccaggcugcagugcaguggcacaaucuuggcucacugcaacuuccaccuccugggcucaagcaauucucaugccuccgccucccgaguagcugggacuacagguaucugccaacaugcccaccuaguuuuuguaugcuuuguagagacaggguuuugucauguugcccaggcuggucucgaacuccugagcucaagugauccacucaccucggccucccaaagugcugggauuacaggugugagguacugugacuggccuauuuuuucuucuuuuuaaacacacauuugagcaaauaauaaaucaaauucucuuaccgggggcaucuuuuccaacugcaacaaagcuaucaugaacagcagugauaaguguauuugcauguuuggaaaaaaaggaagggcugcugauuaacggauguuccaauggcucugaaagggaagaauaaaagauaauuauguaaaacaacagauuuaugaaauacauuucucacuauaaaacuuuaaaaugucuauuaaguagguguguuuucuauaaaaaaaagauucauauuucauacacaacuguaaaauauuuuggcugcgacaaaauaacaccucuccucaccccaaugcauuaaguccuagacuguuuuaguaauuaaaauuauucuuaaaaccuuuaaauaccuaagcucagcacaaguuuauuuugcuuagcaaaacucaaggcuucuggacccaacaagaaaugaagcaacauuucaagucccaaaaguugaauggaugggauuguggccauuccaccuaaauucgaacucagguucauucggggaguucccggggcuccguacggggaggaagcaccuuuaagaaaaaaaaaaaaagaguuaagucauacaagcucauuuuauauuagcuacccaaaugcauacauuucauuucaaugaaacuuuuaaaaacagaguuuaaaugucucaggcauuaauccauaccuugaaauauuaauaugcagguauucuguaacaaauuuugaagacucagauggcaaacaaaauaauacauaugacacacauguauaucauaugucuuucaaugacauacauaaagaagacacuuuauaacugcugagauuuuuuuuuuuuuuuuuuuugagacagagucucauuguacugcccaggcugcagugcagugguacaaucauaguucacuacaaccucaaacuccugggcucaagcacuucucccaucagcauuccaaguagcuguaacuauagauggauggauaccacugugcucaguuaauuuuuaaauuuuuuguagagacagggucucacuauguagcacaggugguauccaacuccuggcuucaagugauccucccaccucagcccccuaaaugcugagauuauaggugccugccacugcaccuggcugaaguguuguuuuuguuuuauuuuguuuuuuuugagacugagucucacucugucgcccaggcuggagugcaguggcgagaucucggcucacugcaaccuccgccucccaggauucaagcaauucuccugccacagccucccagguagcugguuauuacaggggcccacgaccacgcccggcuaauuuuuuuauuuucaguagagacuggguuucaccguguuggccaggcuggucucaaaugccugaccucaagugaucugcugggcucggccucccaaagugcuaggauuacaggcgugagccaccucaccuggccgauguguuguuuuuaauagcgcuaagauucugguucuaaaaucaacagcuucauguuagcugcucugaggcuuuuuuugcaaggcaccucacauaauguacugaaaaaacauccgucucuucuaaccacaacaaugcgcuuacaacaguaaucaguaauauuaaaaaaaaaaaacaaaaaacagaaaaacaugauaauggauuuuuugguaaugaaccuaaaaauuaugaagugcuucauuucaaacgaaaaacacugagcaaaaccucucaaagccuuuuuuuuuccuacuucaaaacuaugcuucuaggucaacaaagccugauuaaaaaagcaaaaaacaagaauaucuaccucuuaccuuuguguacaggagucauaggauuuaaaccuggagauguagcuacaugacacgaauugcccugaggugaggcauuagaaucaaugcuuauuguacuuugaaucagaggcacacaaaccuaugggguaaaagaaaacaucgaucuauaaacuauacaacugucacaguuuuuaaaagccucacauaauauaaauuucauuaaauggagccuuaauauauuccauuuuacagaucguuuccaugcacaaacaggcuaaaaaguggaauuuggaaaaaauaugaacauuacaacuguauuugcccuaaauauguauuaccuaaauuuguuuauauacaucaacaucugaacuguacacauuacugguagacuaauuuuaacuuuuuaaaacucuggaaaacaugaacucagacaaagcucauuucuaacaucauccuaguaccagucacauguaguuaccaaauaaauuauuccaauuaauguauuggacaaaugcaaagaauuagccuauuggacccuuauaaugguagaauuuggaaaauucauuaugaugcaaauuacauuguugacaaugcccaucuucaauuauuucauguuauauaaauuuaaaacucaauaauuaaaaaauuaaaaacugaauaaaaauggcuuaaguauauuuauaaguccuccuguccaagaaugcauucccugcuaugcagcuauuuauauaaaauauaaaauauaccccuaaaauauacccccagaaguaaaauguacccccaaaauccaaaauaagugauaaagaaaugaaaaagauguuagcagagcugcuccuuuuaacuguaaaaaaauucaaaaaccaggcuggcgcaguggcucaugccuguaaucccagcacuuugggaggccgaggcaggcagaucacaaagucaggagaucgagaccauccuggcuaacacagugaaaccccgucucuacuaaaaauacaaaaaauuagcugggcgugguggcgggcgccuguagucccagcuacucaggaggcugaggcaggagaauggugugaacccaggagguggaguuugcagugagccgagaucgugccacugcacccuagccugggcaacagagcgagacuccaucucaaaaaaaaaaaaaaaaaaaaauucaaaaaccaaggauggaaauaacugcaaauaacucaaaagguuuagguuaagauuaaacuuuauaucuaaaugccaguaaggauaugcaaauccugaagaauucguaaaaucauuguguaacaauuaaaaagaaccuauaaauaggauucagucauugguuaucacuaugcagccuagaaaacggagcaagaaauaaaaaaacaagaacugguccaaccuuguaucuacccaguguagcacuugauuucucucuuuuuuuuuuuuuuugagauggagucucacucuguugccugggcuggagugcaguggugugaucucagcucacugcaaccuccaucuccuggguucaagcaauucuccucagccucccgaguagcugagacuacaggcacaugccaccacacccagcuacuuuuuuguauuuuaguagacacgggguuucaccauguugcccaggcuggucucaaacuccugagcucaggcaacccaccugccucugccucccaaagugcuaggacuacaggcaugagucaccgcgcccggcugauuucuauuucacugaugcugguuuucuucucaauuauauuccaaaugcucuaggggaaaaaacccuuuguuuaaaaucauaaugcuuguagaguaagaauguuugaguacuugcuaauuuaaaaacauuucagggccaggcgcgguggcucaugccuguaaucccagcauuuugggaggcuggcaugggcgaaucauuugaggccaggagugcgagaccagccuggccaccaugguaaaacccuaucuacacuaaaaaauacaaaaaauuagccagguguggucgugcgccugcagucccagcuacucgggagacugacacaggagaaucacuugaacccaggagguggagguugcagugagccgagaucgugccacugcacuccauccugggaaacagaacaagacuccaucucaaaauaaauaaauuaauaauaaauaaauaaaaacauuucagguaaaggggcuccauuucaagcaacugaacaauaucccuugugggaaaugaauuuaaguucucugccaguaaagugaaagaccuuuuauauguucuagucugcuaauaaauagcaaaaauaacaccacaggauuacauugguaagaauuuaagaacacauuaacaaaaacauaaagugcuauagucaacacuuguaauguuaccuguucaaaauuagcaggaagaugagguccaagucucaucaguaaauaccaccagacuucuaguuuuguuaaugcuagaguuucuguucucacauggauggaacucaaaggcugcauuaacaacuugagucuuuuugcacuacauaguauaucuuaaaagaaaauaagcacacaguuaaagagacguccaagcuaaagauuaacucuaacacuagcuaugcaacagucuuuuaucacagcaagagaacguauuuuaaaauuuuuuuaaaaaaauaaauccccaggcuguccuugcucuacccaaaacuugcauuuugauaaacuacaguacagcugaaccaaaaacacucaauaaaucaaaaauauauuuuaaaacaaauaaguaauauuuauuagauauugugugccggggcaauuucccaccagggaauacuucagguugguuacaaaugaggggaugcuauugacaucuuagugaguagagacuacggacgcuacuaaacuucaacaccacaccaggacaguccugaaaaacaaauuauccagcacaaaaugccaaaacuuugacaaauacuguccuagcugcuuuagcauucucauuauccccauuugacaaagaaacggaagcauauguuuacauuaugucaaaaaaggcuaucauuuuaaaaaucaauuauuaauauauuccaucaaaaaucauuacuacuggggccacugacugaauacauuuuugaaaucuaaauagauucauuuagauucaggacugcccuaucuuaacaauaaucauauuguuaaaauucagcauagaaauuaaauccaaucuucagaaaaaacauuuaugccaaaugaguaagacuggggauauguaaaauuaagacacagucugugcuaaaauaacuugucaaaaagaccuuaaaagggcugggcguggugguucacgccuauaauccuggcacuuugggaggaugaggcagguuggucacuugaggucaggaguuugaaaccagccugaccaacauggugaaauccuaccucuacuaaaacuacaaaaagguuagcuaggcauggcgguggcuccuguaauaccagcuacucaggagccuaaggcaggagacucgcuuggacccaggaggcagagguugcagugagcugagaucacaccacugcacuccaggcugggugacagagugagacuccguccugaauaaauaaauaaauaaauaacuugaaaaggauucugaaacaucaaucaggccauguauuugguggaauggcacucaacaaugucuguuacaacuacucugccauuuagcuauuucaauuaacaguucuauaagaaaauaaaggcuaucacuguaugaacaaguucuccaguccaagacacuuccuuuuuggggucuccuauucuuuuuguucauucauucauucauucauucauucauucauucagagacggaaguuucacucuuguugcccaggcuggagugcaauggcaugaucucggcucacugcagccuccuccucccggauucuccugccucugccucccaaguagcugggauuacaggcaugugccaccaugcccguccaacuuuguauuuuuaguaaagaugggguuucuccauguuggucaggcuggucucuaacucgagaacucaggugaucugcccgccucucaaagugcugggauuacaggcgugagccaccacgucuggacucuauucuauuuaugagaagagcuccauaauaauaucucuacaguagcagagauuaauugccaugcaauaaaccaaucuccuuuaauuaaaaaaucugauuuuacacaggacagugaugggugcccaauuuuugacuacuuuuucuagucggccacugagccauucuacccaguaaaauuuaaguggauguguauauaagauucuuagaaggcuauuucuagguauaggugaguaagcugugaagaagucuuuucugcucuucugccuucccuccuuccugucugcaauuaagacaaaucaaagauggcagaguaaaaauacagucaucugauuccuugaugacuucccggauccacagcaucagucauggauucccuagcucugaacuuauuuuuaacuuacuaucuuuaaacuacucuuauuuuaugcuuuaacuuaauuccuaaagauuguagucccaaacauuaccucacacuucuggguuuacaguuagacccaaauacaugccagcucauaaacauaaaaauaagcuacaauuucaauuaaaaauuguaguagaaugagcacaguggcucacaccuguaauccuaacacuuuggaaggcugaggcagguggaucacuugaguccaggagcucgagacuagcccgggcaacguggucaaaucccgccucuacaaaaaauacaaaaauuagccagaaaugguggcacacgccuguagucccagcuacuugggggggcugaggugggaggaucacuggagcccaggaggucaaggcugcagucagccacugcacuccagucuaggugacagggcaagacccuaaguggggggagggggggaaacuaugcccccaaaauguaccaguauuuuaaauaaaaguaauuauagggcugggagcaguggcucuugccuguaaucccagcacuuugggagaccgaggcaggcagaucacaaggucagaaguucgagaccagccuggccaguauggugaaaccuugucucuacugaaaauacaaaaauuagccagacguggcagcgggcgccugucaucccagcuacuugggaggcugaggcaggagaaucgcuugaacuugggaggcggagguugcagugagcugagaucacgccacugcacuccagcccgagcaacacagugagacuccaucucaaacaaaaaagaaaaaaaaggccgggcgcaguaccucacaccuggaaucccagcacuuugggaggcugaggcgggcagaucaccaggucaggggaucaagaccauccuggcuaacacggugaaaccccgucucuacuaaaaauacaaaaaaauuagcugggcguggugacgagcaccuguaaucccaacuaaucgggaggcugaggcagaagaauggugugaacccaggaggcggagcuugcagugagccgagauugugccacugcacuccagccuggacgacagagcgaaacuccgucucaaaaaaaaaaaaaaguuauuauacauuaaugcaaauaaucacaauacaaaacauauuaaaaggaggaagaaaugggauaaauaauggucuuuggcaggaaaaauauaggauaaaaaucaacauuacuuagcagcucuuguaaacauacaguguuaauuaaaucuaagauuaacuaccaccuaguuaaguacucauacuaacacaguuuugggcuaaauauucuuucuugugaauauauuaucagaaaacuccauugaacaauaagaagauaagguuaaaguaaaucaaaaagaaugacuuccauauaucaauauuaaaccacuauuagguacucuucuagagauccugaaagaaguaaggucaucgaucacugauauuuuuauuccauggaaaucacaacugcuuccuaucaucuacugguuaugugaccucuggauaauuacucaaucucucuaaaauagugauuaauaauuacaucucaggucuauugugaugauuaaauaaaauauacauaaaguacucaacucagugcuaacauguaagaaagccacaaauaauaggcugggggcaguggcucacgccuguaaucccagcauuugggaggccaaggagggcggaucacuugaggucaggaguuccagaccagccuggccaacauagugaaacccugucucuacuaaaaaugcacaaauuagccggguguaguggugggcaccuguaaucccagcuacucgggaggcugaggcaggagaaucucuugaaccugggaggcgggggucgcagugaaccaagaucccaucacugcacuccagccugggcaagagcgacccugucucaaaaaauaaauaaauaaauaaaaaaggaagccacaaaucauuauuuuucacuuuguucaguuuuugaaauacugugaaacagauuucauauuugugauuuccaaugccuaguaugugaauucuauuuucaguacaaauuuauuccuguucccuuaaaaugaaaauaauucaguaguuacuuaacuucaacuuaaaauccaaaaaaccagaaaaacuucauuuaucuugcuuuaagcaaaacaaauucacagaaaaucaaaauuguuaaaauauuacuuaccuggauuuaaagcaaaauuaucuauuaaacucuuccaagcaauaaaagcuaucuuuuuaaucaugggugcuccacuacgaaauccaaguucuucuaguugcaagagagaauugaugaaacucccacuucgaugcaaggucuaaaaaggggaaaaaaucauuaagaaguuauuuaucugcaugaaacagaauaauugcuaucauuccuuuauucauucacuuaacagaugcucuuaggacuucauaaucuaauggggagacaaaagacaaauuauucacaaaacauaaagagauguguuaaauguuagauauguuaaaagucuuaggaauauaagaaaauaaacuuuaaacacacauucuaaacucaagaucacaaaauauauaaaguuugaagaagcagacaauguacaacacagaacauuucuaaaacagaaaauuaggagagcagauaaaucccaaacuuuaucaaaucaauaccaaacaaaauauacauuaaaaaauuauauuagagaaaaaaggcauugaacccugaaaauaauaaaaauaaccuuucaaacaaacugaauggaaaauuaaggaaacaucuuauuucauggcuguaaaagaaauauuuuuuaaaaacaguauuaucugcuaauaaaaaauaguaaaagugagauaaaaaucaagaaaacugaauaacuuuucuuuuuuuugagagggaaucucgcucugucgcccaggcuacagugcaguggugccauuuuggcucacugcagccuccagcuccuggguucaagugauucuccugccucagccuuccaaguagcugggauuacuggcuaauacuaccacgcccagcuaauuuuuguuuuguuuuguuuuguuugagauggagucuugcucugucacccggcuggagugcaauggcuggaucucagcucacugcaaccucugccucccagguuuaagcgacucuccugccucagccucccaaguagcugggauuauaggugcgugccaccaugccuggcuacuuauuuuauuuuugguugaggcaggguuucaccauguuggccaggcuggucucgaacuccugaacucaguccaccucggccucccaaagugcugggauuacaggcgugagccaccaugccggccuaauuuuuguauuuuuaguagagacaagguuuugccaugcuggccaugcuggccaggcuggugacuaacuacugaccucaagugacccacccgccucagccucccaaagugcugggauuacagacaugagcaaccacagcugguagaaaaccggauaacuucugaauuacuuccaaauauuauguaagauuuaaaugggaauacuaucaaacaaaaagaaaaauaugagcucaggagaaaaaaaaacaaaaaaaaaaauuaaaaaaaaaaauaggccaggcacgguggcucacaccugcaaucccagcacucugggaggccaaggcaggcgaaucaccuaaggucaggaguucgagaccagccugaccaauauggagaaaccccuucucuacuaaaaauacaaaaaucagccaggcgugguggcacaugccuguaaucccagcuacucgggaggcugagacaggagaaucacuugaaccugagaggccgaggcugcagugagccgagaucauguuugcacuccagccugggcaacaagagugaaacucugucucaaaaaaaaaagaaaaaaaggaaaauaaaguacaaaauggaaaaaugacaaguaaugcaucacaaauaaaaaauuacaucaacacgaaugcuccuaacaggcuauaaaccacauauaaucuuaacaggcuauaaaccgguaacaaaaaaaaaagguuuagaaaauaaaaaacacacaaguuagcuauaagagcuaaaggaaauacuucguaauagaucuagcccaagaaguuaaagacacaagaugaaaauuaugaagcacugcugaaagaaauuaaagaccuaggccuggcacaguggcuaacaccuguaaucccagcacuuugggaggccgaggcagauggauugcuuuaggucaugaguuugagaccagccuggccaacaugguaaaaccccaucucuacuaaaaauacaaaaaucagcuaggcaugguggcaggcaccuauaaucccagcuacucgggaggccgaggcaggagaaucacuugaacccgggaggcugagguugcagugagccaauauagccaggacaacagagcgagacucugucuuaaaaaaaaaacaaaaaaaaaacccuaaauaaauggaaagacaucuguguucauggguagaaagacuuaacaucaaugaaaugcuaacuacucaaggcauuauaugcagauucaucacaaucccuaccaugauuccaacugucuuuuucacagauaaagaagucgaucgucaaauucacacggaauugcagucucaaaaagccaaaacagccaggcgugguggcucacacguguaaugccagcacuuugggaggccaaggcgggaggauuacaaggucaggaguucgagaccagccuggccaauauggugaaacacugucucuacuaaaaauacaaaaauuuagcugggcgugguggcgugcgccugcagucucagcuacucgggaggcugaggcaggagaaucgcuuggacccaggaggcagagguugcagugagcugagaucacgccacugcacuccagccugggcgacacggacagucuccagcucaaaaaaaaaaaaaaaaaaaaaaaauuaaaagccaaaacaauccugaaaaauaauaaaaccagacaaacugacugccaaacuuagcauaaagcuauaguaauuaauacauaugauaauggcauaaggacagccauacagaccacaagaauagaauacugagcuuggauauaaaucuuuacaccuauguucaauugauuuucaaaaggguaccacaggccaggcgcgguggcucacgccugcaaucccagcacuuugggaggucgaggcggguggaucucuagagcucagaaguucgagaccagccuggccaacgugguaaaaccccuucucuaauaaaaauacagaaaagaaaaaaaaaaugugccgagcaugguagugcgcgccuguaaucccagcuacuugggagacugaggcaggagaauugcuugaacccaggagacagagguugcagugagccgagaucaugccacugcacuccagccuaggcaacagaguaagacucugucucacaaaaaaaaaaaaaaaaaaaaaaggguaccacaaggauuuaauaaaaacaaccucuucaguaaaagauauugaggaaucugaacaucugcaugcaaaaggaugaacguggacucucaccuuacaccauauccaaauauucacucaaaaugguucaaagaucuacauucaagaucuaaaacuggaaaauucuuagacgaaagcauugggaaacaaaaaugacacuggauuuggcaacaacuucaugaauaugaugucaaguacuagcaauaacaaaaaauauauauauuauacuucaccaaaauuaaaaacucugcaauggauauuaccaagaaagcaaaagagaaccuacagaacggaauuaaauauuugcaaaucacaaaacuaagggaugcauauccaaaacauauaaagaacuacaacucaacaacaaaaauucaaaccuacucaaaaaugggccaaggacuuagacauuucuccacagacaaugaaacaaacagccaagaaccaagugaaaagauguucaacaucacuaguaaucagagaaaugcaaaucuauaccaaaucaaucccacuucacauucacuaggauggcuaucaaaaaaaggaaaauaaaaaguguuggugaggauauuauggaagcggaaccccagugcauuacuggugggaauguaaaauggggcagcugcuacagaagaguuuggugcuggcugguucaaguggcucaugccuguaauccaacaauuuuggaggcugaggcaggcggaucacuugaguuagagaccagccugagcagcacggcaaaacccagucucuacaaaaaauauggaaaaaaaaaaaaaaaaaaaaaaaaaaaaaaaucagccgggcugggugguagucccagguaauugggaggcugagauggaaggaugguuugagacugggagacagagguugcagugagcgagguugugccacugcacuccagccugggugauagauagagccagaccuugucucaaaaaaagaguuuggagcuuucucaaaaaguuaagcauagaacuacuacauaacccagcaauuccacucuuaagcauauacccaaaaaacugaaagcaggaacuccaacagauuuguacacugguguuuacagcaacauuauucacaauagccaaaagguagaaacaaccuaaaugucucucaacagauaaacaaaauguguuauauacauacaauuacucagccauaagaauccaacuuuaauauauguuaugacauggauaaaucuuaaaaacuuuaugcuuccaggcacgguggcucacgccuauaaucccaccacuuugggaggccgaggugggcagauaacaaggucaggagaucgagaccauccuggucaacauggugaaauccuaucucuacuaaaaacacaaaaauuagccggacauacuggcacaugccuguagucccagcuacucaggaggcugaggcaggagaauugcaugaacccgggaggcagagguugcagugaaccaagaucacgccauuguacuccagccugggugacaagagcgaaacuccgucucagagaaaaauaaaaaaacuuuaugcuuagugaaauaagccagacacggaagggcauauauguuauaauuucacuuuuaugagguaccuagaauaagcaaauucagagacaggaaguagaacagacauuaccaaagggugaugucugggugcaggaggagggcagaggaaguuuacucuuuaauggguacaguuuuuguuagggaugaugcacagguuuuggguauagauaguggugaugcuuacaacauuaugaauagauuuaaugccacugacuuguucauuuacaaaugguuagaacauguauauuuaccacaauaaaagcagcacacccccuaccacccaaaaccuggcuuaaucauugaacauacaguugauucucucucauuauucauaguaguuaugguuuucuauuauauaaaguagccuugaacacuaaauuggcaaauacugagugaucacucccaugggaaauacaggguuagguucucuggacacaacacuuuugucagcuguucaauauauaaccugcuuaacgucuauuagaagauauuuuauacaaaugaaucacuaacaucaaacucacagccaguagcucuauaaaucaugccugaacaaaguuuauuuucaccauuggguauaucacagccuuccuuugcuuaggaacacaaacuagaaagcaccuggacccaagcuuuagguuccaaauuuaaacagugaaaccaccaggaaaagcacagaaaagugaaaaauguggcauuacauggauuauaaaaaggacaccuguuuaagguaugagaacuaaaacaaaaaggcagagcguaaccuugcuugaccucagcuggaaacaugcacguugugugacuccaauucuuugccacuuugggugucuacaaaugaaagcaaaagcaaugcaaguacugguuucagauuuacaaauaaauuuuagugaguaggcaugaaauaaugagcaucagcuguacaaaggaaauaaugagcaucaacuguacaaagaaaagguaagaaaauaaagaguccagcauguaaaaacuguugacuguucauuaacugggcacuuacccuuccaaguaguuugacaaacaaaggccauaauuuuaacacguaagucucauuuuuacucauaaauagcuucugaaguucugagauuaauuucugcaaacaaaagcaauuaauuuaccaaacagacucuuagaaaaaaaaauccaauaccaaagucuaggaauaauuuucaaaaacugauucaaccaaauaguuuucuccauaauaaaaauauuaccccacccaaggccaggugcggugggucaagccuguaaucccagcacuuugggaggcugaggcaggagaaucaccugccucggccucacucuugaagucaggaguucaagacuggccuggccaauauggugaaacccugucucuacuaaaaacacaaaaauuagcugggcaugguggcagacgcccauaauuccugcuacucgggaggcugaggcaugagaauugcuugaaccugggagguggagguugcagagagcagaaaucgugccacuguccuccagccugggcgacagagcaagacugucucaaaaaaaaaaaaaaauuuucccaaaagacuccaaaaggaaaacugaagcauauagcaaauccgagugaguuuuuacaguaaaugcucuaauacaaacacucagauucuaccauuaacacuuuacuauguuggucuuaucaccuaucuggccauccuaccauccaucaauccaacuuuuuuuuucuaccaauauacuuuacccuaaaaaugucagcaugcauaucauuaacuaguuuaaaugacacuguauuuuuucacaauaaugaaaaaauacauuaauagcuucauaaucaacagacacgugaaauaauuuuuagcucaaauuuauauaaagaauuucauauaugcuuuguugcaagcuugauaaauggguuaaagaaagaauuuuauggucaggcgcaguggcucaugccugcaaucucagcacuuugggaggccgaggcgggcggaucacaaggucaggaguucgagaccagccuggccaauauggugaaaccccaucucuacuaaaaauacaaauaucggucgggcaugguugcaggugccuguaaucccagcuacuccugcugaggcaggagaaucgcuugaacccaggagguggaagcugcagugagcugagacugcgccacugcacuccagccugggcaacaauugcgaaacugucucgaaaaaaaaaaaaaaauuauauaugucacuaaaauugaauucaucagaauaaagcuauuuaugagacacucgaguuacugugucauacugaacauuaccacgaagucuucugcauuuuaagcaaguaaaaucccagguuuuaggggcugggugugguggcucacgccugucaucccaacacuuugggagagugaagugggaggauugcuugagcccaggaguucgagaccagcuuggguaauauagugagaccuugucucaaacaaaaaacaaaacaagaccuucaaauauggcuuuccauguaaucuagaguaaaaauccauccuuacaauggucccugccauaguccuaugugauugggcccucuuuuccucucacucucauucacuccacuacugucauacugcccagaguucccagaacaccaaccagguacacaaccauuagagcagggccuuuugcccucauaguucucuugucugguucuuuaucuacauggguaacuccuacucugccuucaaaucacuguucaaauguccuuuccuuugccuucucugaccaccuuacauuccuuucucacagcacucuccgguccuugcucuucuccuuaguggucuucacuuacuacacuauguacuuaauuaucucucccacaagaaaauaagcuccaucaagccucuuuuguucacugcuauauucacagcgccugcaacaaugcacugcacauaucagaugcccaguaaauauguuagaacaacaaugguuagaaaaccuaaaaccuguggcaaguaauaacuagaaaacuauagagacuagguaaguuuauguacauuaaauuuguaucuacugggauuauacaguaacaacccaaacaugagucaaucaguuaaugcucucccucuuucagaaauacaauuccuauuuccuauuuauugggaaugaaguaaaaugucuggauuuuagcaacaauagauagcucccuuccuuacuacuauguaaugagcaaugugccuuugcuaacuuaugcaacucuuaagguuuugauucaaagcuaaaauccuauaucauagugcaacuauaccaauaugcccagacagauuuuuuuuuuuuuuuuuuuuugagacagggucucauucugucacccaggcuagaaugcaguggugagaucauagcucacugcagccucaaauuucuggucaagcaacccucccgccuuagucucccaagcaucugagacuacaggcgcaugccaccacgcccagcuaauuuuuaagauauuuuguagagaugggucuucacuauguugcccagaugggucuggaacuccuggccucaagcaauccucccaccucagccucccgcuuugggacuacaggugagagccaccguaccuggccaccagacugaauuuuaagcuuagugcagaaccuuccgaugcaguauccagaaaauucuuacauaaaagaacacucacaguagucauaagcugcuccguaauagaugcuauuucuugcuguuucugaagcaauaauggcauucccaucuccagagcaguugcuccccgcaaauguaccuuuugugcugaaugaaccacuaaagguaugaccaguuuugcccaccucacugccucuucucccauuugaauuggggcuuguucaauuagccuauaauagagaaaucaaugaauaauuagcgugaccucauguuuuaagucuaaacaagcaguaaaauaggugaaacagaaauauacacaguacggcccauuuguuuuagaauauauacaaauaugcauauacacacaagaaauagaucuuauuuuuacgaauuugcacauuauugcuuuuguaaauuuuuuuuaaagaaccaaucuugucuuuagauugaaacauuucagucaucccucaguaucccugggggauugguuccaggaccucacaauaaugcucaaguccaauaugaaaaggacaguauugucauucaccacagagcaacguuuuggucaaagaugcagcacauucacaaugguggucccauaagauuaugagggaccugacaaguuccuaucaccuagugacaucauagcuguuguaacacugcagugcaauacauuauucauguuucugaugacacugguguaaacaaaucuacugcgcucucauucauauaaaaguacggcgcauuuacauauagaacauaauacuguacuauaugauaaugauaauaaaugaccggccgggugcaguggcucacaccuguaaucucagcacuuugggaggccgaggcggguggaucaugaggucaggagaucgagaccauccugaccaacauggugaaacccugucucuucuaaaaauacaacaauuagcugggugugguggcacaugcuuguaauccuagcuacuugggaggcugaggcaggagaauugcuugaacccgggaggcggagguugcagugagccaagaccucaccacugcgcuccagccuggugacagagcaagauuccgucucaaaaaaaauaguaauaaaaaaacaaaaaauaaaugacuaaguuacugguuuauguauauacuacacuauaauuuuuaucauuagaguuuacuccuacacuauaauuuuuaucauuagaguuuacuccuacuuguauuuaaaaaaaguuaacugcaaaguagccuugaggguccuucagcagauacuccagaagguagcaucaaucacagaagaugacagcuccaugcauguuacugccccugaacacauuucaguaugacaagauguggaggugggagacaguagaaugauccugacccugcagaggcccuaggcugauguguuauguugcuaaccaaaaaguuaugaaaguuaaaaaaaaaaaaaaaaaaaaaaagaauuuaaggcuccuagaauaaggaucuaacgagggaaaauauguuugcacaauuguauguuuguguuuuaagcuaaguauucuuuuuuuuuuugagaccaagucucacucugucacccaagcuggagugcaguggugcaaucucagcucacugcaaccucugccucccgggugcaagugauucucaaugccucagucucccauauagcugagauuacaggcacgcgucaccacgcccggcugauuuuguauuuucaguagagaugggguuucaccauguuggccaggcugcucucaaacuccugaccucagguaauccacccaccugggccucccaaaguucugggauuacaggugugagccaaagcuaauuauucuuacaggccugaaccacugugccuggccaaagcuaauuauucuuacaaaagucaaaaaguuuaaaaauuuuaaaguuacaguaagcugcccaggcacagugguucaggccugugauccugguacauugggaggcugaggugggugcaccaccugaggucaggaguucaacuccagacuggccaacguggcaaaacccugucucugcuaaaaauacaaaaauuugccaggugugguggcugacgccuauaaucccagcuacucgggaagcugaggcacaagaauuacuugaaccugggagguagagauugcagagagcugauaucacaccacuacacuccagccugaacaacagagugagacugucucaaaaaaauaaaguuacagaaaguagagguuaauuuauuuuaaaaauguuuuuauagauuuaguauagccuaaguguacagucuuuaugaaaucugcaauagugcacaguaauguccuagaccuucacauucccucaucacuccuucacugacucacccaaagaaccuucaguccuaaaaccuccauucgugguaagugugagauacagguguaccauuuuuuaaucuuuuuuaucauauuuuuaguguaccuuuucuauguuuagguacacaaauaguaucguguuagaagugccuacaauauccaguacaguaauauacuguacaggucuguagccuaggagcaacagguuguaccaugcagccuggguauauaguaggcuauuccaccuagguuuguguaaguccucuuaauaauguuugcacaaugaugaaauuacaugaugcauuccucagaauguauucccaucauuaugugacacaugacuguauuugcauauaaccuacgcacauccucccauauacuuuaaaucauuucuagguuacugauaauagcuaauacaauguaagugcuaaguaaguaguuguuauacuguacuguuuaggaaauaaugacaagaaaaucagagucuguacauguucaauacagaugcaauuuuucugagacuuucaacccucaauugguugaauccaaggaugcagaaccuacaaagggccaacuguauuacuuauuguuauauuacuaaauucaucauuguuauagaaaaggauagccagagaaccaugacauaaucuuagcaucaaucagagcauucaacaguggggaaguuaaagcaaguaacucaacaagaaaauuuuaaagaacaaaaaacagggaagacagaaaugucaucaaagaguuuacacuuaaaagaguuuaugcguuggcaugccuguuacaacaaaaaugaagaagguacucuauucccugcuaaacacugacugccuuccuaaacaacccaagcccacuuaugaguuuacauuauuuuuuaaauccuuacacaaacuuuaagauauuuuucaaaccugaacuguguauguuacuagcaggaacauaaccaagacuucaccuugaacauggucccaguaaaaauaaacaaaaaaccuaguaacccacacauaucuacuuccaucuuuuuucuauuacuuuuuguccuugagucguuugguguaaaugacauuccccccuuuuaaugucugucucucauuuaaaucccaaaaacccucuccuucagcuaaauuuaugaaaacuauucuucaauuugcacaacauccaaaugcauaccuuacgauaacauuuaaugcuucaaaaucaacaacagcagaaugcgucucuccuuuguuaaacaguauuucuaaugaaucaauuauacuggauaccuaaaaaacgaaccaaauaaauacaaaugaaauaagccugaacuguuuuuauuggcauuauaguuuuuucuuuuaauuggcauauaguuaagauggcauacccaaaaacuauacucaccauuuugccaaccacuucagagggaaaugucugcuuagauaucacccaaagugcucuaguacguacauuuuugucugaauucuuaaugguaucauucaauuuugaaagcaauucuagagcauuugccucugaaaaacaagcaguuuuaauuuuguauagaauaggugauacucuuuaaagucucaaauauaaaacuagagaaaacaauauacucaucaaucauaaaauuaaauguauauccagagaacagaucagagaaccaaugcugauaccaaacuucucccaaaaacacaaaauucagauuagaggggaggauauacugagagaaaauaaaacaacagacaccaaaucagauaucuugugcaacugaaauaacuagauaucacuguagguuugaacauacaagacaauuuuugguaagauguuuucaauccugcaucucugcuccaaaaugaacaacuccugcuuuagguugcuaacacuuccauguauaaaaaagagcaggcagcagcuuuucccucaaaaacagaugguaacaacuuugacaucuuuauuccuaacuucccuucucuaaagauaaggguuuccuuuacaauggaaaucaucuaacuauggagcaacagugcagacuacuugaaaacuuggaaagcauuagguucugugcuuucauuaccacuuuuaguuccaaauuaucccacauuuaucaugucaaagaacuuuucaauucagcauauuccuuagugcauaugccugaauaaaaguuucccuuuuuacagcaaucauguuuaaauacccuuuucauuugauuuuuuuugagacggaguuucacucuugcccaggcuggagugcaauggcaacaccuuggcucacugcaaccuccaucucccagguucaagcgauucuccugccucagccucccgaguagcugggauuacaggaaugcgccaccacacccagcuaauuuuuuuuguauuuuuaguagagacgggguuucuccagguuggccaggcuggucucgaacucccgaccuuaggugauccacccgccucggccucccaaagugcugggauuacaggcaugagacacugcacccagcaauauccuuuuuuuuuuuuuuuuuuuuuugagacagagucccagucuggagugcaguggcaagcucugccugccagguucacgccauucuccugccucagccuccccagcagaugggacuacaggcaccugccaccacgcccggcuaaucuuuugucaaauaccauuauuuuuaagagcaaauuuuguaguaucgaaguuagagcuauguguagguaaugauaaucuaaacauucuuuuuuuuuuuugagauggggucucacuuaucacccagguuagaguacaauggcacgaucucgacucacugcaaacuccgccucccggguucacgucauucuccugccucagccucccgaguagcuggaacuacaggcgcccgccacggugcccggcuaauuuuuuguauuuuuaguacagacgggguuucaccauguuagccaggauggucucgaucuccugaccucaugauccacccgccucggccucccaaagugcuaggauuacaggcgugagccaccacacccagccauucuuucuuucuuaaaagcaaaccuuaaacuacagguucugaaacuaauccagacauaacaguacuuuuaacagcaucaaacuacuuauacuuaaaacuuauacuuuauacucuaaaaauauuaagucauaagaaauuuaucuaccugauaauucugagguaauuuugggauuauauaagcaaaaccccagggcuuguagagcagcacuacucagcuccgaguuuugacuggaaaugugagucuacaaaaacaaaaucacauuuauuacaaacaagcacaacuguaaaucaauuuuuagaaagcagaaguugauuacagaacaagcauauucaucauguuacuccaacaaauccuugagaauacgcauaaaaaauaaaaauaaaaauaaacaaggaauaaaauccaaaggccauguguacagcuugguaaagaaaggagaggaaacuggaucgagaucaccugaaugaagauaaaggauaucucuacaccuaugaaagcaaagaggucaacagaugaaagaugcuaaagacaugacagggaaaagggagcaaggcccuuccacugaguaaacaagagacucaaauccaaaagcuaacauccuagcuuuagaguggagugacaucucuuccucuaagacugggagaaggaagggguuagaauguaacguuuauaaaguaucuauuauuaucucaauuaauaguaaaauaaaacaauuuuuuaaaccuuauacauaagagaauuucaauccaugucaaucuagaaauuuuuuuuuuuuuugagacagaguuucgcucuuguugcccaggcuggagugcaaugguguaaucucaguucccugcaaccucugcuucccagguucaagagcagcugggaugacaggcgcgcgccaccaugccuauauuuuuguauuuuuuguagagaugggguuucaccauguuggccaggcuggucucaaacuccugaccucaggugauccacccgccucaggccucccaaagugcugggauuacaggcgugagccaccgugccuggcugucaaucuagaauuuaaagcccaacucauaccauuuauguaaaagcuauaaaaggccaaaucugucaaagaguaucucaauaugaaaguuuacuuuuacccuguaccccauuucccuuguaccauuuccuacuccaaagggauuuaucuucaaaacccccauaucuauuugaaucaaauauccaaggaaucuucaauuguuauucuugagcaggaagaauagcaaauguaaaugguuaaauauaugagcagauacuucccugcagugucuucuauauuuacaaaacgaagccaaaaaaugcaaauccuagaguacagaauguaagggauauagcacagcaaccaguuguaagcaacuaaguaaggcuuaauacuuugagagcuacuaguguaucuccuggauaacagcuaguaaauguuugugauuaaucuucauuaaacuuacuugaaaguguuccuuaacgaugaugugucucauuuucaagaauguuguagauuccuagacacaauccuagcugaacucugaacacgacauauaaacauguucuauuuuaccugguaugguuccuacucugaaagaauucaauuauccuuucauugcuuaaaauugcuuauuguccuauuaucaaccuuccaugugcauccaaauaauuucagguacaaauccuauuuacgaacaaugcaacuugacucaaaauguaugcaguaaggcugggcacaauggcccaggcuuacuuugggaggccaaggugggcggaucaccugaggucggcaguucgagaccagccugaucaacauggagaaacccccgucucuacuaaaaauacaaaaaaaaaaguagcugggcguaguggcacaugccuguaaccccagcuacuugagaggcugaggcaggagaacggcuugaacccaggagguguucaagccauugcacuccagccugggcaacaagagcaaaacuccgucucaaaaaaaaaaaaaguaugcaauagaauuccugauccuauaaauacucaauacacgaaagugcaugucuucacaucuaauuauuauaauauggaauaugauaaugaagaaaauggaauaaacacugauauuaaguaacuagcacacaauaaaguuucugcuuacacaaaaaauguugaugacugugacaccaccaagaguaggcaguaucucuguuaauacuucgccaaaaaucacguuaaaauguacaugucuggaugaaacacuuguuuaaaggcacacggcugggcacgguggcucacaccuauaauccuagcccucugagaggccaaggcggguggaucaccugaggucaagaguucaagaucagccuggucaacauggugaaagcccgucucuacuaaaaauauuagcuggguguggugggggcaugccuguaaucccagcuacucaggaggcugaggcgggagaaucacuugaaccugggaggcagagguugcagugagcugagauugugccacugcacuccagcacgggcgacacagcaagacucugucucaaacaaacaaaaagcacaaaagcugggcaugguggcaccuacuuguaaucucagcuacuaaggaggcugaggugggaggaucgcuuggacccaggaguucaagacuggcuuaggcaaccuaucaagacccccaccucaauuuuaaaaauuaaaaacaaaaauaaaagcacaagaacaaggucauaauaaaaacaaacaaaaaaaauuaaaaaaagagaacaaggucauaaaaaugagaacucaaacuuuggagauaaaaguucaacuuuuucauucuaaaaacaaggaaauuuaaaagauguuaaggauagucaggaagccauuaaguaggcaagugaagacaggaacacagguccacaguaugaugucaaacaucauuucccuaaagcaaaaaugauaacgguuguagcaaaaacugagggugaaugaggaaaaagaaauuaaugcuaccuagauuagaccaaagacaauuguaauuuuagaagcacuuacuuagauguagauucccaaaaggaaagaaaacagauuaaucucugaucucugcuuucaagagcacaaacucagauucaagugccccuaggcaacuuuaggcaaauuaaauuaauuucuucaccugcaaagugaucauuaagaaauaaucucauggaaccauggagaguuaagugauaaagcguguaagguaauuaagaaaguaccugagaagcuuuaaguaacaauaaagaguauuauaaucaguauuauugcuguuauuuuagauucaaagcuuuugagucaacuggcaaaacuuuuaaaaaccaccaaaaguggcuggacacaguggcucacuccuguaaucccaacacuuugggaggcugaggcaggcggaucaccugaggucgggaguucgagaccagccugaccaacauggagaaaccccuucucuacuaaaaauacaaaauuagccggggcgguggcggaugccuauaaucccagcuauucaggaggcugaggcaagagaaucgcuugaacccgagaggcggagguuucagugagccgagcccgagccugagccauugcacucucgccugggcaacaagagcaaaacuacaccucaaaacaaaaaaacaaaaccaaaaaaaaaaaccaaacuaccaaaagugaaaaacuguuuaacaaacagauacauaccuuuaaaacuuuguacagccgaggaaguuuuuucucaauuucuguaauuacuucuuuuccuucuucuccagucauacgacuuaaaaagcaggaagaacacaaguuuaaguaguugacaggaaaaaaaaaaauacucucaaaaauacauguacaaucuuuuuaaaaauuacuuucuaacuccugcaaaugaauugacccaguagguaagguccuuaaggguauacagaauauauaaugcaauauauaucagaaaugaaaguagaaaaacccucagaauaaguuuuuacaucgaguacaugcaaguugugacaaccugacuccaaaaagacagaacagggaucccuauuccuaguuacuaacgauuugcuaagccuuuccaaaggguuuuacaaaacuuuaguacauuucuaugaaaauuacuuugaagcauuuugcaauuaauaaaaaucaguguauugcucuguuaaaaaaacucuggguagccacauuuucccaacacaucggagguuuacacugaagaccccuccuccaacaacuacuuccaaccgaaacuuuuaaaaaucccucgcuugcaaaacacacgugcaugcucccucguuccaaacacacaccucaagcgcagcagcagcaguacccgggaacgucaccuagaauacaucucccccgccccccaaggcguccgcgacucgggcguccucacauuugcuagacuucuagaacucacauucauucuacgcgccccucccaaccaccuucuuucuccccacuauagagcgccccacucuccgcuacgccccguggcggaccucaccuggucagagucagguaagcgucagucugcccuccaugggaggcagaagggucuuccaaagucuccaacagcggcgcgagggggcucugaccccuggccgucaugucggccacccugaggcccgaaccggaagaggagaaaauccagugaccgauggaaacagccccgcggcggcccagugugaguccggcccucacacccgcacgcccgcccgggccucacagccacgccgcgucugcaccccaggccuccgaaucaccaaaccccagcgcgaaccuccuccggcgcccgacaccagacaccugagcccacgccacauucgggccugggcccgcucccgccaccacuuucccgggcagcuuucaacagagggaggagaucggcggagggcgggagaagcccggggaacgaggcaucucgccgcgagggggcggagggugggcagacugaggguuccccgcggccuaccacugucaccccgauauuuaucccaccuaggaagaucaggacaggguucucuccgccucugccccucagcacccagacgcugccagagcucgacuuucccagcuccggcuguuuacucacgcgugcggcgcgcucccuccuagaccaagauggcggcugggcgggcccaggagugcg

SEQ ID NO: 191199 - RNA, 7255 nt, Homo sapiens
aacaagggaggugcugcaguuggcggucgggcuagagaagagaggcgccugcgcuugcgagcugggcuugugaguggggcugccgagagggcaggcguggggcgaggccaaaggacugaacccgcaggagcgucacgggcgccggggcggcugccgacggcgggacugggucagugagaagcccgugggcccccgcccugccugcuacucccauccccaccugcgcgcuccccaugggggacgacccccgauuggguccgaugccuacccucgggguggagccggcaggugugugagcgcgcgaggccuaggcguggugugugcguccgcagaucuccucgcggguggagugugaggagcaaagcccucccuuaacuauaaaaacccgcggauucgcugacauaaacgcuguuuuuuuaauccuuugguuucugaggcauggucaggacuagauggggccaaguuuuuuaaaaauaggaauguuaaaacguaaugauaugcuuagaauauuuacguuaggaccuuugagauauuuuaaauuucuugguaaauacaugaccacagaaaucuguuaggaguagcugcgcguuugguuucaaaagaugcuuuucuaacacauugauguacagauaacuucauuacuaacaaguuggcucugacguguacacauaaugcaccaaauuggagucucucaaaaugaaagaacaaaaagauuuuuaauaacgaauguucuaacacauagucgugcuauuuuucuuuagguuuucuaucagauguuccacguaauaaugcugguaaguauggaauaauuaagaaaauauuugaagacagaaauuaguuugugcacauacagcgcugguagguuuuuggaacuauaccuuaaaaagugucaagaacugggggccaggcgcgguggcucacgccuguaaucccagcacuuugggaggccgaggcgggcggaucacgaggucaggagaucgagaccauccuggcuaacacggugaaacccugucucuagcaaaaauacaaaaaaauuagccaggcgugguggcgggcgccuguaguuccagguacucuggaggcugaggcaggagaauggcgugaaccugggaggcggagcuugcagugagccgaccaucgugccacugcacuccagccugggcgacagagcgagacuccgucucaaaaaaaaaaaaaguuucaagaacugggaaggaacagagauuuuuacccuguuugcaggcuaacuuagccuggcaguuucauggaagacacaagacuauucauuucaggaaugaauuacucccagcaguagccaguaaaucagcaauuucgccugaguucccuaaagccccaguucccacaggauaaugcaaagugggcaagaagucaccuagauguagugugugucgaauuacaggaaaggagcccugagcuuagggaacccagaucuuuaucauuuggacaaauaagcauguuucucaaggcuguccaguguacaaacauccuugagacaauagucuagaggaaagggcagucaguaagacaugcagaaccaccagagacgcagggaaaauugucucccaacaacaauuuucuggaauuuuaacaaaauugguuacaaaaguauugaaucucaugauuugaugucaguuacuugccaauuugacaugguggucagauauaauuugacuucagacucgagauuccagcuccaaccuguggauugucacaaccaagucaaucuagaguuauuuguccuauacccaccacucuuuuauuucuuuguugugaauuuaauaagguagcauaugcacucugaucugaaacagaguuuaaauuauucugagaagaaaaaaauuuuauuacaaaauugauguagaaaaagugugaacuacgguugaaccaaccauaaccaucccacugcacauguaaacauuuucuaaaacaaaaacaggauuauacuguacacacuauuuugugacuugcuuauuuaauuugaacugaauaucuuggcuuuuacuggcuggauauucuguuauuugcuaucacaugcauaucuuacuuaauuauuucccaauucuuggaugucuguguaguuuuuaauuuucauuauuguguaaaguaugcaggauauuguuacacuauggaaacauugcagacauaccaaauagacauagauugugcuuuugaagagaacaguuaacuuuuuggaauuuuaacaaauugguuucaaaacagauucacauucuuaaaacuaaaucuuuguucauauucuuaauuuuuggagacauuuuaauuucuaguacagcacuaaaugucuauugacaacagaauguggaacuccucuauuauuaaacaaguacaaagaaaaaauggacucugaaaaucucaaucagcuuaacacugauuuuauccacuggacaaaaacuuauuuucacauaacauuucuuauuuucgacaccaagucgauaccaaguggaaagcaaaacuuuguucuccuauugccaaaagaugcuuuucugacauuagaaaaacaacauaauuagaaaauacaaaaaaaaaaauuuuuuuuuuuuugacacggagucucgcucuguugcccaggcuagagugcaguggcgcgaucucggcucacugcaagcuccgccucccagguucauaccauucuccugccucagucucccaaguagcuaggacuacaggugcccgccaccacgcccagcuaauuuuuuguauuuuuaguagagaugggguuucacuguguuagccaggauggucuccauuuccugaccucgugaucccccgccucggccuuccaaagugcugggauuacaggcgugagccacugcgcccggccugaaaauacaaauguuaaagcuuuuaaaauacuuuuauuaauuuuaggaguuaagaaguuuccauuauuuugcuccaaaccagaagacucuguucccuguauauagaauaggaguaauauuugaaaacaacuggcugauguuuaaaacugaagauugucaugauuguuuauccuaaucccaaugcugaaguaagauugucuuggaaauacuaaguuggguaaguauuuuuuaaagguuuauguugaguggugagaaaauacuaacagaaaaagaugggaaaauuuuaaaagugcacuuucagaucagcaggggaacuauguuaccucagucucaugcuauuuugaggcuaauaauucaggaauuucaguaauuuguggcuaauuaaguuuagguuugaggcaguuuucaaacaacagugaguuacauuugaaauuuguuuuaauuauaaauucagaauucucaaaaagcauauuuaauuuaaaaugugccuaguuacaguacuacugugauugucaauuaugccuuauuauuuauuacauuguuucuguaggaaagugaauucugcauuuaaauuucagggaaccagucagaagcaucuggauuaggcauuuagugauacaaggauccagaauaacaaaaacuauguaccagccacauucacacaacaggugauaccccuauagguuaauuauucucuagauauucuaaauuaagagacacagaauacuuagucuuaugugagucaagagcucuauucugucuucacuacugggugucuacuguuauaaacuggagaauaugugugguuaaaugccauguuuuucauuuuuaauugaucuuuuucuuauugcugugguucuuugccuuuuuaggauuucuuguaaaaaccucaaaaugguuauaaagaguaucacagaugugguguuaugguuaguguguacuuugaaaguaaugaauguuuuuauguaauuaaauaucuuucugccaaaauuaccuacuuaguguuauauuuuuaaacuaaugaguagucauuaaauauucuauuuuuuaacacuagaauuugguacuuaaaagcaugaagucuggaaucaaaucaaccuaagauuccagcucuggcacuuuacuaacaccuaaccacuucaagauccagcuuauauaucuuuaagaugaggauaauaaugauuccuacuuaauaggguugugacaauuaaaugguaugauauugcaaaguuuuuaggucagugccugacauauaaugacucucaaaauuauuauuauuaucuguuuacacacauuaauuauauccuuuucuggauauucuauauaguuauuuuuuauaaauaauguuuauucuuaccaucaguugaccagcuuauucuuuccuuuucucuugagauuuauaauuaaucaccuucauuauauucuaaugaaaacagagacauaaguaauugucacaccacaaacaguaugauuacucagguguauucaaauuauuuggcaccccagagcuaaacuaucuagagcagcuauaaauaaacaugugaaaacucuuaaccaaguuacuucuaguuuggaagaauuaaauuggccuccaguucucagguaauuuguuuagaauaucauauagagugucagcaaucauuuacuuauaauauugauauuuagaaauugauuuuaagcuaaauacuuuuuuaauuuuuuugauuuccaccuuuuaaguucagggguacaugugcaggauguguagauuuguuacauagguaagugugugcccugaugguuugcugcacagaucaucacaucaccuagguauugagcccagcauccacuagcuguuuuccugaugcucugccuccucccacccccacccucugacaggucccaggguauguuauucccuuccacguguucucaugauucagcucccacuuauaagugagaacacaugguguuugguuuuucuuguuguuguuccuguguuaguuugcugaggauaauggcuuccagauccauccaugucccuguaaaggacaucaucucauuccuuuuuauagcugcauaauauuccaugguguauaaguaccucauuuucuuuauccagucugucauugaugggcauuuagguugaucccaugucuuugcuauugugaacagugcugcagugaacauacgcuugcauguaucuuuauaauagaaugauuuacauuccuuuggguauauacccaguaaugggauuacugggucaagugguauuucugccucuacgucuuugaggaaucaccacacugucuuccacgaugguugaacuaauuuaauuuacacuccuaccaacaguguaaaaguguuccuuuuucuccacaaccuugccagcaucuguuauuuuuuggcuuuuuaauaauagccauucugacuaguauaagaugguaucucguuguggcuuuaguuugcauuucucuaaugaucagugauguugagcuuuuuuuucauauauuucuugggcacauguauugucuucuuuccagaauugucuguuugugucuuugcccacuucuuaauggggcuguuuguuuuuucuuguaaauuuguuuaaguuccuuaucaaggaacuacaugauucuuaucaaaaaggauuuuggacagauuuuaugggcagagucuuuaacuauuugggagcuaaagguguaagagaagauaaaaugaaaagagcagugacaucgaugccuuucacuucagggaugguggaacuuuucaacuuuauaauaguugcuggauauuagaccuuugucagauggauaaauugcaaaaauuuucucccauucucuaaguugucuguuuacucuguugauaguuucuuuugcugugcagaagcucuuuaguuuaauuagauaccauuugucaauuuuugcuguuguugcauuugcuuuuggcaucuuugucaugaaaccuuugccuuugcuguguccugaauuguauugccuagauuuucuucuagguuuuuuauaguguuggguuuuacacuuaagucuuuaauccaccuugaguugauuuuuguauaugguguuaaggaagggguccaguuuguuuucugcauauggcuagccaguuaucccagcaccauuuauuaaauagggaauccuuuccccauugcuuguuuuuguuacuaaauaccuuuucuuaaaaaguuauuuuacaucuuccaagauuucauguuauguuaaauuuguucagaauuuugguuaguacacagagaguccuuuauacaugaucuguuauuuaauaugaggauuguaaauauuuuaaucuaauaaaauaagugugguuugauugauaauuuaaugauaguaagaaaugcuuuuuuuucuuucuuauaaauucuauaagaaacacaccuccaggaacacaauaauacuaugaauguccuuuuuauauauuuuguuuuccacuuaaaauacucaaauacgaacuuugcuucuuagagaaaagugguuagguaguggucuugaagugcuuaauuacuuuguuuauauuccucccuuuagcagauuaacauuuaguuauguuuauuaaauaaguauuuuagcuagauauguaaacagaguuuguuuagggaauaauauuucuucuuuuucaggguaauccaaaucuauuucuggaaccaugaaaauuuugcuaguuuuugacuuugacaauacaaucauagaugacaauagugacacuuggauuguacaaugugcucccaacaaaaagcuuccuauugaacuacgugauucuuaucgaaaaggauuuuggacagaauuuaugggcagagucuuuaaguauuugggagauaaggguguaagagaacaugaaaugaaaagagcagugacaucauugccuuucacuccagggaugguggaacucuucaacuuuauaagaaagaauaaggauaaauuugacugcauuauuauuucagauucaaauucggucuucauagauuggguuuuagaagcugccaguuuucaugacauauuugauaaaguguuuacaaauccagcagcuuuuaauagcaauggucaucucacuguugaaaauuaucauacucauucuugcaauagaugcccaaagaaucuuugcaaaaagguaguuuugauagaauuuguagauaaacaguuacaacagggagugaauuauacacaaauuguuuauauuggugaugguggaaaugaugucuguccagucaccuuuuuaaagaaugaugauguugccaugccacggaaaggauauaccuuacagaaaacucuuuccagaaugucucaaaaucuugagccuauggaauauucuguuguaguuugguccucagguguugauauaauuucucauuuacaauuucuaauaaaggauuaauaugucagcaa

SEQ ID NO: 191200 - RNA, 38696 nt, Homo sapiens
aacaucaguccaacugaccacaaagcaacuagggguuucagagggaguacacguaaggggcaaaagcagcaacggaauacgacaacggaauaagcaugaauacgaccuggcuaccugaaggagguaggacggggaaccgagcagcagcaggugguggaaugccagggaaauccaaccgugcuucccacgcuggcaucgcucugauuaugaccaauccucuaaucuuauucucacaauuagggaggaagaaaaaaaaacaaacccaaaccaaaaaagaaguugguaggugacucugugagacuacuguuuuauaaagggagcguuuccuuuuauaaaauuuagcugagcagaugcuaggcagcccacaggaggccacuauuccccucagcuguacaguuugggaaaauaccuacacacccggagaacagagagcuugguguguguugaguucgcuccuguucaucagcagcccuuuccccgccucuggccaccagggggaccugcaaccaaguauguguucuuucaggcgagcgggaacgcgucugcauaaaucuaguccaauccagggccccguagcaaggcgccaaagcugggggaagcgcauuucuguucucucgcgagcacgacgcggugccucccaguccuccuccggcccucccucuccgcccucccggcccgcgagcgcucgggccccuuccaguggcucgcggcagguggcgcugucugcggcgucgcagcggcccgggcugcagcagagacgaucucccggcgggcugugcggcccggcucuccggcggcagcgagugccacgucccaagugcuacgcggaggauuagagcaggcggugcgcugggggcgggagcagcgcggagcccggcucggccacaccgaucgcccgccgccaugggcuccucgcaaagcgucgagaucccgggcgggggcaccgagggcuaccacguucugcggguaagggcuccgacggcggccggggagcugcgggcuggaggcggggccggccgcggggaggcggaggcccccaugggcuccuucacggggcagccaggcccgaucccgcgaaggagcggcggucgcgggcgcugccuuggucgaggcugguuccggaggccgcucgcaucccaccuccgcggagcgcccugggcacgggguccgcggcuguaggaggacgggcuggagcuggaggcggcugccggcgacucggccagggggcggcccugggaaggggggacaaccuugcucuuuuuccgcacggccuucucucuccuccacccccccucauuuuuagcuuccaaaguuaggaagggcgcggaggcaacgucuccaaaguggugacugugaaggcagccuuugcgcuuuccuaggagagggauccggacccgcaguccggaggcggggccugcggcggcagguguuaaaucaccucggcgccggccgaguggccugaaagaccagcagggcaggagacggaaaaccaaauggccuggaaguagguucgacggacuuaaacagacuugauuuugaccagacuuuuccuuucccgugccacuccugacccucccaaaccuucucaagauuuccuggagugggaacuuccguucuguuccgauugcugagggugugguuuagauuauaagguuuagauccacagugguaaagagguagugcagagaaauuuuuuuuaaaaaucggaguauauaaaggaaaacaacccuagcuuaacuuccaggacgcagagaaacauaguaucucaaaaggcgucagcuaagccccuaccuaugaacggccugggccugggugguacaaagcauguggucuuuuccucauggaaccgggcgacuuuagaaguagcauugaugguuguuugcugugacaccugugugaguguuaacaugaacagucaacagaguggccgcagcguguagcgccauuuagggguguaauagagugucacucaauauuagcuccucacaggcaagaacguuuucacugaaaguaagagagugcacuuccuggugcuaccuucauuuccugcccugggucccauguuuuaggugagacacauucuuaaauugcccagcugucuaugugauagggcugagacagaucaucuuucugaucuuccggauuaucgugucuauugccuuuccauuacacuaaaaaucccuccucugccauacucuuaguaggaaagggugauuuuuuuuuuccccgaaaggaaaagggagccuauaaauaaaccguauuaucuuccuauccccuucugcuaaccaaacacccaagagccacacugagagaggaaauggaaggagaauugucaguucccaaaugugaggugaaagcugugcuuuucuuucuauuaucuggucugauuuugaguucucuacccugggauguuacccaguauuaccagcuguuucucacagugaccgauuguggucaugaauccuuggggauucaugauauuuuuauaauacaugcacucagggaaacucaguaaaacacauuaguguuaauaagcaaaaaaaaaaaaaaaaagucgcguguuugaaagaaagccauacacaucaaaaggauuccaacuuagugacugcauuccgacauaaaaugaguuuguauuuucuuuauguaagugcagucaagugaaacagcauucauacauauucaguagugcagauguguuauuaaucuauacaucugauuuuuagaaaaacuagggacaaccuuaguuaccaaucugcaucuggagcauuaauguugcacacgaugaaauaauucuuauuuaguuagacuuuuacuaaagagagcuuuaaaauaguaaugaucuaguuuaggagaauuuugugucugccuuccuaagacccucugccccugauucuguaauugguuuucuuaucuuuguuuuuagagggaaaagugcuguguuaaaucuuaacauguaaaaaugucuuccuuucauuuguuauugccuaaauggacagcgauauauuucauuguuagauuaccaagcuuguaaacuggaguaacuguggcaggaaaauuuugaauaaaaucacccauauucaacaaguucuagaacgauuuaauuagaaguuaguuuucuugaauaaccaauucccuggccaaucuuguuguaguaaaaacuuaauaugauugacuggguuuugaaauaccaauuauaauaacauuuauauccacugcugucuuuugauuucaugagucccuauaauucagauagauugagcuuuccauuuuuuucauuauuuuucaauauccaucuaaaaauauuuaggggacagccuuuaaauggauucagaaguucugcuaugagcaguguaguuccuuuuuauguguucuguauguaugagugcauauuuucagauugugaucauauuguguacccaacuucuuauccccacuccagaguaaccacuguggacaguuuuuuacauagccuuucagauauauuuuaugcuuauaaaaaagucucuuuggccgcgcacaguggcucacaccuguaauccccacuuugggaggccgaggugggcggaucaccugaggucaggaguucgagaccagccugaccaacauggugaaaccccaucucuauuaaaaauauaaaaaauuagccgggcaugguagugcacaccuguaaucccagcuacuugggaggcugaggcaggagaaucacuugaaccugggaggcggagguugcagugagcugagauugugccauugcacucuagccuaggcaaaaagagugagacuucuuuucaaaaaaaaaagagucucuucuucuuccacccuucucucuuucuuuuuguuaccuuguaaucaugauccaugcuguugcacaccucagucuucucaguuguugaccuaucuuggcagucuuucuguaguagcaaguggccaucugcuucaugcuuucaguuagcucacgguagucuuuuguaccauagauugguuaaggaguaccuccugguguugaacauuugguuaucuagucuucuguuauuauaaguacauauuuacaaccuuaaauccuacuuuuuguuuucccauaacauacauccuuuucccagauuacuguauugaauuuuaaugguagcugucuguagaaauguugaucuuuauuuuaguaaauaacuacauuguuuucugaucaucaacauguguccauuagagaacauuuggaugugguaaaaaaguacagcaaagaaccugaauuaccuguaaucccaccaucuaaaggcaaauacuguugaaguauuucucuuagucuccuuuuuuuccugggccuaacaucgccccuuagccauguuucacaaagauuuugaauaauaugacguauucaaggacuauauggccaaaaguuaucuuaagagguuaacauuacaaccaaaauagccaacagcugagaaauuguuaaacaaaucagggccuaaacacagauagaaugcuacacauucacucaaaauuguguuucagacacccugugugugugcagguacauuugagugcuuaggaaaauaaagcugaaagguaauaaacaagguugucuaaaaaauuauuaguggauggugacuuuuuuuuuaacuuuaauauauuuucuaggauuucugaagugaucauuaaauacuuguauagucacccaaaguguagauaugcaaaauuacuuuuaaaaaagaaguggacuccuaguggaggauuuaaaaauuuguguagaagucuuuuuuuaaaaaauagcauuucagauuuccuuauauagugggucagauuugugcucacuaugaauggcacuuuuauuuugguccuccaauccuaauguaaggcaggaaaaauguuagggcuucucaguuuuugaaguuauuguaaguuacccccuacaugugaacuauguuuaauaucaaauuuuugccuauauuuuccauuaauuauccagugaacccaacaagaccauuuucaaaauuaaauuaaaccaaaauauccaacaggugagaaauuguuaaacaaaucagggccuaaccacagauagaaugcuauacauucgcucaaaauuguguuucaaacacccuguguaugugcagguacauuugagugcucaggaaaauaaagcugaaagguaauaaacaagguucucuaaaaaauuauuagugacauaguucacaaaauuaaauuuuuggagugaccucacagaugccuauuauaggaucugcuuuuaaauuaaaauauucauauucuguuccacacuuaaaagagauggggaauagcugagggcauacuuucuggagcaaguauucaguguggagacuguguggaguguggagacauggaaaauggcauuuucauucuuucucaugcuugcuucugggagagauuuugaggugauggauauuuugaaggaagggucauugacaugaaaugugucacgaguguaauaacagguuuuuaucuucugagcuauuugcugcagacuggguaacauuuagguguucucagagaagcaagugacugcaaguggaauuacuucuauagaaaaugcaaugccuacaccauaucuucuaucauauggaacugcucuuuuuauauauuuuuuucuauuuugucagagaugaggucucccaaagguacugcucuuuuuaaauggugccuaacuaaccuaucugcaauccuguugugaugggauuucaauuuaguacuuauuuugaaaaaauuaauuucugauauucaauagucauugucuucuuuauucuucuaacagucuuucucaaacuuuugaaacucauacccuguuuuuuuuuuuguuguuguuguuguuguuuuguuuuguuuuuuuugagauggaguuucgcuuuuguugcccaggcuggaguacaauggcgcaucucggcucacugcaaccucccggguucuccugccucagccucccaaguagcugggauuacaggcaccugucaucacgcccagcuaauuuuuguauuuuuaguagaggugggguuucaccauguuggccaggcuguucucgaacuccugaccucaagugauccacccgccuccaccuccgacaagugcugggauuacagguguuagccaccacgcccuaccucauccccuaacacagaaaucucacucuggcucccuucucacucauucuggaaacaauggguaaaaagaaaacaguaggguuauuugguauuguuuucuauauauaaaguuauaauugugaaaccugaagagucugacccugcccccagaauugaucucuccuuuuuuuucuuuuuuguuuguuuguuuguuugugagauggagucucgcucuguugccacggcuggagugcaguugugcaaucucagcucacugcaaccuccgccuccgaaguccaagcaauucuccugccucagccuccagaguggcugggauuacagguuccugccaccgugcccagcuaauuuuuguauuuuuaguagagaugggcuuucacccuauuggucaagcuggucucgaacugcugaccucagcugauccacaggccucggccucccaaagugcugguauuacaggcgugagccacugugccaggcccaaaauugaucuuuucuaauaaaaggcccagaaguuguuuaauaaacauucuuuuaaauugcuuucaaauguaggaaucaggaugucucaguuuauugaagccauggaauacaauguauauaaaucuugggauacuuuuaggaauuauaucauugaacauaaacuuuuucuaauauuaauaggccuugaacaaauuaguaguuucauguugauuauauacacuuuuuuuuucuuugagauggagucuugcucuaucacccaggcuggagugcaguggcgcgaucucagcucacugcaacuuccgccacuccaguucaagugauucuccugccucagccucccaaguggcugggauuauaggcacccaccaccacacccaacuaauuuuuguauuuuuaguagagacaggguuucaccuuauuggccagguuggucuagaacuucagaccucaagucaucugcccaccucagccucccaaaguguagggauuucaggugggagccacugcacccagcacccccaacgccccaccucuuuuuuuuuuuuuuuuuucuuuuuuugacacagggucucacucuaggcuggaaugaguagcacagucuccacucacugcagccuccaacucccaggcucaagugauccuccccccucucagccuccccaguagcugggacuacaggcacacaccaccaugcccagcuaauuuuuuguauuuucgguagagauggguuuuugccauguugcccaggcugcccucgaacuccugaguucaagcaauccacccaccucagccucacaaagugcugggguuacaggcgugagccacugcgcccggccuguauaugcuuucguacuuaugugaugagguguguuuuaaugccugcgcuaucauccucaggauucucacugggggagaucugcuguuagugguuaauuaugguuucaguaaguaguagaguguacaacacugauucuucugccuucugggucagauacuaacagggcuuuuuaauaauuccucugcaaauuuuauaaaaauugagcuuagaauaaccguuaacaucaguguguucauuuugcuuacuuuaauauucuauugaaaggauuauauauauugauugauucacuauaaaauacuaauguaaacuaggaaauagaaaguuugauaugugcuuuugaaacugacuuuuuuuuuuuuuuuuuuuugaagcagggucgcacucugucacuauggcuggaguguugugguguggucauggcccacugcagccuugaacuccugggcucaauuaauccuuuuaucucagccuccugaguagcuuacaggcauaugcugccacgucuagccaauuuuaaaauuuuuuuguagagagaucuuucuauguugcccaggcuggucuugaacuccugggcucaagcgauccucucgucuuggcuucccaaaguguugggauuacacuuaugagccaccacaccuaguccuaaguaguuacuuugagagacuguacauuucccuguuggcauugcaaauaaauuuacuguagcaugaagauaauuauucugggguuuuguucucucuuuuaagcaucaaugagagaaggcucaagcacauugucagaaauaaggaagcuuaagccgggcauaauggugugcaccuguaaucccagcuacuccaaucaggagacugaggugaggugggggcccaagaguuuaagaccacgcugggcaacauaaugagauccggucucaauaaaagcaaaauugucacuugaccaaggacuuugaggcugcagcgagcuauccucacaccacugcacuccagccuggguaacagcagcgucucuaaaauuaauuaauuaauucguuaauuuuuuuaaaaaaaauuuaaggcuaggugcgguggcucacgccuguaaucccagcacuuugggaggcugaggcggguggaucaccgaggucaggaguucaagaccagucuggccaacauggugaaacccccucucuacaaaaaauacaagaauuagaccggcaugauggcgcgugccuguaaucccagcuacucaggaggcugaggcaggagaaucgcuugaacccuggagguggagguugcagugagccgagauggugccacuguacuccagccugggcgacagagugagacuccaucacaaaaaaaaaaaaauuuuuagagacccgguuuugcucuguugcccaggcuggagugcagugucacagucccagcucaccgcagccucgacuucaugggcuccagcaguucucccucccuagccuuccaaguaguugggacuacaggugcguaccaccacagcuggcugauuuuuugaagggacaaggucucgccacauugcccaggcuggucucaaacucccgggcucaagugauccuccugcuuuagccucccaacgugcugggacuauagcugugagccacaucccugcccuaauuaauuaaauaaaaguaaaauccaggcuuuguggcaugugccuguagucccagguacucaggaggcugagguggaaggauugcuugagcccaggaguucaagaguagccguggcaaaauauugagagcuugagaaagaaaaagaaagagagagggaaggagggagggaagggaaagagggaaacaaaggaggaagcaccugguacagugacugucaccuguaauccuaacacuuugggaggccgaggcagaguauuacuugaagccaggaguuugagaccagccuagacaguaaagugagauccugucucuaaaaaaaauaaagacagaaggaaagaaucuuguuaucuuuguggacaugaguacauugagaaacuaucauagucaaccaccagagaccaccuuugggaacuggauucuagugccagcucuaucacuucauucuguuuccuugagcaacccuuugaacugcuuugaaaagcuucagucuuuguaucugaaaagugcagauaauagcagagccacuucuaccuuuuccacuaaaaaacacauuagauacuguguaugaaaauaaugaaaacaauugagcauuauuaaaucucuuucuuaaaacaacgcuaucuaccuccuugauuauccuguggguuaaaugagauauuccauguaaagcacuuaacuuagaauguggaauauaauaaggauucaaauguuagcugaugccuuuauuacuagcauuugcauuauuguguagaaccaguaucguggcaauacuagcuaaaauauacuacuguaguuguaaacauuuuuaguauuuuuauuugauuaagcaacaguuacuuuuugucuguguaccuaaccuguacuuuacugcuguuuaaaacguaaguuugaggucagaucugacccauuaauuuuagucauauaggcacacacauaaauggugccuguuaauuuccucugauccucauuuuuaaggaaauuguuuuuuaauuuuaaacggggagugccaguauccuuuucauugcauugcuacaguguuacuacacacauuaauuaaaauggcugaaagagucuaugcaauuaaaaugaucuugcuguauuugauuuucuucauuguagaaucuauagauagcuuagcaacaguuagacuuauuucauggugggucauucaggcuuacagauuacauaguuagccuccucauuuuugcagcuaaagaaaagaagcacaggccuguaaucccaguacuuugggaggccgaggcggugaucaccugaggucaggaguuugagacuagccuggccaacauggugaaaccuugucucugcuaaaaaauacagaaacuuagccaggcauggcagugggcgccuguaaucccagcuacuugggaggcugaggcaggagaauuacuuaaacccaggaggcggagguugcugugagcugagauugcaucacuguacuccaaccugggaacaagagggaaacuccaucucaaaaaaaagaaaaaaagcacagagaaguuaaucugauuugcccaaggucacagagcaaguuuucuuucccuaagaaacaaaucccuaaguuauuugaagaauauaaaaugaguucagaaguugucagaguuuuugcuucuuuuagagcaaacuucaauuucuuucgauguuguuuuucuaauguacagaucuuuucuggaaaacuauuaugcaauaauggguuuuuauuuccuuuuaguugccauuacaauuuuauuuuaaauugcuugaauguuaaaaauuaugucaggguuagugucaggagaacauguacuuugcuuuguuuuggaagaacaugugaagacaauguuuuagcaggugaggcuugaacucuucuagucuacugcaaaauuauuuaccacacauuugugucaagacccaaauaaggaaacuuacccauuugcagacauagaauauaguagucucuccuuauccacaguuugacuuucuguggcuucaguuaccuuuggucaacugagguccaaaaauaucagauggaaaauuccagaaauaaacaguucauaagugguagauuguucuguuuuauauuauuaguuauuguuguuaaucucuuacuaugccuagcauauaaauuaagcuuuaugauaaguguuugcauaugggaaaaaauauaguacaguauauguaggguuugguacucugcaauuucaagcauccaugggaggucuuggaacauauccccugcagauaacagggacuacuauagcucccucacccuccucacuaaaaaaaaugcuuauuauaaccacggaggauuuaggauuucuuuuuauuauaucacauucccagaucuuuucccaucauuuugaucaccuacgcacacauauagugcaugaggauuuauguuuauaguugaggugggucaucauuuagguauugcuuggauugaauuuauuuucuagucuuguuuaacaucuccacuguuuuuaaaagcaguacaagagggagaguguuagaagagaugauaguguagauagucauucaauggggcuuuucugcauuuuauguguggaaaaggaauauaugguguaguaauaaaaaggagacaguuauacauucuaguaagccaauuuuaugguauaauuuucauugucagaaaacuuaaggaagauaauuuacauaucagccagaaacauggauaagugugucuuuguguaucaccuagugcagcauguagucuggugauauccugugugcugcaaguugccuugugguuuacuuucuuuguuacuuuaagguagaaggucuguauaccucagcugaagguauguaagucaguagaccagugcaguugggagaaugcccccugacacccaacuccacccaaacacuucuucccucuuacucugccauuccucccucccccaagugaagaauuaaagagagaaagagguaaugugaaaugacccaaaccuagcauaaguaguaguaguugaacauucuuaauccuggaagaagagaugaaugcuucacuggaaagcaauaguuaggucuguguguuaaaagaaaagaaaaguuuaggcuaaaucugguaaaacuuuuaaugauacgggaucagaaguggagggaaaagucaagaagugaauugcuuuuuuuuuuuuuuaccaggaacuuaauggagcagaaguauuaacgguaucuuguaggacagcuuuuccuaacuuuauuuuuauuguagcucaagccaaaaaauguauuuuccauugcaaccaguacauacuacauuucaugaagaauauaggccuuuauuauaucaugcauuuuugacagauuuucuauugugauauuguguuuugauacuugucuuuugugacacacuaaauugauuucagaaccuacugaaaucauccacuguaguugaaugacaccacuuuagggauuauuucuauaaaguuggugauuaaaaaauccagcuucuaaucauugaugcaaauuucuuuuuauguaauagagaugccccuuuacugugcaguuucaucauaagcuucucauuuuugcucguugagggguaaaaacugucuagcaaauaucaucuuguuuauugcagccguuuuuucuagaauguuaggagagaagcauuucuuucacgcugcuguaguuuuuauuuuguaagcuaaccucagauguauaguuugaaccuuacaacugccaguuaauguguucauaauuucuucuaccuauccauguuuugguaauauaucuuuuuauaauuauuauuuuguaagcauaauugcucuuuaguauuuucagcugcuuuauuauguuucuuaauugucaaaguaaaucguguggcccuaagaagaauuggaaaaaaaggcauuggaaaaaguguaaccucaguauacuuguuuugauacagggagcaucuuuuaaggcuuuauauuaaaagagugcacacaaguguauagcuuggugaauuuucacaagcaacacacuuaauguaaccagccucuuaucccuuuccagugacauccugcacaacucccaccuccacaggaugaauauccugauuucuaacagcauagaugaguuuggccuguucuuguacuuuguauaaggggaaccaugugcuagguacucauuuguaucuggcuucuuuugcucggauauugcuugugagauuuauucauguauauuauuguagaccuuucaugucauuaauguauuuggugccauugagagaauaugccaauauuuauuaaccuguugauggggauuuuuguaguuuucaguuuggggcuuuuauaaauagugcuacuaucaacauuauaguguauugcuuuuagagaacauguguauacccauuucuguuggguauauacccaagguuggaauauacggucaaaaggugugcauauuuucaauauuaauagauauugccaagucauuuacuaguuugcauucuaaccagcaguaauugagguuucuaaauguccuacguccucacuaacacuuaauauuuuucgucuuuuuaauuucauucauucugauagauguguaguaguguugcauugugguuuuaauuugcauuuccuugaugaccauugaaguugagcacauuuucauauuuauagaucacuucaguauccuguuuuguuuagugucugcuaaaaucuuuucuccauuucucuauuggguugucuuuuuuucuguuuuaagcaacuuuauugugauaaaaguuacauaccagaaaguucagacuucuaaaguauacaguuugguggguuuuuaguauauucauagaguucugcaaccaucaccacugccuaauuccagaaucuguguauuacuccagaaagaaacccauauguauuaguagccauucccccauucuuccacccacaaccccucauaacaacuaaucugcuuucugucucuauggauuugucuauugcggacauuucauauuaauugaaucaaacaauauguggucuucugugacuagcuucuuucacuuagcauaauguuuucaagauuuauccaugucauagcgugcauugguacuucauccuuucuuauggguauaccacauuuuguuuauccauuuaucaguugggggacauuugggcuguuucuacguuagggauauuaugaauaaugcugcuauaaaauuuguguacagguuuuugcauggagauauauuuucauuuuccuugguuauuuguauaccuggaguggaauugcuggaucaugugauaacuuuguguguaacauuuugaggaucugccaaacuguuuuccacagcggcuacaccauuuuacauucccaccagcaaauguaugaguguuccauuuucuccacauccuugccaaugcuuguuacucucuuuuuaauuauggucauuccaguggacaagaaauaguaucuugcgguuuuauugucugucuuucugaacgcuuuacaguaguucaagauuucuucuggauacagauccuuuguuggauauguauuaugucuuuuuacuuucuuaauuauaccuuuugaugagcagaaguucuuaguguaguucacuuuaucaauuuauuuuaguuuaugguuagugcauuuuguguccaguuuauuaggaagccuuugcaaacuugaaggucucaaagauauucucuuauguuuuucucuacagcguuuauuguuuuacccuugaccuuuuagagcugccauccaucuggaauugauuuuugggaggcaacauuugaaaaaaugguuugucucucuuuccugcuaacacuuuacaaguuuuauuuuuucuuuuuaagaguaaaagguauuuaauaugguuguaaaaauaauguuguguccaggaauugguuagcuauaaagacuuacccucagauggugauugcagaguuaggaggaugagcuuaagauuucuuggccuucuaucauaggcuugagacuuagcuaggcauuucauaaacuuaacucauugaaucuuuacaacauucuugugaagaagauggcguuaucccuuacuugcaaaugagaaaauugaggcccagcgugguaaauaaacuuuaccaagcucacacagcuaauaacuggacaaaaucauggcuuaaaaccaacucagucuggcucuaaaagucuauuauuuuuucacuguauauaaucuuuuaaaaucuuauuuauuuauuuauuugugagauggagccuugcucugucgcccaggcugaagugcaguggcgugauccugacucacuguagucucgaccuccugggcucgagcaauccucccgccuuagcuuccugaguugcugggacuacaggcaauugccacuaugccuggcuaauuuuuuaaaaaauuuuuguagagauggagucucacuuuguugcccaagcuggucuugaacuccuagccucaggagauccucucaccucugccucccaaagugcugggauaacaagugugagccaccgugccuggccuuaauuauuaaauuuacaaauuuaaccuguucauuguaaauugcuuugauauuuggcccaguaauaaauguuaaauggucuguggagccaaguauauauagacuuuuaguuaagaugacuugaagaaagcgaagauaaauuaauaaucaggagaucucauaggggauagaaaguauugaagugguaaucugaugcuugagagauuacgugccaggagauucuugucaguggauaacauugcaagagaaacuuaccugugucaguguuugguuugcuauguuguagaucauauuuuccaugcuacaaaauauaggaaauuuccuuuagguauaugagggucaaagagaggauuuuucuagggcacucucugcugacuuccuagcaguaauuaagauaccuaccuauguaauugugcagauacuaaugauguaaauaaauuuaggaaagaaguuaauuucaagggccauuagaaacagagaggaaaucgauguuaguaacaaaugaaauagaaaaauagagcuagggaaaggaucaaguuuauuuuagaauucaaauuuagcuauugaaucauuuuugaauuauaggaaaaauacuucugauauuggaaaauuuccauuucagacaaauaguuuaaacuuuauacucuaaaguuuauacuuuaaacuuuauaaggguggccuaguaagaaucaguaugcagggucagcuuucuacaugagugauuaccuuauaaaagugcugucuuuagcccuuuuuaacuaaaagguaaacuucuggcagucucaguggcaaagucugaaauugaucagugaccuaguugaguucuagauaaaaugcuauuaauaguuuuuuagaaacauucagauucagagaauuaggugauuagaugugggcuuuauuagaugagaaacuccacucugaggaggcgccugaggaucugugcuguucauucccuuucacaccugaggccuuucacaucuaauugauaaccaccuaauaggcauuucacaucuaguugaucugacuuuguccccaguagcugugacuugaccucacuuuucuugugacuccaggcagccacuacuuuaccuuucagaguugccauuugagaagaaauaugcuauuuugaguccuagacauuuuauuugauaacauacagaauaugaaauaacccccauagaaaacugaguauacagaaacuaaaagcuggguauggugacgugccccuguaauccuagugcuuugggaggcugagaugggaggaucacuugagacuaggaguucgagaccugcauuggcaacauagcaagacccccaucucuauaaaaaauuaaaaaauuagcugagcauggugguacacuagaaaaaauuuaaaaaucagcugcgugugguggugcgcuagaaaaaauuuaaaaauuagcugggcaugguggugcacacgugucccagcugcuugggaggccaggaguaagcuauggaugcaccccacuccacuacagccugagugacagagugggaccuugucucaaaaaaaaaaaaaagaagaagaagaagaaacugaacaccuuuaauagaucccuuugauauuuaacuuauuuaauuuacaaaaugauuuggucccaaauuugcagggaaacauaaaaaacaugaucaaacaguuuuagggaguuagacguugaaccgucuauauagggcaacuauucuuuacuguuaucaaaagaagaauaucaaguuuuacuucuucugagacaauacuauaauuuggcguaaauaaaagguaacauuaagagguaaugaacaauucugauugacacugguauuagaaggauguauuuuaggaacaaucuguguuccauuuugaaaguauuaaaaugacuuguuacuguauaaauagcuguagcuuuguguaugguugaaaguguaucugucauuugcugcuguuauuugcaaaacugacuauagaacuauuuggacuauuauagaaagucaaccuauaaauaucaaugcaaacuuuuguucuuguggaauagauuuuuuuuuguuuuguuuuguuuugagacagggucucgcccuguccccuauaccggagugcaguggugcgaccuggacucauugcagccucaaucuccugggugcaagugauccucccagcucagccuuccaaguagcugggacuacagaagcauacccccauaccuggcuaauuuuuuuguagaaacaggggucucccuauauugcccaggcuagucucaaacuccuggacuccaauccuccugccuuguccuccuaaaguucugggauuacaggcaugagccacugcaccuggccauggaauaguuuugacagcacuuaauaauaucaagcagaauaaaaauuccuugggaaaauauuuuggaaaaaaaauguggaguggauuauauuuuuuauuuuuugucauauuucuguuacuagcuacuaacauuuuacuacuguaaauuuugaaaauuugacaguccauuaucaaauaugggaugauaaacauuugaguuguugagaagcuaaguaaucuuuuuuauucuaugaaccuaugaauuauauuaaaaguaaucucacucuuucauuuaaaggccaguaaauguagcucuaccccuucuuuccagccuuuuguuagacuaauaguuucaagauggacuuuuggccggaugcaguggcucacaccuguaaucccaacacauugggaggccgaggcgggcagaucacuugaggccaggaguuugagaccagccuggccaacauggugaaaccaugccucuacaaaaaaaaaaaaaaaaaaaauuaggcgguguggugguggugcacaccuguaaucccagcuacuugggaggcugaggcacaagaauugcuugaacccgggagguggagguugcaguaagccgagauugugucacugcacuccagccuaggcaacagagcaagacucuugucucaaaaaauaaaaauaaaaaagaugaauuuuugaguuuaacuuccaccauuaggcagcuauggaaucauaagcaagacaugguaauuuuuuuuaaccuaucaaaugaaagaauugcacaaaaucccugguuuuuaaaccuucuuggaguuauggagaaacccuuugagaaucugaugaaagccaccaauauuuacacccugaaaacugcuuauucauauaaaagauaguguguaauuucaggagcuguaguauucucugaagccauccacagaccucaauuuaagaucccuggauuagaggauuucuggguuaauccuaguuuucaaagucuauaauucucuauuucuguccacacuacucuguugucuagcuacgcaugcugugauccucauucuucagacuccugcuucggguguuuacucauacuguuuuguccauuuucagauguccuuccuacccccuugaccaucuuuaccuuugaauguucuacccucuuuuuaaaccacaauuccuuaucacuuuuuaugucugaagcuucuucagucagaauuaaucuuucccuuagaaccuuauaccaaauagccuuuagccuguuugguuuuacauuauagugauuagagggcuguguauccauugccccuuccucuucucaccuauuccucaacagauuauaaaugucuugacauacgugacuaugugccuguauuugcuuuguaacugaguggugccuugcuaguaguagucaaggaauaauugcuugaauuugucacuuaauuguagugacugucugcuguguccccugcuaauugcugagaggauuagccccuuucucccaaaaaaggagaaaguggugcagaaauagaaccacagagggaaaaccucauauagaagaugaacuaggcccggugcaguggcucacaccuguaaucccagcacuuugggagguugaggcagguggaucccuugagcccaggaguucaggaccagccugggcaauaaggcgaaacccugucucuacaaaaaauacaaaaauuaguuggacauggugguacgcaccuauaguccucccagguacucgggaggcugaggcacaagaaucgcuugaaucagggaggcagagguugcagugaaccgagauugugccacugcauuccagccugggcaacagagguggagucugucucaaagaaauaaaauaaaaauauaaauagaagauuaacuuaaagaauggguagaguuuagggagcuggacgggcauuaucugggagagaugaagagaaaugagagaacuagcguguacuguauuucauuaucagugaaauuggucuauuuuuacugaaaagagagauucggcuuacaauuuucaccuaagcuuuacauuuuuuauuuuugucguuuuuguuuccgcagguacaagaaaauuccccaggacacagagcugguuuggagccuuucuuugauuuuauuguuucuauuaaugguucaagauuaguaaguucaacuuucuguaguuuugucuauaguauuuguaaucucucaaaaauggaauuuuucagaugaccugagauggguauuuauuaguuacaaucauuauguguaguaugccaauuuauagaaauaaucauguauuaauaaacauugaaauaucuauaauauuauaccuuaugcuccacugauuaucuuagggaagucucuagaaucaguggagucuuuuauauguuaaauauuuaauuuuuauaagcagaaagaaauaauuaagauguaaaagauugcuuuuuaaagaugucagacuucuguugguuguugacaaauggauuacuagaaagauucauucucucaucucauucucucaaacucgucaguuuucuuggugcuaaguuucacaauauaugaauaauguuauuagaaccagacagagagaugugcuccaaaguaccaaauuaaaaccacuuuuuauaccuuguuuagaguuuacccauaauaaaguucuaagauaaagaaauuauauaaucucagcaaauucuuaggacaguagccacuugguugguuuaauuuuucguaacagucuuaaguuuucguucauuacuuacaacaucucugacauauaaauaaaggccaacaucuggccuuuauuuguuuaugaaaugaaauauuuaauaugcuguuucuacuuucuuuucuauccagcucuuaauaaagcauguauuuagaaauagaguccaaaauuaaacguuaaccccaguaaauguuuuagauuuuuauaaucaaagucaucacaacuucguuaguaaugugacuucuuauggcauauuuuguuuuuacacauugaagcccuagaucauucuaaauaauguuggguugcaaauuccauaauccauaaugagcuauuagaaaaaagucaguuucaaguuguugcuaacguaagaguucuuaauuucuugacauucuuuuacauagaagaaaauuuaaauguuggugaaaccuuuguugaauguuuuauuuauguugauuauuaauauuacucuuauagggccauaggaugcuuaagcuaacauuaaauuuuuauuuacuaaggaaugugauuucuauguguucacagaauaaagacaaugacacucuuaaggaucugcugaaagcaaacguugaaaagccuguaaagaugcuuaucuauagcagcaaaacauuggaacugcgagagaccucagucacaccaaguaaccuguggggcggccagggcuuauugggagugagcauucguuucugcagcuuugauggggcaaaugaaaauguuuggcaugugcugguacguaucaacugugaacuguuacuggagguucaugaagcaguguggaaagauguuuuaacaaugguuguuucuggcuuaauaagauuguaaggauauuauuaauaggcaauuuuugccaaaaaucagcguucauugcuuuuuaaguauggaucaauuuuuuuuuaaguugaggaagagaagcaaauguacaaguuuaagaacuuuuucuaaugauuuauucauuauaagauguguuagaguagauagcuacaaaaauauuuuaaauauuuguuaaauauuauguaauuuuuaugcucagaaguuuaaaauauauucuguaguuucugacaucugacacaucucuagcaagacagaaguauacagauuuaaaaaaucaacauaauuaaaaauuggacuauaaaccuuggaagauuauuuuauauauauuaauuuuaggguguguguuuaugucauucuaggagguggaaucaaauucuccugcagcacuggcaggucuuagaccacacagugauuauauaauuggagcagauacagucaugaaugagguaauucguguguuuauucauagugagaacuauauaaaauuuucucauugagguuugaguugagaaagauauuugcaugcuuugcauuuagaguuaaaauuucagucuuugcugaucaaaaauaacuuaagccucaggguguuaaauggaacaucugguaggugucuuauuagguauagcugugaggaaaaacacauacugugcggcaauugcacagauuuuauguguaauauacagaaaucuuugcauaccugaagucuaaaucaaauucucauuuucaauuguucauugauuucauuuucucuuccccuuuuuguucagugacagcauuagcucagcuauauuacauccuuuuccuugucucuuagcuagcggaaguauacauugcuaaaucaaaaaugagagaaaaggcugggcacaguggcucaugcccauaaucucagcacuuugggaggccgagaugggagaauuacuugagcucaggaguucgagaccagucugggcagcauagugagaccuugucucuacaacaaauacaaaaauuagccaggcaugguggugcaugccuauagucccagcuaccugggaggcugagguggaaggaucacuugagccugagagguugaggcugcagugaggcaaaaucaugccacugcacucuagcccaggcaacaguuagagagacccugucucaaaaaaagaagaaaaaaaaaagagugagaaaugaggugcccagacaaccaggucuuaauaaugggaaguaaaagcagaauauguagaacucggguguaaaagaauuguacuaagagugccaacuagaucuuaaggaacuggccauaaagccuuguauguaguaaguaggcuuugcuugaauuaauauauugaauuaaaccugcuugugauuuuuaugucuggggcagggcccagaaucuguauuuuuuucuuagauuucucaggugauucugauagccagguuugagacacacuguuccaaaguaugguaacgugaaacauuuucuccugugacacuuuugcagucugaagaucuauucagccuuaucgaaacacaugaagcaaaaccauugaaacuguauguguacaacacagacacugauaacugucgagaagugauuauuacaccaaauucugcaugggguggagaaggcagguaaggucauuuuuuagacuaaguuaugacugcuuaaacauaccagucagauauguugcagacauugauuguuuuuauuuugaaagaaauuacugguuuauuuuaagacuccucuuaaaaaaaagggaagagcuagucuagaauauugaaaccaauuuuuuuaaaguacauaucuagggaacauaguauauauacuauaguccuuuucuuuacuaaccuaagagcuaacagcauuucuuuuuaauugagaaauuauugcgcauaagccauaauuauagaaaagccuagaauuuggaaacauuccacauguuuucaaaaguucuaaucccaugcugggaaaaggauaacuuaguugcugcaggcaggaaaagcuuccguuugcucacaguaucuuuacccacacuaccugagauucuccagcugaauguuucgccacaaguauucuaacuuguugcaguuugagaaaaguaagauagaugugucauccaagagucuggccuauauggggcaauacuugaucaaauuaucauuguccauugcccagguuuguaaaugcccagaaauaggaucuauucgaggcauucaaaauuuauucauuacaagaggcacuuccucauauaaacuacauuugcagagaagcugcuauauuugaaugacaaauuuucaguuugcaauagaaaaauacccccucucuaguuagaagaauacucaggucagauuaguaccacaagagugccugcugagcauggaaucaaacuggaggaagagauucuguggacagugaagaccaacagcaaagaacaucacauauucuuucauuuuuaauuauguuaacuaaauuuggcuacauucuuuggaagacauuuuuucuuuugauguguuuaauacugucaguuggccauugcauuagcuaggcccauacagaacauuuucgucagucugccucugaccaugcauuuggucuuuuugugcuucuguuuuuauuccuuccucagaggcugaccacauuucauuuauuaaaucuuauuucucuuaauuucauucuuaggcugucuuuaaguuugcccagggucuugcuguugccucaagugcauugucuauuaccacuuaauuacuuugaccaauaagcaccuuguuuucaaauguagcuaccucugaaaggccauaauugaucacuauaaauuauuuaaucuuuauuucucuaaaucccaguccagugagaauugcaggguuuuguuuguuuguuuggagacagcgucuugcucucugggcuggagcacaaucauaguucacugcagccuuuaacuccugggcucaagcuguccucccgccucagcuuccugaguaccugggacuacagguguacacacuguacuuggcuaauuuagaaacucuuuuuuagagauggggccuugcuuuguuucccaggcuagucuugaacucuucgcuucaagcaaucuucccaccuuggccucccaaaguccugagauuauaggugugaucuuccaugccuggccgaauugcaguuuugauugugagggaagaagggaagaaggaacaaauaauugugagaugaagcaucauugugcauaucagacugguaaaggaggagcuaggccuggcaugguggcucacgccuguaguacuaccgcuuugggaggcugaggcggguggaucacuugaacucaggaguucaguaccagccugggcaaccugaagaaccguugucucuacaaaaaauacaaaaauuagccagaugugguggcaugcaccuauagucccagcuacucaggaggcucaggcgggaggauugcuugagcccaggaggcagaggucgcagugagccaagaucaugccacugugcuacagccugggcaacagaauaauaaauugucuuaauaaauaaauaaauaaauaaauaaauaaaauuaaaaaggcugaaguuggcuacugccugcucacccagcuuuugguggcaguggagauaauagaugauguggcaggagaagggcacagagguauucaugcauggccuacucugaaauugucaaguuguuugggaaauaaaagacaucaugauggaaacauaaguuggaaccugauuauggagagccuuaaauaccacggucaggacuuccgauauauuuugagcaguugaggcugugauaauuguaucaguaagggguuuuggguucaaaugguaaaaacuagcugucaccaucauaagcagauaacauacuuaaugauauggauuagcucauauaaucaaggaaacagcugaagaaccagauguagaaaggacaggacucagaaaaccuagggauuuagauaggaagaaguauuuggcaaugucaucagcauucauucuacuaaacccauuuuuguuuuuucucugacucccaagguuugcagccaugggcaagagaaauuggccuggcuuugaccaugagccauucccuugguuugggcagggcagacacucugauugacaauccuaccagcacugcacacaacagcagagaaguaauuccccaaagggaggaaagagaaaggaauguugagaagacaucagacuagaaagaagcaaugugaucacaucuuacuagaaaaaugccucugguggcagugggaggaugaaauagaagagaucuggguugaacauacaugacugauuugugucagguucugaaagagaacuauggaauguguaaaugaugucaucauacagacgugcuuagagcucuucaguggaaaggcuguaucgaugucauuuguuuagcgaguaaucaucaaaugucugccaugugccggcagcuaugaaggcaguaaacagacaaggucucugcccuucaggaccuuaacauuuuguugggggagauagauaguaaauaaauaugcaguguguuggauggugaugaauucuugaaaaauaaaggaguaagggugauauccacaguggagggcaggguguuguuuucugugggguggucugggagaccucugcuuagaugacauuaucuaaaagaauagaaauuuguuuguuuuuaucuuuuaaaaucucaaagaagggagugcauguucagggcaacuugaaucuaugcucuuggguuacccgccccccccaaaaaaaacaccucaaagaaauacaagcugugauagauaacaacguuaagaaaaaaauguuuuuauagccuaggauguggcauuggauaugguuauuugcaucgaauaccuacacgcccauuugaggaaggaaagaaaauuucucuuccaggacaaauggcugguacaccuauuacaccucuuaaagauggguuuacagagguaagaucacguuccuaccugaguauaucauaaaguuuuuaccaaaacgagucacguguuucagugcuacuauauggcaguagcacuaugaaaauaggguagacgaugaguuaaguauugauuguguuacauuugagguuccuguaaaauaccuagauagagguuagauaugugagucuggauuuuaggaaaaaggacagggcuagagaugcagauuugggaaucaucagcaaagagaggguaauguaacccauuggcuguuaggaaaccuguacugcuagggauugggucugggugggucgccaucuugaaaaucuggaugggcagagaucuagcaaaggaagcucagcaggaggccagagggaaaaccaagcuucaagaaaucgaacacagucagccaugucagguagugcagagaagucaggugaaaggagugaaaaaaaccauguccugggcgagagcaauuucagagacuugccaggggacaaacaaacugcaggucagcagagugaauaggugaaaaggugcugcuagcuguugcuuauuguuucaagaaacgauugagaaaacaaggagagcuaugugugugggggucaugaggggagugaaggggcuauuacaggaucaaaguaagacuuuuuaaggaauaagagauacuugagcaggcuuacagggcuuuugaauguuucuuaaggagguaucucagggcaguuaacucuugucugcaccacuaaauaaaaaccaaauacccaaaaagaaaaugcugcuguuguaaagacaaggcugcugccacugugguuuugucuacacaguuuggccaucuucaguucuagaggaacugaagcucuucuuuaagagcugcugggaaguuucaccuccaacauuggcucauggccagagccaauauaguuacauguucagaccccaaccaccauauccacuggcccuaaucagggcuuucccaguugaaccucuuuggguagucugagaagaugacagugacuagcagcugggcaaagggccagaauacagguugucucggaauguacugaagggcacuggagcugcagaagguggguuauucagaaaugaaaccacccaucuguagaguccauagagacuccuuuuuuucuucuccugaaaaguggagaucuggcugccacauuuauucacugaugagaaaauauuaaaugcacucaugagguuggaaaucuugagaagucuaucauguauuaagacuuccagcugauuucuuuccugagcaaugaaaguuaaaacaaauaaaccagcugggaauucaggaaagcaguggugguuuaaagguugaauaaaaugauuuccagguggugaggaaagaggagagaguagaaucucuucuaguguggaaguaugaagaacagcaugugcaacuugggguagaagccaugugucucaagacuagaagugacaggagagagagaugcuuacagugcaugguccgugacauguaccaaaauuaggagggagugucuggaggcagacgugccagaugaagcuugugacagcucaugugugaaccaaauaucuaucugcagggcaaguaagagccaauauuuauauuuucuuugaaauaaacuuaaguaaucuuuguguuuuuuuuucuuuuuuuggaagguccagcuguccucaguuaaucccccgucuuugucaccaccaggaacuacaggaauugaacagagucugacuggacuuucuauuagcucaacuccaccagcugucaguaguguucucaguacaggugugcagaaaaauauauucuguuuucagucuauuuuauguaauauuauugcauagaauuuuaaaaauugaccagacacaguggcucacaccuguaaucccagcacuuugggaggccaaggcaggauugcuugagcucaggaguucuaaaccagcaugggcaauaugguggaaccacgucucuaaaaaaaaaaaacuuuuuuuaauuagccaggugugguggugugcaccuguagucccagcuccucgagagccugagaugggaggauugcuugagccuuggagguuguggcagcagugagccgugauugugccacugcauuccagccuggucgacagagugaaaaauuuaaagaauuuuaaaaaauuauuuuaaaaaaauuuuuaaaaaagaauuuaaaaaauuaaugccaguguaccuugaaaacugcauauguacucuguguugacagguccuggcugugaaagcuuguucuaaaucaccauguggauacacacgggguuuaaacuucuucccugcauauuuuagacccugagcuuuccuuagauucuacaacuuguaaagccaggacucugaguugaaauucuguuuaacugcucugguuacucaacacguuugcguguuucugaaguaguaggcacugaggaugcaaaagugaguaggaacuccuuucugaggagcucagucuugcuuaggggacaugugccugucuccuuccuuuucuuuuuuuuuuugaaacagaguuucacucuuuuugcccaggccggaguacaauggcauggucuuggcucacugcaaccucugccucccgaguucaagugauucucaugccucagccucccaaguggcagggauuacaggcacgugccaccauacggcagccaauuuuuguauuuuuaguagagacgguuucgccauguuggccaggcuggucuugaacuccugaccucaggugaucugcccuccucggccuuccaaagugcugggauuauaggcgugagccacugcacccagccuccuuccuuuucuucaucccuuguucuaccugauauaguccuuuuuguuuguuuuggguuuuauuuauuuauuuuaaagcuuucucaagauaaaaugcauauuaccauacaauucaccugcuuaaaguauacaauccaguguuuuuuuaguguauuuguagaguuguacaaccaauaaccucaaccaauuucagaauauuguaucacaccaaaagaaacccuguacgcauuaucaguuuuucugaaguuuuaguuuuuauguuuuuguagggcuggggucucucuguugcccaggcuggucccuaacuccuggccucaagugaucaucgugccuuggccucccaaauuguugguauuacaggugcgagucauggcuccuagccucauuaauaccuuuuauuucugggcugucuuaaauauuuauauucacaauuuguuuauaucccacuuuguucuguaauggacuuaaaacagccuaccaagaugcaguaguaagguugacaguuuggugucuagaauuggucuccuagguucucaucccagcucuuuaguccugguuuuauuucucuagaugaaauuuaaaauuucaaacauacacaaaagagcuggaauuguauaaugaaccccaucacccaacuuuaucaauuaucaauauugggauauacuuccccuuugccuucuuugcugguuuucuuuuuuuccagcuuuaucgauaaauaauuugccuaccauaaauuaacucacaauaaguaaacaacuaaaugauuuuuaguaaauucauagaauugugcagucaucaccacaauccaguuuuagaaugcuuccuagaugaaauuaaguauuaaugucaucagucucuaaucauagaguuggaagggaacuuaaaguuuauuucauucaagcaguaugaguccuuuuuaugauauuacgauuuuuugccuacaucucaucacauaauucucuaguuuauuccugaauagacuuaguaaggguaggguaguguacuucccaaggcagcagcccauuugagucugaauuguucauauuuguuuuagaguaagcguguuuccagaugcucuuuuuuuuuuuuuuuuuuuuuaaaaaaaaaaaaaacagacucuguugcccaggaaggcuagaguacaguggcacuaucucugcccacugcaaccucuggcucccagguucaagcaguucuccugccucagccuaaccaaguagcugugauugauuacaggcacgugccaccacacccagcuaauuuuuguauuuuuagcagagaugggguuuugccauguuggccaggcuggucucaaacuccugaccucaagugacccgcccgccucugcugccccaagugcugggauuacaggcgugagccacugugcccggcccuuuuuuugaggcagaguuucacucuuguugcccaggcuggagugcaauggcgcuaucucagcucacugcaaccuccgccuccuggguucaagcgauuuuccugccccagccucccgaguagcugggacuacaggcgcacgccaccaugcccggcuaauuguuuguauuuuuaguagagacgggguuucaccauguuggccaggcuggucucaaacuccugaccucaggugauucacccgccucagccucccaaagugcugggauuacaggcaugagccaucgugcccggccccagaugcgcuucugauuuuaggcgauaguugacaugucucuucaagccccaguuucucuucgacauuuuaaaucuuuccucauuacguuguaguuauacuuguauugucugauaaacacaugcacggagcucccuggcuuauggcacugcagagaaauggcuucuugacuguuaaagacaaauguaaauaaagcacuaauugcucaaaagagacugaaagaaauugacaucaucacuuuugaguaaauaaauuuaaaaagacuaaaauguucuagcaucacaacacgugagaaacaacuuuuugaugggcauuuuucagucuucacuuuucauuauauugcuugcaaaguagccuauacauuguaacaguguaauacaguagccuauauaauguaacuguagagacauaaaaguaacuauagagaaauaaaaguauauguauuuuuaaacuuuuuuguggauuugaagauuuuuggauuauaaaauuuuuagaaaagauuuugaaguggcaucgaucauugugaccugcuugauuuuucugcaguguaucaccuuuuucuuuuuuuuuuuuuuuuuugagacggagucuugcucugucgcucaggcuggagugcagugguaugaucuuggcucacuguaaccuccaccuccuggguucaagugauucuccugccucagccuccuaaguagcugggauuauaggugcucacccccaugcccaguuaauuuuguauuuuuaguagagacaggguuucaccauguuuuccaagcuggucuugaaccccugaccucaggugauccaccuaccucagcuucccaaagugcugggauuacaggcaugagccaccgugccuggcccaaguguaucaccauuuuacaugcuauguauuuugaucuuucuccuuuuuccugccccucauuagaauguaaauuuccuaaagguucugauuucuucauguuguaaagugccucagugccuugaacaauguguaacauacaguaggugccccccaaaaaacuugaaugaaugaccacacucaacuauccauucaacuccauugagaaucugaugaaagcaaagaaccugccuucgaaaaauuguuguauacaauuuuaggagcuucacagacccccugaagcccacuugugggcccuagauuuagaauuccugucuuagauugagucuuccuggcuuagauuuagucaguuauuuuugaaacuugugaauguaucuauccuuuaagaaugaaaagaaacuuaugugaaagacuuuauugggaaagagaagaaauuggcuuaaccaauccaagcugcuuuuguuuucuuaaaaccgagauuucaaaacaaauauaaaaaaauuauagcauugcuauugugugugaccauuaacaaagcacacacucacuaacauuuugguacagaguagagaacagcuucuuuuauuucagugaaauuaugcagucugggauccaguagagcauuugccagugcuucaguuagacuuuucuuauuuuugcuugccucugaauuccgcagaaaaguagauaaaugaauaaauaauagacugccugcaugguugguucauacuuuuaggcacaauuuauucccgcuaccauauguaagcagaucuguaagacaaaaucuggaaucuaugcuagauaaaugaaaaugagugcuaaauaagugaaaggugugcuuucauuuauuguuucgacaucagcaaaacgucccacugggguaggugguaaacgugauuaggugguauccugaggcuuacuuguacgugaggaacguaaccuccucaagcuaauguuaguacacguuuguguuagacuucaaaggacugucacagaaccuaaggucaaaaggaaauggacauucaggaagccaagucauucucuccauccuagagguucaucugcucuuuugucucuuucaggccaucuaugucauucuuuucuuucacagacuagcauucacuguuucacagggcacauggucccccugcaaccccuggcuuacguggcaucuuaguuuaggagcccaguugagauugacuagaauccuugugucccauauacaaauuucuaagacaguuuucuaaucuagcccugcuugggucagguguaaaccucuuguccagugagcugggcuggggugggacugcacggccucuugcccucuugucacaggcucugguaacagccuuuguugagagcugugggcagagucagugaaucugccguaaagggugauggacagucaguugcagcuggaaaucgggaccaaaugaagaccugaccacggggcaaggagggacugcagauuguccuaauguguucuguucauuucuugucgacuaaauuuguuagaaaugaaaagauugugcuuucuuuuuagguguaccaacaguaccguuauugccaccacaaguaaaccagucccucacuucugugccaccaaugaauccagcuacuacauuaccagguaaccaccaggggacuagagauguggcugauaauaacaguauuacugauauuugcaucuuaaaaacaaugaaaaauauuauaccugugugguaacuuuuuaugucuuuuaaucucaguuuaucucugcaauaaguuugugauaaaugagagcuagggcaacucuccuuaguaaacaaggaaccagagaugucauuuaccagcuaguuagcugccgagccuagugcuccuuacccccagccagcggccaccuacugccccugcagcucuacagugcagcaucggccaggaauaaggaaucugcagaaguccauucuccacugucuccuuagugaggauuuccuggcagucauucgugugagccugaagagaaggcuucuuauuuggucuucaguagcucuaacauuaaauuaaauuuuuguguuuuucucuucauauucccagugaagaccaagucccuuuauccagccaauaauaaucaaauacuauuuuagugaucaaauauacuuucauugugagggcuuuuaauguauggcuaaaaaugucauuauccaagcauauuaagccaugaaccaaaugugugcacacacacaaugaugaagcaagugugcugauauguggacaugugggaauuugggugaaagguggauucuuuuuacuacuuuugcaacuguaagucugcaguuauuuuucagaauaagaaauuuuaaaagucauagagacuguaaaccucaaccaucaaagaaaaauucaguuucauuaucugccauaucuacugaaacaaaucagccuuuucuccaaggcgcucgggccaucaucguucuuauuccagaguguuaagaguauuaguuauuuauuuucaucuucacccaguuagccaccuaaucuaucuaaucacuuagguagauaaauauauuucaauuaagugaaauuuuguuauuuauauuguuaugauacacagcugccacacauuagguggacuucugguacugucacuuagaaguggcugggauuguuuuuaauacacgaggauuuauuucuuccccaggucaagugauuucucuuuuuuucuuuucugccuucucuucaggucugaugccuuuaccagcaggacugcccaaccuccccaaccucaaccucaaccucccagcaccacacaucaugccagggguuggcuuaccagaacuuguaaacccagguauguugcagaucucacccuccuaggacucucucuaauaaaaguuuuauucaggaaugcccauccucuucaguuuuuucuggagagagcaaaucaguuuaacagauuucagcuacuucaaauaaauauucaucuuuuuuguuuaaaaagcuuaagaggaucacgccuguaaucccagcacuuugggaggccgaaguggguggaucaccugagguuaggaguucaagaccagccuggccaacauggcaaaaccccaucucuacugaaaaaauauaaacauuagccaggcaugguggcaggugccuguagucccagcuacgcaggaggcugagacagaagaaucacuugaacccaggagguggagguugcaaugagcugagaucacacuacugcacuccagccugggcaacagagcaagacuucaucucaaaaaaaaaaaaaaaaagcuuaagaggaaagaagaaugucucucaguccccgcugcuacugcugcugcugcugcugcuccuccuccuccuccuccucccccuccuccuccucccgccccccucccccgccccagaguagcaguaaagcacaguggaguggcccugcugcacugacuuuaaugaaaguguacaggcugccuaguggaggcgaaugaauuccccaccauucucaucaccccugcucagcuggcugggcuuguauuuuuuguuuuguuuaguuuuuuugagacagagucuugcuuuaucacccaggcuggagugcaguggcaccgaucuuggcucacugcaaucucuaccucccaggaucaagccauccucucaccucauccucccaaguagcugggacuacaugcacauaccaccacaccuggcuaauuuuuuuguauuuuuuguagagaagggguuucaccauguugcccaggcuggucuugaauuccugggcucaagcaaucuuccugcuuuggccucccagugugcugggauuacaggcaugagccaucucacccagccaguauucuucuuuuguaaaaaaaaaauacauauaaaaaaacaaacgugaauauucuccauuauuuacaaaugcuuuuauacucaaaacuaugggaaauuuuagcuggagaugucuacgguagcagauauuccaagugucugcacucagauuuucugucugaaaaugaagcagcagcuuccuacaaguccaugcaguuaaugaucagcauaccuuaaccuuugggagggcugacuuuuaauaggucaucucaguaguuuuauaggcccgucagugaugucagugaaugaucuuacagcaccauggugugcaucgucaccaucuuguuucugucuagaugauaauugucccucuuguaacacucaccaucuguguauauuccuuaaccuacuuaguuuucaggccaaagguuuaaaaaugaaguacuaggccaggcacaguggcucacgccuauaaugccagcacuuugggaagccaagguggguggaucaccugaggucagaaguucgagaccagccugaccaacauggugaaacccugucucuauuaaaaauagaaaaaguagcugggcaugguggcaggugcauguaaucccagcuacucgggaaggugaggcaggagaaucgcuugaacccaggaggcggagguuguagugagcugaggucgcaccacugcacuccagccugggugacagaaugagacuccgucucaaaaaaaaauaaaaauaaaaaugaaguacuaguaguagucaaacuaccauuuacugucgcagcgcucaccccaccuuuugugcccuguauucuuggcuccuccucugcccuuucccuaaauuugacaggcucuaaguagugaggauuucaccagcuggugguugcccugaaccugugcuuuacacccugccuuuccuuuguuucuugaaauaauucuccuuuccuucauaugcauuuuaauuuuuuuuuuuuuuuuuuuuuuuuuuugagacagagucucacuuugucauucaggcuggagugcagugguguaaucucaucucacugcaaccucugcguccuggguucaagcaguccucccaccucaguggccuuguagucucuaguagcugggaccacaggugugugccaccacgcccggcuaauuuuuguacuuuuuuuuaguagagacgagguuuugcuauguugcccaggcuggucuccaacuccuggguucaagcgauccucccaccuuggccucccaaagugcugggguuacaggcgugagccaccacgccuggccuugcauuuuaaaaucaucaucaugagcccacugaguguaauauaaauaguuaucaaucacagguuuuaagcaaaugcugaguacuccuggugaggacaguggaaagggcgagaauccaggccccucccuucugcugccuucgcaggaggguugcagccuaccucucccuguugucugucaagaaugcagcuguaacucagcuugcagcuggcaugggugagcaugagucccccugucugacauccaguguagcugugucaccugcugggugggcugcuaucucuucugacuggaaggauccuaucuaucuuucuucccugagccaguuucccccagugcugggccagguuacauggagccuagaaguugagaaccuauuccuucaggcagcugcgauuguagggaauaguuaacccugccagggccucuaucuggaaaucagccaagguugugauuuguguuaccuccucaacuucaguuuccuuaaugaaauguaaauaaaaauagcccuuugacaaugccugcuguccuuucagugcugggaggauguaugaucuaugccguuuuuguccuaggucugccaccucuuccuuccaugccuccccgaaacuuaccuggcauugcaccucucccccugccauccgaguuccucccgucauuccccuugguuccagagagcucuucugcagcaagcucaggagagcugcugucuucccucccgcccaccagcaacgcacccuccgacccugccacaacuacugcaaaggcagacgcugccuccucacucacuguggaugugacgccccccacugccaaggcccccaccaccguugaggacagagucggcgacuccaccccagucagcgagaagccuguuucugcggcuguggaugccaaugcuucugagucaccuuaacuuugaaccauucuuuggaauuggcgugguauauuuaaccacgggagcgugucuggaaacgcaaacuaucauuaauuucauacuaguuuguaccguaucuguaggcauccuguaaauaauuccaaggggaaaacuaaacgaggacguggguuguauccugccagguugaguggggcucacacgcuagggugagaugucagaaagcgcuuguauuuuaaacaaccaaaaagaauuguaaggguggcuugcugccaggcuugcacugccguuccugggggugugcaucuucgggaaaggugguggcggggcguccacuagguuuccuguccccugcugcuccuuccguaagaaaaugaaauauucuaugccuaauacucacacgcaacauuucuuguacuuuguaagucguuugcgagaaugcagaccaccucacuaaacuguaaacgguaaagagauuuuuacuuuuggucuccgugagucgcaucucuacuaagguuuacacaggaauuccaccugaagacuuguguuaaaguucuacagcgcgcacuguuaacugaacgucuuuuucuucagccuauacgcggauccuuguuuugagcucucagaaucacucagacaacauuuuguaacugcugcuguugcuuucuacauacaccuuauaaagugacauuucaaaagaaauaaggugccacaguuuuaaaccagaagguggcacucuguggcuccuuguaguauuauagcuauacugggaaagcauagauacagcaauaaaguacaguaauuuuacuuuuuuucuuguguuacaucuaaauuacaacccuuaauugccacgugugcacuuacuacucuccaguaugucuuauuacucuccaguaugucacgcaucuuuaacuuuucacguccuauguuugcuuucucccauuuuuaagagaugguaaguuaacuggaauugauuuacugaaugaaauuaaaugcagauaucccuguuuuugaaauaagacaa

SEQ ID NO: 191201 - RNA, 38696 nt, Homo sapiens
uugucuuauuucaaaaacagggauaucugcauuuaauuucauucaguaaaucaauuccaguuaacuuaccaucucuuaaaaaugggagaaagcaaacauaggacgugaaaaguuaaagaugcgugacauacuggagaguaauaagacauacuggagaguaguaagugcacacguggcaauuaaggguuguaauuuagauguaacacaagaaaaaaaguaaaauuacuguacuuuauugcuguaucuaugcuuucccaguauagcuauaauacuacaaggagccacagagugccaccuucugguuuaaaacuguggcaccuuauuucuuuugaaaugucacuuuauaagguguauguagaaagcaacagcagcaguuacaaaauguugucugagugauucugagagcucaaaacaaggauccgcguauaggcugaagaaaaagacguucaguuaacagugcgcgcuguagaacuuuaacacaagucuucagguggaauuccuguguaaaccuuaguagagaugcgacucacggagaccaaaaguaaaaaucucuuuaccguuuacaguuuagugagguggucugcauucucgcaaacgacuuacaaaguacaagaaauguugcgugugaguauuaggcauagaauauuucauuuucuuacggaaggagcagcaggggacaggaaaccuaguggacgccccgccaccaccuuucccgaagaugcacacccccaggaacggcagugcaagccuggcagcaagccacccuuacaauucuuuuugguuguuuaaaauacaagcgcuuucugacaucucacccuagcgugugagccccacucaaccuggcaggauacaacccacguccucguuuaguuuuccccuuggaauuauuuacaggaugccuacagauacgguacaaacuaguaugaaauuaaugauaguuugcguuuccagacacgcucccgugguuaaauauaccacgccaauuccaaagaaugguucaaaguuaaggugacucagaagcauuggcauccacagccgcagaaacaggcuucucgcugacugggguggagucgccgacucuguccucaacgguggugggggccuuggcaguggggggcgucacauccacagugagugaggaggcagcgucugccuuugcaguaguuguggcagggucggagggugcguugcuggugggcgggagggaagacagcagcucuccugagcuugcugcagaagagcucucuggaaccaaggggaaugacgggaggaacucggauggcagggggagaggugcaaugccagguaaguuucggggaggcauggaaggaagagguggcagaccuaggacaaaaacggcauagaucauacauccucccagcacugaaaggacagcaggcauugucaaagggcuauuuuuauuuacauuucauuaaggaaacugaaguugaggagguaacacaaaucacaaccuuggcugauuuccagauagaggcccuggcaggguuaacuauucccuacaaucgcagcugccugaaggaauagguucucaacuucuaggcuccauguaaccuggcccagcacugggggaaacuggcucagggaagaaagauagauaggauccuuccagucagaagagauagcagcccacccagcaggugacacagcuacacuggaugucagacagggggacucaugcucacccaugccagcugcaagcugaguuacagcugcauucuugacagacaacagggagagguaggcugcaacccuccugcgaaggcagcagaagggaggggccuggauucucgcccuuuccacuguccucaccaggaguacucagcauuugcuuaaaaccugugauugauaacuauuuauauuacacucagugggcucaugaugaugauuuuaaaaugcaaggccaggcgugguggcucacgccuguaaccccagcacuuugggaggccaaggugggaggaucgcuugaacccaggaguuggagaccagccugggcaacauagcaaaaccucgucucuacuaaaaaaaaguacaaaaauuagccgggcgugguggcacacaccuguggucccagcuacuagagacuacaaggccacugaggugggaggacugcuugaacccaggacgcagagguugcagugagaugagauuacaccacugcacuccagccugaaugacaaagugagacucugucucaaaaaaaaaaaaaaaaaaaaaaaaaaauuaaaaugcauaugaaggaaaggagaauuauuucaagaaacaaaggaaaggcaggguguaaagcacagguucagggcaaccaccagcuggugaaauccucacuacuuagagccugucaaauuuagggaaagggcagaggaggagccaagaauacagggcacaaaagguggggugagcgcugcgacaguaaaugguaguuugacuacuacuaguacuucauuuuuauuuuuauuuuuuuuugagacggagucucauucugucacccaggcuggagugcaguggugcgaccucagcucacuacaaccuccgccuccuggguucaagcgauucuccugccucaccuucccgaguagcugggauuacaugcaccugccaccaugcccagcuacuuuuucuauuuuuaauagagacaggguuucaccauguuggucaggcuggucucgaacuucugaccucaggugauccacccaccuuggcuucccaaagugcuggcauuauaggcgugagccacugugccuggccuaguacuucauuuuuaaaccuuuggccugaaaacuaaguagguuaaggaauauacacagauggugaguguuacaagagggacaauuaucaucuagacagaaacaagauggugacgaugcacaccauggugcuguaagaucauucacugacaucacugacgggccuauaaaacuacugagaugaccuauuaaaagucagcccucccaaagguuaagguaugcugaucauuaacugcauggacuuguaggaagcugcugcuucauuuucagacagaaaaucugagugcagacacuuggaauaucugcuaccguagacaucuccagcuaaaauuucccauaguuuugaguauaaaagcauuuguaaauaauggagaauauucacguuuguuuuuuuauauguauuuuuuuuuuacaaaagaagaauacuggcugggugagauggcucaugccuguaaucccagcacacugggaggccaaagcaggaagauugcuugagcccaggaauucaagaccagccugggcaacauggugaaaccccuucucuacaaaaaauacaaaaaaauuagccagguguggugguaugugcauguagucccagcuacuugggaggaugaggugagaggauggcuugauccugggagguagagauugcagugagccaagaucggugccacugcacuccagccugggugauaaagcaagacucugucucaaaaaaacuaaacaaaacaaaaaauacaagcccagccagcugagcaggggugaugagaaugguggggaauucauucgccuccacuaggcagccuguacacuuucauuaaagucagugcagcagggccacuccacugugcuuuacugcuacucuggggcgggggaggggggcgggaggaggaggagggggaggaggaggaggaggaggagcagcagcagcagcagcaguagcagcggggacugagagacauucuucuuuccucuuaagcuuuuuuuuuuuuuuuuugagaugaagucuugcucuguugcccaggcuggagugcaguagugugaucucagcucauugcaaccuccaccuccuggguucaagugauucuucugucucagccuccugcguagcugggacuacaggcaccugccaccaugccuggcuaauguuuauauuuuuucaguagagaugggguuuugccauguuggccaggcuggucuugaacuccuaaccucaggugauccacccacuucggccucccaaagugcugggauuacaggcgugauccucuuaagcuuuuuaaacaaaaaagaugaauauuuauuugaaguagcugaaaucuguuaaacugauuugcucucuccagaaaaaacugaagaggaugggcauuccugaauaaaacuuuuauuagagagaguccuaggagggugagaucugcaacauaccuggguuuacaaguucugguaagccaaccccuggcaugauguguggugcugggagguugagguugagguuggggagguugggcaguccugcugguaaaggcaucagaccugaagagaaggcagaaaagaaaaaaagagaaaucacuugaccuggggaagaaauaaauccucguguauuaaaaacaaucccagccacuucuaagugacaguaccagaaguccaccuaauguguggcagcuguguaucauaacaauauaaauaacaaaauuucacuuaauugaaauauauuuaucuaccuaagugauuagauagauuagguggcuaacugggugaagaugaaaauaaauaacuaauacucuuaacacucuggaauaagaacgaugauggcccgagcgccuuggagaaaaggcugauuuguuucaguagauauggcagauaaugaaacugaauuuuucuuugaugguugagguuuacagucucuaugacuuuuaaaauuucuuauucugaaaaauaacugcagacuuacaguugcaaaaguaguaaaaagaauccaccuuucacccaaauucccacauguccacauaucagcacacuugcuucaucauugugugugugcacacauuugguucauggcuuaauaugcuuggauaaugacauuuuuagccauacauuaaaagcccucacaaugaaaguauauuugaucacuaaaauaguauuugauuauuauuggcuggauaaagggacuuggucuucacugggaauaugaagagaaaaacacaaaaauuuaauuuaauguuagagcuacugaagaccaaauaagaagccuucucuucaggcucacacgaaugacugccaggaaauccucacuaaggagacaguggagaauggacuucugcagauuccuuauuccuggccgaugcugcacuguagagcugcaggggcaguagguggccgcuggcuggggguaaggagcacuaggcucggcagcuaacuagcugguaaaugacaucucugguuccuuguuuacuaaggagaguugcccuagcucucauuuaucacaaacuuauugcagagauaaacugagauuaaaagacauaaaaaguuaccacacagguauaauauuuuucauuguuuuuaagaugcaaauaucaguaauacuguuauuaucagccacaucucuaguccccuggugguuaccugguaauguaguagcuggauucauugguggcacagaagugagggacugguuuacuugugguggcaauaacgguacuguugguacaccuaaaaagaaagcacaaucuuuucauuucuaacaaauuuagucgacaagaaaugaacagaacacauuaggacaaucugcagucccuccuugccccguggucaggucuucauuuggucccgauuuccagcugcaacugacuguccaucacccuuuacggcagauucacugacucugcccacagcucucaacaaaggcuguuaccagagccugugacaagagggcaagaggccgugcagucccaccccagcccagcucacuggacaagagguuuacaccugacccaagcagggcuagauuagaaaacugucuuagaaauuuguauaugggacacaaggauucuagucaaucucaacugggcuccuaaacuaagaugccacguaagccagggguugcagggggaccaugugcccugugaaacagugaaugcuagucugugaaagaaaagaaugacauagauggccugaaagagacaaaagagcagaugaaccucuaggauggagagaaugacuuggcuuccugaauguccauuuccuuuugaccuuagguucugugacaguccuuugaagucuaacacaaacguguacuaacauuagcuugaggagguuacguuccucacguacaaguaagccucaggauaccaccuaaucacguuuaccaccuaccccagugggacguuuugcugaugucgaaacaauaaaugaaagcacaccuuucacuuauuuagcacucauuuucauuuaucuagcauagauuccagauuuugucuuacagaucugcuuacauaugguagcgggaauaaauugugccuaaaaguaugaaccaaccaugcaggcagucuauuauuuauucauuuaucuacuuuucugcggaauucagaggcaagcaaaaauaagaaaagucuaacugaagcacuggcaaaugcucuacuggaucccagacugcauaauuucacugaaauaaaagaagcuguucucuacucuguaccaaaauguuagugagugugugcuuuguuaauggucacacacaauagcaaugcuauaauuuuuuuauauuuguuuugaaaucucgguuuuaagaaaacaaaagcagcuuggauugguuaagccaauuucuucucuuucccaauaaagucuuucacauaaguuucuuuucauucuuaaaggauagauacauucacaaguuucaaaaauaacugacuaaaucuaagccaggaagacucaaucuaagacaggaauucuaaaucuagggcccacaagugggcuucagggggucugugaagcuccuaaaauuguauacaacaauuuuucgaaggcagguucuuugcuuucaucagauucucaauggaguugaauggauaguugaguguggucauucauucaaguuuuuuggggggcaccuacuguauguuacacauuguucaaggcacugaggcacuuuacaacaugaagaaaucagaaccuuuaggaaauuuacauucuaaugaggggcaggaaaaaggagaaagaucaaaauacauagcauguaaaauggugauacacuugggccaggcacgguggcucaugccuguaaucccagcacuuugggaagcugagguagguggaucaccugaggucagggguucaagaccagcuuggaaaacauggugaaacccugucucuacuaaaaauacaaaauuaacugggcaugggggugagcaccuauaaucccagcuacuuaggaggcugaggcaggagaaucacuugaacccaggagguggagguuacagugagccaagaucauaccacugcacuccagccugagcgacagagcaagacuccgucucaaaaaaaaaaaaaaaaaagaaaaaggugauacacugcagaaaaaucaagcaggucacaaugaucgaugccacuucaaaaucuuuucuaaaaauuuuauaauccaaaaaucuucaaauccacaaaaaaguuuaaaaauacauauacuuuuauuucucuauaguuacuuuuaugucucuacaguuacauuauauaggcuacuguauuacacuguuacaauguauaggcuacuuugcaagcaauauaaugaaaagugaagacugaaaaaugcccaucaaaaaguuguuucucacguguugugaugcuagaacauuuuagucuuuuuaaauuuauuuacucaaaagugaugaugucaauuucuuucagucucuuuugagcaauuagugcuuuauuuacauuugucuuuaacagucaagaagccauuucucugcagugccauaagccagggagcuccgugcauguguuuaucagacaauacaaguauaacuacaacguaaugaggaaagauuuaaaaugucgaagagaaacuggggcuugaagagacaugucaacuaucgccuaaaaucagaagcgcaucuggggccgggcacgauggcucaugccuguaaucccagcacuuugggaggcugaggcgggugaaucaccugaggucaggaguuugagaccagccuggccaacauggugaaaccccgucucuacuaaaaauacaaacaauuagccgggcaugguggcgugcgccuguagucccagcuacucgggaggcuggggcaggaaaaucgcuugaacccaggaggcggagguugcagugagcugagauagcgccauugcacuccagccugggcaacaagagugaaacucugccucaaaaaaagggccgggcacaguggcucacgccuguaaucccagcacuuggggcagcagaggcgggcgggucacuugaggucaggaguuugagaccagccuggccaacauggcaaaaccccaucucugcuaaaaauacaaaaauuagcugggugugguggcacgugccuguaaucaaucacagcuacuugguuaggcugaggcaggagaacugcuugaaccugggagccagagguugcagugggcagagauagugccacuguacucuagccuuccugggcaacagagucuguuuuuuuuuuuuuuaaaaaaaaaaaaaaaaaaaaagagcaucuggaaacacgcuuacucuaaaacaaauaugaacaauucagacucaaaugggcugcugccuugggaaguacacuacccuacccuuacuaagucuauucaggaauaaacuagagaauuaugugaugagauguaggcaaaaaaucguaauaucauaaaaaggacucauacugcuugaaugaaauaaacuuuaaguucccuuccaacucuaugauuagagacugaugacauuaauacuuaauuucaucuaggaagcauucuaaaacuggauuguggugaugacugcacaauucuaugaauuuacuaaaaaucauuuaguuguuuacuuauugugaguuaauuuaugguaggcaaauuauuuaucgauaaagcuggaaaaaaagaaaaccagcaaagaaggcaaaggggaaguauaucccaauauugauaauugauaaaguugggugaugggguucauuauacaauuccagcucuuuuguguauguuugaaauuuuaaauuucaucuagagaaauaaaaccaggacuaaagagcugggaugagaaccuaggagaccaauucuagacaccaaacugucaaccuuacuacugcaucuugguaggcuguuuuaaguccauuacagaacaaagugggauauaaacaaauugugaauauaaauauuuaagacagcccagaaauaaaagguauuaaugaggcuaggagccaugacucgcaccuguaauaccaacaauuugggaggccaaggcacgaugaucacuugaggccaggaguuagggaccagccugggcaacagagagaccccagcccuacaaaaacauaaaaacuaaaacuucagaaaaacugauaaugcguacaggguuucuuuuggugugauacaauauucugaaauugguugagguuauugguuguacaacucuacaaauacacuaaaaaaacacuggauuguauacuuuaagcaggugaauuguaugguaauaugcauuuuaucuugagaaagcuuuaaaauaaauaaauaaaacccaaaacaaacaaaaaggacuauaucagguagaacaagggaugaagaaaaggaaggaggcugggugcaguggcucacgccuauaaucccagcacuuuggaaggccgaggagggcagaucaccugaggucaggaguucaagaccagccuggccaacauggcgaaaccgucucuacuaaaaauacaaaaauuggcugccguaugguggcacgugccuguaaucccugccacuugggaggcugaggcaugagaaucacuugaacucgggaggcagagguugcagugagccaagaccaugccauuguacuccggccugggcaaaaagagugaaacucuguuucaaaaaaaaaaagaaaaggaaggagacaggcacauguccccuaagcaagacugagcuccucagaaaggaguuccuacucacuuuugcauccucagugccuacuacuucagaaacacgcaaacguguugaguaaccagagcaguuaaacagaauuucaacucagaguccuggcuuuacaaguuguagaaucuaaggaaagcucagggucuaaaauaugcagggaagaaguuuaaaccccguguguauccacauggugauuuagaacaagcuuucacagccaggaccugucaacacagaguacauaugcaguuuucaagguacacuggcauuaauuuuuuaaauucuuuuuuaaaaauuuuuuuaaaauaauuuuuuaaaauucuuuaaauuuuucacucugucgaccaggcuggaaugcaguggcacaaucacggcucacugcugccacaaccuccaaggcucaagcaauccucccaucucaggcucucgaggagcugggacuacaggugcacaccaccacaccuggcuaauuaaaaaaaguuuuuuuuuuuuagagacgugguuccaccauauugcccaugcugguuuagaacuccugagcucaagcaauccugccuuggccucccaaagugcugggauuacaggugugagccacugugucuggucaauuuuuaaaauucuaugcaauaauauuacauaaaauagacugaaaacagaauauauuuuucugcacaccuguacugagaacacuacugacagcugguggaguugagcuaauagaaaguccagucagacucuguucaauuccuguaguuccugguggugacaaagacgggggauuaacugaggacagcuggaccuuccaaaaaaagaaaaaaaaacacaaagauuacuuaaguuuauuucaaagaaaauauaaauauuggcucuuacuugcccugcagauagauauuugguucacacaugagcugucacaagcuucaucuggcacgucugccuccagacacucccuccuaauuuugguacaugucacggaccaugcacuguaagcaucucucucuccugucacuucuagucuugagacacauggcuucuaccccaaguugcacaugcuguucuucauacuuccacacuagaagagauucuacucucuccucuuuccucaccaccuggaaaucauuuuauucaaccuuuaaaccaccacugcuuuccugaauucccagcugguuuauuuguuuuaacuuucauugcucaggaaagaaaucagcuggaagucuuaauacaugauagacuucucaagauuuccaaccucaugagugcauuuaauauuuucucaucagugaauaaauguggcagccagaucuccacuuuucaggagaagaaaaaaaggagucucuauggacucuacagaugggugguuucauuucugaauaacccaccuucugcagcuccagugcccuucaguacauuccgagacaaccuguauucuggcccuuugcccagcugcuagucacugucaucuucucagacuacccaaagagguucaacugggaaagcccugauuagggccaguggauauggugguuggggucugaacauguaacuauauuggcucuggccaugagccaauguuggaggugaaacuucccagcagcucuuaaagaagagcuucaguuccucuagaacugaagauggccaaacuguguagacaaaaccacaguggcagcagccuugucuuuacaacagcagcauuuucuuuuuggguauuugguuuuuauuuaguggugcagacaagaguuaacugcccugagauaccuccuuaagaaacauucaaaagcccuguaagccugcucaaguaucucuuauuccuuaaaaagucuuacuuugauccuguaauagccccuucacuccccucaugacccccacacacauagcucuccuuguuuucucaaucguuucuugaaacaauaagcaacagcuagcagcaccuuuucaccuauucacucugcugaccugcaguuuguuuguccccuggcaagucucugaaauugcucucgcccaggacaugguuuuuuucacuccuuucaccugacuucucugcacuaccugacauggcugacuguguucgauuucuugaagcuugguuuucccucuggccuccugcugagcuuccuuugcuagaucucugcccauccagauuuucaagauggcgacccacccagacccaaucccuagcaguacagguuuccuaacagccaauggguuacauuacccucucuuugcugaugauucccaaaucugcaucucuagcccuguccuuuuuccuaaaauccagacucacauaucuaaccucuaucuagguauuuuacaggaaccucaaauguaacacaaucaauacuuaacucaucgucuacccuauuuucauagugcuacugccauauaguagcacugaaacacgugacucguuuugguaaaaacuuuaugauauacucagguaggaacgugaucuuaccucuguaaacccaucuuuaagagguguaauagguguaccagccauuuguccuggaagagaaauuuucuuuccuuccucaaaugggcguguagguauucgaugcaaauaaccauauccaaugccacauccuaggcuauaaaaacauuuuuuucuuaacguuguuaucuaucacagcuuguauuucuuugagguguuuuuuuuggggggggcggguaacccaagagcauagauucaaguugcccugaacaugcacucccuucuuugagauuuuaaaagauaaaaacaaacaaauuucuauucuuuuagauaaugucaucuaagcagaggucucccagaccaccccacagaaaacaacacccugcccuccacuguggauaucacccuuacuccuuuauuuuucaagaauucaucaccauccaacacacugcauauuuauuuacuaucuaucucccccaacaaaauguuaagguccugaagggcagagaccuugucuguuuacugccuucauagcugccggcacauggcagacauuugaugauuacucgcuaaacaaaugacaucgauacagccuuuccacugaagagcucuaagcacgucuguaugaugacaucauuuacacauuccauaguucucuuucagaaccugacacaaaucagucauguauguucaacccagaucucuucuauuucauccucccacugccaccagaggcauuuuucuaguaagaugugaucacauugcuucuuucuagucugaugucuucucaacauuccuuucucuuuccucccuuuggggaauuacuucucugcuguugugugcagugcugguaggauugucaaucagagugucugcccugcccaaaccaagggaauggcucauggucaaagccaggccaauuucucuugcccauggcugcaaaccuugggagucagagaaaaaacaaaaauggguuuaguagaaugaaugcugaugacauugccaaauacuucuuccuaucuaaaucccuagguuuucugaguccuguccuuucuacaucugguucuucagcuguuuccuugauuauaugagcuaauccauaucauuaaguauguuaucugcuuaugauggugacagcuaguuuuuaccauuugaacccaaaaccccuuacugauacaauuaucacagccucaacugcucaaaauauaucggaaguccugaccgugguauuuaaggcucuccauaaucagguuccaacuuauguuuccaucaugaugucuuuuauuucccaaacaacuugacaauuucagaguaggccaugcaugaauaccucugugcccuucuccugccacaucaucuauuaucuccacugccaccaaaagcugggugagcaggcaguagccaacuucagccuuuuuaauuuuauuuauuuauuuauuuauuuauuuauuaagacaauuuauuauucuguugcccaggcuguagcacaguggcaugaucuuggcucacugcgaccucugccuccugggcucaagcaauccucccgccugagccuccugaguagcugggacuauaggugcaugccaccacaucuggcuaauuuuuguauuuuuuguagagacaacgguucuucagguugcccaggcugguacugaacuccugaguucaagugauccacccgccucagccucccaaagcgguaguacuacaggcgugagccaccaugccaggccuagcuccuccuuuaccagucugauaugcacaaugaugcuucaucucacaauuauuuguuccuucuucccuucuucccucacaaucaaaacugcaauucggccaggcauggaagaucacaccuauaaucucaggacuuugggaggccaaggugggaagauugcuugaagcgaagaguucaagacuagccugggaaacaaagcaaggccccaucucuaaaaaagaguuucuaaauuagccaaguacaguguguacaccuguagucccagguacucaggaagcugaggcgggaggacagcuugagcccaggaguuaaaggcugcagugaacuaugauugugcuccagcccagagagcaagacgcugucuccaaacaaacaaacaaaacccugcaauucucacuggacugggauuuagagaaauaaagauuaaauaauuuauagugaucaauuauggccuuucagagguagcuacauuugaaaacaaggugcuuauuggucaaaguaauuaagugguaauagacaaugcacuugaggcaacagcaagacccugggcaaacuuaaagacagccuaagaaugaaauuaagagaaauaagauuuaauaaaugaaauguggucagccucugaggaaggaauaaaaacagaagcacaaaaagaccaaaugcauggucagaggcagacugacgaaaauguucuguaugggccuagcuaaugcaauggccaacugacaguauuaaacacaucaaaagaaaaaaugucuuccaaagaauguagccaaauuuaguuaacauaauuaaaaaugaaagaauaugugauguucuuugcuguuggucuucacuguccacagaaucucuuccuccaguuugauuccaugcucagcaggcacucuugugguacuaaucugaccugaguauucuucuaacuagagaggggguauuuuucuauugcaaacugaaaauuugucauucaaauauagcagcuucucugcaaauguaguuuauaugaggaagugccucuuguaaugaauaaauuuugaaugccucgaauagauccuauuucugggcauuuacaaaccugggcaauggacaaugauaauuugaucaaguauugccccauauaggccagacucuuggaugacacaucuaucuuacuuuucucaaacugcaacaaguuagaauacuuguggcgaaacauucagcuggagaaucucagguaguguggguaaagauacugugagcaaacggaagcuuuuccugccugcagcaacuaaguuauccuuuucccagcaugggauuagaacuuuugaaaacauguggaauguuuccaaauucuaggcuuuucuauaauuauggcuuaugcgcaauaauuucucaauuaaaaagaaaugcuguuagcucuuagguuaguaaagaaaaggacuauaguauauauacuauguucccuagauauguacuuuaaaaaaauugguuucaauauucuagacuagcucuucccuuuuuuuuaagaggagucuuaaaauaaaccaguaauuucuuucaaaauaaaaacaaucaaugucugcaacauaucugacugguauguuuaagcagucauaacuuagucuaaaaaaugaccuuaccugccuucuccaccccaugcagaauuugguguaauaaucacuucucgacaguuaucagugucuguguuguacacauacaguuucaaugguuuugcuucauguguuucgauaaggcugaauagaucuucagacugcaaaagugucacaggagaaaauguuucacguuaccauacuuuggaacagugugucucaaaccuggcuaucagaaucaccugagaaaucuaagaaaaaaauacagauucugggcccugccccagacauaaaaaucacaagcagguuuaauucaauauauuaauucaagcaaagccuacuuacuacauacaaggcuuuauggccaguuccuuaagaucuaguuggcacucuuaguacaauucuuuuacacccgaguucuacauauucugcuuuuacuucccauuauuaagaccugguugucugggcaccucauuucucacucuuuuuuuuuucuucuuuuuuugagacagggucucucuaacuguugccugggcuagagugcaguggcaugauuuugccucacugcagccucaaccucucaggcucaagugauccuuccaccucagccucccagguagcugggacuauaggcaugcaccaccaugccuggcuaauuuuuguauuuguuguagagacaaggucucacuaugcugcccagacuggucucgaacuccugagcucaaguaauucucccaucucggccucccaaagugcugagauuaugggcaugagccacugugcccagccuuuucucucauuuuugauuuagcaauguauacuuccgcuagcuaagagacaaggaaaaggauguaauauagcugagcuaaugcugucacugaacaaaaaggggaagagaaaaugaaaucaaugaacaauugaaaaugagaauuugauuuagacuucagguaugcaaagauuucuguauauuacacauaaaaucugugcaauugccgcacaguauguguuuuuccucacagcuauaccuaauaagacaccuaccagauguuccauuuaacacccugaggcuuaaguuauuuuugaucagcaaagacugaaauuuuaacucuaaaugcaaagcaugcaaauaucuuucucaacucaaaccucaaugagaaaauuuuauauaguucucacuaugaauaaacacacgaauuaccucauucaugacuguaucugcuccaauuauauaaucacuguguggucuaagaccugccagugcugcaggagaauuugauuccaccuccuagaaugacauaaacacacacccuaaaauuaauauauauaaaauaaucuuccaagguuuauaguccaauuuuuaauuauguugauuuuuuaaaucuguauacuucugucuugcuagagaugugucagaugucagaaacuacagaauauauuuuaaacuucugagcauaaaaauuacauaauauuuaacaaauauuuaaaauauuuuuguagcuaucuacucuaacacaucuuauaaugaauaaaucauuagaaaaaguucuuaaacuuguacauuugcuucucuuccucaacuuaaaaaaaaauugauccauacuuaaaaagcaaugaacgcugauuuuuggcaaaaauugccuauuaauaauauccuuacaaucuuauuaagccagaaacaaccauuguuaaaacaucuuuccacacugcuucaugaaccuccaguaacaguucacaguugauacguaccagcacaugccaaacauuuucauuugccccaucaaagcugcagaaacgaaugcucacucccaauaagcccuggccgccccacagguuacuuggugugacugaggucucucgcaguuccaauguuuugcugcuauagauaagcaucuuuacaggcuuuucaacguuugcuuucagcagauccuuaagagugucauugucuuuauucugugaacacauagaaaucacauuccuuaguaaauaaaaauuuaauguuagcuuaagcauccuauggcccuauaagaguaauauuaauaaucaacauaaauaaaacauucaacaaagguuucaccaacauuuaaauuuucuucuauguaaaagaaugucaagaaauuaagaacucuuacguuagcaacaacuugaaacugacuuuuuucuaauagcucauuauggauuauggaauuugcaacccaacauuauuuagaaugaucuagggcuucaauguguaaaaacaaaauaugccauaagaagucacauuacuaacgaaguugugaugacuuugauuauaaaaaucuaaaacauuuacugggguuaacguuuaauuuuggacucuauuucuaaauacaugcuuuauuaagagcuggauagaaaagaaaguagaaacagcauauuaaauauuucauuucauaaacaaauaaaggccagauguuggccuuuauuuauaugucagagauguuguaaguaaugaacgaaaacuuaagacuguuacgaaaaauuaaaccaaccaaguggcuacuguccuaagaauuugcugagauuauauaauuucuuuaucuuagaacuuuauuauggguaaacucuaaacaagguauaaaaagugguuuuaauuugguacuuuggagcacaucucucugucugguucuaauaacauuauucauauauugugaaacuuagcaccaagaaaacugacgaguuugagagaaugagaugagagaaugaaucuuucuaguaauccauuugucaacaaccaacagaagucugacaucuuuaaaaagcaaucuuuuacaucuuaauuauuucuuucugcuuauaaaaauuaaauauuuaacauauaaaagacuccacugauucuagagacuucccuaagauaaucaguggagcauaagguauaauauuauagauauuucaauguuuauuaauacaugauuauuucuauaaauuggcauacuacacauaaugauuguaacuaauaaauacccaucucaggucaucugaaaaauuccauuuuugagagauuacaaauacuauagacaaaacuacagaaaguugaacuuacuaaucuugaaccauuaauagaaacaauaaaaucaaagaaaggcuccaaaccagcucuguguccuggggaauuuucuuguaccugcggaaacaaaaacgacaaaaauaaaaaauguaaagcuuaggugaaaauuguaagccgaaucucucuuuucaguaaaaauagaccaauuucacugauaaugaaauacaguacacgcuaguucucucauuucucuucaucucucccagauaaugcccguccagcucccuaaacucuacccauucuuuaaguuaaucuucuauuuauauuuuuauuuuauuucuuugagacagacuccaccucuguugcccaggcuggaaugcaguggcacaaucucgguucacugcaaccucugccucccugauucaagcgauucuugugccucagccucccgaguaccugggaggacuauaggugcguaccaccauguccaacuaauuuuuguauuuuuuguagagacaggguuucgccuuauugcccaggcugguccugaacuccugggcucaagggauccaccugccucaaccucccaaagugcugggauuacaggugugagccacugcaccgggccuaguucaucuucuauaugagguuuucccucugugguucuauuucugcaccacuuucuccuuuuuugggagaaaggggcuaauccucucagcaauuagcaggggacacagcagacagucacuacaauuaagugacaaauucaagcaauuauuccuugacuacuacuagcaaggcaccacucaguuacaaagcaaauacaggcacauagucacguaugucaagacauuuauaaucuguugaggaauaggugagaagaggaaggggcaauggauacacagcccucuaaucacuauaauguaaaaccaaacaggcuaaaggcuauuugguauaagguucuaagggaaagauuaauucugacugaagaagcuucagacauaaaaagugauaaggaauugugguuuaaaaagaggguagaacauucaaagguaaagauggucaaggggguaggaaggacaucugaaaauggacaaaacaguaugaguaaacacccgaagcaggagucugaagaaugaggaucacagcaugcguagcuagacaacagaguaguguggacagaaauagagaauuauagacuuugaaaacuaggauuaacccagaaauccucuaauccagggaucuuaaauugaggucuguggauggcuucagagaauacuacagcuccugaaauuacacacuaucuuuuauaugaauaagcaguuuucaggguguaaauauugguggcuuucaucagauucucaaaggguuucuccauaacuccaagaagguuuaaaaaccagggauuuugugcaauucuuucauuugauagguuaaaaaaaauuaccaugucuugcuuaugauuccauagcugccuaaugguggaaguuaaacucaaaaauucaucuuuuuuauuuuuauuuuuugagacaagagucuugcucuguugccuaggcuggagugcagugacacaaucucggcuuacugcaaccuccaccucccggguucaagcaauucuugugccucagccucccaaguagcugggauuacaggugugcaccaccaccacaccgccuaauuuuuuuuuuuuuuuuuuuuguagaggcaugguuucaccauguuggccaggcuggucucaaacuccuggccucaagugaucugcccgccucggccucccaauguguugggauuacaggugugagccacugcauccggccaaaaguccaucuugaaacuauuagucuaacaaaaggcuggaaagaagggguagagcuacauuuacuggccuuuaaaugaaagagugagauuacuuuuaauauaauucauagguucauagaauaaaaaagauuacuuagcuucucaacaacucaaauguuuaucaucccauauuugauaauggacugucaaauuuucaaaauuuacaguaguaaaauguuaguagcuaguaacagaaauaugacaaaaaauaaaaaauauaauccacuccacauuuuuuuuccaaaauauuuucccaaggaauuuuuauucugcuugauauuauuaagugcugucaaaacuauuccauggccaggugcaguggcucaugccuguaaucccagaacuuuaggaggacaaggcaggaggauuggaguccaggaguuugagacuagccugggcaauauagggagaccccuguuucuacaaaaaaauuagccagguauggggguaugcuucuguagucccagcuacuuggaaggcugagcugggaggaucacuugcacccaggagauugaggcugcaaugaguccaggucgcaccacugcacuccgguauaggggacagggcgagacccugucucaaaacaaaacaaaacaaaaaaaaaucuauuccacaagaacaaaaguuugcauugauauuuauagguugacuuucuauaauaguccaaauaguucuauagucaguuuugcaaauaacagcagcaaaugacagauacacuuucaaccauacacaaagcuacagcuauuuauacaguaacaagucauuuuaauacuuucaaaauggaacacagauuguuccuaaaauacauccuucuaauaccagugucaaucagaauuguucauuaccucuuaauguuaccuuuuauuuacgccaaauuauaguauugucucagaagaaguaaaacuugauauucuucuuuugauaacaguaaagaauaguugcccuauauagacgguucaacgucuaacucccuaaaacuguuugaucauguuuuuuauguuucccugcaaauuugggaccaaaucauuuuguaaauuaaauaaguuaaauaucaaagggaucuauuaaagguguucaguuucuucuucuucuucuuuuuuuuuuuuuugagacaaggucccacucugucacucaggcuguaguggaguggggugcauccauagcuuacuccuggccucccaagcagcugggacacgugugcaccaccaugcccagcuaauuuuuaaauuuuuucuagcgcaccaccacacgcagcugauuuuuaaauuuuuucuaguguaccaccaugcucagcuaauuuuuuaauuuuuuauagagaugggggucuugcuauguugccaaugcaggucucgaacuccuagucucaagugauccucccaucucagccucccaaagcacuaggauuacaggggcacgucaccauacccagcuuuuaguuucuguauacucaguuuucuauggggguuauuucauauucuguauguuaucaaauaaaaugucuaggacucaaaauagcauauuucuucucaaauggcaacucugaaagguaaaguaguggcugccuggagucacaagaaaagugaggucaagucacagcuacuggggacaaagucagaucaacuagaugugaaaugccuauuaggugguuaucaauuagaugugaaaggccucaggugugaaagggaaugaacagcacagauccucaggcgccuccucagaguggaguuucucaucuaauaaagcccacaucuaaucaccuaauucucugaaucugaauguuucuaaaaaacuauuaauagcauuuuaucuagaacucaacuaggucacugaucaauuucagacuuugccacugagacugccagaaguuuaccuuuuaguuaaaaagggcuaaagacagcacuuuuauaagguaaucacucauguagaaagcugacccugcauacugauucuuacuaggccacccuuauaaaguuuaaaguauaaacuuuagaguauaaaguuuaaacuauuugucugaaauggaaauuuuccaauaucagaaguauuuuuccuauaauucaaaaaugauucaauagcuaaauuugaauucuaaaauaaacuugauccuuucccuagcucuauuuuucuauuucauuuguuacuaacaucgauuuccucucuguuucuaauggcccuugaaauuaacuucuuuccuaaauuuauuuacaucauuaguaucugcacaauuacauagguagguaucuuaauuacugcuaggaagucagcagagagugcccuagaaaaauccucucuuugacccucauauaccuaaaggaaauuuccuauauuuuguagcauggaaaauaugaucuacaacauagcaaaccaaacacugacacagguaaguuucucuugcaauguuauccacugacaagaaucuccuggcacguaaucucucaagcaucagauuaccacuucaauacuuucuauccccuaugagaucuccugauuauuaauuuaucuucgcuuucuucaagucaucuuaacuaaaagucuauauauacuuggcuccacagaccauuuaacauuuauuacugggccaaauaucaaagcaauuuacaaugaacagguuaaauuuguaaauuuaauaauuaaggccaggcacgguggcucacacuuguuaucccagcacuuugggaggcagaggugagaggaucuccugaggcuaggaguucaagaccagcuugggcaacaaagugagacuccaucucuacaaaaauuuuuuaaaaaauuagccaggcauaguggcaauugccuguagucccagcaacucaggaagcuaaggcgggaggauugcucgagcccaggaggucgagacuacagugagucaggaucacgccacugcacuucagccugggcgacagagcaaggcuccaucucacaaauaaauaaauaaauaagauuuuaaaagauuauauacagugaaaaaauaauagacuuuuagagccagacugaguugguuuuaagccaugauuuuguccaguuauuagcugugugagcuugguaaaguuuauuuaccacgcugggccucaauuuucucauuugcaaguaagggauaacgccaucuucuucacaagaauguuguaaagauucaaugaguuaaguuuaugaaaugccuagcuaagucucaagccuaugauagaaggccaagaaaucuuaagcucauccuccuaacucugcaaucaccaucugaggguaagucuuuauagcuaaccaauuccuggacacaacauuauuuuuacaaccauauuaaauaccuuuuacucuuaaaaagaaaaaauaaaacuuguaaaguguuagcaggaaagagagacaaaccauuuuuucaaauguugccucccaaaaaucaauuccagauggauggcagcucuaaaaggucaaggguaaaacaauaaacgcuguagagaaaaacauaagagaauaucuuugagaccuucaaguuugcaaaggcuuccuaauaaacuggacacaaaaugcacuaaccauaaacuaaaauaaauugauaaagugaacuacacuaagaacuucugcucaucaaaagguauaauuaagaaaguaaaaagacauaauacauauccaacaaaggaucuguauccagaagaaaucuugaacuacuguaaagcguucagaaagacagacaauaaaaccgcaagauacuauuucuuguccacuggaaugaccauaauuaaaaagagaguaacaagcauuggcaaggauguggagaaaauggaacacucauacauuugcuggugggaauguaaaaugguguagccgcuguggaaaacaguuuggcagauccucaaaauguuacacacaaaguuaucacaugauccagcaauuccacuccagguauacaaauaaccaaggaaaaugaaaauauaucuccaugcaaaaaccuguacacaaauuuuauagcagcauuauucauaauaucccuaacguagaaacagcccaaaugucccccaacugauaaauggauaaacaaaaugugguauacccauaagaaaggaugaaguaccaaugcacgcuaugacauggauaaaucuugaaaacauuaugcuaagugaaagaagcuagucacagaagaccacauauuguuugauucaauuaauaugaaauguccgcaauagacaaauccauagagacagaaagcagauuaguuguuaugagggguuguggguggaagaaugggggaauggcuacuaauacauauggguuucuuucuggaguaauacacagauucuggaauuaggcaguggugaugguugcagaacucuaugaauauacuaaaaacccaccaaacuguauacuuuagaagucugaacuuucugguauguaacuuuuaucacaauaaaguugcuuaaaacagaaaaaaagacaacccaauagagaaauggagaaaagauuuuagcagacacuaaacaaaacaggauacugaagugaucuauaaauaugaaaaugugcucaacuucaauggucaucaaggaaaugcaaauuaaaaccacaaugcaacacuacuacacaucuaucagaaugaaugaaauuaaaaagacgaaaaauauuaaguguuagugaggacguaggacauuuagaaaccucaauuacugcugguuagaaugcaaacuaguaaaugacuuggcaauaucuauuaauauugaaaauaugcacaccuuuugaccguauauuccaaccuuggguauauacccaacagaaauggguauacacauguucucuaaaagcaauacacuauaauguugauaguagcacuauuuauaaaagccccaaacugaaaacuacaaaaauccccaucaacagguuaauaaauauuggcauauucucucaauggcaccaaauacauuaaugacaugaaaggucuacaauaauauacaugaauaaaucucacaagcaauauccgagcaaaagaagccagauacaaaugaguaccuagcacaugguuccccuuauacaaaguacaagaacaggccaaacucaucuaugcuguuagaaaucaggauauucauccuguggaggugggaguugugcaggaugucacuggaaagggauaagaggcugguuacauuaaguguguugcuugugaaaauucaccaagcuauacacuugugugcacucuuuuaauauaaagccuuaaaagaugcucccuguaucaaaacaaguauacugagguuacacuuuuuccaaugccuuuuuuuccaauucuucuuagggccacacgauuuacuuugacaauuaagaaacauaauaaagcagcugaaaauacuaaagagcaauuaugcuuacaaaauaauaauuauaaaaagauauauuaccaaaacauggauagguagaagaaauuaugaacacauuaacuggcaguuguaagguucaaacuauacaucugagguuagcuuacaaaauaaaaacuacagcagcgugaaagaaaugcuucucuccuaacauucuagaaaaaacggcugcaauaaacaagaugauauuugcuagacaguuuuuaccccucaacgagcaaaaaugagaagcuuaugaugaaacugcacaguaaaggggcaucucuauuacauaaaaagaaauuugcaucaaugauuagaagcuggauuuuuuaaucaccaacuuuauagaaauaaucccuaaaguggugucauucaacuacaguggaugauuucaguagguucugaaaucaauuuagugugucacaaaagacaaguaucaaaacacaauaucacaauagaaaaucugucaaaaaugcaugauauaauaaaggccuauauucuucaugaaauguaguauguacugguugcaauggaaaauacauuuuuuggcuugagcuacaauaaaaauaaaguuaggaaaagcuguccuacaagauaccguuaauacuucugcuccauuaaguuccugguaaaaaaaaaaaaaagcaauucacuucuugacuuuucccuccacuucugaucccguaucauuaaaaguuuuaccagauuuagccuaaacuuuucuuuucuuuuaacacacagaccuaacuauugcuuuccagugaagcauucaucucuucuuccaggauuaagaauguucaacuacuacuacuuaugcuagguuugggucauuucacauuaccucuuucucucuuuaauucuucacuugggggagggaggaauggcagaguaagagggaagaaguguuuggguggaguugggugucagggggcauucucccaacugcacuggucuacugacuuacauaccuucagcugagguauacagaccuucuaccuuaaaguaacaaagaaaguaaaccacaaggcaacuugcagcacacaggauaucaccagacuacaugcugcacuaggugauacacaaagacacacuuauccauguuucuggcugauauguaaauuaucuuccuuaaguuuucugacaaugaaaauuauaccauaaaauuggcuuacuagaauguauaacugucuccuuuuuauuacuacaccauauauuccuuuuccacacauaaaaugcagaaaagccccauugaaugacuaucuacacuaucaucucuucuaacacucucccucuuguacugcuuuuaaaaacaguggagauguuaaacaagacuagaaaauaaauucaauccaagcaauaccuaaaugaugacccaccucaacuauaaacauaaauccucaugcacuauaugugugcguaggugaucaaaaugaugggaaaagaucugggaaugugauauaauaaaaagaaauccuaaauccuccgugguuauaauaagcauuuuuuuuagugaggagggugagggagcuauaguagucccuguuaucugcaggggauauguuccaagaccucccauggaugcuugaaauugcagaguaccaaacccuacauauacuguacuauauuuuuucccauaugcaaacacuuaucauaaagcuuaauuuauaugcuaggcauaguaagagauuaacaacaauaacuaauaauauaaaacagaacaaucuaccacuuaugaacuguuuauuucuggaauuuuccaucugauauuuuuggaccucaguugaccaaagguaacugaagccacagaaagucaaacuguggauaaggagagacuacuauauucuaugucugcaaauggguaaguuuccuuauuugggucuugacacaaaugugugguaaauaauuuugcaguagacuagaagaguucaagccucaccugcuaaaacauugucuucacauguucuuccaaaacaaagcaaaguacauguucuccugacacuaacccugacauaauuuuuaacauucaagcaauuuaaaauaaaauuguaauggcaacuaaaaggaaauaaaaacccauuauugcauaauaguuuuccagaaaagaucuguacauuagaaaaacaacaucgaaagaaauugaaguuugcucuaaaagaagcaaaaacucugacaacuucugaacucauuuuauauucuucaaauaacuuagggauuuguuucuuagggaaagaaaacuugcucugugaccuugggcaaaucagauuaacuucucugugcuuuuuuucuuuuuuuugagauggaguuucccucuuguucccagguuggaguacagugaugcaaucucagcucacagcaaccuccgccuccuggguuuaaguaauucuccugccucagccucccaaguagcugggauuacaggcgcccacugccaugccuggcuaaguuucuguauuuuuuagcagagacaagguuucaccauguuggccaggcuagucucaaacuccugaccucaggugaucaccgccucggccucccaaaguacugggauuacaggccugugcuucuuuucuuuagcugcaaaaaugaggaggcuaacuauguaaucuguaagccugaaugacccaccaugaaauaagucuaacuguugcuaagcuaucuauagauucuacaaugaagaaaaucaaauacagcaagaucauuuuaauugcauagacucuuucagccauuuuaauuaauguguguaguaacacuguagcaaugcaaugaaaaggauacuggcacuccccguuuaaaauuaaaaaacaauuuccuuaaaaaugaggaucagaggaaauuaacaggcaccauuuaugugugugccuauaugacuaaaauuaaugggucagaucugaccucaaacuuacguuuuaaacagcaguaaaguacagguuagguacacagacaaaaaguaacuguugcuuaaucaaauaaaaauacuaaaaauguuuacaacuacaguaguauauuuuagcuaguauugccacgauacugguucuacacaauaaugcaaaugcuaguaauaaaggcaucagcuaacauuugaauccuuauuauauuccacauucuaaguuaagugcuuuacauggaauaucucauuuaacccacaggauaaucaaggagguagauagcguuguuuuaagaaagagauuuaauaaugcucaauuguuuucauuauuuucauacacaguaucuaauguguuuuuuaguggaaaagguagaaguggcucugcuauuaucugcacuuuucagauacaaagacugaagcuuuucaaagcaguucaaaggguugcucaaggaaacagaaugaagugauagagcuggcacuagaauccaguucccaaagguggucucuggugguugacuaugauaguuucucaauguacucauguccacaaagauaacaagauucuuuccuucugucuuuauuuuuuuuagagacaggaucucacuuuacugucuaggcuggucucaaacuccuggcuucaaguaauacucugccucggccucccaaaguguuaggauuacaggugacagucacuguaccaggugcuuccuccuuuguuucccucuuucccuucccucccuccuucccucucucuuucuuuuucuuucucaagcucucaauauuuugccacggcuacucuugaacuccugggcucaagcaauccuuccaccucagccuccugaguaccugggacuacaggcacaugccacaaagccuggauuuuacuuuuauuuaauuaauuagggcagggauguggcucacagcuauagucccagcacguugggaggcuaaagcaggaggaucacuugagcccgggaguuugagaccagccugggcaauguggcgagaccuugucccuucaaaaaaucagccagcuguggugguacgcaccuguagucccaacuacuuggaaggcuagggagggagaacugcuggagcccaugaagucgaggcugcggugagcugggacugugacacugcacuccagccugggcaacagagcaaaaccgggucucuaaaaauuuuuuuuuuuuugugauggagucucacucugucgcccaggcuggaguacaguggcaccaucucggcucacugcaaccuccaccuccaggguucaagcgauucuccugccucagccuccugaguagcugggauuacaggcacgcgccaucaugccggucuaauucuuguauuuuuuguagagaggggguuucaccauguuggccagacuggucuugaacuccugaccucggugauccacccgccucagccucccaaagugcugggauuacaggcgugagccaccgcaccuagccuuaaauuuuuuuuaaaaaaauuaacgaauuaauuaauuaauuuuagagacgcugcuguuacccaggcuggagugcaguggugugaggauagcucgcugcagccucaaaguccuuggucaagugacaauuuugcuuuuauugagaccggaucucauuauguugcccagcguggucuuaaacucuugggcccccaccucaccucagucuccugauuggaguagcugggauuacaggugcacaccauuaugcccggcuuaagcuuccuuauuucugacaaugugcuugagccuucucucauugaugcuuaaaagagagaacaaaaccccagaauaauuaucuucaugcuacaguaaauuuauuugcaaugccaacagggaaauguacagucucucaaaguaacuacuuaggacuaggugugguggcucauaaguguaaucccaacacuuugggaagccaagacgagaggaucgcuugagcccaggaguucaagaccagccugggcaacauagaaagaucucucuacaaaaaaauuuuaaaauuggcuagacguggcagcauaugccuguaagcuacucaggaggcugagauaaaaggauuaauugagcccaggaguucaaggcugcagugggccaugaccacaccacaacacuccagccauagugacagagugcgacccugcuucaaaaaaaaaaaaaaaaaaaagucaguuucaaaagcacauaucaaacuuucuauuuccuaguuuacauuaguauuuuauagugaaucaaucaauauauauaauccuuucaauagaauauuaaaguaagcaaaaugaacacacugauguuaacgguuauucuaagcucaauuuuuauaaaauuugcagaggaauuauuaaaaagcccuguuaguaucugacccagaaggcagaagaaucaguguuguacacucuacuacuuacugaaaccauaauuaaccacuaacagcagaucucccccagugagaauccugaggaugauagcgcaggcauuaaaacacaccucaucacauaaguacgaaagcauauacaggccgggcgcaguggcucacgccuguaaccccagcacuuugugaggcugagguggguggauugcuugaacucaggaguucgagggcagccugggcaacauggcaaaaacccaucucuaccgaaaauacaaaaaauuagcugggcaugguggugugugccuguagucccagcuacuggggaggcugagaggggggaggaucacuugagccugggaguuggaggcugcagugaguggagacugugcuacucauuccagccuagagugagacccugugucaaaaaaagaaaaaaaaaaaaaaaaaagagguggggcguugggggugcugggugcaguggcucccaccugaaaucccuacacuuugggaggcugaggugggcagaugacuugaggucugaaguucuagaccaaccuggccaauaaggugaaacccugucucuacuaaaaauacaaaaauuaguugggugugguggugggugccuauaaucccagccacuugggaggcugaggcaggagaaucacuugaacuggaguggcggaaguugcagugagcugagaucgcgccacugcacuccagccugggugauagagcaagacuccaucucaaagaaaaaaaaaguguauauaaucaacaugaaacuacuaauuuguucaaggccuauuaauauuagaaaaaguuuauguucaaugauauaauuccuaaaaguaucccaagauuuauauacauuguauuccauggcuucaauaaacugagacauccugauuccuacauuugaaagcaauuuaaaagaauguuuauuaaacaacuucugggccuuuuauuagaaaagaucaauuuugggccuggcacaguggcucacgccuguaauaccagcacuuugggaggccgaggccuguggaucagcugaggucagcaguucgagaccagcuugaccaauagggugaaagcccaucucuacuaaaaauacaaaaauuagcugggcacgguggcaggaaccuguaaucccagccacucuggaggcugaggcaggagaauugcuuggacuucggaggcggagguugcagugagcugagauugcacaacugcacuccagccguggcaacagagcgagacuccaucucacaaacaaacaaacaaacaaaaaagaaaaaaaaggagagaucaauucugggggcagggucagacucuucagguuucacaauuauaacuuuauauauagaaaacaauaccaaauaacccuacuguuuucuuuuuacccauuguuuccagaaugagugagaagggagccagagugagauuucuguguuaggggaugagguagggcgugguggcuaacaccuguaaucccagcacuugucggagguggaggcggguggaucacuugaggucaggaguucgagaacagccuggccaacauggugaaaccccaccucuacuaaaaauacaaaaauuagcugggcgugaugacaggugccuguaaucccagcuacuugggaggcugaggcaggagaacccgggagguugcagugagccgagaugcgccauuguacuccagccugggcaacaaaagcgaaacuccaucucaaaaaaaacaaaacaaaacaacaacaacaacaacaaaaaaaaaaacaggguaugaguuucaaaaguuugagaaagacuguuagaagaauaaagaagacaaugacuauugaauaucagaaauuaauuuuuucaaaauaaguacuaaauugaaaucccaucacaacaggauugcagauagguuaguuaggcaccauuuaaaaagagcaguaccuuugggagaccucaucucugacaaaauagaaaaaaauauauaaaaagagcaguuccauaugauagaagauaugguguaggcauugcauuuucuauagaaguaauuccacuugcagucacuugcuucucugagaacaccuaaauguuacccagucugcagcaaauagcucagaagauaaaaaccuguuauuacacucgugacacauuucaugucaaugacccuuccuucaaaauauccaucaccucaaaaucucucccagaagcaagcaugagaaagaaugaaaaugccauuuuccaugucuccacacuccacacagucuccacacugaauacuugcuccagaaaguaugcccucagcuauuccccaucucuuuuaaguguggaacagaauaugaauauuuuaauuuaaaagcagauccuauaauaggcaucugugaggucacuccaaaaauuuaauuuugugaacuaugucacuaauaauuuuuuagagaaccuuguuuauuaccuuucagcuuuauuuuccugagcacucaaauguaccugcacauacacaggguguuugaaacacaauuuugagcgaauguauagcauucuaucugugguuaggcccugauuuguuuaacaauuucucaccuguuggauauuuugguuuaauuuaauuuugaaaauggucuuguuggguucacuggauaauuaauggaaaauauaggcaaaaauuugauauuaaacauaguucacauguaggggguaacuuacaauaacuucaaaaacugagaagcccuaacauuuuuccugccuuacauuaggauuggaggaccaaaauaaaagugccauucauagugagcacaaaucugacccacuauauaaggaaaucugaaaugcuauuuuuuaaaaaaagacuucuacacaaauuuuuaaauccuccacuaggaguccacuucuuuuuuaaaaguaauuuugcauaucuacacuuugggugacuauacaaguauuuaaugaucacuucagaaauccuagaaaauauauuaaaguuaaaaaaaaagucaccauccacuaauaauuuuuuagacaaccuuguuuauuaccuuucagcuuuauuuuccuaagcacucaaauguaccugcacacacacagggugucugaaacacaauuuugagugaauguguagcauucuaucuguguuuaggcccugauuuguuuaacaauuucucagcuguuggcuauuuugguuguaauguuaaccucuuaagauaacuuuuggccauauaguccuugaauacgucauauuauucaaaaucuuugugaaacauggcuaaggggcgauguuaggcccaggaaaaaaaggagacuaagagaaauacuucaacaguauuugccuuuagauggugggauuacagguaauucagguucuuugcuguacuuuuuuaccacauccaaauguucucuaauggacacauguugaugaucagaaaacaauguaguuauuuacuaaaauaaagaucaacauuucuacagacagcuaccauuaaaauucaauacaguaaucugggaaaaggauguauguuaugggaaaacaaaaaguaggauuuaagguuguaaauauguacuuauaauaacagaagacuagauaaccaaauguucaacaccaggagguacuccuuaaccaaucuaugguacaaaagacuaccgugagcuaacugaaagcaugaagcagauggccacuugcuacuacagaaagacugccaagauaggucaacaacugagaagacugaggugugcaacagcauggaucaugauuacaagguaacaaaaagaaagagagaaggguggaagaagaagagacucuuuuuuuuuugaaaagaagucucacucuuuuugccuaggcuagagugcaauggcacaaucucagcucacugcaaccuccgccucccagguucaagugauucuccugccucagccucccaaguagcugggauuacaggugugcacuaccaugcccggcuaauuuuuuauauuuuuaauagagaugggguuucaccauguuggucaggcuggucucgaacuccugaccucaggugauccgcccaccucggccucccaaaguggggauuacaggugugagccacugugcgcggccaaagagacuuuuuuauaagcauaaaauauaucugaaaggcuauguaaaaaacuguccacagugguuacucuggaguggggauaagaaguuggguacacaauaugaucacaaucugaaaauaugcacucauacauacagaacacauaaaaaggaacuacacugcucauagcagaacuucugaauccauuuaaaggcuguccccuaaauauuuuuagauggauauugaaaaauaaugaaaaaaauggaaagcucaaucuaucugaauuauagggacucaugaaaucaaaagacagcaguggauauaaauguuauuauaauugguauuucaaaacccagucaaucauauuaaguuuuuacuacaacaagauuggccagggaauugguuauucaagaaaacuaacuucuaauuaaaucguucuagaacuuguugaauaugggugauuuuauucaaaauuuuccugccacaguuacuccaguuuacaagcuugguaaucuaacaaugaaauauaucgcuguccauuuaggcaauaacaaaugaaaggaagacauuuuuacauguuaagauuuaacacagcacuuuucccucuaaaaacaaagauaagaaaaccaauuacagaaucaggggcagagggucuuaggaaggcagacacaaaauucuccuaaacuagaucauuacuauuuuaaagcucucuuuaguaaaagucuaacuaaauaagaauuauuucaucgugugcaacauuaaugcuccagaugcagauugguaacuaagguugucccuaguuuuucuaaaaaucagauguauagauuaauaacacaucugcacuacugaauauguaugaaugcuguuucacuugacugcacuuacauaaagaaaauacaaacucauuuuaugucggaaugcagucacuaaguuggaauccuuuugauguguauggcuuucuuucaaacacgcgacuuuuuuuuuuuuuuuuugcuuauuaacacuaauguguuuuacugaguuucccugagugcauguauuauaaaaauaucaugaauccccaaggauucaugaccacaaucggucacugugagaaacagcugguaauacuggguaacaucccaggguagagaacucaaaaucagaccagauaauagaaagaaaagcacagcuuucaccucacauuugggaacugacaauucuccuuccauuuccucucucaguguggcucuuggguguuugguuagcagaaggggauaggaagauaauacgguuuauuuauaggcucccuuuuccuuucggggaaaaaaaaaaucacccuuuccuacuaagaguauggcagaggagggauuuuuaguguaauggaaaggcaauagacacgauaauccggaagaucagaaagaugaucugucucagcccuaucacauagacagcugggcaauuuaagaaugugucucaccuaaaacaugggacccagggcaggaaaugaagguagcaccaggaagugcacucucuuacuuucagugaaaacguucuugccugugaggagcuaauauugagugacacucuauuacaccccuaaauggcgcuacacgcugcggccacucuguugacuguucauguuaacacucacacaggugucacagcaaacaaccaucaaugcuacuucuaaagucgcccgguuccaugaggaaaagaccacaugcuuuguaccacccaggcccaggccguucauagguaggggcuuagcugacgccuuuugagauacuauguuucucugcguccuggaaguuaagcuaggguuguuuuccuuuauauacuccgauuuuuaaaaaaaauuucucugcacuaccucuuuaccacuguggaucuaaaccuuauaaucuaaaccacacccucagcaaucggaacagaacggaaguucccacuccaggaaaucuugagaagguuugggagggucaggaguggcacgggaaaggaaaagucuggucaaaaucaagucuguuuaaguccgucgaaccuacuuccaggccauuugguuuuccgucuccugcccugcuggucuuucaggccacucggccggcgccgaggugauuuaacaccugccgccgcaggccccgccuccggacugcggguccggaucccucuccuaggaaagcgcaaaggcugccuucacagucaccacuuuggagacguugccuccgcgcccuuccuaacuuuggaagcuaaaaaugaggggggguggaggagagagaaggccgugcggaaaaagagcaagguuguccccccuucccagggccgcccccuggccgagucgccggcagccgccuccagcuccagcccguccuccuacagccgcggaccccgugcccagggcgcuccgcggaggugggaugcgagcggccuccggaaccagccucgaccaaggcagcgcccgcgaccgccgcuccuucgcgggaucgggccuggcugccccgugaaggagcccaugggggccuccgccuccccgcggccggccccgccuccagcccgcagcuccccggccgccgucggagcccuuacccgcagaacgugguagcccucggugcccccgcccgggaucucgacgcuuugcgaggagcccauggcggcgggcgaucgguguggccgagccgggcuccgcgcugcucccgcccccagcgcaccgccugcucuaauccuccgcguagcacuugggacguggcacucgcugccgccggagagccgggccgcacagcccgccgggagaucgucucugcugcagcccgggccgcugcgacgccgcagacagcgccaccugccgcgagccacuggaaggggcccgagcgcucgcgggccgggagggcggagagggagggccggaggaggacugggaggcaccgcgucgugcucgcgagagaacagaaaugcgcuucccccagcuuuggcgccuugcuacggggcccuggauuggacuagauuuaugcagacgcguucccgcucgccugaaagaacacauacuugguugcaggucccccugguggccagaggcggggaaagggcugcugaugaacaggagcgaacucaacacacaccaagcucucuguucuccggguguguagguauuuucccaaacuguacagcugaggggaauaguggccuccugugggcugccuagcaucugcucagcuaaauuuuauaaaaggaaacgcucccuuuauaaaacaguagucucacagagucaccuaccaacuucuuuuuugguuuggguuuguuuuuuuuucuuccucccuaauugugagaauaagauuagaggauuggucauaaucagagcgaugccagcgugggaagcacgguuggauuucccuggcauuccaccaccugcugcugcucgguuccccguccuaccuccuucagguagccaggucguauucaugcuuauuccguugucguauuccguugcugcuuuugccccuuacguguacucccucugaaaccccuaguugcuuuguggucaguuggacugauguu

SEQ ID NO: 191202 - RNA, 57761 nt, Homo sapiens
ccucgcccgccugccgccuuuuugugcgcgugugagugugggccccagcgugcccucccggggguggguuccgggcggaaggcggaggcccggcgcgcagcccgccgcccgccugcccgcggaccggggagccggggugcuuggagcgggggacgccaggcgugggcuggcggcgggaccaggaggaggaggaggaggaggaggagagcgcgggcuggcgcuugcccgggcgcagucggcggggaccgagucguacuuccugugcgaaaggcggcccgacccuaaccgccacccccucccccugucucccucucugaacccgcccauuggggguaggacacucagccgucaccgcucgcucugcuggccgcuaccugcagcaagauagggccgccaucgccgggcgacgacgaggaggaggcggccgccgcagccggggcccccgccgccgccggagcgguaagucccgcgcgcggcccgcccccgccgaggccgggcgcccgccaucccggacccguggcgcgccugcccaaaaggccuccccggcgcccgcgcuucccccgacccgcacgggccgcugggcuccagggcgcccuuuccugcucuuucgcaucccgguuuggaucugaagccagcccaggcuuucucgaaauugucacugcagcaccucgcgcaaaaucuucacaaaaugaagucugagagggcggggguagaggacuccaaaauggauguuugagcaauucauaucagugcugaaaacuccuucgcuuaacacuacaaaauuuucaagcacagccuaucggccauagauaguaucaacuagaggcaaugucuuuaguuuuuauuauuuuugaaccuggagcauuuucuguuggacguuacaggaucuuacugcuuuaaaucauacauuauuaaaaaaaaugaggguuuauucuuugaauuacccuuuuguaugcaggagugaagacugcuuuuuuaguugaccauucaaaaucguugaauuuuaguuuuugcagacuacuaaaauuugcagugacuuuuuuuuuguaagggggguaaaugaaacauuuagcagccuuugaaaucagcaaguugcuuagauaguacuuuagauuuugaaacugaauauaacaguguuagaaaaguauguguaaggaauuguauuuacgugcauacuaguaguacaauacuuauagcugaauuugguuggcaaaaguauguuuucauuuuauuacgacugcuagucagguaagauauggugggauucuuucuguaguguuuucagugucugggcaaggggaggagcucgccuguguuauaugagggguuaauaccaauaggauaggaacaguuuuuagacuguuaauugugaauuuuacauuugggucaucacuguuguguagauuuguucaccuauuaaaauaaugaaaacccucauuugagugugugugugugguggaucauaggaauugauuuguggagugauacuuucaauagucacugaagacagaaguuugguauuugguauagucuacaacaaaugcuuaguauguccagguauuuuuuuuuuuuaaguuaaaccaauguuaagcuauuacugguaaauaauuuguaauuuuagugcuucguuauaggggaugugaauaguuuuaaugucuuguuuuuucauaagcagauuaacauguaaaaauguaaaauuauauuaggcuuuguuauuuuuaaauacauuuauggauugguacgccuucuguucaccucauuucagcuucgcugagaguugguagauuuuuuuaugaacuguaucccucuaguuccaaagugccaaaacaaauugacuguaucuuaaaaaacuacugcauaaguaaaauuaaaaagcagauugcuucuccugaucuuuuuuguauuucaaauggaacaaaacuuuucuuguaacuguaauuuguaaaguuuagauaucaguuuacagaugggggaggggagaaggaaggaaauaugggugaauaauauguguauguacauacauaugugagucugaggcccaaggauagaauacugucuccaaccuuagccagcuguggccauauacuuguagggaaguuuccaugcuucuucagcugcuuuucugaauuaccaaaucacuccugacaacacauauucugccacaugaagacgaacuagaaucaaucugauaaaucugagauuuaucaaucaaauacaucauaauuugccaaucauaguaaaaugaaaauaguuuugccuaaaaaaaaaaaaaaaaaaaaaaaaacccaaaccauauauuuaugaugucugguaccugcacccaagauuuuucacuuugaguaaaauugguaagacuggcuuguguguauuugccuuagcaaauagaaaauuugcuaaaaauuuauuuuuccagugcaaauaugaacuuaagacaucuuuucagcacaucuuagaaaaggaaauucacaugaguucaugggcuuagauaaucuuuuauuacucaaaugacugggaauuaugagagguuauagcuguguuuuuaaauaauuguauuuuggaauaauuuuaaauuuauagaaaaguuggaaauacagaacugaguaaucucauacccuucauccagcuuccccuaauguuaggauaaugaugauacauuuguccaaauuaagacaugaacauugguaugacauuacuaaccagacuuuguuugcguuucaccagcuuuuccacuaauguccauuuucucuucugggauccaguccaggauuccacauugcauauauauuguuguguuuaaacaaguggaaauauacacauacagaugaacuuuaugccaguuuagcuugguauuuugagauuaaaagggccuugaaaagccaaucaacugugcugaagauugcuuuuaauauuuggauuuugaauuuggaauuugucauaaaagaggauccuagccaaggguguuugguuacccacaguacauugcugaagaagucuagucauaaagcagucucguauauaaugucguacaacauggacucugaaagaugguuuuauagcaacgcuccuuuguacuuaaguuguggcuaauuuuaguaguaaaccaggaaauagaaaaaaguagaccuuugugcaaguauuaacuuugaccaguuugcauuuaugugaacuuguggauuauuaauuuacuucauuuuuacuuuaguggaauaaaauaagugacuuuuauuuuuauuuuuauuuuuuugagacagagucucacucugucgcccagacuggagugcaguggcgcgaucucggcucacugcaggcucugcuuccuggguucacagcauucuccugccucagccucccgaguaacugggacgacaggcgugugccaccaugcccggcuaauuuuuuuuuuuuguauuuuuaguggagacaggguuucaccguguuagccaggauggucucgaucuccugaccucaugaucugcccaccuuggccucccaaagugcugggauuacaggcguaagccacugcgccuggccuaaaauaagugacuauuaugaaagugauugcuugaucuuugguuuagguuguaaauuuaguguuccuuaauuuggcacauaaauguugagcuaaaaaauaaguaauagcuuacuucaaaaaaguuauuuugccauuauuuaaaauaagaccugugcugucauuguaacuaauucauuggguaggguaauucuauuugaagucugaguucuuuuagugcucuuugaagauuuuaagaaacuugaauauuugccuaaguucuuaauuuguuuccaccucagcuucacaccuguucuuguuuccaguuauacuccuuccuuuccuauuucuggcuuucguaaaggcauucgugggaacuaaguuaauaaucauuuccaaaugcuaugcaauagguggugugaauuuuuucuuuuuccguuuccaccgguauauuuguauguagagagacuuagagugccuuaguuacaacuuuuuacuguacuaaugccaacauucauguuagaugguguuuuguuuguuuuuugagaaaggcucgcuuugucucccaggcuggaauggaggugugugauuacaacucacugcagccucaaccacuggggcucaguugauccucccaccucagccucccuaguagcugagacuacaggcacgugccaccacgccuggcuaauuuuuguauuuuuuguagagauggggcuucgccauguugccuaggcuggucuugaacuccuagacucaaaggauccaccugccuagguuuuguuuguuaauuguccgguaagaaagguacugagagaaacacugguggauuuuuaauuugguuuguaaacuuacguagacauagguuauguagaggauuaucuugcuucuaaaccaaauacuaguucucgucuugguugccuguuuuaauuuuuuuuauuuuuauuuuuauuuuuuugagacugagucucgcccugucacucaggcuggagugcgguggcggaaucucggcucacugcaaucuccgccuuccaggcccaagccauucuuccgccucagcccccagaguagcugggacuacagccccagagucccagaguagcugggacuacagauguacaccaugcccggcuaauuuuugucuuuuuaguagaggcgggguuucaucauguuggucagacgggucucaaacuccugaccucaagugaucugcccgccucagccucccacagugcuaggauuacaggcgugagccaccggcccugucacgguuguacguuuuuaaaucuccuuuuauucuuuuguuucuguaguguuuccaguagucuaacaucaaacauuuuucaaacuuuuuuuuuuuuuuggucucagaugauuuucuaauuuauuccucucccauuugguauuuaguguacuuuaucucuuuuagugguauauugcugaugaaauuucuuuuacaaagaaauuugauugugcuuugcaaggcuuuguaguuuugaaauauuuggagcugauucauuguggaauuguggaaauaaauaggcuuaaaauugguuuagacuuuuucauagaaggcucuuaauaccucaaaauuuguuuugauccauucugucauuguguuugcaaugauuuuaaaguaaaauaacuuuucauucaguaaauauauauugaucuuacugagugccaggaauugugcuaggcuaauuuuaauggauguuuuucaaaucuauucucauaaucuuagcacucacaaugaucuugggauugcacagugcucaauaguuuauaaaauuuaauauuuuucuucugauucuuaugccccugcaagguaauguuuuuccgguuguugacaugagaaaauugaguugcuguaacucacacaauuccacaguguagccagaacuagaacucaguucugagcuuuuuuuuuuuucuuguguaauauauugucgaguguaguuuuggcauaaaucaucuaguaguuuucugauucaauguguuuuuuccauuccauuuagaaaauaggguauucagcaaauuuuuuuaaaacugcaaauuuauuaaauuaaaaaaguuccuuuucuugcuugauucuuuuccuuaaauuaccuguugcuuuuuuuuuuuuucccccaucguugugcuucacagguauuuuaauaaugcuuuucauuucaggcuuauucagaaaaguucggaauacaucacuuugcucuagguuuagagauuuuccuucaauuaauggccugaauugcugagaaaaauggcacuacaguuuauuuuuaucuagcuucuggagaggggaugacuugggcaauauuuacucagauuugucauuugcguuagcuguauuuauuuucaaggaauuucuugacuagaaagcuguucagugaugguugaauaucugccuuuauuacuauuuuguaaaaaaaaaaaaaaaacacuuuaggugcuguaaauuugacuuuguuuuuuuuaaagaaaggaaaagggacaaaaugccaguaucauaaaauuaauuugugucugaguuacuauauucuuugauaaaaguucaauaccuguaaauuuuaugcuggucagaaaaaauuucaguggauccuccaggugagcaauaaccuuaagaagauaaagguuagauuuuagacacacuuuaguguagauuuuaguauauagauuuaaauauuuguaguuuacuuaaaaugccaagagaccgaaaugaaacauuugucacuguaauguuaggaaaggugacuuaacauuguaauuucuauaccagauugaaguugcagagugacaugugacuuuaaugucugaugcuucauuuuaaaauuguuuaguaaauauaauuuaaguguauuuaagacagaucgcuauuuuauaguucaggccuagagauuuguauuggguuccacaauuucucagccuuuagucuccucccuuucuuucagucuccuucauugagccuuaguuuaucuuuauaagacacagaugugauugcaccacucacuugcuuauaaaccuuuuauagcuuucacucacuaucuacaggauaaagucuaaacaauuuagugggaucugugaagccauuuacaagcguugauaaaaauaucuaguccuguuccccauuacuuuccucuaugaauaugagccuuuuugggaucuuuucuucaacuccaaacugcauauuauuauuuaggguuucuuuuugugauuuuauuguuucuaugcuuuuauuagugccucuuuuuuaacugacuacaggaaaaucuuauauucuaauacuacuuuaucucuguaugaaaucuuuuuuuucaaucuugugucuuccacagaguguuuugaucauaugacuagucugugcuacuuuucacauuguauuagcauggauguguguaugucugcuuggauugacagugaaccguuugaagauugggauuguaugucauggguuuacucacguguguauuucaucuugguaaauuacguucaaauguuugaauucagucauuuaacugugguucauccacugaaauaacuguauauauuucucaacuaugucuucaugaaaauuagguagugaguuucuuuaagaaacuuaagauuuuuuuguuuaucauauuugcauuaaguuuuauagaaugguuuauguugagagaacuguguaugucucaacugauuuuuauggucccauugagauucccauugagaauauaaugaaacccuagauuaucuuucucucccucaaauuguauuaauacaccagaauacaaaagguauaugccagacauucuacugaaaacuuagacuaguaaguaaagucacaguguguauccuccagcuucugauccuagagaaaccuuucaaauggggcuacguugucauguggucacagggcaaugacuuuuucucauuaaguuuuuuuaaggucuuuguuuuucauuaguucauggaaaaaguagaguuugauagcuuaauggaauagcccuagccaugaguuuacuuuagaguauguuaauagaugccacaaaagaguagauuucauuguuugauuuuaggcuuauagcaauaaaucuuuucuaagucggaugacuuaauacacuaugcuuauguuuccuuuuuauacacaaauauaaugcaccugauuuggucauagccaucuccacuguuuuguuuuguguuuuaacuguguaguguuagagaucauagaugcaggauuagaaaauuggucugugguugugaugaacauuccgagaauuuuuuuuaucccacucaaauaggaugaauugucuuugcaguaacaaaacuggaagugauaauuauuguaguucauauaguacugcuccuguauuugaacuccauuguguuuuaagauaaguugaauuuucagguaguaggauuuauaccaguuuuuagaauuuuuugaggguugauuuaaauauaccacaaauauaucaccuuuuuguuuucuucauccagacaggugauuuggcuucugcacaguuaggaggagcaccaaaccgaugggagguuuugucagccacaccuacaacuauaaaagaugaagcugguaaucuaguccagauuccaagugcugcuacuucaagugggcaguauguucuuccccuucagaauuugcagaaucaacaaauauuuuccguugcaccaggaucagauucaucaaaugguacaguguccaguguucaauaucaagugauaccacagauccagucagcagauggucagcagguucaaauugguuucacaggcucuucagauaauggggguauaaaucaagaaagcagucaaauucagaucauuccuggcucuaaucaaaccuuacuugccucuggaacaccuucugcuaacauccagaaucucauaccacagacuggucaaguccagguucagggaguugcaauuggugguucaucuuuuccuggucaaacccaaguaguugcuaaugugccucuuggucugccaggaaauauuacguuuguaccaaucaauagugucgaucuagauucuuugggacucucgggcaguucucagacaaugacugcaggcauuaaugccgacggacauuugauaaacacaggacaagcuauggauaguucagacaauucagaaaggacuggugagcggguuucuccugauauuaaugaaacuaauacugauacagauuuauuugugccaacauccucuucaucacaguugccuguuacgauagauaguacagguauauuacaacaaaacacaaauagcuugacuacaucuagugggcagguucauucuucagaucuucagggaaauuauauccagucgccuguuucugaagagacacaggcacagaauauucagguuucuacagcacagccuguuguacagcaucuacaacuucaagagucucagcagccaaccagucaagcccaaauugugcaagguauuacaccacagacaauccauggugugcaagccaguggucaaaauauaucacaacaggcuuugcaaaaucuucaguugcagcugaauccuggaaccuuuuuaauucaggcacagacagugaccccuucuggacagguaacuuggcaaacguuucaaguacaagggguccagaacuugcagaauuugcaaauacagaauacugcugcccaacaaauaacuuugacgccuguucaaacccucacacuuggucaaguugcggcagguggagccuucacuucaacuccaguuagucuaagcacuggucaguugccaaaucuacaaacaguuacagugaacucuauagauucugcugguauacagcuacauccaggagagaaugcugacaguccugcaggugagucuuaaguuaugucaugccauaaauaaguucagugauaauacauagagggaaauuuuuugcuuuagguauuuaucagcaucagacucacauuagaauuaaugaucaauguuuguaugaaaauauguuuguaugaaaguagacaucaaaguaucuuccaaauuauucuuugaaaguuuguaguuuuugaaguuagggauucauguuucuauuaugccaauuaacauuuauaguuuuuucuuaauuuuauauuuguuuugacaucugauugauauugucaggcauuauaaaauuuuuauuuggcagguagggugucuugguuggccuuagugugaugugaauuaaaauuuuuaugcauuauauuugguugaggagucagguugguauagugaaaacaugguacagggaguaaauaugccucagccacuugcuaggugugugauuuugaccaaguuauuuuucuuucgcaaacucaguuuccuuguuguguaaaauggagguguuggacuagguaacugucuaggugaccuuccagaccaaaaauucuuugauucugugauagugggcauuaaacuuagcugugcuagaaauaguugucaauaguauggguagacauuucugaagucugcucuuugaauguuguguaagaauuaaauaauaaaguuuaaaaagagauagugucauuuuuacccuauuaauguugucugucuagauaacauuugauugaauguuuuguugugcaguaaauccugaacuuuauuacuuuaauucuguuuuguauuuggauuucuguggagauuguacuacuaacauucuuucaccaggucagugauucuaaacucuuaaauugggacacuuuaacugaacugauugacauaacucccaucaccauuuaaagauuaccuuuuuucuuuugauaaauuugugauacaugcuuagaaaauugaaauggucuuagaaccucagauccguauuuggaaauccuuuaauugcauuuaagccuucugaagcugugauuauuuuuuuuuagggguugggauuaggauuucugaaacugguuuagagcaguaguuguuuuuuuuuuuguuuuguuuuguuuuuugagauggagucucgcucugucacacaggcuggagugcaguggugugaucuugguucacugcaaccucugccuucuggguucaagcaauucucgugccucagccucucgaguaacugggauuagcuccugaauaacugggauuacaggugcacaccaccacauccggcuaauuuuuguauuuuuaguaaagaugagguuuaguaaagauguuggccaggcuggucacaaacuccugaccucaagugaucugccugucuuggccucccaaagugcugggauuacaggugugggccucccaaaguucugggauuacaggugugggucucccaaagugcugggauuacaggcgugagccaccgcucugcuccuggccuagaacaguaguucuuaaaaugugaucuguggaccauuggauaucccugagacccucucagagguccuucacaucaagcugcacuaagaaauuguuugccuuguucucuguguugacacuuucaguggugguggauaaaacugcuugugucuuagcauaaaucaaggcagugacagcaaacuguaauaguuguugcuguauucuucaugaccaugcacuugcaguuaaagaaaaaucccaguuucacucaagaaugaccucgaugaaccaguaagaaaagauauuuacuaaaucuugacccuugagggcugcaugucuuuuaaaaaauaauagcuuuauugggauauaacucacauaccguaaaacucacucuuuauacaauucacugguuguaacuauggucauagaguuguacaaccaucaucacuaucuaauuucagagcauuuuuauuaccucaaaaggaaacccauacccuuuagcagucacucaucauucacuuccccucagacccugacaaccacuaugcuacuuucugucccuucagauuugccaguuauuucguaucaguguaauuguacaauauguggccuuugguguuugguuucuuucauuuagcaugauguuuucaagguucaucugugucaugguaugugucauuaccucauuucuuuauauauggcugaauacuguuccacuguauggauauaccacauuuuauuuaucuacugguggacauuuagguuguuuacacuuuuuggcuauuaugaauauugcugcugugaacauuuguguagguaguauuuuguguggaaauguuuucuuuuggguauguaccugggacuggauugcuggguuauauggcaauuggguuuaaccgguuuuccaaagagaccauaccguuuuacauucucaucagcaauguguugagagucccaauuucucucuagcgccaccaaccuuauuauugcccaucuuucugauuacagccauccuagugggugugaagugguaucuuuuuaugguuuugguuuguaguuccuacugcauaucuuuguaguaguauuuaugaugaaaugggaaguaugccuuaauaaagcauuuuugcugcauaucaaaauaagaauugucuuuaaaaaaccacuuuuuucccucaguuaugcaguucugugaguugcaagcugaacuagaugcuauuuucaucaaauacuguuuuuacuugaaagaaugauaaacuguggucuugagauuaauguacuuaagugacagauauuuccucaaaaaaaaaaaaaaaaugaagugagccugucaugugaaggaaaaaaacuggaaagcauuugcugcugcagaugacaaaauuugugcuuuccagugaaaauuagaauuuuagaaaacucaaaucuauuaugagcuugauaccuucuuaauauuuuucugaugagauggauagugauacuaacaaagcuuuuuugauacuguauuuuaauguaaugugcuaacacuuggaagaucuguaugauaguucagugaaccggcaguuuucagaugaccaacucauuauauuauaaaaucaugcaugaguaaaagauccauucaaagugcgagauagaccaauaacaguauagaaaguuuacagguagugucagauuccacauuuggacugaacuugaagaaacugccaccuguuaaguuugguguaguauucaaagaaaacccacaauuggcugaaaggauauuaaguuauucuugcccuuuccagguagauauccgugaguagauacucuucauaugguucagcccgaaccauauugcaagagauugaaugcaggagcagaucugagacuuuaaaugucuucuuuuauucacucuagacauuacagagauuugugaaaauguaaaacaugguuuucucauuaaacuuuuuuuguuguuuugaaaaauguuuuucauaaaauguuaauuuauguuaacguguaauggauuuauuuuuaaaugaacuaaauuuaaauuucuguuuaugauaugguaaguaucaguauacacauauacuacaugaacagaaguuuuuugugaacgucaguaauguguaaguuuggaaaggaguucugagacuaaaagguuugaguuaagugacagacuacugaagacauaaaagauaguuuuuagaaacuaguuuuuaauguguguacaaaauuaauguuacagcguucuauagguguuagaaaauaaaucuagaaacuuugauuuuuguggauuuauguuggucaugaaaugaaguugguauaaagcaccaaguucuucaguaaaguaauuucuuuucaaauguuaucagaauagaaacacuguguauauugaauacaaaauggaauuuuaguuuauugaauguugcccaggaaggguaaaauaaauacuccagaaagccauuaaauuugaauuuuguccugauuuuaaaggaacggggaaauuauuugagaaaguaaaaguuaaagcaagugagaauaaaaaugcuguauaagacauagcauauuuaguaauaaauucauuuugaggauauaaacuuucucuugguauacuaucuuucuaauuggcaagaagggagauauguuaagaugcuuuuucucacuagaaaaucagagcaaaacauuuuuguuucaguguuacguguaguaugcccagaugaaaaugcugaaaacuuugacauccuugguuugccuuuuuuacuuuuuuuuuuuuuuuuuaagagacagggucucuguuuucuaggcuggagugcaguggcaugauuauaacgcauugugaucucaaacuccuggccugagccuccugaauguguagaacuacaggcuagcgccaccaugcccagcuaaguuuuaaauuuuuuguagagauggcaucuugcuauguugcccaaguuggucuugaacugcuaggcacaagcaguccuuuugccuuggccucccaaaguguuggaauuauaggcaugggccacugugccuagccugcacuuuacuuuugauaagcaugacauuaauguaacaauuucccaaaauaaaggagaaaguacuuuuuuuuuuuuuaaaccagggcucuggaacuugccuuuuuguuuguuuuuguuaaguuuaaaggaccccuuuaacaaaaaugaccucuacucgagccuguauuaagcaguaagucugacuuuguucccuucuuuuuugggguacuuuuacuacuccuuauccuuuagaaggcaaaucuccaucuuccuggaaacaucaggcgccaagcugaaacccuacuaaucuuacauauuucuguccauuuguggcccacugagaaaugcaugcuguuuuaggaaacuucauuguugucucauuuuuacuuuaucguugcuguauauuugaaacuggguaagaggaggcaaagugugaauuuauguaucuuuccaaugucaaaauuucccccaaauuuaagccaagacuuaauucagucucucaaauuuuaguccucugucagauuuuguuuuaucuaaaauacaguuaaucuuucaagacugggcacauuuaaaauggagucagguguuugaaguuggaagaagaguuuauagaagucauuucuucuuaaaagcaaacaacuuaauguuuagaauuccccauuauucaugaaaaacuggauaguugcagguuaacugguagcuaucuuuuuuugagaaaauagaagccuuauaaaaggcaggcuuuuuuaacuuaauauuuaaguauuuaaagauugacaggcgaaagagggauggaucucuuaugggcuccuacucuaucggguacuguuuagguguuuuuagguguauuaucucauauaauucuuucuuacauuaaucuauuuacuauucucacgguuggauaggaaaguaacuggcccaaggcuucacaacuaggcuuuguucuuuucacucuccuauagugucuuggcagugugcucuuuaauuuauaucaguauuguauuuuucuucccuuuuuuugguuauuuuuauuucagauuuuuuuuuuuuccuuuuugaggguaaaauacuagccuugaauaaaguauuuucuacaugguaaguggaggaaaugucuucugaaacauuuuuauuugugauucuaacaaggugaaagauaaauccuuacugauuuuaccuaagggaucacugucagaacugguugauuauagaaaugcacaaauacugcuaaaaggccaacccuauugcuugaaaaguagaguguaugauggaaauguggucuuuuuagaguuacaaaaagaauagacaaaaugugaugacuaugaucugugcugauuuuaaguaauugguagaucuccuuuugccccucuuacacaacauaaaagguuguuguguaagacuuuuacacuguugcuuucuguagacuuuaaaguugucuuaucaaaaauaaccugaggaugguuuauuuagguaucauaccacuuagcuugguuaugucugaguuccuguucauuugugaaucauguauguauugcaugcuauggucuuuaaauuuuagaaauuaagauuuuuauuuuaaugcuuggggaaaaccuauucauauucugauuuuccaacgauuuuuuugguuuauuaauuuugagacuuauaauuauuuauuuucuguacuuaaaguugauuugcuuacaaaaguaauacauggcuugauauggaaaacaaaaacauuauggaaauauuuaauguagaaagugaaauuuucucuuaucucuuaggaauaagacuuagugucauauauuuuaaaauauugucauaauuauacugcauauacacuuuuuacaauauugcuuaauuuuuaguuuuaggaggaugaaaauagaauagucgccccccuuaucagugagggauaguucaaagacccccaguggauccugaaaccucagggaguaccaaacccuauauacacuaugguuuuuacuauaugguaaugaguggguagcauguauaguggauaggcuggacaaaggaaugauucaugucccaggugggauggaaugagacagcaugagauuucuuagugcaaagaauggcauguaauuuaaaacuugcgaagucuuuauuucuggaauuuuuaauuucauguuuucagacugugauugacuauggguaacaaaccauuguggaaagcaaaaccuuggauaaggguauaaggacuuccuauacuugcuaaguauuuaggucaagaauuacauccuauuuaauuagcuauuaauauagauaaaaguacccuacaugcagaaaaacccagaguuagauucauugcugaaaacaagagccuggaguagggcucuuuuuuguuaaaggggagcuacaaaaaguuguugcuguuuguuauccugagguaugacuuaaaugaagauuuacggagaugagacgaugaugcaggaaaauaggaggacaucagcacagucuuacgaccaccacaucugaaccaaucugaaccauugaacuguuagcugaguguuuggauuugugauauagccaguauuacugcuuacaagaguuauauaugaguuuuggggcuugcagaaaugccagacccaaaauuguaauacugagaaagaaagaaaaaaauuguauucaagaugauccugcaaaccuaaauuccaaaauacaugaagacaaaaucugugaaagauagcugauaaaaucaacaauuaggagaugaauucaugucagauuaaagaaaacaaaacauucuguugaagacuuugaaaaucaguaugcuugcaauugucagugagauaaaagaagcaauagcaucuauagaaaagaagugaaacaaaaacaauaaauacggaaaaacaaucaaauccuguacaugagaaacccauuucauugauucuaagacaauuuuuugaaaucggagugcaucuugcuauucaaggcaugucaguguuucucucucuuuuuuuuuaaacugguagugcuuuuucuuagaugaaacauaaaaguuuuucggggagaaaaaagacaaccuuuagaauggauugagcaaauaguaauaugcuuaggaauuuacccagaauaccacacagagauaaugaacgagcaguuaagacauggaggauagauugagaaccaccaguguaggaauuucagaagaaaagaauaaagugaauggcaagagaagcaauguuugaugaaauaauggcuaagaauuuucuuguguugaagaaguacaaucuacagaucaaguuuuauuucaaguauguugauaaguagaaauaaguucaucucugacuugaacuaaaaucacagacauuacagagauguuacauuaacaucuuaaauguuaacagagagaagacagauuacuuacaaggaaugauagcccagcuagguaugguggcucaugccucuaaucccaccaccuuaggaagccaaugcaggaggaucacuugaacccaggaguuaguuugagaccagccagggcaacauaguaagacccuccgucuaccuuaaaaaaaaaaagccaggcguggugguacacaccuguagucgcagcuacuggggaggcuaaguugggaggauugcuugagccuggcagguugaggcuacagugagcugugauugugccacugcacuccacacuggugacagaccgaggcccugucuuaaaaaaaaaaaaaaaaaaaggcagaucuuucuuuuuagccacacagaugucagaagaucguggaguaacauucagagugcugagagaaaauaaccagcagcccagaauucagugggcaauuaaacuacuauucaagauucagaguuuagugaagauauuuaaaauacuauuauucaaagaccuuuauugaacugacuacuguaggauuaaguaggaaaaauggauccugaggaaaugaguuggaaaugaggaaauaacaguaauuacagaaauggauuuaaaaaauugaugauuugaaucccaguguggugguacaugccuuuaguuccagcuacuccggagguugaggugggagaauugcuugaggccaggaguuuaagaccagcuugggcaagauagacccccaucucuuuaaaaaaaaaaaaucaguaauauugguaacuuagaaauauaaaaaauuucaaaaguacacaaaaacaauauauaaugaaccuuccauguaccccuuucccagcuuuagcaauuaugaacacccugcuauucuuguuuccuuuauuucuaccauuuaaaguuuuuuuuuugcuggguuauuuaaucaauuuauuauuauuuuugagaccguaucuugcucugucacccaggcuggagugcaguggugugaucuuggcucagugcacccuccaccuccuggguucaagugauucuccugccucagccucuagaguagcugggauuacaggagccugccaccaugccuggcuaauuuuuguguuuuuuaguagagaugggauuucaccacguuggccaggcuggucuugaacuccugaccucaaaugauccguccacaucagccucguaaagugcugggauuaaggcaugagccaccaggccugacguuugcuggguuauuuuaaagcaaaucugacaucauauaauauuaucccaaaauacuaauggagugguucucagugugugaucugagaccccugggggagguguccccgugauccuuuaaugggagagugaagucaaagcuauuuucauaauauuaagauguuauuuaccucuuucaccucacaaguaguguacaguggaguuuuuauuaaggaaguugaacauaugugcauguucauuggcuauuuguguuuuuuuguuaaauugccuuuuauguuuuuuauuuucccccacuaguauagcauacuucuuguauacuguauacauaaagauguuguaaaugucuuuauaugucugggauauuaaucuuuugucccacacuacaaauaaugucaucauuuuuuugccuucagguuuagucauguugaguugagguauacauaaguucuuacuagacuuuuuuuaguauaacaauuuagaaacuuugagguguaguuuuugaauuuaguuuguauggauuuacaagucuucugauguagugggaacaguauguggaagaaauuggguauuuuaaauuauacuuucuuagacuagaagaucuaaaaugcauugugugaccuuuaaaauaaaguaauuuuaaauauaugguuuuggucacacuuugguuucuuaguauucuauggaaaaauaguguucauaguuccaugagacccauccuuaaggaugauacuuucaucaaccugaaguguauuuaauuuaacauuaguaaauauuauaaccauuuacuuguucugauauagcuaugugauuuaaaccauagaauuuuagagagcucaacuaauucaacuuauuaaaugcaucuugaacaaauggcugcucaguguuuguuuuucguagagacaggguuucaccauguuggccaggcuggucucaaacuccuagcuucaagugauccagcugccuuggccucccaaagugcugggauuacaggcaugaaccaccgucccaccauuggugguuuuuuuugguuuguuuuguuuuuuaguacuuuucucuuuaauuuuuuuggaauaguauauuuaguuuaauaaccaaauuuaccccauaauuuagucagcaacaauaaugcaaauaaggauucuggaugaacauaaaagaauggaaaucaccugaugugugcucuucauuagaguguugauauauuuuucaguaaugccguauuuuauuccaagagaagaacuuuauuacagcuuguucucuaaacugccucaucauuuuagugguucuuggggacaauuuuuguauucaacuuaacaguuuuuuugagacaaggucuagcucugucacccaggcuggagugcaguggugcaguuuuggcucacugcaaucuccagcucccaggcucaagcaauccuccugaguuagcugggacuacaggugugugccaccacaccuggcuaaucuuguguauuuuuucuagagaugggguuuugccauguugcccaggguggccucgaacuccugagcucaagcaguccgcuugccuuggccucccaaaguguugggauuauaggcaugagccaccaugccuggccuucagcuuuauuuuaugaagguacuuaacaugugacguuguuuucauaaaucucauaaauucucugaugaaaauaggaccaucauucucccagcaaccuagguuagucagucauugauucagucaacaaauguuugagguuauagucacaugcugcauaaugauguuucagucagcagcgaaccacauauaugaugguggucccauaagauguaagacuuuuacgauuccuuuucuguuauguuuagauauacagauacauaccaucauguuuacaguugccuauaguacucaguagaguaacuugcuauacagguucuuagccugugaacaauagacuauaccuauagccuagauauguaguagacuauaccacuagguuuguguaagaaagacugugauguuuguacagugaugaaaucgccuaaugauguauuucucagaauguaucccagucauuaagugacaaaugguuguauauuacacuauucuagguaauguucuuugcagcagugaaaaagacuaagucccucuucucaugaaucuuguauucuaguggaugaagacaaauaagcaaauacaauacuuuuaaauaauuaguguuaugaagaaaauaaagcagcgcagggagcagugguucaugccuuuaauuccagcacauuggaauaccgaagugggagguucacuuaagcccaggaguucgagaccagccugggcaacauagugagacccccaucucauaaaaaagaaaauuaaaaaggaaaguaaagcagaguuauggaauaaccauggaguauggugguuauuuuaaauaugaugguuaggaaaucccgccuuaugagaaaaugaaauugaacuacagaucugaacauugauaaaggagccugucacauugacauuuggaggaaagaguauuccaggaagagggaaugagcaagguggcuggaauuucaugaaugaggaguguuagaaaauaagauuggaaucagucaggggccagauaauauacgccaugguagggaaauuggauuuauuucaugucucauaggaaaacauuggcagguuuuaaauagggaacugauauaauuuauguauuuaaaagaucacgccagcaggucccugccucagaguaagcauaaggcugauggagcaauagagucauuccucaguauccauugggcauugguucuaggauacucccuacacccccuagaauaucaaaauccccagaugcucuagucucuuguaguauuugcauauaaccuacacacauccucccacaagcuuuaaaucaucucuuaguuacuuauaauaccuaauauaauguaaaugcuauauauauaguuguacuguauuuuaaauuuuauauuuuuauuuuuguguuuuuaaaaaaacauuuuugauuuacaguuaauuggauccacagauauagaaccuguggagggcugacuguacaagcaaaagaugauaguuuggcuaggcuaguaaugaagaaaaucuagggaaggguggaguaaagugggaauuaagucuguuauggcuuuguuaaaucugaaaugacuauuagaucuacaaguggaugguuccaguaaacaguggaauaucagaaucuaguggucagguugggcuggagguagaauuuagggugucauuaguguauacagauaugacucgaugaaauauucaggucauaguuucuuuuccagucacccagacuggagugcaguggcaugaucuuggcugacuguaacuuccaccuccuggguucaagcguuucuccugccucagccucccaaguagcugggauuacaggcaugcgccaccacgcucggcuaauuuuuguauuuuucauagagaugggguuucaccaugcuggccaggcuggucuugaacuucugaccucaagugauccaccugccucggccucccaaagugcugggauuacaggcuuacaggccuugugagccacugcucccggccccaacuuuugacugcauuguaggaucucacagagaacuuucuagaagugccaacaacuuguguucauccuccucccaauucuaguuuaauugcucugcaugaaaccaggaaaguuguguuguaaaaaucccaaagugauuuugaagugcagcugguuuaagaauuucuaacuuaguagagaaagaauauacauagagaagaacuugggaaaucauauucugagccucaaguuacuauucuagacuuuuuaaaugcagggucuggcacagaaucaaauguaacccaccaggcauaugagaagguaagauaccgugaaugagaaccagcagaaacaauggaaauagacuaaaaacuacuuacuguggucuagggaauacaagccaagcuugaaaaaauuuuaacagaguuggagacuguaacagaaaugacacugcagauuuguaaaauaaccaaauagaaauucaggaacugaaacuuaaguauccaaaauugagggaaagccuuaggaaugaguccuagggcauucccaacauauagagggugagaaguagaggaagagcuagcaaaggaaacagaaggagcuuccaugaaagccaaguauauucuggaagccaaguguguaaauuacuuaagaaaggaggagggaaugcuuaucccuuucuuuucuuuuuuuuaggcagggucucaacuaucacccaggcuggagugcaguggcaugaucacuggccuggaccuuccgggcucaggugaccuuaccaccacagcuucccaaguagcugggacugcacaugugugcugccaugucuggcuaauuuuuuguaauuuuuagaagagaugggguuuugccacguugaccaggcuggucucgaacuccuggucucacguuauccaccugccuuagccucccaaagugcugggauuacaggcaugagccaccaugccuagcauuaucuauucauauauuguggaggguacauaagaugagagagaacgggauauuggauuuaguaagauaaugauuguuggugacuuuuaacaagugguuucauuaagagugcuggggaggaaagcaugaguagaaugauuuaaaaggugaagaggauuuagugagaguaauuacagacuuuuuuuuuuuuuuuuuuuuuacucguguugugagcaacauugaaauaggugguagcuggagguggaccugguugaggagguugguuuucuaagaaucucgccacaaauuaaugauagaggagagaaaguaugaaagaggaugagagagggauguuuuaagaaaacaagcaaggugaaacacaggacacagguuuaaggguuggacacaggaguaggggucauuauaacagggaaagggcauuggauagacauucagagauacagauauguugauuggaagauaagauaauucuugucagauuauuccuuauuuccuuuugugauaagaaacaagcuaagaugggugagagggccagguguuaggaaguuugagaaggaagaagguaugaaguggucaucugagaauuggaaagugaaaugugagauguagaauugcagcaguacugggugccugcuugaauaauuagcacaguuguguuuuuucuccagcuaccuuuagcugcugggcacacaugcaaacuucaaucuucuguuuccugguggaaaguuccaaguccuuuuuguucuguuucugccauauuuuuguuaucuguucauccucuccauucucaguuuguuaguuuggcucuuacuggucuccuagaccaggggucuugcacccccgggugccaaggccacagugcaaaaaguaagcagugggcgauaagcaugacuggcugagcuccgccuccugucacaucaacagcagcauuagauucucauaggagcccgaacccuauugugaauugcacaugcgagggaucuagguugcaagcuccuuaugaaaaaucuaauaccuaaugaucugagugaguggaacaguuucacccugaaaccaucucccuugucagcaguaaaauugucuuccaugaaacuggucccuggugccaaaaagguuggggaccgcuguccuagacuacuauuaagacaucuaaucuaggcugagugugguggcauaaucccagcacuuugggaggcugaggcugggagaauugcuugaagccaggaaguugaaaccagucugggcaaccaagcaagaccuugccucuaccaaaaaacaaaaaaaaauuagcuggucacaguaaugugugcccauaguccugucugcucagagaggcggagaugggaggauugauugaacccaggaggucaagccuacagugaguuaugauugagucauugcacuccagccugggugacucucucuuaaaaaacaacuuccauuuuccaugcccccuccuuucuggugcauuaacaaaaauuuauuuuuaaaaaaaauuuuuacauuuuuaaucuuuuuaauuccucccccaaaaucaguguaacuuuuuuuuuuuuuuuuuugaguuggagucuugcucuguugcucaggcuggagugcaguggcgcaaucuuggcucacuacaacuuccgccucucuggcucaagugaucuuccugccucagccuccugaguagcugggacuacaggcccaugccaccacaccuggcuaauuuuuuguauuuuuaguagagacaguguuucaccauguuggccaggcuguuaucaaacuccugaccucaggugaucuaccugccucggccucccaaagugcugggauuacaggcaugagccaccgugccuggccagaugucacaaaaauuuuuaaucuuauuucaaaaaugcugcaguagauauccuuauacagaugugucauuucuuuuguuaaaguaugcauaucugaagcauauacaucugaaagcacaaucccaagguuggagaauaugugcauuuuaaauuuuguaagauacuagaaacuguuccaauacaucauuuugguaucagucauuuucccuaaacacagaucauguugcuuucuguaaagucuuuacuggcucuuccauuaccuuuaaauugaggucuguugagucuacagauaacuuacagcgcucuugcugugcaugccagauacuggaauuacaaagaugaauaugauaauucuugcacuaaaggugcucauaaucuaacaaguuagacuaugauuucucaaccucugcacuguugauauuuugggccugaugauucuuuguuuuggggcuguccucugcauuguaggauguugaggagcauuccugacuuacccacuagaugcugguagcacucuguaccccaggcaguugugauaauaaaaaaaauggcuucacacauugccagauguccccuggaggacaguucuucaucucccccuuaagaaucauuggguuagacagacaugcacaugauucuaguauaaugugauaaaugguauauuaacauugaaccccacagcacuuuagaaacaggaauaguggaguaaccuucagguugacaucuuucaagacuuagcccagauacugccuuaucccgcagccuucccuucuucuugccaccuuugaauuaccgcuuguuuaauagcacuuguccuuugucuuguauuauagcuaacauguauuucuuguuuugggauugggcagucauugcuuacucaucuuuuuuuuuucugcauucuuuuuuuugauggauaaaaugaagagaugccaauaauagauacagaauaaacguagauuuguguggaaauguguaauguaaauuuuaccuguuugguugcuuuuuuuuuuuuuuuuuuuuuuugaggcaaaguuucgcucuuguugcccagacgggagcacaauggcacuaucucggcucacugcaaccucugccucuuagguucaagugauucuccugccucagccucucccgaguagcugggauuacaggcgcccaccaccacgcccggcuaauuuuuguauauuuagcagagacaggguuucaccauguugacuaggcuggucuugaacuucugaccucaggugauccacccuccuuggccucccaaagugcugggauuauaacuuuguucagaugugauaguugcauucuguguuucauaccucuaccaauucuguaauuguguuaaauuuguagcuuuuuaaaaacucuugacauuaagaauuauguuucagaagccaacauauaaaccugugggggaagaaacuaagagaagcaagaggaacguuagguuuagucuuacgugcauaugagagaauuuaggagaauuaaaugacuugcccuaaagucauuuuuuaacacuguagauuuaguguauuuuuauucuaagaauaacaugaugagagauuuuuuguaaguucuuuaucuuugagcaguacauaaugaaauauuugcagaugaaauguuauaucucggauuuguuucaaaaugagguaguuuggguuauacaugaaauagaauugucccagaguuuguggaauuuggguguuggguacaugggaguuuguuaugcuuuccuacuuugguauauauuggagauuuucuagaguaaaaagguuuugagaaugugaguuuuagccucauguuuuuaaugaguagaaaauuuggauuaaaaaauauuuuaaaacuucuuuuuaaacauuuuuuucucggacuuuagugagcaucagaauuauuuaaaaauuuuuuuucaagaaauuuaacauaaaguaagauuggacuuuaauuuugguuccaacaucuccugugauguuugaguuaguaagcuuuguucauaguaacagcuugggcaggguuuguauacuuacuugauucacaaguggaagaggauuuuaugguucuguugugaaagccuugaagaugaaguuuugacuguuuaggcuauuucccugcauuaucucuuguguuaaugaagaagguaguugauaaauuucaggggauaaccagucacacuaaacugcaguggaaguguucuugguuuuucuugcauaugaaggggaaagucagauaaauuuuuaauaaaugucuuugcugcuuucauuuggcagccuuguuugggcacaggguuaauaaaggcucaagaacuugagagagcgggugaacaaguuucuuacugugaaaauguaaauagucaacugugugcuuuuuuuguauugucuguagaaguauguauguguucauuuucucaagaagcuuacagauuuauuggaguauuuaagauagauacauggaguaguaaucaacaauauaaaucagugugugaucugcaauauaaaucaauauaguaagucacuaaauugcaugauacagauaacuguguagaaguucagaggaacagaaaaucaaaaaaggcuccaggagaccuaauagagaagagagaaguuuaauggggaaucuagauuuguauagguagagagaugagaggaagauguuuacuaacaagguuuaaaaaaaaaaaagguaagaauagaggcaaggcaaaguguuucuccaaaaaugguucguaagauauuaauagguauuauuaaauguuauaaaaaugcuuauuagcauguuaaaguuucugagaaauccugugggaaauaaaccuauuuaaggaaaggaagcagcauuuuuuucuuuuuuagauuauacaucuguauugauuaguauuucauuggguuacuugugaggaacuacuuugggaaaugcuguuauagcaugaauagaaaucugggcaguuuggugacugguggcugauaggacacauuugaauaaguauggugagagaaugaaaagcacugaauacuauuggugaggguugcacuauuuuuaaccuuacuuaaggagccuuugaaaguuuuugaacagaggaauaacgugaauaaaucaaugcuuggaagacauaaccuucagaacagaguggaaugggaagaaacuagcacuaaagaagguaggagcggggccaggcauggugguucacaccuguaaucccagcacuuuaggaggccaaggcagguggaucaccugaggucaagagcagccugaccaauauggugaaacccugucucuacuaaaaauagaaaaaaauuagccaggugugguggcgugugcuuguaguccgagcaacucaggaggcugagacagaauugcuugaacccaggaggcauagguugcagugagcugacauugugccacugcucuccagccugggugacagagcgggacuccguuucaaaagaaaaccaaaaaaacaaaaaagguaaaaggggcuacuuuauuuaaacagggagaaaguaaggaaggaaggaagaaugccagacauuucaaaguaugaauuuuauaggauuggugauuagcuaucaggaauacaagagaugaauccguuggugauuagcuaucaggaauacaagagaugaauccguuguuuuaaaguuauaucauuggcacguuugugaggggaaaacugaucuggggacuccaagaugacacuaguuggaauggauugaauuugugguugaaauaauuguugcuaguagagauggagggcugagccuaggacaaaggaauggaauucuguaggagaugguugauagacacaguugaagucaggagaguugauaaaacugagcaggggaauuauaaaaaggaagauguuuugggaaauuuuggggaugguggaguguggaccauaaaacgugcaggaaguguguacauuuucuaccauuucugagauacucuuuuaggauaauaaaguuuuaguggguaauauauuucuuugggugacaggaaaacaggauuucucuuuccccugacauuuggcauuguaaaguuuaguuugcacucagauaguuugguuuugauuguuuuguugguuggguuuugguuuugucuuacuauuuuccaucaggaaagcaucuacauggauugucugucaguucuagauaguucuagcagaggugauaaccucugcuuuauuuaaaaguuagcuucuuuuaaccuggacugaucauuaauaaguuagaacacccagcuuuaugauuuuuggaaacagggucucacugucucacccaggcuggaguacaguggcauaaucauagcuuacugcagccccgaaccuccugggcucagucaguucucccgccucggccuccaauuacaggcaugagucacugcaccuggccuagaacaucgacuuuaaaacagguuuuggaagaaagaauuaauugcugguaucugauaccagucgacauaucaguacacuuauucccuaagcaaaauuugcugcuauauuuacauaagaccuucuuugugaugcuuuuuuauuuucuaccacuuaaaguauuuaauucccauuacuucauguaauucagccauucauuaccuuggauccucuuauaugccaaaauucuuucuugaauguuuaagugaagauggaauagaauguauuuauuuuuagaagaaaggaguuucagccuuagaacuguaaaagcaaagcuuuugaccuugaagguaauaccuuauauuuguugauaaauaaguagagugcugauuuaauuuuuuuuuuuacuuuuuauguuuuauagugauggggucuugcuguguugcucaggcuggucuugaaccccuggccuuggguaauccuccugucucccuccugaagugccggaguuacaggccuggcaauugacuuuuuuguuacaguguuaauaaauggcagaaaguuaacuuuaaaggguguaaggaaaucuuuuugaaaauuggugaaaauaucuuuaguuuugauuaacauuaugucauuuauuuccugcuuucucccuacuuuuuauaaauaaauugguuuuuucacuccuguuuaauuuucuuucagccuauacuuguuucaacagcaguaaccacucaaaaagacuugguaagaaaguuuuaaagaggauuuaaaguacuugauggccaaaaugaauuuaaaaaaugguauuugaugucuguuuccauuuuugcuuuuuuucccauucuaaucaauuaaguguuugcucuuuuuuuuuuuuagagacaaguucucucucacucagacuggauuacagggguaugauuauagcucacugcagccucaaacuccugggcucaugugauccuacuguguuagccaccugaguaggugggacuacaggugccccgcacugugccuugcuaauuuuuuuauguuuuaauuuuuuguaaugauggggucucacuauguugccuaggcuggucuugaacaccugggcucaagcuauccucccaccucugccuccaaguaacugggacuacagauguacaccaccacauccaacucuuauuuccgcuuuucauuugcuuuuauuaaaucuucaggaauuucguugaagggcaaaugauguuccaugguaaagaaauuuuauuugucuuagauuuacuguuuuaucuaguuaauggaaguaguuuauucaaguaguauagcucuaccacuuuaucauuucauuugcuuuuugaagcaggguuauaucagagcaaaaggaaaauaaagguagaauuuauugaaaacgguuugaaaguuuuaaauugugauuuuauaaauguuacuuuauaacuuuuauauauauauauauauauauauauauauauauaaaguuuuauaaauguuagucauuuguacugucuuccuaauauuucugguucucuucaugggcacaccgaaguuggguguagccauggagcuugcuuuggccaaugaaauacgucauggugauugauccauuaacauugauucauaagucaggaaagcagcaucagcugacuuaugauggaugugaauaaaaaauagaccuuuguuuuaagccacugugauuugagggguuguuacugcaacuuaauuuugcccugcucuguuauauaggggagccauuagcccugugaugcuauuaagcacucgaaauguggcuagacugaauugagaugugcuguaaguguaauaaaauacaaauugaauuuucaaguuuuaguauaaaaaauagaauguaaaacauuucaugaauaauuuguauuauugauaaaagauugaaauuuaauucuuuggauauauaggcaugcuuuaucuuauugugcuucacagauacuacuuaaaaaaaaaugaagaauguggcaaccucgcauuugagcaagucuguugaccccauuuuuccaucagaacgugaucacuuugugucccugugucacauuuuggcaauucuuggaauauuucaaaccuuuucauuauuauuuuuuauuuuuguuuuugagacagucucguacugucgcccaggccuggagugcaguggugcuauauuggcucacugcaagcucugccucugggauucaggccauucuccugccucagccucccgaguagcugggacuacaggaccccaccgccaagccuggcuaauguuuuguauuuuuaguagagacgggguuucaccgugucagccaggauggucucaaucuccugaccucgugauccaccugccuuggccucccaaagugcugggauuacaggcgugagccacugcgcccgaccuucauuauuauuauacuucuuaacagugauccguaaucaguggucuuugauguuacuguuguaauugucuuggggcacaacagaccaugcacccauagaaggugaacuuaauugauauaaagguuguauguucugacuguugcaacgaccagccguuuccucaucuuucuccucgggccucccuccucccugagacacaacaauauugaaacuaggccaguuccaggcacgguggcucacuccuguaaucccagcacuuugggaggccgagaugggcggaucaguugaggucagggguucaagugcagccuggccaacauggugaaacccaucucuacagaaaauacaaaaauuagccgggcgugauggcaggcgccuguaaucccagccacuugggaggcugaggcagaacaauugcuugaacccaggaggcagauguugcagugagcugagaucacgccauuguacuccagccugggcaaaagagcaaaacucugucucaagaaaaagaaaaaacuaggcaaauugauaauaacccuacaguagccucuaaguguucaagugaaaggaagaauugcacauaucucacuuuaagucaaaagcuuagaaauaauuaagcuuagugaggaaagcauauugaaagcccagauagaccagaagcugggccucuugugccacacagccacguugugaaugcaaaggaaaaguucuugaaggaaauuaaaaguccuaguccagugaacacgugauaagaaagcaaaacagucucauugcugauauggagaaaauuuuaguggucuggccagauauaccagccacaacauuccuuuaaaccaaagccuaauccagagcaaggccccuaacucuucaauucugugaaugcugauagaggugaggaagcugcagaaagaguuggaaguuagcagaauacugguccaugagguuuaaggaaagaaacuguuuccauaacauaaagacaaggcugcaagugcugauguagaagcugcaagaaguuauccggaagcuaagaucauugaugaaaauggccacacuaaacaacagauuuuccggcugggcgugguggcucacaccuguaaccccagcacuuugggaggccgaggugggaggaucacguggucaggaguugaagaccagccuggccaauauggugaaaccccaucucuacugaaaauacaaaaauuagccgggcaugauggcgcacaccuguaguccuagcuacucgggaggcugaggcagaagaaucgcuugaacccgggagguggagguugcagugagccgagauugcaccacugcacuccagccugggaaacagagcgagacuccaucucaaaaacaacaacaacaaaaaugccaggcuggucucgaacuccugaccucaagugaucugcucgccuuggcaucccaaagugcuggaauuacagaugugaaccaccgcgccuagccagcaaccaccaucuugaucagucagcagcaauugacuuugaggcaagacccuccaccagcaaaaagauuacgauuuacugaaggcucagaugauuguuagcauuuuuuagcuguaaaguuuuuuuaaauuaauguacuuuuuguuuuuuuagacauaaugcuguugcacacuuaauagacugcaguauaguauaaacauauguacugggaaaccaaaaaaauguguggcuugguuaauugcaauauuagcuuuauuguacuugucuggaaucaaauuuguaguguuucugagguaugucuauauuagguuaaaugaaauauauuaaaguuaauuuuaccuuugaguuuuacuuuuuuaauguggcuguuagaaaauuugaaguuaacguacguggcuugcauuguauuucuauuagacagcaccuauauuauuacagccuaucaucacuuaagucaaaauuuauacaaggaauaguaugcucuaacaaaaaacuucaacuguggcauuggccugaggaucaggcagcaaggaaacugauguuagaugcuagaaacaugacgaugcagagaacaauauuauuauauaaaacuuaacgugcaguaacuuggaaggcaaguaauauauuuaaugcauuugaagcuuuugggacaagguuggaaaacaaauuguauuuuaacugguacugguuucauuugacaagguguuauaagaaagagaugagcuagaaaauaauugguuaguuugcaaguaugaaugaaaagcaauacagaguccagaaauuugggaauuuguaggauuagaagaagcaauuacugcugcaccuuuuuuuuucuuuuuaauuaaauuagaggcagucucccuguguuacccaggcuagucucaaauuccugggcucaagcaauccucccaccuuggccucccaaaguacugggaugagcgacugugccugaccaguaguugcuucuuaccuccaaucaguaggagacacaacugaaaaggcuuuugaguagauaauuaaaauucauccuuuugguaggauccagucaggguuaugaccaucacuuccauuguuaaaaugucugaaaggauuaagguaauucagaguaaaggccaacuugagagggaauugcuuuucaguuggguuagggaaaagagacuaaagguauggaaccccugcuaaagccagguaaacucaagguacccauaguuagagagaaauagacacacugucucauggggcaagaaagcaaagaaaaguaguaaaucuaagaggcauaucuuagaaaaaagcuuugguucuggacauuggcgcuuggaauuggauagaaucaaauagauaagccuucuaauuuuuucagggagaggcauagacaaaagucugaauaaaguauaacugcuugauacauaaugaucuugcucucugccccauaccucccugaccuaucugccugcugagaauucugcucugcuaaggagucacacucucugaugcucacuucacuuguagcguuagaagauaacagaccaggaaaaaccuuccagaaggcagaaccuagaggcacagagaacagcagacuuagaaacuccucccaagggucagucagagcauuccccaccuuccaggacagagagcccuugcacaaucuguucagccuggcuuaugaauugcuaugaacuacugacuguugucuucuuuucuucuuuugaacuggagcauuuuuuauauucugucaguguguauugugugugugaagggaaguagauaacuuguuuuaauaaauaggucucugugaagaggggcugcaucuggacuugauauagaggugauuuccccaucagcgcagauccuguccuuugaucuugaugcugagacuggaugggauauuuggguuaccuucugaauggagggacagguguauuuuuucaugugggaagaauaaauauuugacagcaggggacuagggagucaugauucuucauaaaauaaucauugaauugcccuuuccuuuaauucuuaaugucgggcauggccacgugccuuuuuguaaccaguaaaaugugaguggaaguuaaagaacagaaugugauuugccacguuuucuuucaccuuuggcaaggcaaccuuggaagcauguaucaaguggagccuggaagcauguaucaaggggagccuggacuccugaggcacugucaugaucacaucucccuuaccaaccugaauuggacauuugaaauuagugaaaaauaaauuuuuguuguaucaaagccauugagcuuuugugauugauguuacuguagcacagcuucacugauucugauuaauguguuagauuauaauuuuggucaacaaauguucgcucaauauaguuguucaauaaauguuugaaucaaauauguaaaaauuggagggcaaaagaaaaauguauaaauucuaaaacugccaagauccaggucuuuggcuuuuauucuuugugaaagccaaccacauggugacuaaggguccucuaauuauauagguaauacggcagagaugauuuagguagcagacacgggaaaauagaaaacaaugaagcuuguaaauaacuagggguucaaagcaauacauaggugucguuuaguggaucauuuaaagcauuuuuucuucuauuuauauugauaccaacucaggauuguuuacagucugcagaaaguguuggaacggaaucauuuuauuuacaggcaguucugcuuuuuuuuuuuuuuaaugaaggaagaaaaccccaaaccauguguuuuuguuguuguugguugguuguuuucccccuagccauugcagcaguggcagaaacaucaguuuuaguccagugcuagagcagagccuuuuccucaaaugacaucuuaggcagaacuccaguguauaaaacuaauauuaauggggcugcucugacuuacaugagggccuggggcccucuucucugcugacacuuaacaguuugaaauuuccuguacugaagcagauauaccugccguggccaucuucauuuugaaggguuugaguuucuuaagaguagccuuagauccuuucuuuaguccuaauuuauuuaauguuuauauacaguuuuaacaauuccgacugcuuuccaaauuuaaaacuggcuuagaaaauguacaguagaagggaugauggguacgguaaccugggagguggaggauggagaguugauaucaccagaguugggaagaaggcaggaaaaacaaguagaagaaauaaaaaacuauaauuaugaauguuuuuaguucaguguucuagggccuauuugauaccauaaauuacuuuuaauaaugaauuggaauaauuagacaaagauuaaauaacguucugagcuuccugccaaggaaaguagguaaauguguaauugauucuggagaaauuuuuguucaagauaucauaacuaucuuaaauaacugaugcccugaagguuuugaauuuuagaaguuuuugauguauuuuuaaagcgauacacaaauaauugaaaguugaaauaguaaauaauacuguuuuccaaaguuuaauuaaaauacuuuauaaagcuuaaaaggaucucaaguuacuuaaauuugagaaaaugaguuuauauugugauauaugccauuaccauugcauuucaacaaguuauaagaaugauauaggucgggugggguggcucauuccuguaaucccagcacuuugggagaccgaggccggcagaucaccugaggucaggaguucgagaccagccuggccaacauggugaaacccagucucuacuaaaaaauacaaaaauuagccgggcgugguggcggacacuuguagucccagcuacucgggaggcugagauaggagaauugcuugaacccugggaaguggaaguugcagugagcggagaucacaccacuguaccccacccugggcgacagagugagaacccugucuuaaaaaaaaaaaaaaaagauauauaguugauaugguuuggaagucccacccaaaucucauguucaauuguaauccccaaugugggaggaaggacuugauggaaggugauuugaucaugggggugguuucccauggcuuaccaccauccuccuugguguugucuuggugauagugaguucuugugagaucuaguuaaguguguguggcaccucuugccacccucuugcugcccuggucaugugacuugccagcucuccuuuugccuucugccaugauuguaaguuuccugaggccuccccagaagcagagcagaugccagaaucaugcuuccuauacagccugcagaaccaugagccaauuaaaccuuuuaaaaaaauaaauuacuuagucucagguaucucuucauagcagugggagaacggacuaauacaauacuaucuaaaaagcauaaccaaaucuguucugucauggcuauuuuuuuuagaauauuuuaagaaacgacuucaagccauucaauuuaaguuuuauugcaauaugcaauuggaaugacuuaguuaauagaauuaauguggaagccauuuuuacauucuuaaaauuuuuuuuaauuacuuaaaaauaauuuuaaaauuaucugggcauuguggcccaauuuauuuuugguagagacuggucuugcuguguugcccaggccagucucaaacaccuggacucaagugacccucccuccuuggccucccaaagugcugggauuacaggcgugagccaccgugcccagccucuggugcguucuacaggaugcuuggcacuuguccuguugaaagacagggcuuuucuggggaccaccugccucauuuuuguauucuuggugaguagcauaaauacauacauagaaccuggaagaaaauauauauaucuauuugguagaaggcaugaaaaccgagaauaagauuauaauagguacaucuauuaaauaccaagagaugagguuaaaaaauaauauauauuauugcuauuuuguauguuuccuucauuggucuuacuaaagaaggaggcuugaaaaacaguguauuuuguccucaaguaguuagacuaaguuagacuagacauugugauacaauguuuagauuaggugauugggaggugggaaaggagguaaacuacauuaagauccaauuucuguuguagucauaguuuguuuugaaucaagagcaguuugaauacuuaaccuuauucauaauaggcagcuucagaucuuuaguugucccuaaaaauucagucuaccuuuaagaugagcauuuaguacauuuuaguacauuugauuugagaguugugaguuacagcugcuuauagcagaucacuuuccugcuguuuauuggauagcaguuaggaauuacugagaacuuuaucuuuuuguguguguacuauuuuaaccugguagaacagcuuuuaaaaaaaccuuuauaguaaauuuaaaguagucuuuuuuuuaaucugaaggggaggggaaaacuagucccuaaagcuuauggggacaaggcagagccuuaggaaagaguauuguguguuacaauaacuuguaauauugcuguguauccuucauaguuucucugaccuucuuaccugugacauugaggauuuuauccauuagguuccuaaaauaaguccucuaugggagugggacaacagggaagauuugccagauuuuuaaaaaaauuguaaaaaacacauaacauuaaauuuaccaucuuaacaauuuuuaaguguacaguucaguaauguuaaguguauucacauuguuguguaacacaucucuagaauuuuucaucuugcaaaauugaaacucuaccuuuuaaauaccaacuucccuuuucaucucucccccauuuggcaacuaccuuuuuucuugcuguuuguaugauuuugacuacuuuaaguacuucauauucauggaaucauagcugucuugugacucauuuauuucacuuaacauaauguccuugagguucauccguguuguagcgugugacaggauuucacaugcuacauacacauacuauauacauacaauagaauauuucacauauaauagcauauguggcugagcgugguggcucacgccuguaaucccagcacuuugggugggcggaucaugccaaggugggcggaucaccugaggucaggaguuugagaccagccugaccaacauggcgaaacucggucucuacuaaaaauacagaaauuagccgggugugguguugcaugccuguaaucccagcuacucagguggcugaggcaggagaauaguuugaaccugggagguggagguugcagugagcugagaucacgccacugcacuccagccugggcgaugugacacucugucucaaacaaagaaaaaauagucuauguauguacuaaaguuucuuuaucuuuccuagauuuuuaaacucacuuugauuugauuuaauuaaacuaaaacuaauuaaaauugcauauauuuauauacagggaagcuaacuuaaagcugcuguuccuaugaaugaacuggccugguagggaguugaucuuuagcaauaucugcaauaugguuuugcacaguuuucaucuuacauccuggcuccauccauuuucaacugugugacuucaggcaaacuacauaaccucuuuguuuucucaucuagaaaggagggggaaaauaauauuaaacucagcguaguugggagcaugacaugaguuaauauauguaaacacuuagaauagugcucuacaaguaguaaauccuuaucuuauguguuuagccaucauauucaucauuggagagaguaggaguccccuuaacaggggcuuaacuaguacuucagauuuaauaaggugaagugaauaucucgcuagucaguuuacuaauuacaggucacaucaucuuuuucucacauauuugugguaagacuauaaaaugagaucuucuguaauacauauuagaaaaucagucauuucugguuauguucauauguauguguauauaaaauaauuuggaaaacugcuauaaaaaugaaagguuaauaaaagauuaauuucaaaugggaggaaaggagcaguuuauagaagaguaaugauccaaaucuaaggagauggcauuugggggaagagauugcuugauguuaaagcagagauggugauuaaccauccaucuauauuuuuaaaauuauuauuauauuugguaaggggauaacauuuaguuuuaaaaaccuaaccccuaaaguguuaacuucuuuuagcauuagugaaguuauauuuuuaggaacucauaucuauaauuuagaacuauccccuuagaagaaaaguugaaaaaaaacuugguaccucugaaauauccauaggaaucugaggaauaaugaaacuuuauaauacaugagauauuguaggauuauccggugguucuguuagaugauuuuuauggcaggugaagcugauuaaagggaaaauguaaauaaaauaaacuuuuagaaucaaaugaaguaauuugauucuaaaucaaauuugauuuagaaucaaauuacuucagugcuuaaaaaaguugaaggcagagaauaugaaagacuuugauaagaacaacaaaaucuuaauggcacacuauugauaaaagauaaugucucauuuuaucaaccauacuguaauucauauuuaucuaauguuagcuauuuaaauuaaguaugcguguuccagacuugauaaguugguuaagaauuuaucuuaaauguucuguuagcucuauugauaaauaauuagcaguuaauuuuaggaagagguauuuaggauuuucuuguaauauuuuuaauagaaaucuaggcaugcccugaguuauugauacuuaacuaauacugaaaauuagccuuaucuuuguaaccauauuguguguguggguguguguguauauuucauuauuuaaauuuucuguuuuuuucucuucaauucuugcccagguaugcagaauuuuuuuuucuuuuguacauaccccuuucgcaagcuuguuuuauugguaggccuugaaaacagccauaaucacaggacagagauacugucagugcaauaacucaucaaaugaaaaggaaacuuaaacauuuugagguggagaauagacauaaaaaaacagugcuguuuauaaaguucuuaaaugugucauacacauuuccuugaauuucuguuuucauugcuuaaauuuuuugcauacuuuuccucaaauauuaaucaaauuuaagucagcacauucauuucuuuauacugcuagcaugcacuauugcuacagaauauaaaggcugauuuacaaauacuucagguacccuuaugugucaaaucuacccuugugggcuaaccuaggaacuguacugccaauuuuauaaugcuugcuuuuauagcaaaacccuuggaaagaguuaaccuguacuuguuuacaauucaucuccuuccacucucuggagucuauacuaggcaggguuuugugcucacaguucuugucaagaucaccagugauuaccacaauguuauauccaaggaucauuucuuagucuuuauuuuacuugacuuuuuaaguauuugacacaguuaaguucuucccgaaaugauuucuucaguuugguuucuggacaccaguuuccucauaucucacuggcacucucaguccccuaugcugguucuuuuuagucucugcuuguuaauuuuggagugcugcaggguuuccuccugucuacauuauauuccagaugacucucaaugccuaauguauaugcugauauuggcaggccagauuucuaccugaacuccaaacccauugacugucugaugaacaccuucaucuggauauucaauaggcauucagaacuuucauauuucaaaauaggccccugacuggcaccccuccccugcaaucuuuucuaccuucaguuuaccauaucucaguuaauggcaacuccaucuuucuaguugcucaggauuuaaaaaaaaaaaaaccuugggaguguuuuuaacuucuuucuguucuugcuccucacaugauaaccuguuaucaaucuguuagcagaugucuuugacucuacuuuaaacauauuuucugacugaacaauucuaccccuccuccucaauaccuuagcuucaggccacuaucaucucuuuuuaagacugugucaggccauuccuguauuacuauauagaaauaucugggacuggguaauuuguaagagguuuaauugacucaguucugcaggcuguaccggaagcauagugcuggcaucugggucugggaaggccucaagaagcuuuuacucauggcagaaggcaaauggggaaugggcacgucacaugguagaaguagagggaggugagagacagagaaagaguaggagggaaggugccacacacuuaaaccagaucucuuaacuauugcaaggacagugccaagacaguggugcuaaaccauuuaugagaaauccgcccccaugauccaaucaccuccuaccaggcuccaccuccaccuuuggggauugcauuucaacauaagauuuggauggggacaaauaucuaaacugugucagggucuuucuuuguugcccaggcuggagggcagugaugugaucauggcucacugcaaccugaaccuccugggcucaagugauucucccacuucagucuccugaguagcugggaccacaaggcaugugccaccaugccugccuggccuguuuguuuguuuguuuguuuguuuguuuguuuuuggauagugacgggaccgcucucucuuggcucaggcuggucuugaacuccuagguucaaucguuucucccgcuucggucucccaaagugcugauauuacaggcaugagccacccugcccagucagcaugaacuuuuaacuugcuaacugccuuauccuuagaacuuagaacagugacuggcacaucguagccauacauauaguuguugagugaauaaaaucauauucuaaauuucauauuaugaauuuaauuugugggacacacucauuuuauuauuuguauaaaaaugggggaagguuuagucaacuaugugggaacuagagguaaagcaaaaaaauugucuuuaacaguuccuaaguaaucaccuauaaauuacguuaaaauauuuaauuuauaauaaucuuuauauugaaguacaauaugcauucagaaaauguagagaucaaauguauauaacuugaugaaauuuuacaaaaugaacacauaggaaaacuaccacccagaucaagaaauaggauauuaccagcaacccugaaaucucccuguacucagucauauaugucccucaaaaguaggcagucaccacucuucuauccccauggagcaccuacucccuucacauuuaaauaauuauuuuuaaacugggcucaguggcucaugccuguaaucccagcacuuugggaggcugagguggguggaucacuugaggucaggaguucgagaccagccuggccaacauggugaaacccugucucuacuaaaaauacaaaaacuagcugggcaugguggcgggcaccuguaaucccagcuacucgggaggcugaggcaggagaaucacuugaauccgggaggcagagguugcagugagccgaggucacgccaccacagagcaagacucugcuuaaaaauaaauaaauaaauaaauaaauaaauuuuuaaagagcaguugagaugcuuaguaaaaaugaaaggaaguauagagauauaccuuaccccccgccccugcacaugcauacccuucccuaugucaacaucacccaucauucagagugguucauuuguuaacaguugaugaauuugcuugauguauuaucacccaaaguccauacucuacauuaggguucccucuucguguuuauacauucuguaaguuugaacaaauguaugccaugcauccaccuauauuacaucauacauaguauuuucaguacucugaaaugaaaauacgucugugcugugccuauucaucccucccuccccuuuaauuccuggcaaccacugaucuuuuuuaaugucuucauaguuuugccuuuuccaacgugucauaugguuggaauaauugccaauuguuaugaaucuuauauaaaugaaaauuucuuuauauaaauaucauacacgaucccauucccuguauauaaagggaauacauagggggugcgggggggcuucuuuuguucgaaaugcuuugagagauucauuucuguugcauguaaguuguuguuaauguucauuguuuuaacauguuccauuguaugaacaaauaugauuuguuuuuccauuccaauacuaggggauaugugaguuuuucuaguuuagggugauuacaaauaacauugcuguaaauuuuguacuuguauuuugguguuaaguguaugcauuucuguagguuguguaccuagggggaaauuguuugagcuauaggguauauauagguucacuuuuagaagauacagaugaaagaguuuccaaagugguuguacugaucuacacaccuaccaucacugugggaguuucaguuguuccacaucuuugccaacagucuguacggucuguuuuaaaauuucucgucauuucuguggguguguaaugauaucucauugugaauuaaauuuuuauuucccugauauuuaacaauguugaauaccuuuucuuacuuuuaugggucauuuugauggauuauuacuuuuguuucuccugagccuuauaaauaguggauuucuaagaauaacuagccaccauguaggacacuaauacagcacaguaaaaaaaaguguuuuccugucaucuauacugagauaccaaggaagauguaaacuuaagugccugguacugaagacuuauuuuuaaaguaucuguauuaaguugguaugcaaaggagaauuauuuagggcuuacuacauuaauugauuuuauggugagaauuugaaaguauacccagauguguaugaaugagugcagugauuagacauuggguauaacacuuuuugggcaauuaauuuauugucuuuagugagcacuuuguggucucaucuauaugaacugacuuaaucuuguaacaucucuuuauguauuauuugcacauaaaaggcauagaaaaguagaggagaaaguuuuuccagguagauuauuaccuauauuggaaguuccuucuuacagaagacuuguucauuuagggagauuguauuuuccgagaacuuugagugaagcauuuauuaucuaaagggacauaugaacuaauuaauguuauuaauucuacuauaagcauuuauacaggagauuacucuccaacuagucuugaagaauagagguuaguuagaugaggaacaaaauaacuggaaaacagucuaggcaagagaaguagugcaugcaaaguuguaacauugggagaagacauguaauuucaugcugucuuuuugggccauuugguugcuucucaucuguauuugguuuuuuuuucccuuuagauauuaggaucaaggaagaagaaccugauccugaagaguggcagcucaguggugauucuaccuugaauaccaaugaccuaacacacuuaagaguacaggugguagaugaagaaggggaccaacaacaucaagaaggaaaaagacuucggaggguagcuugcaccugucccaacuguaaagaaggugguggaagguaugcauacaugaaacacauauauauuuuuaagagugcuaauaucauucugauuuuugaaauacugcaugcuaugucauuuaauuaugagaaauuauuacaugaucauuuuugguguguguguaugcguguggcagaaguuagagaacaaaauauauggaauuggauuuucaguucucaauguuuuuuaaacuaaaauuauuaguuugcuguuucaaaaauaguacagcagaugccauuuaacaggcccacacugaucagaaauuagccuguuugcaaaccagcaauggaauuugccuaaauauagauaaaaaguugauuuuuuagguugagaauaguaguuacguaaaaauuaaguucaggaauggcugauaagcauaaguauuuccauuuucuuagaagugaaaaauaagccuuaauagauugaauuuuuuaaaaaaugggauuguauuucaguucagucuuuuuaaagguaaacauuaagacagaauaacaugacuggaguaaacucaaaaugaucagaaauuauguuaaauauggauguacuaagcuuaauaaugaagagauugagacucagaucauauuuuuuuuaaaaaaaaaaacaagauccagacugauguuaauuauaaagaacaccugaaauaauuggcacaggaauauugaagaugagggauggaaaaagauuuaucaggcaaguauuaacaaaaagaaaacuuggauagcaguguuaauauaucacacgagacggaauugaggugaaagccccaaauaagacagagauguauuucuuguuaauaauauuaaauuuccaccaagaagauuuaauagucacggucccuuuuuugugcagcuuugaaauauauagagcaaaaacggauagaacucuaaagccauacuuaaccaaaucccuugucauggugaaaauuaacauaccuuucuuagaaaugcacuguuuaaguagauaaaauguacuuuuaauagaguuaacaaacuugaucuaauagagcuuuucuaucugccuuugaguugcacauuggccagcccuuuccaguaauaauaauugcuaacaacugguaacauugagaguuuaccguauucccagugguguuagaagugagacauagagagguugagugacuccuaagagcacacacaacagggauuuggaccuaguuuuacuccagagccuuaaccauuaaacuauacugccucccaagugacucuccuucuacaucugauccuuagguauucauguuuauuguaauuaguuuaaaguuuuguuuuuugacauauuuuggucaauuaaaauugugaauucuaacuaggcaguaacuuuucugaaacucauuuuagaggggcuuuuaagauaaauuauucacaaaagucaaaucuaacggaggccuggccuuuguuucacuuauucuuuauuuuaaaaugaaaauguuuuaauuaguuuauguuuauuaaacuaaaacaugcucauaaaaauguagacacauaggacauuuaaaaacaccaaaaucucaccccucuucaaguuaagcuaguaauguguuuguguuuguccuuuaagauguuacauguauuuuaaaguagaaucaucuuauucucacuguuuuauaugucuguucuuguuuugagaauuuuugugaccauauuuucaagucuauauagucugaaucauuuuuauggcuguauaguauucuguuguauucuauuguauggauguagggugauuuaacaucuuuuguugggaauuuauugucauaaucuuacacguaugucuuugcacauuugucugauuauuuuauuuguauaaguuggcagaagugaaauugcuggguuaaagggaauugucugcuagaaaggcuaguuuauacucuaaccagcagugugugagaguaucuaguuucccacaccuuugccaacaaugaauuuuacaauuauuuuuaaccuuugaaagucugacagaugaaaaauaccuuaauauugucuuaguauauuuuuaaauuacuuggugagguugaacauuuuuggggauguuauuuugccauuuuaaaauuuauuuuuugaauuguuucuuuuuuuuuguaaaucuguuaauuuauguaacucugucacgugcaaauguuuuuucccaguuuuacauugccuuugucagugguuuguagaaugcauuguuauuacacaaguaaagaaacaguuccaucacuuacaccuugcaaacauuuuaagcacaaaaaauuaaaguuggucagccuuuccuuuauuagaugccuuguuaccaugcuauuacaaguuuuccguauucugagaauuauaaaaauguucauuuauauuuuuucuagaacuuuugugacuucauucuuuaauagcucacuuauucuaagcaauaaaaauugagauuccuaagaaaagaaacuauauuguuucuuagagcuuguuugaacaaaauucaagcaguauaugugugauagacacacuuguauaaaugacaauuguaccuaauugauagaagcauaacauagguaguaaauccaaacuauucuaaaguauucugcaaguugauacagauaguaauuaaaaaaguuuuuuagaauauuugucuuuuuuugcaaccauuauuuuuuuaaagaauaugggcaagauggcauuuuuagagaacugauuuuauucaucuuuagagaaguaaauuuuauuuguuuaccuuuuaaaguaagguguaaaauauaaaauauuuaaaaguuguaauuauuuagcaaauauuuauugagcagaaccagcuuucagagacuguuuaaacuagugagagauaaccuagugagagacaaauaauuguaaguaaaauacauucuagaggcaugauuguuauauagguuuuguauggauuaaacaucaguccauauuuuuaaaauugugcacaaucuguuuucuuugucagcauuucaguuuauguccuguuuuucccacccugagcagaagagaguguauuuacuuaacuuuucuuaacuccucuacccacaguuuagcuuccacucuaucuuagcauuauuaaauuauugggaacaaguuuagacacucaagaauaaaaacguaaaauuauuaguuuuuccuauauuauaggcauuagugguguggauauuaaucaagaagaaaacuuuaaaucuuuuauuccugaacuuuguugagaaauucacuucaguucucucccuucaagccuugguaugacaugccguaaauccacaucuaccauaucuauaucuuacuuugaaugaaauuuucuuuuuaaauagaauuuugggccuggauguugagcuuuuuccuuaaauaugugugcaaccccgccccuauguuuuuucuuuccuagaugccugucccauuuucaaauaauauuucuuauuuccuaauaauucaguuaaaaauaccuucccuagcuucuugcuucuuugagaacccagaucuguugcuguuaauuuguuagucuugugcuuuguuaguguucccaugcuaaauuuugcuaaguuugugaaaugcacuuuugaguuuguaaaagcgcguugauuauugaccugagugguaggcuuagaggagaggcaugaaauaaugaguacacgagugaacugaauuggguucucugugaaauugcuauggugaacacgauauguaaaauugguuuguacaccaguagccacaaacauugcuguuuuucuuagggauuuuuaaauaauaaaauaaauuuaaaaaucuaaauuaaauggaaucaauauuggcuuugguuaguaagacuuuggcauugcaagggagccagaaaaaccuguuucacuuaacucagcucuuugaagaguuguagaaauuggggguggacuggagcagaaacuagaauuguguuagauuaugacauccuugcccuugagacaacagcaugacuccuccuugucuuuacuuaugcuauuccucugccuggaaugccuucccuccuuucuaucuaaauccuacccaccuccuccacgaagccuucucuaacuacuggagcccacauugaugucucccuguucagaacaccuauggcaucuaacagccagcacugcaccguuuagcacuguuuguccuauggcaauuucacaugcuacugagugugaguacauuaaaauauaaauguggggaaauaugcauuuuuccaguaaauuugaaaaacgauagguguauuguauacaggaggauuuacaggcuauagaaaguuuuacaggauaugccuaaacugugagauugggggaggaggggaguuggggagggggcuaaauguacuuuuuuaaaaaaacucagaaacauuguaaaguuuauacaaauuguuuuguccaaagugucauguuuuuuaaaaacuaauuuauuuuuauucaguaacaagccuaauuuuuuuuuuuauuuuaaaagguugagaaauaacauuuucuguaguguuuaauacuauucaaaugaucaauucugggaucaaaaaaguuuucuucuugcuuaggcuaagauaccucuguucacccaucuaaucucauaucuucuaaacccugcucuugguaucaaauacugaaauguaauaaauguccaauuuugugauguggagaaaacuguauuuuauuauaucucuugugucuaauuuuggguaucuuuuacaugguuaauaugaagggaauuuuaaauguaaagauaauuuugauuuguauuuaucucaucuaaugcuaagggaguucagaccauugcuuuaacuagauuuaaaaaaaagcuuucuccaagucaguguauauucagaguguggccacacaaauaugaacaaauauucuuaaaucauauuaaagucugcuaaagcugccuauaucuuuuaauuguaccugugaucaguuacguauucauucuuugguuuaaauauauuuuugauuaucugacgacuuuugaauacagaccacauuuaguuuccuauauaauuaaguggaucaggcuuaugcguagaauuugugaaugguucugauagaagaauaaauagcuuuauuguacauucuuuacauaugaaauguccuuuuaauuacauaauucuugagcauauuuacauuuggacaacaaucacauuaauucuggaguaagguuaauauauaaaauguauaugcuugaaauacauaaauuuucauuuaaacugauuuuaaaugguuuugguuucugauugacuuuguaaugauaaugucuucuauuuaaaauucaacauggggauauaugauguaaaugguaauguccauuugaauauuuucauauaaguauauauuauucuauguguguuuuuuagagguaccaaucuugggaaaaagaagcaacacauuugucauauaccaggaugugguaaagucuaugggaagaccucacaucugagagcucaucugcguuggcauucuggagaacgcccuuuuguuuguaacuggauguacugugguaaaagauuuacucgaagugaugaauuacagaggcacagaagaacacauacagguuacuaauacuuacuuuuaacagacaaaaaugaauuauagggcuacauaacugccuugacuucuuuuuuauuagcauuccuuacugaacugaaucgauuuaaaauacaaugaauuacauccaauuuuuaccuuuaguaacaccaucuuaauaacacaaauuccaaagaacaagucagucuggcuuaucuucuaaaauaaaguuauauuuaaguagacuuuggguggcuuuuguugacauuauugaaugcuuuaaaccacauuuauacuauuuuuauucuguuaacauuuuuaauuaguugucagcuuuuacucuugaucuauccuauuuuuuuucuuuccucuuaacacuguaacaaaaaauacuccuguuucuucugacauauuugggcauuucaccuuuucuuuuguuuuuaguaucucugagguaagggaaagguauuucacugaggaauaaccaaggcaauguugaugugaagacuuucucugauuauauuauuuuuacauaguguugugugguuguuaaaugaaauggaccugugacugaucuacacugaaaccuaacaguguuaacuuagagauaguuuuuuccuacuaccauguaaaugauuaaaguguucaucagucuaugcucaacacuggagaauugaaaacuauguauuuacaaucccuagagagcuuggaagaagcaugguaaaauggagaacaacauggauuuugaagucaucuggauuccaauccaaguucccuauuagguuaagcgaauaaacuaucucugacguugcuucacauauccuacuuuggccuucaguauuguauaaaauuaccuaugaagucuguaguaguauacagaugcucuaauaguuuuaguuccugucucucauuggguagguagacagaugagauuaaccuacaugaaacugcaacagacaauuaagaaaguagauaaggcugcagggcgugcuggcccaugccuguaaucccggcacuuugggaggccaaggaaggcagauugcuugagccucaggaguuugagaccagccugggcaacauggugaaaccgugucucuccuagaaagacaaagaauagccgggcggaugguguguaccuguagucccagcugcucaggaggcugaggugggaggauugcuugagcccauggggcggcgguugcagugagccaaggucaugccacuguacugcagccugggugacaaagugagauccugucucaaaaaaaaaaaaaaaaaaaaaaagguagauaaaagauuuugcguugcagucugcuguugaaaaggcucagaaacagagauaauuacugcuugggauaguaaaguaugggauaauagaucuuaugauggcccuguuaacagaauuuuccucaguaggauuuuaucagcagguuguaaaaaggaauaauguaaaagggagaaaaaggucaaugaucaaauaaguguaggaaauagugggccaaagaggguauaaguaccuucaaggcaguaccucuuaggaccuuuaaauuaaaugcuagauugacagcuugcaucuauaaguuagugauguaauguguguguagcauuuccuaaccuugugccguuugccauggaguaccucucaggacuaauguuacaagagaaacugggaaauacuuuaguagaaaaauggugguauguuaauagaagaagugagagaccuuuuuuuguagcggugaaugaggaugagauuuuacauaacauuucuguuaaguaggauugaggcacacuuuaaagguccuuguaaauuaggcaguggagcaucuaaacuguuacgucaucugcaaguuacccuugcauuuccauaucacuuaauauaaucuugaaguuuucugauguaauaaaauuuggucuuuaaggaagauagucuggagagagagagagacuaggaugugacugcaguauaguucaagcaugaggucugauaaagaccuauguagaguagaggugcuagaacaaaggauacaagcuaagacauuuuugaagaaaggaauuaagaaaauauuuacuagauuuauugauugauuuuuauugauuucucucugaauuccuuuuagguuggccuuuugucuucucuuuugguaaucuugcagagucggucuucaacauaauagaaguucagucugucuuuuguauuuaaacuuacuuuauucaugcugggaaauaaauuuaggcaucaggauuuuaacagcuuuaacaucuuaacauauuaggcuuguucuugauuguuguagcugaagucaagucagcuagccagauucauuuuucuaaggauuacucauucuuuuuggaucucaagcuuguggugucauuucuuuaaucuagaaguacccuguugcuuuaauucauauuuaagaguugaagguuuaguaucaugaacauggcauguuaguauuuuaauuauagcgugaaagaauauacuuuuauuuagacuuuaaaguguguuauagaugcuuauuuuuuagcuggcaucuuaacacagguauuucaaacaaacucuuagcguaguugagauauuaaagucuuauuugaauauccaucuauuauauaauacauguuugaagacugcuagucaucaaaaaguaaagaugaaagauuuaaggagaaauauucuguaagagaaaucuggcagggguagcucguaaaaugaauacaauuuuaauagaccccugcucccauccucaccugucagcguugacuuacuuucuguuuugggggagaugauugagcuauuaaaguugaauuuuuaaaaccaaguaacuuaauuuuuuucuuaacaggugagaagaaauuuguuuguccagaauguucaaaacgcuuuaugagaagugaccaccuugccaaacauauuaaaacacaccagaauaaaaaagguauucacucuagcaguacagugcuggcaucuguggaagcugcgcgagaugauacuuugauuacugcaggaggaacaacgcuuauccuugcaaauauucaacaagguucuguuucagggauaggaacuguuaauacuuccgccaccagcaaucaagauauccuuaccaacacugaaauaccuuuacagcuugucacaguuucuggaaaugagacaauggaguaaauauuacacaaauacuuauucauugugguuauuuuuauacaguagugagaagaauauuguuccuaaguucuuagauaucuuuuuauugaugugcaaaaauuuuuggauugacaguaacuugguuauacaugacacugaaaugccuuacuuuguaugauauuccauaguauauuaaaaaugguaaaauugcauggguuuuguagguacuuuuggaaucuagaagaaaugaaauuuuaccaaguuauauaaagagaaaauugaauuuaacaaugcgaaugguagucuaaccaaaugcaucaauccugugugguuuaguguaaaaaugagaacauguugguauuuaucuauuguaagauaaaaaagcuggugggugaaagaaaucauguuaugauaaaaaauuuuguaauuuucuugaugacuggaauuuuuauuaugcauaacugacaaaucaaguuuccaagcaaauguuacauaguguaggcuuuacuuagcuuaucaauuugucauuuugaagcuaauuauuuuaauuagguuaacuauguacaauauuuuaagcauuacucuuguaagauuuugaaaacuacauuuuaacauggaacucuagggauagucaccuuuuaaauccuguugaaaagccauguuuaagauuuaauuugccaaaauaaugucuuguuaauauucuuucaauaacgaaguugggcaauauaaccaauguuuaaaaaaguuuaaaauguauaaguugaggcauuugggugguaagagaauguuauagugaauuaucccuuuucuugacuauuggaggaccaaaaaaauaagguguauugcgucuuagcagugauuuuuauccaaucuuguuuccaaaaaccaugucucccagggccuuaaaagccaucauguaaauuaccaguaaaguguaacauaugcaaacauaacaaaaucacuuccauagugacgauacuccaaccauauggauauuagucauagaagaacuagagguuuuaugauauuuuuuuaagucuuuuuuuuuuuugucuagguagucagucugcacuuaaauaucaaucauuuuccuuuuuugcuucuucccuuaaaauuuauauguauccaguacauuuaauugagaagcguauguuuuuuauuaugcuguauuuucuuuuuauuuuuuaauuauuguuuauauuuucaauucaaaaauguacaaaauaaaguuacauugcuggucuuguaagagcuauacaguuuuccuaaauguauaccuguaacugcagcaguucaccuauuucaaaaauuuggaauucuguucauuuguuauucuuaagaccaccucaaauuuaaaggcuaccuuauuguacguuuaaaguguauuauaacagugugguaguuaauaaaacacuauuuuuuuuucuuuugaguuuguuguauuccuaugcauaaaaaauauugcagugguaugggguaagaauuggugguuuauuuuucuucaacuuggcuuuuuauuuuuagauucuugauuuuagacacugaauuguaaacaggcauuuauuugaagaagagauauauagagacacuggucauuuacuaauuuuuuaccuagaguaaauaagaaugagcuuauuaaauaaaauuuuugaaaaaaagucuuagcccuuagcccacauugauucauaucaguuuuaucaguaccauuuugcaauuuuuuuguuuuccguuuuaaagcaaugcagaauauuuugauuuaucgaaaaccugaauuuacauuaagacuccugaaaaugauaagacaagcguugguaaccauggcaggaguuacuugaaaaaguugccuuugaauuugcauguguuucaucauuauaaaggcagaguaggaggaaagaguauuaaugugauuguguauuguagauguuuuaaaguaaaaaucaaguuucuuaacacauguauacaguggggguaaagauguccauuuucuguuuuccaggcccagucugacucugucuguaauaccugauugcauuggagaacucuagacacgcauaaacauggacaguuuuucuaaaugugagacuuaagccugugauguaaaauaggaaguucuacuuggaauaauauaaaggaaccacuagaauuuacaauuauuuugaaguuacagggauuagauuuugaaucuuaaaauccuuuagguaauuuuuagaauuuuuaaauuaagauuaaugugaagagaauuaagugagcagcaggugguucacuugagcaaacugcccauuaagucagauuaaaccauuugaaugauaguagagauguuuuaaguaauacuggauuuuuacaguaaguuuaugguguacuuugaaucgauagguguccaugcauauuuuaugaauucguggagaaugaaugcaaugaagaaaguaaguagucuugaaaauuauuuaaauaaaguuguagauuuuuuuagugcccccuaggaauauauuagugaacuuuggaacuuuuaccaaaguuauguaaccucaguguagauaauuuuaaauauuucuauuuuuauauuuuaaaauguugaauauacucuggaaacaacauuugaagauuugcucugaugucaacuuuuucugguuauaaaaccuauuaguauuguguauaauucucaggguagguauacucuaauagguguuuugucaauugcuuuauuuuuguaaaggcuagaguuagugcauauugaauauauuuauguacaaauaauuccuguuguaacauuuaguggacgcgauuaucuguauaccucaaauuuuaauuuaagaaaguaucacuuaaagagcaucucauuuucuauagauugaggcuuaauuacugaaaagugacucaaccaaaaagcacauaaccuuuuaaaggagcuacaccuaccgcagaaagucagaugcccuguaaauaacuuuggucuuucaaaauaguggcaaugcuuaagauacuuaaaaauacacauacauauaagcugaaagcaugucaagccuauuucauagaaaauaguucuuaaacaguauuguucauuagaaauugcuggggagcauuuuagagauuccauaggccugguagccaccucagcuuacuaaaucaacaucucuggagauggaguguauauguguuuugaaacagcugcucaagugguucuguuaaacacuccugcguuacaaucacuuaaaauagagcaagcauccccuuaggcucuuaauuguaguuuaaauuccaguacugccuacucagacccaaaaguuuuguuuuaugaaaaauuuguauuguguucaauauuguuugaaauuugggguuguugcauaaaugauuauggaauaacauuugguuuuaaaauaauauaaacugacauguuaugcuaccuguuacacaauuugguuuucaguuuuaauuauaugaagcugguaacaaucguuuuuguuguaaaagaauuauuuuucacuaaacaguauguuuaaaacuga

SEQ ID NO: 191203 - RNA, 33585 nt, Homo sapiens
aagcccagccccgggacgagggaggagcgccuuaagugcccagcgggcucagaagccccgacguguggcggcugagccgggccccgcgcacuuucucggccggggagggguucgggcucgggcacccggaguuggccccucguaacgccgcgggaaagugcgggcgagggcaguggacucugaggccggagucggcggcacccggggcuucuaguucggacgcggugcccccugguggcgcucaccgcgcgcguggccuuggcuuccgugacagcgcucgguuggccgucacagcagcccucgguuggcccuuuccugcuuuauagcgugcaaaccucgccgcgccagggccaagggacagguuggagcuguugaucuguugcgcaauugcuauuuuccccagagcggcuuugucuuuggauuuagcguuucagaauugcaauuccaaaauguguaagacgggauauucucuucugugcugucaaggguaagaguugcgaguguagauuagaauuucuguugcuuuuagucuguuaguaauuuuuugcuuucagcuauuauuucuccccugaguacuuuauauauguuuccuuuucaguugagaauuugccucaauuucuuaacauguucccccucuucugcaggggcagagaguggaacgcuugcguuucaaaacacuugcuaauuucugugaauuguuauaaaagugaaaagaaguuucugcucauccuuuguagaaacuuuaaaaguagauauuuauauuucuaacuucuuuuguaaaugaauuuuaggaaaaaaauuggaauucaaggaaauguguacuugauguacaguaaauacguuuaugcuguuaaauguaaaguuuucgguuaauuccaaagaucuauuguaaaguuuuaaguuauggacaauguauuaauugugcuuuuuucccccuuuaaaguuguuugucuugaacuuuuccccagucuucauugggauuguauucuucugguuccaacuagugaagaauuaaauuguaccuuccgauuuauuuaauagcugcuguucaagaguuaucuauaggaaugcuuguuugacugaaggauauaugauaaaaaugaacuuuaguuuuucugauuuccggaauugucuacagcccucuauuauuuuugaauuuuucuuucuuugcuguguaauauaacauuccuuauacaaaaaugcgugaaacauauguaccgcauuaaguguguauuuuccaauuacguuugauaaaaauaacugcuuuucuaccuuuguaaucagacaucgauuugcauauuugaaaacagaaaaagaacaagaaaauuuagaauugauuuuguuuaugauucauauuagauuguugucauccauaaagauuugaacagagucaaacauuuucuugaccuuuugucaaaaaaaacucuccaggugugaagugguaguaggauauaguuuuucaccuucugugcagaggauguguugauaaacagggcaguaaggagagccuuagauucaguaucuccauuagguggaaggaaccauccauuacucuuuucaagggugucuuggagagauaaagcacuuuccuagaugagggaugaaguugauauugaaauagaccgaugagauuauuuuuaagucaaacaaaagaaaaauaggacaggccucucaucuccugaaugaauguuaagcaaagaacaacuugacuuuuuagauaugugaaaaaucucuugagagguuguggaagcagcauguaggaggauaaaugcauaacucacaucagucuuuuacgcauuaaaaauaacuugggccauuuugaaaucuuucuuucuugcccuggguucuuauaagcaauguuggggggaaaacugacucugucuuuaggauuaccaggaaaaguugaaagccaaaugcaucauuuuucuuaauauuuguuuuuauugaggauaaaucauguuuaacaaagcugcaugaaaaaaaggaacccaacaaguacauuuuuuuuucugggaauuuccucuguccugacugaagacauuuaaaggggguuuugugucaauauuuccuccuuaacuguuccucaagccuggguuaacuuuucaguaugcaggaagaauuuggcacuaagauaauaauagauaaguuacugggcacgucccugggugccagacauaauugcuucacaugcauaauuuuacaguaaccucacgggaaauauuauuaucccugguuuccagguugggaaaaccaggcauaauaguuagaucaggcauuagguuaggaaagguuaggagagaggcauagagaaaggccaggaccugcuaaggugaccauacuauugaguggccaagguagcauucaaacagguuugacuccugggggcuucuaaucaccacuuccagacuguaccaaaacuccuuaaacucuaaauaggaagaaaagcucacacuuuaaaaaguggguaaguugagauuugccuauucugggggaaggagaggccggaauauaaaagauuaaugucugcagcuuuuccauuuagcaagacauuuaaucacuguaugugacguggggagguggaccuuguuaaauacagggagagugaauacaauccaucaaugguacccacugugguccuuuuaaggaagacacagaggccucgguggauucaauuuagaaaggcaggacuguuuuuuguuuuuuguuuuuuuuuuuuuuugagaugaagucuuguucuguugcccaggcuggaaugcaguggccugaucuuggcucacugcagccucuacuucccggguucaagugauucuccugcuucagccucccgaguagcugggauuauaggcacccacugcccggcuaauuuuuguauuuuuaguagagaugggguuuuaccauguuggccaggcugggcuggucucgaacuccugaccucaggugauccacccgccucggccucccaaaguguugggauuacaggugugagccacugcgccagucuguuucuuaauauaauaauaguuuuaaaaauuucugauguuuggcaauguccaagauucugccucacauuuuucagaaacugccuuuuuucuuaauuaaaucucuuagcuacuggagucuuugccuuuguuugccuugcuacuugguacauuucuucuguuccauuggcucuuuuuguuuugaaguagugcucaaaaauaaguuugguaguaagaauauggugaagagugugacagacaggguuaaaccaggcugaaggaaagagagcagaauggggaaaauuugaguugaaaacagcuagcagaaagcugauggcgcaaauucaacccuaaucucauguuuuggcacuucugaacuauagcaagcauaagggcucaacucuuaucuaguugaagcuuacuugggucuuugagaauaguacaucucaaaauuaaacacuuucuuaguccuuauuguuaaguuguuuuuggaauuauugucuuauuugucugaauuaagugugcugcaggacuuauaggaucugauggaugauuugccuaaaaguugguccaggucaaccucagggcauuuaaaugcuugguccagccacuuucugaaaguugacugaaauauguugcacagcaggguagaggaggacaaguuuacuagaugucauuuuuaaccugcuugucuucaucucugacuguagaaauguauauucauuauaaguuugccacaaauagagaauagaguuuauucuuugaucaucuaauuucuaggagcuauugaaauuucacugcuaccugcuuuuaaauaagcgccaacaaacauuuauuaaaagggcuuuaagguauaggccaagauuuauucaauugcuaaugguauguuuucuguaaaugaaagcaaaaauauguucaaguguauaauauuaaauauuaacauucagaaacuuggagaaauacagauggcuuuuuuuuuugagacgcagucuugcucugucgcccaggcuggagugcaguggcaugaucuccgcucacugcaagcuccaccucccggguucacgccauucuccugccccagccucccgaguagcugguacuacaggcacccgccaccacgccuggcuaauuuuuuguauuuuuaguagagaugggguuucacuguguuagccaggaugaucucgaucuccugaccucaugauccgccugccucagccucccaaagugcugggauuacaagcuuaagccaccgcgccuggccuagauggauuucuuguaccagacuauacccuagacaugaaaacaagacuguuaaacaaaauccugugcuaccuaaaguuugagccuucugugugucaguuucugccauaauaaauaacucuuaacuaugauuauuaaguauauuaagaacuuugaguaggggaggcacguuuaaucauucguuuuuacggcauauguacuauaauaccuguguguugcaaauccugguauuuaaaagucuuuuuguguauuugagcauguaaguuuauuugguccaaacugcugguacuaguaaagacaaguccagggcauaaguaggacuuacagcaccaaguucgucuuuuuuuuuugagacagagucucagucggucacccaggcuggagugcauugguacagucugggcucacugcacccuccaccucccgaguucaagcgauucuccugccucagccucccaaguagcugggauuacaagugugugccgccacgcccgguuaauuuuuguauuuuuaguagagauggaguuucacuauguuggccaggcugaucccgaccucaggugaugugcccaccuuggucuccgaaagugcugggauuauaggcgugagccacugcgccugaccuccaaguccaucuuucaaaggcucuguugauaauugacucuugagagucauuacaguccaucaacagccuguauucugaauauuuguuuuuaauucuaagacaaugcuaaauagccauuccaaauaaggugagaacugagacuuuagggccuguauuaucagcuguacacugacaagcucugaacucuauugcuuuuucaaaucagagaagaaaaaugaguaagaaaagaaaaauauggaucacuuaggcuuugaugccuccucugaguuuauaguguuuaccuucuguauuacuuaggugauccucucuaauggcauuuuaaaucucuguugauacuugucuuacuuauguaucuguuuuuuuuuccucuauaguagauagaauuuauagauauauauguauuuuaaaguaagauacaauuuacguaccuuacaauuuacccauuuaaucuaauucaggguuaugcaacccuaugaauuuaguaguuuauucauagaguuaugcaaccaucacuguaaucaauuuucaacacccucaaaagaaaccccauauccauuagcagucacuucccauuuccccucaacucuccuggccccugguaacuacucaguuauuuucuguaccuauggauuugccuauucuggacauaucauguaaauggaauagcauguaaauggaaucauacaguauuuauccuucuguugcuggcuucuuucacagcaauauguuuucaagguuuaaaaauguugcaacguauaucaauagcgucauuccuuuuuauggcugcauacuauuccauuguauggcuauaccacauuuuauuuauccaguugaugaucauuugaguuguuuccacuuuuuauguuucuguuuguuucuuacagcagugguucucaaacuguuguauauuagacucaccaucaguauuuaaaaaacuaaugcccaggccauaucccucaugaaaucaaaaucucuggggguggggcccaggcaucacuauuuuuuaaagauucugaggggauucuaacgagcagucagguuugagagccagugcccuagggcagcaguccacaaccuuuuuagcaccagggacuaguuuuguggaagacaguuuuuccauagaaggagguagaggaugguuucaggaugaaacuguuccaccucagaucaucaggcauuagauuguccuaaggagcuggcaaccuacaucccuugcauacucaguuuacaacaggguuccggcuucucugauaaacuaaugcugcugcuaaucugacaggagguggagcucaggcgggaaugcucgccuacugcucaccuccugcugugcggccugguuccuaaugggccacugaccccuccgcagccagcagguggggaccccugcccuaggggacccaccucagugcuugguauccauugaaguauauagugauuuagaaaaucugguuaggaugucuuauuuaaaucaugaaagcaagugcuuuugucuuugaucauugcccuucacagccuuacaguuaacaccuacauucaggaacuguguuucaaagugccuggcgaguguuugaaacucacuaaauauauauaaccugggcucauuaaaccccuccagaagauuuggguaacuuuguuaugaaagggcuucccugaagugggucagcaggauugcucuguguuuuuucaggaauguggccugugauaacuugcaaucuagauuauuuggaaauagcacugagagaagccagugaggacagaaugcucagaagcuugggauagguguugaacauccuggaggccaggacggaacacugucuuacucuaggaagcuguguuccugggccucauuaucuuccuccguuaaaaacaaaagacuuaaaucuccacagcagcuuucagcaacuucauuuuuugguucucuguaucugccugauaaagucccacuuuguaguggcucccacuuauauuuaccugaauggcuuuuggguugacauauuuggaaacuggggcuaacuuccaaacuguuggcaacuugugugugggugugcgugccacagcacagcagucccacuugagagacuugauggugugguggugguuggggggcuucugaagcuggcuuagccccagcccuauacacccaccccacagauggugggaacaagcccagaagagaguggguaacucuguccacuguggccuccacagccaagguugccaggcagagcucgcaaggcccaauuccagucuugucuuugaccguugccccuuuguguuggggggguguauuuagucaccuuucuggaagcaugcuuuucuaauucuagucaucaguaguuuguugcuuuaagauuuugaaaaugguauccuguuauuuuacuuaggaguuucguauugaaugguguacauaaugugauucaaguaccucaaaacagaaggacuucaguuaagauuuaggcucuaugcaacauacacuucuugcauuuucucauucaauguccuuuccuuuuuuuuuuuuuuuuuuuuugcaagaauguagcugacauucagaguagauuaguaccuucaaugucugugugaaagaaaugaccuuaauaugaggacaauauugacuguguauuuagggggcccacuguuaaggcauauagaauuuugcuuuauuucagaccugacaaucucuugucugcucugcuuccgcauaaaauuauaauacugcacauggauguaaaacccaaccuauucccugccugagggacuagaauagagggaagaaugacuauaguucuuuguugccuuuugugaagguaacaggcacagagguaugaugcaugauggaauuauauaccucuucuugagguguuugagggcugacuaaggaccuguacuuuuuuuuugguuuguuuugcaguacuggggccagggagccuugcuguugugucuagagaguguugaagaaccaugaauauuucgcaaaaagaaaauaauuuuuuuaaccauuaaaauuccugguagugacuuccucuggcaaguaaaaaacucucauuuuccuuaaaaaaugagaguuuuuuacuugcaauaggaaaacuugccaauuuuucaaguuauuuuuauucuugaugauucucaaugagacauaauuaaaauacacauagaaaaaacaaccguaggccaggugcaguggcucacaccaguaaucccaacacuuugggaagucaaggugggaggaucacuagagaccaggaguuugagaugagccugggcaacauauugagacacugucuccucaaaaaauuaaaaaaauuagcuggauccaguggugcacaccugcaauuguagcuauuugggaggcuaagguggaagaauagcuugagcccaggaguuugaaggugcagugagccauaaucaugccacuguacuccagcccaggcaacagaguaagaucaugucucaaugaaaaaaagaaaaaucaacccuaguggacuggaacagggcugguuuacuuugugucagcugcagugcccccacucgccaacccacauguucuucuccugcugguucccaagcagagaccagaaccaagaaugagaaucauccugugggugcagguuguaucuuauccuccagagacagcacuucacccucuguuagaaacuucuuuaccacacugccuguuuggugaaauccuuagggcagugacuuccaaacugugauccaggggccacccuuggugggaggaucaggaaggagggggaauguaucuuaagaaaaguugggggaagcucauaucucuucucguugauccugagaaguaaagucuuuccuccucagagagaugcggguagacaugacucgccuagauagaagcucauucaucucccucccuucugccucugcaggacucuuggaagucuggguccccgggaguaugcggcucuugcucugugcuacagguuuccaaaguucacuugauaacaguacaauugugcuguaaauugugcaguaauggagacugaggaaacaauuagucuuucaucuucauucauguuaccagcucacuuccuauggugugaaaagagccagacuuuggaguuaggagacaucugaauacagacagaacuggcaagauuauggggaagaaaagggaaaaguaaugaauauuuucaaagagguuaagccauuuggccaggacaacacugcuugcagguagcagaacugggauuuugacuguccauaaucccuauucucugcuuguuuuacuccuucccucucuucuuucuuuuuucauugucuaaugaccuacagacauucugucagcugcuaaagaaugagggacuccuuuauaaagauugauaggacagugucgcuacuuaaggaguuccuuccauguggaccagugggggcgcuguugacgcauggggcuggacuucucuuuggagcagaguccuguuccacggaucgcugugacaagcagaaagugccccaccccaccuccauacaauuccuaaugcuccugggugauacaaccgccccaguggaagcacgguggugcauggacuucuagagaccauuugaagccaggacauugcugcuuguucuuaggaaauggcagaauauuacuuucuuguuuuuuguagggaagccugccaucucaccagguggcagcuuguuuauaccuuuuauccuaaccugaagcaggugaugggacagaggucaucgaauauaaugaaagugccacaaagguagagucuggguauauuuuauuuaugcagguagagugacuuguccagaucccuucacacagagcaacauuuaauaugguaauuguuacugcugaaguuggccauuucucggaccuacagcugcaaggaauugguaacaaaaggauaaacuaaacauuguuacuauuuuaauuuucaaggagaugaaguuaaaaucauauaugucauaucucucuggggcuuagccaccuuuucugcugggcacuuuuugaagaagucugaauacugagauaggagaguaaaggggggaaaguaaguuugcccacuucucauccuuuuucugaccaucagccugagggaaguaacuagaauccgcuaagaaaauucacuuaaucagcaguugauugauuguuauauuguccacauugcaaaauucuuuaaaggauauuugaagauauuaucacauuuguucucuuacaaucuauuguauuguuuauuugaaggggugaguguuaauaguucuuaagauaucguacuuuauuuccgguagcauauccaagaaauaauuuagaaguauuguuaaugggaaugauguuaaauaauuuuucuaugacuaguaguugggacauauaugauauaaaacaugguaucuuuguuacuuaaguaauuugaacucuaaccccauauaucuuagguagacaaugaaaauacugaauuguuagucuaaauaauauacacguacucauuccgcaaauauuuauuagguaucuacacacccuaggaaucuuucagggcaugaagcuguuuuaaucuuccaagauaaugcagcacguaucccccuugagggacauuuguuuuucaaauugcuccucugugucuccucugcuuaggauaugaguuccucuaagacuguauuuuaaucuuuuguguaauucugaugucuagcgccaugccuggugcuuacguaauaguugcucagucaguuugagggugaguccauuaacugcccucuaggagcuugauauuuaauauaaacuagucugugauacaugacaaugcugugacagugcagaugagaaaaugugacuucuaacuggggugcucagagaggauauccuggaggaacugccauuuuaacuagacuuuucuuuuaagcagguagauuuuguuugguucaggcuucagcuggaagcccaagcaauggugcagauaugagcuggacuaugacagacuauugggccaguggggcugacaagguuaacuuggggguugccauagagggccuucagugcucaugugcacuguuucaaguuuguacagggcaucuggaaaccauggaagaagauucuggaaagggcagggcagguaaacuggauguggauaggaaguuacuguggcaggugaauuggaagauggacagguuggaggcagggagauggugagcgggcuccugccaagguguaggucugagcauuguugugacggcuuaguugguuugacaucagcacacagauugaggaucugucauuguaacucuaaauuguauccuuguuagacauguaaaaauaacuuuuuagagccuccguuuuuaaggagggaaguggauugugcucaagcuugcaugcuccgcuguuccugugcuuuaaaaauacucauccaccaguguggucacugaugaaaggggaggaaaaacuagccagaaguugccauuuugcuuaaagaauggauucauuucuuccucaagguggcacagagagaguuucucucuuuuugccccucucuuagauugauuuacuauuuuuaguaaauucuaacagucugauccuugcuuccaauuacaaugauuagcaauauuugcccaagacaagaaaaaacaauuuccucucuuuucucuccuaugagcuuuuccugugagccccaagcagacagauguggacaucuagcaaugcuguuaacaacagcugcaguccguuggacucucugcaacacugggcacgguacaaagugcucugacaaacucuucugcccuuugcaauccuuacuacgcccugugaggugaggaguauucuuccuguuuuguaggugaagaacugaggcaaagagagguuaugucauuagauuucacaauaggguguguuuccguuucaucaucuuuagauugauguuacugugacaucaucuuccuagaauuaacaaagugaacugggcacaggaaauagcacauggcacaccuucagcaaauggugguugugaucauuuucaucauuccauuucuucuugaaaaaaaucccuuuuuuuuuuuuuuuuugagacagagucucacucugucgcccaggcuggacuggugugaucucggcucacugcaagcuccgccucccggguucacgccauucuucugccucagccuccugaguagcugggacuacaggcacgggccaccacgccuggcuaauuuuuuuguauuuuuaguagagacggaguuucaccguguuagccaggauggucucgaacuccugaccucgugauccgcccaccucggccucccaaagugcugggauuacaggcaugagccaccacgccuggcaaaaaucccucgaguuccaguguaaacacucacgcccuuuuuugcuguuugcuauaaaccucucauucuccuuggucuucuuguccuugugugagguccugguuguuguggagacugaggucuucugagacagaaaaccaaccccauagcaggccuggugugugcccuagaauggcagaggccccacacguugccccggcuccucuggaagacccuccagccugucugcuggauuccuuguacuuaugaggauuguuaaaccaucucauaggauuccuuuccagacucagcccuucacuuguggcagcauuucuuacucugagguucugggccuagaaacccaguguccauaggcaaggucuagggacagagagaguuuguagaaagugggaaugcaucaguggaaggcuaaauccaaacaggaacugagcuggccuggguggcuuuguccuuuugccaucuucguaacccuuuaaaggcuuuaagacacuucuuuuguaauaacuaccccaacuaaauuuggccagagcugugaagggaaagaaaaucuaagacccuugagggagaugacagccgaacguuuuacauuuuuaccaccuuuguuguugccaugcacagcugauacauaaacaaguaauggccucaucuucuauucuuuuauuuacugguuagacccagaacccuaaaagguagaugcuucucauggucauuuggcauuugcaacaggagcugaauuuauuaauaguacuaauaccucauccuuggacauccuuggguuguccgauauuuuuaaggggcauuuacauccuuuguuuuucauauggaaaacuuuuccguaagggcugguaucaucuuggccuuccauugcaggaacagcacagggagguucgguggcuaggccacaguuacccacgcagcuagguagcagcagaggccccaccuggcacccccuggcuuccuaagcacaucgcacugugcagccucccugaggaagccucgaguggauaggaacucugguucuuuaagauaaaccugaguuggaucucacugucaccauuuaucagauggggcgaugucuucaggcaaaaguacuuaaccucucuguuuuuguuuccuuacuccaaaaugguaaugaucauacuacuacccaccuggguggauuggugugcauaugaaggaggucauggggacaagugguuggaagaguguugagcacauagaaaguacaagauaaaugguggccauuauguuacuacuuagacuauaucauacuugucuuuaucugggcuuagaaucuugacacugagaucuuucauucucagaucuuaauaugaaagcuuaccagguaaacacuaccccaacauaauuauuuaguggguucauacaugugaaagcaguugaaauacaauuucugaacuccggguuaauuuauauccuuaguuggaacagguaguacccucccagcaccuaaggccucucacuucuauccauucuucagaugaccuuugcaauaaucaugguaauugaauagcaucugcaccauaacauuguugaauaacaucaaaaugauccauuuagccaucaugagccuuccuaguaauucagacucacaccaguucuuucagguuauugaguagcuuuuacaaauaauugcuaacaguacaaauacugucucagguauuuuggaagggugaauuuucccauugauuucaguguaucuuuaggagguaauuugcaaaaccgaagaguuugguuccgucaaagucaccccuaaggaguguggaggaccacauuguagguuuauacugcacugucccucaugcuugaaauuuggcucaugcaaccaaggaacugaauuuuuaauuucguuaaauuuugauuuaaauuuuaaaacagaaauaguauaaaauauuuuucuguuaaauauaccuuguaguguuggcaagacuacauuucguguuaccaugcuggguaagauuucuuguaguguguauuguguuuugucaccucguuaauaauuuucuuauuuugguugcauguuaaaauaauuuuggauauauuggguuaaauaaauauauuguuaaaauuaaauucacuuguuuauuuuuuuguuggugaggcuaggcuacuaaaaaauuuaaaauuacccauguggauugcauuauauuucuauuagugcugcuuuagcugcaaguagccuauuuaaaaaaaaucauuauuuucagacuuauggacuucauagaaucagagguauuuagaggaaaggaucuugggggucaccuaauccagcuccaacauuuugcaagugauaagaccaaggccagaggcuacaauaaaaugacugaccuccucccagauggggacuggaucccaguggcuuuauagccuuugccuuggauccugguuuuacuuggaaacauagcagacaucagagcugcagagaacuucuaccagauccggagugaagaaaaugccuuauuuauuuauuuauuuauuuauuuauuuauggagaccggguauugcuguggccuaggcuguaguauaguggcagaaacaugguucacugcagccucaaccuccugggcuccaggauccucaugccucaaccuucugaguagccggggccacagguacgcgccaccacgccuggcuauuuuuuuuuuucucuuuuguagagacugcgucuuccauguuggccaggcugauaucaaaacuccugggcucaagugguccuccuaccuuggucccccaaagugcugggauaacaggugugagccaucaugccuguuuuggcaguuuuuaggggcccacgcuaauuuugagccagguuugcgcuugauaauguaaugcuggaggcugggcaggggacaugaucugccugaaagggcugagaacugggaggcucuuauuccuauaguauugagagcaaaggcacagucuuacagaaccacacaauauucagagcuuguggguuggagaaggaaaguccucugaaaaauaaaaaaaagaguacagaggccagaggcgguggcucaugccuguaaugccagcacuuugggaggcccaggcaggcggaucaccuaaggugaggagaucgagaccagccugaccaacauggagaaacccugucucuacuaaaaaugcaaaauuggccaggcaugguggcgcaugccuguaauccaagcuacuugggaggcugaggcaagagaaucgcuugaacccgggaggcggcgguugcggugagcugagaucacgccauugcacuccagccugggcaacaagagugaaacucugucucaaaaaaaaaagaaacagaguacaggucagacauugggcaauuuucucauaacaauuucauaggccauuaauuugguuacagacuugaauagcacacaacaguucucuaagggucaguuuccaaaguaauuccuaauauuuaaugaauuuuuaagugauagaaauugcaguaggaaagucuagcuugaaaucuaauuuguguuagguugaccaggugacaaccacccaccccuggauucugcucaguuaggucagaccuggggccaguugcccauuuagcaucucaggccucaggauccucauuuauaaaccugggguuugaacugcggucuccacgaucacugucagcucuccuuagucaguugguuguucuaaauguaguuuaguggccaguaaacaccuguuccugagugauacaucuuuaaggagccgguagaugggucaaccuggcuggacuugcuuuuucaagucugccuugucuauuagaaaggcugagcuuacugauuuugccugucacguuugaguguuccugagacuuugcccagccucggucuuaucugcggguaccccagccucugcauuccuugccccuacaaaaugugcugccaguuccaaaggcacaaaugaaaauuagcuuggcuggagcauggcuaggcacacaccagugguuaaagaaaugcuguuugcuggcugacacuucuggaguggaaguuuauucuuuuuucuuuuuuuuuuuuuuuuuugcgggguggggcagaguuuugcucuuguugcccagguuggagugcaauggcacgaucucggcuuggagcgaucuugggucaccauaaccuccgccuccuggguucaagcgauucucuugccucagccucuggaguagcugagauuauaggcucccgcuaccacgcccggcuaauuuuuuguauuuuuaguagagacaggguuucaccauguuggccaggcuggucuugaacuccugaccuuacgauccaccugccucggccucccaaagugcugggauuacaggcuugagccacggcgcccggccuuuauuccuuucuuuggccucaauuuuauuguuaagagauagugggaagggcccaauuuugaaaugauccuggaauuaauguaggaggccuuguauaagcaguuaauguguauuuauugaguggguacccugugccaauaugauacaaggugugaaggacacaugaguugggaaaggcauggggaaaugcacgcucacacugcuggugcgaguguaaaagguacagucucuauguagggcuauuuggcaguauauacucuuugacccagcaacuccacuuuuaaguauuuaucuuagggauacccucacacauuuaugaaaugauuuauauacaaggauauucauuauagcaauauuuguaauggcaaaaagaaacaaaagucagaugggggacugauuaaauaauuauguuauuaaguaauacuguuucaguacaucuguguaaugaaauaauguccagucauuaaaaauagugaggcaaagucugggugcaguggcucacgccuguaaucccagcaccuugggaggcugaagccggaggauugcuugagaccagccugggcaacauagugagacccugucuguacaaaaaaaaaaaaaaaaaaguaaaauauuagccaggcauaguggcacaugccuguaaucucagcuauucaggaggcugaggugggaagauugcuugagcccaggagguugaggcugcagugagcugugauucugccacugcacuccagccugggcaacagaacaagacccuaucuuagaaaaaaagaaaaaaaagaaaaagggacaacuuacaacucugugcccugauguagaaccaucuccaaaauauauuaaaugagugugggauacuaugcuuauaugcgauuguguguauuuaauggcuuccuaagaaaacaaaaaaaaaccugauacuagugauugccuuggaggaggguaacugggaaauuacuuuugcaacuuuuaaaucuuauaccauguacaccugguaucuauuuuuaaaaagccauuuucaugcccuaaaugaguuuagucagaccauaguaagaaaauccuguaagacauacaaaguaugggguaauuacuggcuuuaugggaagacugauuucaaugcaaaacucucccuaugcaagggaguuguccugauuucaaugcuaagcucucuuuaggcaaguuacguuggccugauuugccuguuaagucguauggggcaggcaagucugaguguccagagggcagaccuuuaacucuuaguuuccugccuugggagaaggcacagggcuaaagugguuuccagaacgugucuguuguggugugaacaccaaggagcaguggacaagcuucccaggcucaaggucagaaggucuggacuggaguccugccucugcuacuuggugaauaugugauuuggggcagguugcuuaauccccgaagccucaacguguucaucuagaaaugaagauuacaggcuggacgcaguggcucaugccuguaaucccagcacuuugggaggcugaggcaggcagaucaucugaggucaggaguucgagaccagcuuggccaacauggcaaaaccccaucccuacuaaaaauacaaaaauuagcugggcaugguggcaggugccuguaaucccaacuacucgggaggcugaggcaggagaaucacuucaacccaggagguggagguugcagugagcugagauugugccacugcacuccagccuaggcaacagagugagacucugucucaaaaaaaaaaaagacuacaauaccuggcccaacucccucaugcuacuguagugaggcucaaaugagauagcacccaugaacacuccuguaaaccaugaaguaugcaaacaccagguguaauagaagcuguuagguaccugugaggccagcagacaagagcaagagaugcuaauuuaaaaagaauuaaggugaagcaaagaucuuuucccucugccaaauaacuuggcaagaguuguaaaauuagaaaaguagacccuuaguaguuugauaauccuuugaccucugacccugcacaaaugaucucacccuuuagaccuguucccuuauuugcaaaacaagaggggcugucugggugauuccuguggucccuuccaguuguagcguuccgugacaguguggcauuaacaguaauucccaucuuggcugagauggaugagucauacuaacugaaaagucaaaauacgaggaagaagucucuuuauguaugagaauuuuccuugagcuagagacucagagccucuuggggaggagaugagggaaaacauugccaccaccaagaagggagacgaaggauguauaaagagaauggagauguauuuacuuuuuuuuuuuuuuuuuuuuuuuugagacagagucucacucuguccuucuggcuggagugcaguggcacgaucuuggguuacugcaaucuccaccucccagguucacgccauucuccugccucagccucccaaguagcugggacacaggcgcccaccaccacgcccagcuaauuuuuuguguuuuuaguagagaugggguuucaccguuagccaggauggucuccaucuccugaccucgugauccgcccgccucggccucccaaagugcugggauuacaggcgugugccaccgcacccagccgagauuauuuacuucuuguguguucuugccaucuccauagccuccuuugcuuucaaaugcccacuugggcugggccuuuggaaaauagauuuaacccuuguuuauuggaaggauauucacacaguaggccaguuauacacuuuguggcagucguuaccucuucugugaggucuuucugugcagauuuaguggcaccuccuccaugcugccugggcuucuacuugcuucucaucacuuugucucauaacucagaucagagacugugucuuacucaucuuuguaucccuggcaucugagggggugguaucugauggguagauggauuagugauccacuuaggguauuuacacuaaucuuguugaucuugacuacuaccuuuauaaccaccaccauucuacaaguuuuaacuuuuuuuuuuuuuugagacagaguuuugcucuugucacccaggcuggagugcaauggcgcgaucuuggcucacugcaaccucugccuccccggguucaagcgauucuccugccucagccucccgaguagcugggacuacaggcacccgccaccaugccuggcuaauuuuuuuguauuuuuaguagagacgggguuucaccguguuagccaggauggucucaaucuccugauccugugauccaccuaccucagccuccuaaagugcugggauuacaggcgugagccaccgcacccagcaaggaucuuuuuuuuuuuuuuuaaagcuaaguguuuuauacauauaauaauauuguuaauaaaauguaucuaaaauucauaccaccagcacacaaggucuccggcuagcagcaguaaauggcauuuaguacuuacuuagcccccaagccuggaugacugacuauacugacuuauuauuacuuuuagcuauuuguagguaguuacaucugaaaauugaccaggcacagugguucaugccuguaaucucagcacuuugggagaccaaggcaggaggaucaguuggggccaagaauuugagaccagcaugaguaacauagcaagaaccaucucuacaaaaaauaaaaauuaaccaggcauggugaugcaugcuacuugggaggccaaggugggaggaucacuugagccugggaauuagaagcugcagugagcuaggaaggugccacugcacuccagccugggcaacagagcaagacucuuaaucucuuuuaaaaaaaaaaucugaaaaggaccccaaggauugaacuuuaucuuuacauuuaucuuuacaaauccaggaucaaaagagaggguaaaggaucacuuggggaguuuagaaguggcagaaguaucuguagaagccuuacggugugaaugugcuggauugugugugcccacccucaugggggacuuccuuggaggaugaggguacaccagcaugggcagcaaagcuguuugaccucaagguggagaucugagccaccuggucaguccaugcccaguuaauuucuauggagguuugguaaaguagguuagggaguuggauccaauguuccugaaguuucuguugguaauauggcaggggucgggucggguguggggaggguuggaucauucuaagggcaguacaagaccuaaucccaaaggugagaaguuccucucuguggaggacagcauuuagaacucaauacauacauggcuuguucaaaaauggggaagagauuagaaaaauuuauccuaauguuugcuugucaaaccaagccauucucucagcaaaguagugaaacccuuacauaaguccuuugaagccuagcagcaguauccuacucaaacacaaaccaccaaaaaaaaaacaaaaaaaaaacaaaaccuccuuggggacucagaugugaaccucucauggaaaauucaguaccaugugcuuuuuguagcagguaggaucaccugcuguuuuggaaauuaacuuuuuuucugacaucuuuuugaccgaacucugcaugugccucuugagaaaauaauccaaauucuugcuuucuucacuuuccaguuuugcuuuaucuuugcaucaugcucugcaguuuacagacaagcauaaugggugagaguuccaguaaauuggcuggaucauauuucuuagauugagucaugacugaggaacuuguuugggaacaggaagcagcccaugaaaauggcugcacauaguaaccugccagauugaagaaaccggaccacuuucuaguggaaagauaaaagggcagaaaaaugguucuauaacucagggaaugguaaauuugugaacuaggguuuuaacuuguugaauaauacgucuuuguguguauuugggcuuuuuuaugcuguuaaaagucucuaguuauucaagauaagggaaaggaaaacuuggauucgugguaacuguugcuaccucuuaaaugucucugcugauguauacaacauguugcuaggccaguuauuuuuuuuaaggcacuguaguuacauagaaauaaaccuggcaacauuuacacuuggccucgauaggcuguaaggccccuuuugucuccaguauucuguguuucuguauuuuaaucaccuacuuuacacuuacuguagcaacacaaucaagauagcaaaucagucuaauaaaaccaaaaguacuggaaugugggaaauagaaagaaugaccuagaauucuugcugagaaaacaauugguauugcuauauucuuguaaugcagugugagagaagccagagaaguaaauaggcagauacauaucuaugaaauguaauuagucaucagcaagauguauuuuaaaaacacaucugcuuggugucauuuugcuuuaucuaauaaggauuacgacugcaaggcagagauuuguaaaugaaggagaucucuguuguuuuuguuuuguuuuugcuuuuguuuuguuuuaagacagggcuggagggcaguacaugaucauggcucacugcaaccuucaucuccugggcucaagugauccucccacaucaguuucccaaguagcugggacuacagcagugucucaccaugucuggcuaauuuuuaaauuuuuuuguagaguugaggccuguguugcccaggcuggucucaaacuccugggcucaagugauucucacaccucagccucccaaagagcugggauuacaggugugagccaccgugccuggcuguuauuuuaucaauuccucaaaauucaagcaugcccucaaauauuuuugcagccucauauagcucuuaauuugguuuauauucauccagaugguaggauaugauucauguuccaccugguuuucuucagaaauacuuagacagugucuauggaaaaaaacauugaaccagauuuagcuuuuagguaaauaauauaaucaccugggaauaauaugaagaaugaaaugaaagaaagaaaaauauaaucaaguguaacuuagacucugaaugcugguaacuaagauuuggaugaaggaaggaucucaggggaauaacauuaaaauaagauuuuuuuuaaauggaaauacaugauuuuaagaaggaauaacuuaagacauuccaacuuuauacuacaugaaaguaaaaagaucaaggaucaguuuucucuuuggagcaaggcucaguuucgcuuucuguugagaguuaguaguguguauaauuaauuuuuuuuaacaguuuauugaugaaauuuauuuuuagaaggaaaucucccaccaccuuccugucauucucagggcaagauagaggguaggagagggaagggagacucgggggaaugggaggugcaagccuuaauuagacauuugagugucuaaaagauuacuuuucauuucaaauacuuugucucaguuuacugaauagcuuuaauuuaggacagggauuguauuaucuuugcuuuaucuuuuccaauauuuuggaucaucuaagcaugauagaugcugguuuauucaaggcacuaaaauugacuugcaaaagacauauuuaauauggauucuguguucaaguccuuucuucuuuguuuauccugguacaaagauguuuguuuuaaagugguaugaguuaauuguccaacuucagauuucccuaaaauguguaacagauuacccaguuggcaaaugaugauauauauuuuuuaaacaugaauauuucuguuaggccagauggugauuuaacaugaauuguccaacauuuguguuucuuaucaaauugucuucuuuugucuaagccaagcuagcaacauaauuuggaacacacucaggaaucacuaaaggacaagagcaaaaaaaauucagacaccaaguggcagacggcauuugcuccauaugccaugcaaaggcuccuggccagugcucgcauggcccuugggaagcuuucucacccguuguaagaaaguaucugugcagugcugugcaacccaucuaccugcuuuccucucucuacccaaacccuacuuaucuaacacuuuguacuguggccuuccuccaugggggacuugcacuuccucaaagcccuggauuucugugcagaagagcaguuuuaguucuuccuuaggcacuucccuuuccuccuguccagugucauguucuuguuuguuaugggcuccacccagacgauuauuuccucuuagaugaugugugagccuugcagagagcugggucauuuguggaauaaaucaugugcccagucacacggcuccuuacaggaaaugguuggugcauauuagcuuagcacaaaauacaguagugagcuugugguccccaacagugagucuucaguuaacuucugcuguuuuuuuuuuuuuuuuuuuaacauaaagcuuugaauguuucauacaguaucaaaucucugcaggauuuugccugcugaaacagaugugaaaaucugaguagcacagaguaugacauuaaggccauaacaauaaaccuauuguugcugcauucuaaauuugaucaagaugucuguuuuugggaauccaaaauaguugcuucaaauuuagcuuuuuucuuuuaugaagcaguuuuguuuuguuuuguuuugagaccucucauagcaagaaaaaacauuacauaaacuuuuuuuugagacaaggucucacuuuguuacccaggcuggagugcaguggcacgaucuuggcucacugcagccucgaccuccugggcucaagcaguccucccaccuuagucccccacguagcugggacuacaggcacaugccaccacgcccggcuaauuuuuguauuuuuaguagagacaggguuucaccauguugcccaggcuggucucgaacuccugagcacaagcgaucugcccgccucggccucccaaagugcuaagauuauaggcgugagccaccaugccuggccacauaaauauaaacuuaaaaauacacaggaaaaccuuucagaacacuuugaaaccuauuuugguccuauuacgauugcacugaaugucccccagccuaaugaagagcaauuagaugucauuugguggcauucuugguggagacaguaagcuagggccgcaggagcugcuuagucucccaggguccagcauuguuucagguaacgugaacaggaugcucaagagcuagucuaaauaaugcuucaugucuuauuuuuccuguuuguugauaaggauucauaaagaugucuuuuucuggucaugucaagggaaauucaaauaaaaaacauugaauugguuuggagcuguccauugaaggguacucacagcaggaauugaguggcaauugaauguguguguguguauguuuguaaacauuuauauuagaguguaugcaaauguauaugggcgugcccacugccaucaccauuacccccaccaacaguaacaaaaccaccaucaagagcaauauccacuaaaacuucuaauuugcuuauuaauuugcuuuauuauuuguaaauaauucagaaucucugagaucaaaauccuuuuuuauuacaacauguuaauaguagucuaauucagaccugcccugaggaagaaccaagcaaugaagcuguccaugauuuuagaaguuaauuggcucauucuuucugaccaucuagguagucccaacauuauuuuaggcucccccuaguuagguccacaaccucauuauuauccauuggccuggacuuuggucucgcuuauacagcaaguaguagagccuaucacugucaacauguaaacauuugcauauuuuacauuuauagagagauacuuuucacgugccucauuugauccacuaacaucuguaugcuuggguaggauggaauaauuaaacaauguauagcuaaagccauccaaaccccucaaauauuaucaucugaugggaaggaaaagggggggaaaggaaauuaaauaguuauuucaauucuuggcaugauugacacugacaauuauaaauuccauucaauauuuucuuccagcucaugaggguugguuguaaggauacuuugcaagucagauuuaugagcagaagauguuugcaaccuaaauugcuucaguugcaugaaaaagucacaaccuuuuacugauuuuuauccugggaucuccuuaacaagaaaaaaccucaggcccaggaagucuagggugaggcagggaugugucaaaguacacuuuuccccacguacagggacaaguauuugaguuucuuugauugacuuugcaaagagcuuugcacacuuugcacaucacuucuugagaugggugggaacauggacugccuauuuuacagaguucaauuaagaucgcaggaucaugcauuccuuucauuuuuggugcuaguaccuagaagaugggaacauauugaacacuuaauaccuugcuugggcagauagcuccaguuugcagaaagucuagacaggauacccugcuauguaucuagauuuacugagaagaagcggcccaagcuaaucagaauuuuaaaguagguuucucagcugggcgugguggcucacaccuguaaucccagcacuuugggaggccgaggcaggcagaucacuugaggucagggguucgagaccagccuggccaacauggcgaaauccugucucuacuaaaaauagaaaaauuagccgggcaugguggcacgcaccuguaaucccagcuauucaggaggcugaggugagagaacugcuugaacccuggaggcggaaguugcagugagcugagauugugccacugcacuccagccugggcgacagagcgagacuccgucucaaaaaaaaauaaaauaaaguagguuucucuauaccuuugaauuuucugucucccaugauaaccuuuggguaaacauguccaucagaauggaaacaaaucauuuuuuaaaauagaaauuauucucauaccuauuuuagugggaaucccccugagaagauagccauguauagucgacugaaugcucugugguugcuauuuuguugcucuuggccaggaaacugaucuaggugaccuacagacuuaaucugaccugcagacuggccgcuucauacuaccaagauuccaaagccaaguguauauacagucggcccaugcagccucugguuccaugaugcaaccaauggcagauugguucaaaaauauuuggaaaaaggccaagcacaguggagugguucaugccuguaauccuagcacuuugggaagcugaggcaggaaaaucaauggagcccgggaauucaagaccagccugggcaaaauggcaagacgccaucucuacaaaaaguaauuagcugggcuugguggcaugugccuguagucccagcuacuugggaggcugaggugggaggaucacuugagcccaggugaaggcugcagugagccaugauugcaucaccacacuccagccugggugacagagugagacccuaucucaaaaugaguaaauaaauaauaaaauuucaaaaggaaaaaaguggaaaaaaaacccgaaaaaauaacaauacacacauaaaauacaguauaacaacuauuuacacagcauuuacacuuuacuagguauuguaaguaauccagggaugaguuaaaguauauaaagggauaugcauagguuauuugcagcaaaugccaugccauuuuauaauaguguaggcucauggcuaauaaagcaugaacccgacugaagcugccuggguaugugucuuuguucagccacuuucugguaguaucuuuuuucuuaaccucaguauucuuauacuguauaacaggaauguuuucucuguauaaggcuguuuugaggaauaguuucuauauguaaaguacuuagaacagugcauagcauauaggaagcccuuaauagauacuggcuuaaagauaauuagguauguccuagugagguauaccuaacuacaagugcuacuuuaacuaugccuacuuugugugcuuuacaauauauauuguucaaggcuagaauaaugagccccaugagcaggguuucauagcauuuaagauuccaacgccaaccuucaaucauggacacagguggccugugccaucuagcuagcugcgcugccuccaggcuggguggccugcuccucuguuggauaaaaauagccugacuccucacugaaacaaccaccauguuauuugcguccuugggaagcugaaaguaauagaacucuaagucuggcguugccagcugucagcagaaugaaaugcaaagugugacgugucuacacuguacccacuggccuucaagucccaacucccguucccccaucuugauuuuuuuccauucucaaauuaauuauuuccccuauaggugauuuguggaauggaaacagauuuagauuuccuaccuauuuagauuuuuccaaagacuaaaauuacaaaucagaaaaacugcuauugacacauuuuugguuaggaaaaucuggaugugguuccuaugccuagccuagucauauaaauucucuccccauguaucuuuuugugugugugaaacagggucuugucacccaagcuggagugcagugguacaaucacagcucaccauggccuugacuuccugggcucaagcaauccucucacuucagucucccuaauaguugggacuacaggcucguaucaccacgugcaacuaauuuguuuugauuuuggguagaaacaggugucacuauggugcccaggcuaguaacuccugugcuccagcaauccuccugccuuggccucccaaacuccugggauuacaggccugagucaccaagcucagccucuccucaucaaaaccauucccucuuuguaagauucuuccuaugucuuaaaacuuaauaccuuuaauccuucccuggagccauaguuuuauuuauuuauuuauuuauuuaugagacagggucucacuuuguugcccgggcuggagugcagugacacgaucauagcucacugcugccaugaccuccuggacugaagugauccuccuaccucagccuccugaguagcugggaccacaggugugcgccaccacaccaguuguuguuguuguuguuuguuuuuguuuugguagaaacagggucucuccauguugcccaggcuggucgcgaacuccugggcucaagcaauccaccugccucagccucccaaagugcugggcuuguaggcgugagccaccgcaccugucccugucugcuuuuauuuuauuuuuuuuugagauggagucuugcucuguugcccaggcuggagugcaguggugcgaucucagcugacugcaaccucugccucccagguucaagccgauucuccugccucagccuccugaguagcugggauuacaggcacguaccaccacacccggcugauuuuuguauuuuuaguagagacgugguuucaccauguuggccaggcugaucucgaacuccagaccucaggugauccacccaccuuggccucccaaagugcugggauuacaggcauauagguaagccacagagauaagaguagcaagcagugauggggagaagauaaucuaguguaggaaagauggaaagaauggugauauuucacaacugcuagauugacacuuuaacuugagaguuaucccucuauaaacuggauauuugcugagcaaaguuuaaagaaaacuccauguauucaguaauguuuuccagaccccacuucucuuauauaagccaguggcuuagagugcuugcucuaauuucuauauuccauuaaacaagggugggauuucuucucauucaaaccauuugugacuuugcccuuuagugaccucuaccaucacccuaucauuaaugauccaagugauuagaauggauggcuauguguuuguagguuguuuguugucuuuaaugaauagauucauugaauggaauuaacugugcucuucuagaacauuggaucuguguucucauuuagauuguauuuguaaucuccccacuucccaccaucaacaguggcauaaugugaauuaauuuaugugguaucugucauuuaaaaaacaugagcucucuccuuccuuuuuuugucuuaaacauaggacauggauuugauugacauacuuuggaggcaagauauagaucuuggaguaagucgagaaguauuugacuucagucagcgacggaaagaguaugagcuggaaaaacagaaaaaacuugaaaaggaaagacaagaacaacuccaaaaggagcaagagaaagccuuuuucgcucaguuacaacuagaugaagagacaggugaauuucucccaauucagccagcccagcacauccagucagaaaccaguggaucugccaacuacucccagguacagaguacucaguucuugggaaaguuauggcagguuuaaggaaacacugagcaaggaauuaaaauaucuggauuugaguuccagcuuugccuuucuuuuacuuaaccuugucaaaucuacuuuccaaccucagccuccugaugaguucaguaccuaaccugaguucaguacccaaccuauugaucuuaacaguguuauugugaggauugggaagacuuaaguuacaccaaagaguuuuguaaaguauagaaacauccuguaaggaucaaguagcagcaacagaaguaguagcaggagaaccaaguagcagggauuacuggcguuacuguguguggcaagcacuguuuuaagaacauauacugacugauuuaauuaacacaacuauauuaauuaguuaccauuaucccuguuuuaucuacgaugagcaacugaagcucacaaagguuaaauaauuugcccagaucacucagaaaauuggaggagcuaagaucugaacccauguggucuaguucaaauugugcaucaaagugaucucugaaauaagauaaauauuuacuuaacuugauuauaaauauuuuaugaacaucaauuauugaauauuuagcuuggcaauggaauauuuaaccauuuuuguuuuccuuugugucauucccuuuuaucagguugcccacauucccaaaucagaugcuuuguacuuugaugacugcaugcagcuuuuggcgcagacauucccguuuguagaugacaaugaggugagguauaaaauaaccugguuaauagaaaaacuccaucauaacuauaaaauaacaaucuauucuauguaagucccgucaaugaaucuccauuuaaaagaauaaaaacauuuuuaggaggaaauuuuuuaaccaaggaaauacucuugucaaggaaaccuuagccuauaaauaacuuuacaauuaagaaaaaaaaaaacccuucacacaauacaaaaccaaaaccauugacuauugcauagccagaaacauggacagcauaaccauggaaacaaauaacccauuugcugcaaguaucuaagagguuuggugaguaaagagccagcugggcaauaaacgaagacuuguucaguuaacaauuuuaauaaaucuguuuuaucuaguaccacugugcuagauauuauauaaacuaaauccuaaagauuguacuuacgcauuuuaaaguuuacuuucaaaugcuuaagcugaaacagaccagcaaauuauaaauuugagucagugggguaggaaaaaaagauuuguuauuuacaaacggggucaugacugguuaguaaguagagagacacagaacugcagcugauuccauuuuguuuuguaguggugccuuagagcuuacucauccccuguugguggaagacucauaaaucaaugccuuaucaauuuuagguuucuucggcuacguuucagucacuuguuccugauauucccggucacaucgagagcccagucuucauugcuacuaaucaggcucagucaccugaaacuucuguugcucagguagccccuguugauuuagacgguaugcaacaggacauugagcaaguuugggaggagcuauuauccauuccugaguuacagguaacuaaaauagaauguaauacuggagauuuuuuuuauauucagugccuuuagucauucugauuauuuauauaccaccuauuuauaggaaggauuggagggugcuauuaacuuagucaugaguacugcccaugcuaguuaaauugguuggacaucuugaggauagaauguuauaaaccugacgucugaucugggaacucugaaaauaauacauaacgcuuaggcguaaauauguauuggaaaugagaauuaucucugaauuauagauaauaaauuauagagauaagccugaagauaauguggguagggaguuuaucuaaauuuaucacguauuaucauggauuaacuuugauuuauauaguauaaacuuccuucucaugcagugucuuaauauugaaaaugacaagcugguugagacuaccaugguuccaaguccagaagccaaacugacagaaguugacaauuaucauuuuuacucaucuauacccucaauggaaaaagaaguagguaacuguaguccacauuuucuuaaugcuuuugaggauuccuucagcagcauccucuccacagaagaccccaaccaguugacagugaacucauuaaauucagaugccacagucaacacagauuuuggugaugaauuuuauucugcuuucauagcugagcccaguaucagcaacagcaugcccucaccugcuacuuuaagccauucacucucugaacuucuaaaugggcccauugauguuucugaucuaucacuuugcaaagcuuucaaccaaaaccacccugaaagcacagcagaauucaaugauucugacuccggcauuucacuaaacacaagucccaguguggcaucaccagaacacucaguggaaucuuccagcuauggagacacacuacuuggccucagugauucugaaguggaagagcuagauagugccccuggaagugucaaacagaaugguccuaaaacaccaguacauucuucuggggauaugguacaacccuugucaccaucucaggggcagagcacucacgugcaugaugcccaaugugagaacacaccagagaaagaauugccuguaaguccuggucaucggaaaaccccauucacaaaagacaaacauucaagccgcuuggaggcucaucucacaagagaugaacuuagggcaaaagcucuccauaucccauucccuguagaaaaaaucauuaaccucccuguuguugacuucaacgaaaugauguccaaagagcaguucaaugaagcucaacuugcauuaauucgggauauacguaggagggguaagaauaaaguggcugcucagaauugcagaaaaagaaaacuggaaaauauaguagaacuagagcaagauuuagaucauuugaaagaugaaaaagaaaaauugcucaaagaaaaaggagaaaaugacaaaagccuucaccuacugaaaaaacaacucagcaccuuauaucucgaaguuuucagcaugcuacgugaugaagauggaaaaccuuauucuccuagugaauacucccugcagcaaacaagagauggcaauguuuuccuuguucccaaaaguaagaagccagauguuaagaaaaacuagauuuaggaggauuugaccuuuucugagcuaguuuuuuuguacuauuauacuaaaagcuccuacugugaugugaaaugcucauacuuuauaaguaauucuaugcaaaaucauagccaaaacuaguauagaaaauaauacgaaacuuuaaaaagcauuggagugucaguauguugaaucaguaguuucacuuuaacuguaaacaauuucuuaggacaccauuugggcuaguuucuguguaaguguaaauacuacaaaaacuuauuuauacuguucuuaugucauuuguuauauucauagauuuauaugaugauaugacaucuggcuaaaaagaaauuauugcaaaacuaaccacuauguacuuuuuuauaaauacuguauggacaaaaaauggcauuuuuuauauuaaauuguuuagcucuggcaaaaaaaaaaaauuuuaagagcugguacuaauaaaggauuauuaugacuguuaaauua

SEQ ID NO: 191204 - RNA, 82809 nt, Homo sapiens
gacugcgcggccgggaggagccgagccgggcggcggcggcgggaggcuacagcgcgcgggggucucccgcguccccuccgccucgccgggagcucgcgcccucgcccagccgagcucccacccccgcuuuuuuccgaaggcgcugggcggcgccacccuccggccggagcccggcacugcacaacccccuccgacuuucaauguuccacacuccccggccagagccuccucggcuucuuuuuuucccuccccccccuucccccccccacagcugccuccauuuccuuaaggaaggguuuuuuucucucucccucccccacaccguagcggcgcgcgagcgggccgggcgggcggccgagguaaggcggcggggccggggggccgcguggggggcggccggggcggcggcggcggugggggagggggcgggggcgggcagcuuuguucgcgccgggcgcccgcgucgccgguguccgcgagccgcggcggggccggcugggcugcucgcaucacuuggcgcccggcgcggcgagcgcuacccgcggcccccgcgcggcccuccccacaaagggccgcggagcugcguggccgccgccgccggccguggcucgccuccgcgggcgcggaaauuuguugcacuucuuggggcuuuguuuauuuguuuguuuuuucucuggguuucuuauuuuuuucguuauuuuggacaaaaugucgguccgugauauaaaaauugagcgaggaaccuugguggcauugggagcuuugcagaaggugcaguuugaauucugcuuuucccaggguggcagcucggucuuggccggaugaaucuucgcugcuggccguggaaacagcuagagcagcucguuaguugauuuuuaaauuuccaaguguuguguuuaaaggcuuuacgugcacugaggaggaaucgccaccuuaaauaagcauaugggcgauuaacaggguguguuuuccucucggaaagggaauuugguagcuuugaccaaugucaguguguaaauauuuagacguuauuagugacuuuuaaacauuuuucagcgagaucuguuauuuacagugugucauauguuauuaaugcuuguugccuaaguuccuuggcaaaucuguuucaugccuucugagaaaguagacaauugauagauuguccaagagacggaaaaaaaugugaguggguuuucuaacuugaguucggcaaaucccuuaacgcuggcguugugugacacaucaccucccuuguacguaccccuguuguacgaugaaauaagugugaacacuuuugaagcuuuuucauuacaagacgauuuuagaugacuagaagaaaaugcuguugguuuauuuccuagauuuaacauuuucuccuccuccuccccuguucucuuuaaaaguuuuccaagagauaacuucaccaagauguccagugauaggcaaagguccgaugaugagagccccagcaccagcaguggcaguucagaugcggaccagcgagacccagccgcuccagagccugaagaacaagaggaaagaaaaccuucugccacccagcagaagaaaaacaccaaacucucuagcaaaaccacugcuaaguuauccacuagugcuaaaagguaauguguaaaagaaggauccagcacacuuugucagguugucuuccaggugguuggacgcuuuuguugguuuuaccucaauagcaguaguucagaaauauuuacuucauuaucaguuuaauuguacuugaaugaguugucauucuuuaggugguauguaagcaacauuacuagaauuauacuuuuaagcaaacuuaauucuguacuucgguaacuucaguuaagaguguccuugaguagagauuagacuaacauucugacagauuguuuaaggaguuggcaaggaaaauuuggugaacccaaauuagaugguacuuuggggauguuccuuuuaugagucauaaucuucuuuaaugaaauugacacuuccagagauuagcagugccucucuucaugaaacuuaaugaucagaaaugaucauauuugcuagaaaauuugcaaauucaggccuuugcuauauuugaaagcagauuuaaaauugugcugcaaaucugcuuacaguuuuacaaaacaugacuuucaaucguauaucacagguaacuuuccugguuaaauuaugauuaucccuuccugugcuugugagggcaaaucaaacugaaaaguagcccuuuacaauuugaggugucacuagugauagaaaacuugcauuguccuugggccucuucacucugaaacuuguggaugugcuugacaaguuaauacucaacagcaggagaaacauauuuaauuggauguaagugaaagaucauuuguuuccuauugauugauguuuucugauggagaaaaaaagauucugucaaugagacucuuaucagugguaguaguaguggaauauccacaaacucuaguaauuauacauaaaauguauaauguuuacagcauuaaccaauuuugacauuuuguuaauuuuuauugauaacuaaaggaaaaagaauauaaaaacugaucaaauauugcauucuguggugauucauaaauacucauauuuuucuauggauuuucacccuuauugucucaguaaugaaguauuaauaacuugauaauauuuuugaauggcagcagucuuugacauaauuuaaaauucucaauuugguauaguguugaugcggaacauauuagacacaucuaaaguuuugaaaucaucuuaaauuugaaucaaaucagagaacugcuuuucucccccuuaacucaggccuauguauuuucuccucuuucucucaauguuuauuaaauuuaagugcuguaccuaaaaucagggaaaacagaaaugguuaaauuagaaugucaaguagucuuugaaaguuuuucacaaguaaagauauuuguaaauuuuaaacuuuuuuuuugacagauaaaauauugucagaacuguuaaugugcucuugcaguagccuguuaauuuuuaccucaguaaaagucacuucaaguccuugucaaauauuccagugcuuucccuccucccuuuuugucucauuugcauauaagcuugaaaagagaauuucuuugguaaaaaguguuuugaaauagauauuauauucuuuacugaguacuaguggaugaguauuucuccaaucaaguguaaaugacuuacuuguuugcagcagcaagugagaaaaaaagcugcaaaguuucuguuaagggauuuggguuaugccucugagaacaaagaggaagcagccauguuagcauuacugaaggcagagccagccuugcauuuaacugcauggugguagagggcaguguaauucccugguuauucuguagacuauaucaaauccuuuuugucucuucucauuucacuaacagaauucagaaggagcuagcugaaauaacccuugauccuccuccuaauugcagguaagaaaugaauuuuguuguuuugguuucaaauuguggaaaaauaccaagagauugauguauugucuggauaugugugcagcagaggagacaacauuugcuucuuuacagcuuugcaagugcauuaaacaaaaauuguagaaggugaacuagauaaaauugggagaaaaaauacuuuuuagcauaaguauacauuguggauuuaugaauauacugauuuugugcuucugauauucauaugaauggugcugauuuuuguucugauguauuucuguagaggguguuuuuucagaaguauacugaagaaacuucuaaaauuuugcuaagcuuuaaaguuacugcuugugugugcaaucugaacugaccuuccacauuuagaaauugcugaaugugguguuacaaaauguaaaugcaguaaauaagcauauaguugguucuguuugauuuauucaguuacuagccuuaaggacaaauuuuaugggcuaagcuaaugguuuuaguggucguuuucuacagaaugcauuguuggaauuauuuacguuuuaagcaaauguccuaauugcuugggaacauuuuuaguaauuuuggugguuggaauauguguaugaaaagcaguaaaugaauuggaauugugggaauucauuuuaguggaacucagguagaugaauuuaagauuauugguugguauaagauacauuaaaaguagcugguugauuauuuuuucucuaauaauuuuuuucauuucauuuguauagcgcucuauucuuuuuuuaaugacuauggcuuacaaaauugaacacgcauagaaaacaauauuguagauaguuugugaagagauaugugcucaauaaugcgaguggcugcaaggaauuaggcaguuuuaugguuugauaggacaauguuuucauguuuaaccuguauuuuugcuacaaguuguauucacuugggaugaucagacccugucucugaagucugcuugugauauaauaggguauaauccaguugcuucuuauuguguauguuaacuggauccucagauaaggugauuugauccugauuuauccgaugaaugaacaguuugcuuguauuuguaauuucaguucaaacaggaaacaugaauguaaacuaauuuuaaggagauggugguaugugagaucucaaaguauuacuuaagagcuaugcuguccgguaauguagccacuugccacauguggcuauuggccucuucaguuguggcuaguccaaaaugagaugugcuauaaggguaaaauuuauacacauuggauuuuaaaaacuuaguacaacaaaaggauguauaauacugcauugacuuaaaaaaaguucauuaauauuaaaauaauauuuuggauauauuuggcuauauaaaauguuaaaauuaauuucacuuuuuuacuauguuaauauguuauuagaauauuuaaaauuacguaugugacuugcauuguauuucuauugaacagugccgcuuuagagaacaaguaaaugaaaguauuuucccuccagccuucuaaauggugugucaaaucuguagccauuuagggaggucaaguuaaauuugcucccuggaagaaucacuuaacuugcagaguguauucugauauuucccauuaugaaaaauguaaagaucuaucaauucagaacucuuaaauguuuuaaaauugcauguagggucaaacauuuuuaaagguuucuguugauugucugcaaaugaaacaaacuaauguacgugcauaaaucuagagagccuaguagacauguauuaagugcccucagagcaauagccuaguguugcaguugccaaagaaaucuacuuuacauguuuaacuccggaauguuuccucaaggucacugaggauuauuuuagagggaguagaaucuuucaaugagauaggagguuucacuugucuuucucuuuauauaccagauuucauuuaaguccuugaaauaaugcuuccucauuuagugaucagacuagugaaacaucaaaacuuugggcuuucugugaacaguaacauggaacaccucaucccugcuuucccuugucacaaccugugaugacuaucaacugcugcaaaugacaucuuucaguucucagguucuuuuaauagaugaguuuauguguggcugugguaugugaaaaacagacauacaguaugucuuaguagggaaccaggauaagugguuucuuauuauuuggaggcaguguuuuaccauaugccucacauguaaaauauccagauacuuugucuucaaauucuuguggguggaagaagaccuaguuuuuguccuugaguaggaauuggaauacugaguguuuaguaaagguguuuuagaacuuugacaaauaaaaagccugaauuuguauuguauuuuugccuucaugucagaucugugacagacugugguguuauguucuuuuaauugacaagugcguaaaugagaauuuuagcuuuacggugauuguacaguuuaaauuuauuaauuuaugcuauaauuaaaaauggaaucuauauucauaaauucuagaauaugugaauucauauugccugagaucuaugaaaccuaauacauuuggcuuucguguguaguuauuuaaucagaauuccauuacaguuuugaauaugauuuuuacaagcuugucaaaguacaugacagauuuaauucuuccucagggaagaaauguaaaguauaucuguguacauucaggaaaaaguugaaugaaacacaagaaaacucagcaaaaccaaaauuauucagacugggaugauuucucuaaaaucccuuccuguguuuuaauuaaugaaauauucuuuaauuaguauauaguuaugucuaguacauacauacccagggugaucuuaagauagauuuaauugaauuguguauggcuuuauacauguuuuaauauauuuugauagcauugauauuucuuuucccgauaguguaaaaguuugauaaugacguuauuuccagugauuugauguuauuuuaaaugguuuuagguauuggagggccaugggccauaguguacuaaacauagggauauguuuauuuauugguuucaguuuaugcuguuuacauaaaguauaaauaauuuauacaucaaugagagucaagggaaauuguguuaugggcauuucccuauuuguauuuauugagaauuguugacuagaauuguuuagugauguguuauuaagacauuuacuuuccaucuguuucccagaggguguccuuguccucuccuagucaccacuugugcaaacagcgaaaguuuagaaagguacuggauuucuaacuuaaccccuaauuucuuuccauauaggaagaagcacaaauauacugacgaauauuuuaagaguguauguucagauugaaucuauacuggagauauuuggggguauuuguauuaauaaauaguuucuugaugugggaaaggccauauugggggauauguauuacaguuucaaguuaauaguauuaauauauugacuagcaaaaccugagaucaggugauuucguugacuuucuucuuuaaaaauaaaaaaauaaugaaaucauaaaagaagcaguuguuucuaaaccaguaguugauaaucucuagauuccucauuagccuaauugucugaggauaaauucugcuuucuucugaggguugcuaccacuuuccaucauuuucuagggcggacuagaacuuugcuacuuaaaagagugagcugcugacugucagcaucugcgucacagaugagguuguuagaaaugcagacucuugcuucccccaacccccaacccagaauuugaauuuaacaagauuccuggugaauuguauauauaaguagguuugaaaagugcugguacuggagcaagacugucugguuucagauccaugcucugucacuaacuugcuauguuauuaccuuagauacauuuuggaauauuucgguucuucuccucaguuguaaaguggggauuaaaaugauaccccccuuuauaauaggguuauugugaggauuaaaugacuuaauguguuuaaguuuuguagcaguguaaaucgagucaguaaaguggccacagcaagauaaaaaugggagagacaguguagccuguagugaugugcucucacuguugcuggcauuuucucuagugcauugacaucuuauguaauuuuaucuuagucaguucaccagauaauugaguacaaguacauaacaagcaauuuguuuuuuaaugucaguaaaagcaguuccuaggaacuugcguaaaaaagaaaauuagccuaaaaacuucaggcauagaugaacaaauauuguauuccuuuuaaaggaacaugcauaagauuaaugauauuuaauucaauagagaauauuaugauuguccaguaaaguauaauaaacaauuuuuagaugaguaaugauuauauuuuccccuuuuaaaauagaagaauuugugauuuuacugugaaugggauuauaucagcaguuguaaaauucacauucuggauugcuguuaccugcauuaccuaaccccauagcauucuuuccaugucugugaacuaaggagaaauuuugaaagcuuuuuucuaauuggcguaugaaagcagguaauaauugaaauaacaugugaucccuauauuagcuuuguugguugcuuauagaguacuugguuuuaaacucucucacacauguagauagacugcuuuuucuucuuuacuuaauacauuugauuguuuuuguuuuaguguuugcuacaagauuguaucucauuaguuaucuaguccuuuuauuuucaauucuucaaaaaaaaagguccuggaacccgcuuuuuauaaaaauuaaaucuuaauuggaagcucgacuguaaaacagauaaauacagaacuacucugacaaaguauuuuucaucccauuaugccguggguggucaucuacagauaguuuguauuauuaguuuuauuguuaauaaauucauuuuggcaucagcauaaaccucaaaaaucaugaggguuuuucuggggacuugggcguuagugauaauuuuaaaugguuuaugaucaaagcaaauugacguuuuauuuuucaacaagcuaauaguuucuucaacacaacuguaauaaaguacuuuuuucaugcuguauuauaauauuugucugcuuucugcaagagcgaguguuccuugaauggagagauugucucauucauuuuuguaucuuuuccuuacuucacauggugcuuugcaugugaaggucuguuaauaaauaaauugaagucucucaaauugacauagaaauagcaauuccaggcaaaacaaugacuucagagaaaauuuauuaaauauccuauacauucuuuaccuuuuucauaauuaugauacuuaauauuuaauaaccuauucaaaguuuaccuagcuacuguuuuugcuuauaagaggaaauugauacucacaguaggccuaguuauuuccuccauacgugccaguguagcagaaauacucaguacucugugugacuggaaacauuuuccaaaagagugaccaacugaaaauaauauucuucccacuaaacuucacauuuuuauuaaggaucuauuaaguucaaugcagauaauguaauuagaagguggguaaaacagcaugugcuuuuaaaaaaaguuauauguuuacuucgcagcuacaugcucacauaaccagucauauuccucucauaaccaauuaguacuuuaugcucuccuuaaaugaguugcuguaacaacagauggauauguuuacuuuucaggaaaaucagcaagucuugcauagaguguaaggacauucagauugagaaugaagaacuuguccuuucagucucuucuucccuaucaauaugagauaaaaacauaauaaaaucacuuguaaaucuagagaaauagaaagugauuuuuuuuuccacauaccaauuuugacagguaaguauauuugggcauuuuaauuggaaucuggaagcugaaacaucuucaaacuuuuaaccuuucuuuugccuuuugaucagugguucucaacugaggcaauuuuuguccuccccuuccccagccaccaggcuaggcgacaauugguaaugcccagagauauuuuuugcuuuucauaacugaaggagaagggggcuaccacugacauuaguagguagacgucagugguacugcugaauacccuguaauacauaggacagacccccacaauaaagaauuaucugggccaaaaugucuagugcugaaguugagagacccuccuauagauauuuguuccuguacuuugccucuugaauuuuugaauaguuugcuuuugacuguuuuccugucuuauuagugaugcauccuuaauauauucaccuacaccuuccucagcugauucuucacuuccugcuacuucuaugcguaguuuacauaugucuuauauuauuugucauacguguguguuauuuuuuaugugaaaccacaggaaugacuaccuugaguacuugcuaaauuauggucuucugaggccagaaaugcuuacagcaguauuuuauuucuuuuaggucuugugccaguuaauuauaucccugcgugaucuagcuuuaggcugguuauaucuauuauguucuacuaggaguacuaaaguaacaucauggagaaauaacauuggacagucaucaaaauucaguuugacauugaauuacacacagguuagaaaugugugcucuucauuuggguuuuauuuucaucauuaugacaauacacaaguuacuucaauuuuuacaaguucacaauccuuuauuugaaacccuuggggccagauguguuucagaaugcagaaaguuucauguuuuagaaagguaguaugauguguuugugguacuuuauguaaucuguuccacaguaauguuucucgacauuacuguuuccacaccaaaaauguauuaauauucauacagguggaauaaguggaagcuacaaauaguuucaagucaguucacauuuaggguugcuaccaaauuauuuuguaacaaccuuauuaaaaaaccuuugauuuuuuuuucuuuuuuuucagaguuuugggauucuagaauuguagauaagcaguuauggcccucuauaauaguucccccuuaucuguggggaauacauuucaagacucccuaguggaugccugaaaguugagauaguauugauuauauacuguguuuuuuccuauacauacauaccuaugauacguuuacauaaggguuacaaauuaggcacagcaagagauuaacaacuucccauuggcauauccaaacugccagcaucacuacucuugggcuuuggagccauuguuaaguaaaaugaggguuguuugaaaauaagcacugcaguagucuauaaccgauuuugauaguggagucugauagccaagaccacuaccaagugacuagagcaagcuuguucuaccugcggcccuugggccaccugguggccaggaugucuuugauuguggcacaacacaaacucauaaacuuucuuaaaacaugagauuuuuuuugcgauuuuguuuguuuguuuuuuuagcucaucagcuauuguuaguguuaguguauuuuauguguggcccaagagaguucugcugcugcugcuguggcccagggaaaccaaaagauuggacacuccuggacuagagcauauacaguauggauaaacuggacaaaaguaugauucaagcccaaguggauggagcagggcaaugugagauuucaucgugcuacuuagaaugagguacgauuuaaaacuuaagaauuauuucuggaauuuuuccauuuaauauuuuuggacugugguugaccuagaguagcuggaacuguggaaaguggaacugcacagauagguagggacugcucugcuacuucuguuacgugaccaugacugaaauuacuuacuacucaugaugaaaggguauuuucauuugcuuugcuuucuuuuuuaccuguuuccuaauagcugauuuugguuucucaguuguuguuuuugguuuguuggguuuuuugucuuguaacuuguaugcuuaagaguucuuuucucuuaaggugaaacuaucagugucuacucguuuuuaaguuguucuuuguuuacuggguuguuuuuccacuuugcuuucaaauacucuuuuaaucauuccauucauucuagauacacaguauuacacagaaaggaagauaaucuuuaauucuuaaacacaaguauuaaguaauacuuaauacuuuggauguauuuugccuugcauuauuuaagugcaauuagacuauaaaaggagauguuaaauuuuucugguuguguugugauuacaaacaaaccuagaaggcucaguggcucaauguauaaagauuuauuucucacucaugugaagaccacuguggguccagggacuaucuugggcagcucuucucuguguugacuuauaucuguguaucuuguagcucugacauuuggaacauaugccucaagcaauccucccaccucagccuuccgaguagcugggacuacaggcgcaccccaccaugccugacuaacuuuuuuuuucuuuuuggagacagagucucacucuguuacccaggcuagagugaaauggcgcaaugucagcucaccgcaaccucugccucccggguucaagcaauucuccugccucagccucccgaguagcugggacuguaggcaugugccaccacacucaacuaauuuuguauuuuuuuuuuaguagagacaggguuucaccauguugaucaggcugggauuugcuuuuuccagugagucucuuuggaagaguggcugcuccacuuuacaaaacagaacuaauguucucagggcaaccuaccacauuuauauauuucauuuuaaauugaugacauuaaugaguuuuaugaaucaaauaugugccuugcaucuugucuaaaugcaguaguaaaguuaaauuguaaagccuugggauuuuuaucucuguugacauucuaucaguuuuauaaggguguauagagaaauaacaaaagcuuguuuaucacaucuguuuuggaugugcccgucgguagguggugauaaaguaauaccaauagugaggaucagcuuagggucauucaauuuguaaaaaucccaguuccuucuuuuugguccuugauguauauaauacuuguuuuaacuuuaugguuauucacaacaaaugaagcuuugaaaggaacugugguguagucugccuuuuuuggaagcuuuuggacuaguuaugccauuccaaaguuuuuuugcugcuuuaguguuccagagcaaauauacucugucauucuguuuaacuuccagcuugucuggggaaaaauaaagacaucucuaguccaaaauugcuuuugggaguauaguuccacaucuuuuggucugaaugaaaggccuagggaaacaugaauuuuguuaccuuuuuauuuuauuuuccuucacuuauaaaucaucaucaugaucccccuuuacauccaugcgucucacuuuuuauaaacacuguuuauucccuuucugaggaugguuauuuguaguuaguuuugccauuuacagucuuauagguccuuuacaaauggaucauuuucucacauuaaauucuaguaggucaagaauccauuuauucagggucccgaagagaaucgaucucagaagauuguggcuacauauuuuuuauggcuuccuauugcuuucuguagucuucuuaauuuaaacaguagcaacagcaaaauauagaggguaccauaaggcauuggcuuuaugauuuauucuugccucauacuuguuucuuaggguauugguguuauuuguuagauuugugauauauaugcuuguacuaaauuuaccugguaucacaaugagaagaaaccuggcauuugaaggcuuugaacgcaaacucagagacauguaauuuauauggaauucaauggcaguuuuaacuagugugccuuuaauuuuucuucauuuuauguuuacaccaguguccuuguaaaauuuuaaaagacauuuuucucaucuucccaggugcuuacuauccacauuuccauuagaagaugccaaauacucauuuucuucuuuugaaaacccuaaaauaagcacguugcaauuaucacuuuucccuucugccgagguuucuuaauuuuggagaacuugaaacauaugcaaaaguaaacaggcugguaugaugaacccccauauauauaaccuuuauccaguuucaguaguuaccuaaucauggcuaaucuggcuucaucuaugccuccguccauuucacccucccauuauuacauuaaaaaaaucucagacaucauuucaucuauaucuuaaaacaugcaaguauuucacuaugcacuuucaaaagauaagacuccuuuuaaccauugugacaucagcaugccuaaaaauuuucaguagcuccguaaucagucauuguuuagguuuacaaauggguguuguccuuccuuccccacaguuauuugagugaggauacaaauaaaguccaguugaccuuugaacagcauggauuugaacgaguggguucauuuauacacgacuuuuuucaauaaauguauuggaaaaauauuuagagauuuacaauuugaaagaaacuugcaggugaaugguguagccuagaaauagugaaaauauuaggaaaauauuaagaauccacaaaauauauguggauacuagucuguuuuaucauuuacugcuaugagauacacacaaaccuauuauaaaaaguuagaauuuaucaaaacuuacacagucauuuacagaccacacauggugccauuuggagucaagagaaucguuaauguaaauauuaaaucguaacugcauaaaauuaacuauaacauacuguauuacugcaguaauuuuguagccaccuccuguugcuguugcagugggcucuaguguugcaaguaucuucuuaaaacacuaugugaugcuaaucauuucuguauaaacaguucaucacuccaguaaauuguguauugcgguaaaaagugauuucuccugguucucguguguauuuuacuguguuucgugcaauacuguaaauaacaccaugggacccaugguguuaguggcacuagugaugcuggaaaugcucccaagaagcagagaaaagucaugacuuuacaagaaaaaguuguaauugcuugacauguacuguagguugagaucugcagcuguaggugccugccauuucagacaagcuuacaauauugauaaauacaguauaguacuguaaauguauuuuaucucccuuaugauuuuccuuugcuuauuuuacuauaagaauacaguauguaauacauguaacauacaaaacguuucuguuauugguaaggcuucaggucaagaauaggcuauuaaguuuuugggggcaucagaaguuauacucagguuuuuuccuuuuuuucuaaucuauaagguucucaguguugucuucauuuuugcaauuuauuuauugaagaaacugggcugaguuuccuuagagucuguuuugcuuauuggauuucugugguauaguuuaauaucuuucuucauccuuaguguuucuuguauguuugggaguuagaucaagaggcuugaucaaauucaggcuggauuuuuuuuuuuuuuucugacagcuaccacuuuuuguuuguuuguuuuguuuuaacgaaacaaaacuccuggugugcuuuucuaucaaaaggcaccuaagaucugguuguuuuucugugauguuagcagccauuggaauacagcucuaaacagaaacuuauucucaucuccuauuugguuaccuggucauacaugguaaagguaagauaugugcuuaauuuuuuugucuuaccaguuuuuucuucuuuuucaaaauaaugaguugguguccuaguauccuuuucagaaugauugucacuucauaauuguauuucaacccauuguaguacuucaguauauugcuguuaucaucuuuauagaauuucuuaauuuaaaaaaaacuucagcuuaaauugcuuugcucuaggaaaccuuagaggguaaaagucauauggaccuauuugguguauaacaaugcgaguacauacauucaacuuaaccauugcucuagguauuauuuugaaaacugaauacuuauugaagcuguuguuucaaacaugacauucuccuagccacuuccuugucaguugucagagauaauuaagucuuggcauuaggagaacugagagaucuuuauuauaacuauaggucugcuuuaaguuuugaauuaaacugaggggguaguuuaagguagaacgcaaaccuuuaucagaaucaaauuaauuugucacaauaauugaacuuaaauauuaacccuguuguuaauauacaagaagcauccuccuuuguuuaguguuucucaucaggggcaucuugguuauuuuugacuggauugugcuuugacuuggaagacauugaacauccucagacucugcugacuaaaugcuauguucuggccaccaaaaccugccucuucccccccauuuccagguaucuuggaggggaggggcugucacuuggcacuugcaaauuacuggccuagauuccacauuguagugauagcaaaucauaaugcuguaagaaaccaauuuuauauagcauuacuuugaguaauauauaauaauuuguaauaguuguguuucuuacauaaaauguauguugaccaagauacauuugugugauuuuuacugcauauguaauugucugauaugcaaaaaaaaauuucuuccucuagcccuuuaguuuuuacaccuccccgcaauucugaacccucauaguacauuugaacuuugugcaugagcuuaauguguacguaugcacacauggcucuuauaaauaugugacucuguguaucccuuugaucuuuuuauuauuaaugaauuuuuuuuuuuccacuuacagggaaacuuguguucuuaaaaggauuucuguuaccccauugccucaaacuacacuuuuuuuuuuuacccuucuaaucucucuucaauuauuuaaccucuuuccuuuucuaagagauuuuuuuaagcucauuuaauucuuucaucuuuuucuacuuauuauccacuauccagcuucccauuuaucuaucucuauuuauuuuuuuucuguccacuuuugugucuuauauuucuuucauauuuuuguuaucuggcuuuuccucuuucauuuuauuuuagaaaggucauuugguaauacuagcuguuaguauuuuuucauaugacuuauucuguuucuuuuuuguuuuguaugcgcauguucucuucaguuucaucuucuuuccugauguacuugaaaugugucuucuuucucccacucuccuuaguauuuaguauuucuucauguaugugauauauauucuuuuuucacccuuguguuguuuaucccuucucaucuccccuaggcucucaugccacauuguaucacagcugcuuuuuggugauggauuucccuuagaauccuagugguugucuaucaaaaguaccugcauuuagcucucuuaauuuaucuuuauuuuuaucuuaucuuuauuuuuucuuccauuauguagaaaagucuuauguuguagcaaaaguauuguuuccuauuaccugaguaaaaguuggguuuucuagauucugcaucuuuguuuacaucucucguugccuaggauggcuuucauccuucaagugguagugaucuuuuaaagccuauuucagauguuacaucuuuuugugaagcccuuccugcacauaucucuuuugagagacauuuguacuacuaauauuuaauucacugguauugccucuugucauguacccuuucaucccagcugaaccgggcacuaggacuggguauagcucuuauauuucuuuauauuuucaucucgguaaaaugccguagcacuaacuaugagaauaauuuuaauuaacuuaguugaaaguaguucugaaacuugccagacucaaaguguagagcacaacagcaacugugcuugaccguacuccuugguuuacaucuauugucuugacaaaaauauuaauagcauuuccuuucacuuuuagaaauacucgaguuuguaugauaaauuuuagguucacuuuacccucaugcuauaaauuggugguguucugguuggacuuggugaaucaggagauuguauaaucaacaauuacccaaagcagagauucugauuuaguaggccaaggguggccuacuaaaugugcauuuuaagaaggcaugucuaaggauucagguaguagugugagaagcaguacucuguuucugguacugaggcuaauggucuuaguugggauaaggagaguggggaaggggcagggggagaugaugaaauucauuuauccucugugaugcuauggaagaacaauuaagaucauguuuccuacuugauuuuaguugcuagucauuucuuaaucuaagcacccccuauaauuuaccuaugucaucaugcaaaaucaccauugguaauaaugugggggcgggggaagucuauacaagaauauuaaggcccugugcgugagcaugucuauaguuaaagacuuaaugagaaagcaucaaauuguggugcaaacagcugaaaguagaaguaaaucagaacguaauaagaugcaacuuuggaggagcucaaagcaacagauacguuuuuauccaaaaaggaguaaaacaaaaaaaucgucaacggcaguuccuucagauaaucaacagaugauucauuugaaaaccauaauuaacuagguuguuuguaaaauaacuuuuuucaauuuauacuuuuuaauguuuauuaaauuacuuuucucuauagauaugcagauaagauguuuuaaauguguaagugguauaaaugucccaugugucuuuuauucuagagcauaagaaaagaugggaagcuaccucaaacuuguuuugaggcaaauguaguaugaaucccuaaacauaacaccaguacugcuaaaugacaguuaucuaaucucacugaugaacaagaauaugaaaauuauaaaaggucgaauuuauuuauuaugauaagagaauaauaccccuccacaaaggguauuacaugaccgcaaagaauggcaguuccuaguacucugacguuccacaguaggcuaaagaagaaaaacugaacauuucaagaaauaccacaauaccaaaaaaagcauuugguauaguuuaucuccucaccaguugugagccuuuugguuguuuccaccuuuuggguacugugaauaguguugcugugaaggauucacaaauacacaucuguuugaauacgugguuuuauuucuucacuguauauuccuaggaguggaauugcugugucauaugauaauuucucugucuuugugaggaaacauugaacugcuuuucacaaaagcuguaccauuuuacuuucccagcggcguaugaggguuccaauuuguccacauccuugccauacuuauuuuuuguuuuuuuucauuauaggcacccucccgcccuccaccccucccaaaaaaaaagaaaaccaaaauauaaaacagaccuuguuguacaucaaggacauccacaugacucagauaaagggcuuuggacuuagacaaauggaaguucaagucuuggcuuuacaauugaguaacuguaaaagcuugagcaaguuaucuccucugauucucagaaaugugaauaauaccuguuucaucauucuuaaguguuuuagauauuauguaacugguauauuuuacauauaaugauauaaaaagcaguuauauggacaaauaaacaggcauguuuaugaaagaacauuuugaaaaaugaaguauuaaaaccaguuguaauaacaagauauacuuuugaaagugguucuggcccacaaauagcaaugaucagugauacagaauaaagaauauuaauacaguuuggugauuguuuuguguuuccagcugccuuuugcaauuuuuguucuuggcauuuaacccaauuucuagauguauuagauacauacauauuuauaguuuuaaaguuuuguucacuagguguucagaauaagacucacuguauuauaaaacaaacaccucuuuaaaaaaucuauuaaaguagcuuucuacaacaugggguuaagauuauuaagugacauugggauacaugaauagugauuuaaaaaacuguuaaucacaacuucuauaaucuaaacauaagauggaugaaaaucuuacauuuuguaaaggguuaagcuauuggaaaacuuugcaaauaggcauauauauuacugguugaaucuaaaauguuaacacuguacaacuccaggggguaccauucauacuguacucuguauucagcauagcacagcacagaguaaguauaguauaaaugguauccccugaguuguauagugugguggccaggauuagaccuuaaagaauaaccuuuuuuuuuuuuuuuugagacagagucucgcucugucgcccaggcugcagugcaguggcuugaucucagcucacugcaagcucugucucccggguucacgccauucuccugccucagccuccugaguagcugggacuacaggcgcccaccaccacaccugacuaauuuuuuguauuuuuaguagagaugggguuucaccguguuagccaggauggucucgaucuccugaucgugugauccgaccaccucgggcuuccaaagugagaguaacuuuuuaaauucauaagcaaaaucguaaaggcauugauugaaacuguuacguaaaguaagaauucuugugcuuugaaaaggaacaaaauuuuaagcacauuagcauuugauguguguuuaaaauauuugcaucaacauuacaaauaauguauguugugcaucaucaacucauaucaguaaugaagauauuaagauuuacugugaugagauggagaauaugacacacugacucuuaaagaggcaaaaauuggaaacaacuugggacaauuugcauuacuuggacucuuucagaaaccuguugaaaguuuugaaccacuacuucagaagaaugcuuaagaauuuuugguuuucuguacuccagaguuccuuuaaagcucuaguguuuuagaaacaugaguuacuacauuuaauguaaauuagagugaggaaaugaaaugagguaaaauaugucacuuaaucaggaaagagaggugggagagaaauacagaguagccuccagaaaguugagagcuuggauuucgaaaguagaauuuucgagcuucuuaaauggcuggggaaaagaaacauacaauuauguuuugccuugagucccagaaguccuccaccccccacacccccaacugugaauguagagggugggacaucaagaaguggaaauacaacaaaagagacaauuuggagaagggauggauugauacagcaccagauaaguagguuugcuuaagcauaagagaaggaauaggcagaaaagugaagaaaaaaauaaaggagauuaggagccugaaauggccuaagagcccugucaaaacugaagguaaggauucuuacauguaaaggccauaggaaaucuuuacaggguauugaaaagaggagcugggauuucgaaggugacagauuagcauauaaccaguuguggugguuauagagacuuggguaacaaauuggggagggcggagagaaagagaacaagcuggaugcaguucaccuuucauaucuguuaauauacuguuuucaaguauggaugaggggauuuuaaauuuuuauuauuuuuuaaucaucuaaaauggcaagacugucuuuacuauuaaguauuuguugacgaaaagaaauguguuuguacaugucuuugcuuuaauaauggaaguuuacaaagaaguuguaguuuuccagcuguugcauauggagauugaagggcuugaauaucccaagcagcagacaguacaguaucauagaagccuaguuggcauuagcuagaaauacauauggccuuccacaccuagcauuugcuggcaaaugaaauaguagggaugagguugacuuuauggcuggccuacugaucacaucuggaauguuuuaauggauuucuuuuuuuacugaaaauguaugcauaucacuuguuggcugcauaagaguacuaguacacaauuaacaauauaaugcccuuugaucuaguuucauguuuaaucuauauuauucauuaauguuuauuuucuguugcucacugcguuagguaaggcauccuaagagguuguaugaaaaaguauagaaggauaaaguacauagagaauguuuaagcuggcagauaccuaucaauucacaauacuuuuuuugaagacaaacuuaggaaugauuacgaacgaagaaaacccucuaaauucauagauuugauugccaugauuuacaacagugcuuuccaauaaaaauguaaugcauaccacguauguaauuuucaguuuucuaguagccacauuagaauuuaaaacaaaggaaaugaauuuuaagauuuuuaaacucaaauaugaaaaauuacuaauguaauauaaaaauuaaugagauauuucauaauuuuuuuguacaguguuuuugaaauguaguguuaaaauauacaccaccuuuuaaggacuuaaaauagccacagguagcuaguggcuacuguauuagcagagauuuacaauugcugcucuguguucuuucacuuaucuucgauuaucuuuuguucccucuuaccucuuuuuauugugcauagauuucaagaacuggggcacaccccaguuugugaaaagauggacaaccuuucuuggcuagagauaacuagaugugaaaggucugaaagaaaacucaacacccgguacaaaaaugcaggcuucuuuucaaggguuuuuguuuugaaacacaucucucugcccaugugucuuuguuguugguaucuuauguaguacaugugugcuuuuuguuuugagagagucucucuguuccuuuugagaauggaguguauguccugaacaucacuuuugugacaggaaguauaauauaugugccuuaauuaguauucccagauagaggaguuuauuuaguaaggagcuuauauuagccuaaauauauuuucauugguguucugagaugaaguguuauuuguuaugaguuuaauuuuuuuauauuaacagcguuuaagcaaacaugagcuaauaauguauuucuaacugcuuuaucacauuauagacaaucuugccauuagcaguacucauguuucagaugaccucuaaugagcaaauaugguauucucacuugagacauuucuagaaguacuuuguaaauaacuuuaaaucaaauuauuuaugucuacuuuugaagaacuuccaggggggaugacgcugucucaagauuuaaaaacaaucuaauuacaguuggacuuuauuugauauaaauuaagauguaguuaguuucuggauuuuuggauugugauuuuacucaguaccugaaugucauaagucaguuugcugguuuugaacacugaauuugaauauuauaaaacuuuauaaaacaaaauuuauuuguuugcacauaguacacuguggaaccagacuguauuuucuaagacuccuagccauggacauuuuuauugccguuuacuuuuuccuuauaugaugaauuguuacaaguaucacuuaauugcagcuauacaugcccauuugaauaugauuucaaaugcauuacuuguucagugugguagguacuauucuagguaauuuacauguauuguugauauuucugcauucucucaggaagauguuacuaucuuuuuagaaaugagaagaauaaauucuucagaaauuauauaacuagucuaaagacagacuaauaaaugauggaagcaagauucaguuuuaggucugucugacugaaggucaugcucuucaucacacugccugcaucaggugugaaugugugugugggaaggucuuggagaggcugggguggagaguuaagaaauaucuaauacugugaaguuaaauuuaaucaguacagcauaauacuuugcuuuucucuucacuuucucuguauuacacagaguuugaaauuaauugacucaaagcaacuuucagaaauuauaauuuuuagaguugaaaccaauggugcaguguguaguaguucuaguuguaaaacuugauaacauaauguuaauauuuuaaauuucuuauuuguaugcaaaaaauuaccugauuagcuguagcuuaagaaacaauacagcugagugugguggcucgcaccuguaaucccagcacuuugggaggcugaggagggcagaucacgaggucaagagaucgggaccauccuggccagcauggugaaaccccgucucuacuaaaaauacaaaaauuagcugggccuggugguaugcaccuguagucucagcuacucgggaggcugaggcaggagaaucacuugaaacauggaggcggagguugcagugagccgagauugugccaccgcaccccagucuggcgaagagcgagacuccaucucaaaaaaaaaaaagaauugcguuaaguaacuuuugauuugggacuaaauauguuuaauacaaggaauacuugucaguuuauguauauguccuuugcacaugcuuacagcauguuucuuuuuaagaaggcuaaggcaucauagccuccuauauugugaaaaaaguaauauauauauacguaguaggugacaacuaaggccuuuauuguuucuuggccuuuugccaaauguaauuuugaaugcuaguguuuguaugauaaaucuucagacagacaaugucuuacgaagaaaauauuuuggaaggauuuuaaguaaaacccaaaacuuuuauuugcauauacuugcauacugucagccuauaagacaaacucagcacuguguguaaguuacuuuuaaaaauugacuuugaaugccuguaucagaacuuauuugguugcagcggcauacaacucaaaccaaaccagcuuaaguaaaacauaaauuuguuggcucacauaacugauaaagucagaguagauuuggcauuuggcaugcugucagcaucugauuuaccuuuccauuugcuugcuuuccuuccucuuaguugacuccaugauuagacagacuuucuccuugugaucauaagauaacugauaguaccucccagcuguguucuucagauugagaugcagugugaaauagcgugaaucuuggccccaguuuuuucaucagaagucuaaugcauuucauuaacuccagcugaguauauuauauccauaugguucaugccuaggccacugcucuauccccaggauaggaauggcauuaauuccauuggaagcauguagacugugagaaggggugcaaaggugaacuggguuaccacaaguuaaguaaaugaagcugaugcugaguagcaaaauuaguauguaucuuuuuggacugauaggcauuaucuauuucuccauaguccuuaccucuuccuauuaugaugguucacuuaacuaauuuauauuaccuguguggcaccuuacugacauuuggguuugauucuucugguuuauaauuuccuguuaucuauugaauaauuuguuacgguuauauaguuauauauuuuuucuauuuaacagaccuacauuuuuagcuuuaaucuuuuguauauguauuuaauauuuuugugaaucugaaguuaccuuuguuugaguugugaaauggcaaggauguuuauaaagggucagguuaauuaguuuuucaaauggcuuuaccaaacacagguuuauguguugguuaaagcucagcugguagucuugaacugcuucuggcaauuucuuagaagaggcuguagcccagauuuuggcucauguguauaauuauagcuaagccaagagcugcugauguaaacaccaguuuaugggcuaaggacugggaggcugucauaguuggaaccaaggagguccaagccuaguccuucugaagaacagaauugggaggcauuuccagagucucuuacucugacagcaaggcagaacuggagaggguaaggaggcagaagucuguagggucagaauucguaucaccaggauaaaauaaacagugagagcuagaauugagcacaaauaguacagaaaaaauuccccagucaagauucccuugagcuggcauuagguuuaaggccauagaguuugcuuaaauagacauacuuucacuuguuuuaaaguaaaggcacaccucccuguucaauguauaugcauucuguucauauuguuugugauuucagauuuuuguugccuuccaccuuuugccguuccagauuccaugaaggauacuacuucuggaucuaggauggccagauaaaauacaagauaccuaauuaaaauugaauuucaaauaaacaauaauuuuuauaaguaugucccaaauguacauggagcacacuuauaugcauguuaaauauuaggaacaugcuaaauauuucucguuuagcugaaauucaaauuuaacugaguaguuucuguuuuucuguaauuaaacuuuugauuuugagauaauuauagauucauaugugguuguaagaaagcagagagauuuuuucuauauuuuuauuugcuaaauuugacaacccucucuggguccuuucaucauaaagcaacccaaccuccaaacauuuguguuuugcaaauaguaaauauuaguuagaaacccuuuggauccucugauacuucagagaagacugacuuuugaaagaucaguuuuuaaaguaagauacuacuaaaauuacuuaaacauuuucaauuucucagaguaaaauuacuuuaaaagccaugcagaauuuauaauaccuaacaaucuaauauuucuagcaagauacugcauuggaaauguuaggaaacaaauaauuuagcuugaggcaucucugagcagguaauauuuugaaccauucagucucaggucucuuucaucucccaguccuucaaaguucuuccaccuccuuugaccuaaauuuaaucauuuuuuuuuccaguagucuguggugacuuuauuagugauuucauaacuaugggauuacaauuuggauaaaucagaucuuaaugcccacugccccuuugaguaagcugagagaaagaagugacccugcagguuuucagaauuuuugagccuaauuaaaauagcuugcuaccuuauccuuuucccucaucuguacaguagguaguauggccuggggagaaagaaggcuagcguguuuuccacgcaauuacuuagcccuacauguugcucccuauugauaaucagaccuugugaguacuuucaucauuuuauaaauauaagagaguagacuggacuccggaaaagaagagaaaguggagauaaguaaaacugugaacuaaguauaauuguuuuuuuuuuuuuucuuucuuuauacuuggaaauaccugggcaaauagcuauagaacauuguucucuaaugagauggaaauuggagcuggaaccauuugaccuuccauugguugaacuuuggucuccagaguuaccauccuggaaggggcagugugucaauguauucuuucugccaagacuguggagggggcccaacagugaauggaggccaguagagccaaaggugcugcugcagguuucugucuacacuagugcuggacaggagaacuuuccacaaugguagaagggcuugauaucugccacaugugggaaaucgaacacuucaaauauggcuagugugaauaagaaacugaauuuauaauucaauuuuaauuauuuuaaauguauaaauagccacagcuaacauuuaaugaagucuugaacccuuaucaaggaagguuucuacaggaaaaguuuguuaauccuuauucuucaagcauccacugaaauuaaagccaaacaaauacaguacuuuguauucugaauugucuuuuuaaucuggcuuuuaaaaaaguaggacuugaaaaguauugagauuuaaucaguuuaaaguugggccugggugauaaaaauaagcaguugugacauuaugggaucucugcgguauagacaaauaugauggguaugccaaucaggcauauguuauuuugcuuaugauguuuuguuucuucugcaugaggauuggauggaagcugugcaaauaauucugcuaauauuuauugaccaauuacuauguggcaggcaauaguguaagucucaaagcagccuuaugaauguuauccucauuuugaggugagaaaacugagguacagagagaaguucuuccgaggaucacaugguugguaaaaggugaaagcaagauuugaaaucaggcagucuggcuccagaguucaugcucuuaacugccacacugcacuagucuuguaaauuguucuuaaaguggucauagaugcuucguaugugcauuucuaguucuggcugagguccaacuggauauauacagcaguccugacuggguaagggaauguuucccuguuccaagccaugcucagggcagcauuaggggcagccccagguucuagcagagagaggaauuaggccuggcuguggcggagucucuaguggugagaggaggauggaggauuuccuuaguggacuaguuaaagggaacgucagugggaaugcuuagagcaggucagagagcacugggugugccuaagucagguauguaucccacaagcaaauguuaaacaguuauugagagugaugguuuaauuucuuuagagcuaagcuugaaauaauuuuguagacagugaccgugauucucuguugcagucuuugacaaagucagucuugcaguaugugcuuuuuuuuuuuuuuuuaucagacuaggguauaauuuguuuuauuuuucaugggaauguaaaauuaguugaaugaaacaucauuggaucuugaugcauuaaauauuauagcagugcuaaggauacuuauucuaaaacaacauaaacagauaaccauuuguauaaaaucguuaaaagguaaagaaguaguuauuucuucuagccaguucuucuacauuuugucacuuguccuucuccuuuagaauguucuaucuagucccagauuuucuuccuuaguaauuguuaauguaaugcuagagugauguuuuccccaggucuguaauauuuuugaugcuaagagauuggacacauuauaaaacaaauaacugaaaaucagugaccuuuuauacuauuuaucuauaaaaccaacuuugaauuacuaaauuaucuuaccauuuuuguuuauuuuggcauauacaccaaaauaaaaaaugcaguuuuuacccauucacaugcaguucuuacccauucuugauuacaguaauguuuuacuaaccagaaacaaaguaagauggaaguccaccacauacuacuacuccuaccauaaugguguaauaauuggaaaauauauauuuauacuaggcuuuauuuauacuaggcuuuauuauuuuauuuuauuaauuaugguucucuauauaguucuuuuuuguucagauaaccaaauauauuucaguauacaccaaaauaaacacuucacugcuugaggucagugaacauacuauuuucuuuauuuuaguguuuguuuuucuaacuucuacuuaagugauaauugugacaauuucuucugacucccguacuguaaaguacaagcuaagacuaauuccuuuaugaaauguaaaauguacuauuuuauggauuuguugauaacuagaauguaaguuuguauuaauaaagugcacuggcacuuagcuauauacuuuauaaaugcuuuuucuauuauuaauguauagccuauuuuucuugauaagcuaacuuuuccaguuuuuuaauacuuuuuuuacucuucauuuauucuucucaaguguauuuguauuuugauauuuuaaauacuauuucugcuuuguuuuaugcuacccagauaugugguugcaaguaugaacagauucuagucacaugcaguuuuuacccauucuugauugcaggaauguuuuacuaaccagaaacaaaguaagaugaaaguccaccacauacuacuacuccuaccauaaugguguaauaauuggaaaauauguauuuguacuagcuuuauuauuuuauauuauuaauugugguucucuauaguucuuuuucauucagauaaaucaguaggcuuaauuucaggugugucagcuaguuacaggguuaauauguuacuaugauacuauuucuugucagucauauucuguauuuucaauacagauuauuuuuuugggaaggauuauuuuuuugaggucgucacuuuagcugguaagaguaguggguguacaagucgcgcucuuauugcagcuggcagcaugucagucuuauaaucugaagaguagugguugauauucuuagcuguagaagaaaucagggaaaucaaagggauauuugcauauuuauagauucugccuauccuccugaaucuguguucucuaauguaagaaagaugaucugaguuucacagguagauauaaaaggaaaauaguagauagcagaauuuuuccaaaugucaucuuauacuuuacuuuuucuacauuuguauaaacaguguuuucuggugggacuucagaauaacuaaaacagccugugacugauacaaucaauuuaggggcaaaaauguuugcuaagaagaggucugauguuauagaauguugaaaauauuuaccuccuguugucauauccuccucuuuuuuuuuuuuuuacauuuugcauggauguguuuauuggcaacauucaaaucugccucagacuuuuaugcgugcuuugaguaccucuuugaaaaaaugaaccuacugauuucuuuacuagugagugucuugaauuaaaacuuccugcugaaggcuugccagcuucaacuucgcaucauacaacagccagagcuuucacagacuuaucuaauauaagcccuucacuuaauaaaauuaaagagagacuaggugacuugagcacagggucuugacuuuuuuuuuuuuaauuaguuagagccagaacaacaauucagauuucuaggcuucaguccugucuuaaucuguuuuguguuguuguaauggaaugccugagacaguaauuuauaauggacaaaauuauuugacucauguuauggaggcuagaaaauccaauaucagggugcuggcaggaccuucuuucuaggaugcugcuuaucccauggcagaguucaagagagagaggugauggggagaaaacgggggugauaaggagguagggagagauaacugcacacaagggcaaaagggggccaaacucagucuuuuauaauuaacucacucuaggguggagcucccgcagcccaguuaccucucagagguucuacuuccuaauacugucacaguggcagucaaaucucagccugaguuuuggaggggacauucaacccauauaacaaguccaguacucuucccagugcaccuaaaucaaaacuaagucaaaaauuuuuuaagaaaaauaaugcacuggcugcacaggaacgaugguauagaagugccauuuuaacuguuaguugcuagguaaugucuuucuauucuuuaacuuccagcuuaaugccagccuugugugagcuguaacaauuuaaucauucagguccucuggcaaguaguguuauagaaauuggaucauaccauuauuuguuguuuuuauuuuggcuuuuaaaaugaaugaaccauguguccuccuuuuaagugauuuuaggaagagcaaaugauaaggauggacuguaacauuuuuuccaguuacuuaauuucacuuuaagaauagugauuuuuauuuguuuuaaaauuuccugagugaggguuguuaggcaaaauggacuccauagaguguaucauauuuuccugucacuuuagugucucagaauuaaaccaucauuuuauguggaagcauagcuccgcuuugcucuacugcaagguagagugcucaguuauuagguuggaaggaaacaaguuaauugauguuuucuuuugagagagggcaauaugaucagucagcaacuccagguuuuugucacuugugaugacauuuuuuaauaguauucauguuccuuucuugcgucaacacuuacuacauuaacaacacugauuaguuucaguaaauguacauguauaacaaaguauacauguacuaguauauacuguaaauuuucaaauauaacugaagcaaauauuuugucuuaugcaguugacaggguauugguuaguuacaguugucauuugaaucagugcugucuuauuuacauuauuuucuagauaguuugcuauguauuuuagguacuuuaauagcucuuuaaauuaaagaaugucaagggauguguguggcuagguggguguacacacacacauacaugaggucgcucauggauucagguuugugaguguaauugauuuuaagucauuuauuugacaaccacacauugucacauaagcacacaagagguuuaacauguaauggccacaaaguaaucucuuuguuaucuaugaagccgguuuggaaugucugacugaguaaaaugagugcaguauauucuguguaaacuaauaguucaaaauauacauauacccauaucccuaguuguuaguuauacagauauuuaguuguaauuacaaucuagguuuugaauuaugguguuaaaccauuugguggcaucacacauuagacuaaaguuuuauuaucuaacccauguauaggcaugaauuuagagauacuaacaaguauugguauuucucauauugaauauuuauggagccccuacuauguguuagacauugcuugguauuuagaauauaccaguggacaaagucaggccuuguccacucccauauaguccuuccuaacaagggaucaggaagacaugcacauuaauuuuuuuauuuuuuacaugggagucucauuauguuucucaggcuggccuugaauuccuggacucaaguaauccucccaccucagcuucccgaguagcugggacuacagucaugcaccaccuuggcugacuacauuaauuuuuuuaaauugcaaauauguuaauugcaacaaaggaaaaauacugaguguuaugauagugaaccauaggaguuguguuaucuauugcuacuuaacaaauuaccccacaauuuaguggcuuuaaauggaaaacauuauuauuucauacuuucuguaagacaagaguuugggagaggaguagcugcuagcugggugguucugguucagggucuuccaugaaauugcaguuaagguaucagcaggcuguagcugucugaagacuugaugagauuggaagaucuauuuucaagguggcucacucacauaaaaagcuguuggcagaaggucucaguuccucacuggcuguuggcaaauggcccuaguuucuugacuuguuggccuaccuguaggcugcuuaaguguucucauaaaagggcaguuaacuuccucuagaguaagugaccugagggagggaaggaugacauuuccauguaaccuggacuucuauaaaccugaugacuggguuucaagagcgaauauucugaagcaggggaagugggaagaagagagggagcucauggguguguauaugugugcagcagaugaaauccucauuacuuuuuuugaccuaggcuuggaauucauacagcaucacuucugcugcuuuuguuggagguaaucagaaaguuccacccaaauucaaagggagcagaaauagaccaugccucuucauggaggaauggccagguucugaaaaagcauuuggaccaauauuauucauguggucauuuuuggaaaauacaguuugcuacagaagggagagcaagagcagaugcuggaagaucaguaacaugcuucuaauagucuaggaaggauuugaugguaguggaaguggagguuguaagaaguagauaauacaaaaggugugccgaaguauggauagcaucuguugauugaaaagauguggauggugaaggagauguauaugucagggaugaugcccauguuucugacguaaguauuaaaugcagugccauauucggagauaggaaauccuggaggguguaaagauggaaguuuuaguuuuuguuuucaaugguugugguuguggugggugggggaacauuuuaaguucauuucugaacaaagugaguuugaguuacuuaagggauauucaguggaaauggaguguugcuaguuggcuacauuucauucugauacaacucagagaagcagccuggguuggaaauuauuugaguauuuuagguguauagauggcaguauguaucaauaaaguucacuuaggugaguguaaacggagaggaugaaaagaggggaaaaaagcuuugagaagaguuaacuuuuaaugauugauuagggaaggcuaaggucaacuuucagugauugauuagagagggcuacaugagcaagcaaggcugagaaggacuaaccugagagauuggaagaaaacaaagagguuguaugucauggaaaccugagguagaaaguauuucauaggugugccagguaaguugaggacuggauaaucuuuauugauuguugucucuuggaggugacuucagcagagcuguuuuauuauuuuuuaaauuuuuauugauauaguuauacauguuuuugagauacaugugauauaugauaccuuuauaugauguauaaugaucaaauggggauaauugggauauccaucaucucaaacauuuaucuuuauguugguagcauuacagaucuucucuucgagcuacuuugaaauauauaauaaauuauuaacuauaauuucccacuguauuauugaaguggaagugaagucaauuuagaauggugugaaaagugagugggaaggaagagaacggugaugccugaugaagcagcccuuaagauguguggucaagcaggcauuagagacugaggucaauagcugcaaagaaaaacgaaguacagaguuguuuuuuucuuaauuaauauuuuuuucccuuuuaagauggaagggguucacaacuuuuauaugcuuaugguaaggaucugggagacaacaaaaaggguggaauccuauacaugugaauuuaguauaaaauucaggacaugcaaaaacauauuuaaaaauugaaacagcauuuauggcccaauauuuuaagccuacauauagucacauuaggacauuuuaaaaugagggcuuuaucacauagcuuauauguguucuuugugaacuaaauuggugacuugcauuuuuuuuauuuuaauacaucuagaacauuuugucaauaacuacaguguuuacugagacaaaguagggauagaugauaguacuuaaugauuuuugcaauaaagacuaacaaaaacaaaaagacuacuuauuaaaaagaccaaguggugaaauaaaugauaaaaguauaaucuggaggaaaugcaguauuaaaagacagugucagaauucuuggaaaaaugaacaguuuucauuauaugauaaagguaagaugauuuuuuacuuuaaauuuuuuauaauaacagauaaggauggaauaaaagcaaguuaauugguuuuaggaagucacuaggaaaaaucgacauuuaaaaaauaaauaccacaaauuccaucaaaggugaaugguaagagaaaaucuuaaaagaaugcacagaagccuggacuggaguauaaucacuaaaaugauuacaugguccuuguuccauauacuagagaugauacccacaaaacuuaagucacuaguucagcaauuuauagcuaacuaugcugcaagugcccaaacuagaaacuggguacucuucucaccagcaaauguuguuucuguuauauaguaccauggagcauguuagagcaaugagaaugaguccagaguaauuagccaugaagauuaaaauuuguucaauucaacuagcuuuauaaaguuauaggaaauuuuagaaagauaaaauaaccacaugcuacuucuggcauucauauggcagaccuugaaauaaauacuagugaacaauguagugggcccgguuucaaauaacugaauuuuaacccugaaucugccacugauuucacuuugugagccugggcaagacacuaaccuuuaccuucuuuauaccuuuuugggguuuaaauuuuuuuuuuuaaauuuuuuaguacagacaggaucucacuguguaguccaggcuggucuugaucuccuggguucaagcgauccugcuuccuuggccucccaaagugcuaggauuacaggcaugagccaccaugcuuggcuaauaccuuuuugucuuuaucaauaaaaaugacaggguuggagucagagcuauaaaaaaacucaaauuuauugucaccaacuauguggcaggucguaucauuuucuuaauauuucuuauuuaauauguaacacccuaugaggcugcuuaugucagacucauuuuacaguuuagccuagauaacuugacaauuaccuggcuuauaaguaauggagguagaaucccagcucaagucuguugacccccaaacugauucuuuuugcaaagcauuaguguuucccaaaccuuaguuuuguacagcuuuaacaacugucgcccuaucagucucacgacuauuaugauuuacuagaaauuuuucuuuaaauguguauucauauauuuuacuuaaauauauuucagaaggaaacugcuugauaaauaagaacaaaacuuaacaaaaaauugguaugaaagucugaaaagauaaggaacucuuucuccccucaugggcagugggguggauauauaugaaagauaggaaggaccaagggcccagagagagggaaccucuuuaaguuagaagccagagccuggaaaugccauaacuguucuaagaauugugcuugaaacuggcaauuugaucccaucugauugagaacuuuauaucacagacagaguagggagagugaggagcagcuggauuugauuuaaaagagaaaacuggagguggagacagaauugggccaggaaugcaaccuguguuauagaagggccugagacugauagaacauucccugagaguggggagaagguuaaagccugaaggaaggacauagggaucgggaguauggaagaaucacaggggcuggaaguuuacauuaaagugggauacaguggucaagacuccuggaaauagaugugugcagguaaaggcugagguccaggaggggccagugggacgaguuuagagcagaaccaguaaagggggcucagaaaugaagccuuagggaugguugcgucugagguugggaugguaauuuuugaguuaggggcaugagggggguggaaaccaagcaugaucccuccuggauuaagccaacacuuuuucuucugaaacuggacuacgaaugugacaauucugagcaguuuucuccaagggaagacagcguguauguguauugucuaaagucaccucauggaaaugcgguaauaugcauaccauccuuuugggaaauguagcuuuuucuagacuggauucaucuaugccuuccuacucuggacucuuccuugauccauuuuuuuuuuuaauacggaagugucauauguugcuuauuuaacaacagcauaaaagguuuuuuuguuuuucuuuguuuguuuccuaauuuguuuaaguaauaguuagaucuaguaugcuuuggacuuaccuugucuuucagcuccgaacuaaaacggguaucugcuaacuacaggauaggggguuuaagaugcuuuuuuaaagggagugauugacgagggcccuguugcuacaggauuuuuugguuagaggaaucccagcuucaugucagccaucaucuuccagcucagucuucugagcgugacucucuuuuuucuguauuucuuuucacagugccuuuacuuucugcuuucucuuucuaccuagaagaccacccuaauuuuguuuucguuguauuuuuaaccuagcucuacauuauggggcugcuacagugauugugcuuuggcuucacuuaugccugugggacuuucauuuucuuuacucuucuugguacugcuggcugucuucuaaaaugaauguucuugaauguauaauaaaaacaguuauacucuaguagcaauuuaugccaauaaaauauaaagaacacuaauuauguuuagagauucuguccaccuuggaggaaugcauucuggugauguaccuguauacauaaauacauauccacacauauaagcaccuguguuuacacauguguuuaauauuuuuaucucuguguguguguauauauauauauauauuugaccuaggaagauaauauuuuuaucuguguauacauauauauuuggccuaggauuguacaguuuaucugggugcagauaccuaucuaccuuucagugcaguuaaucuauucuugaugagcuuuugugcccgaggacucaggggaguauaguaguaaaacugugcccuuuuuauuugcugaucucccugcauuuuguuucaauuucuguguuuuuuuuuuuuuuuuuuccauuagugagcugauucugaagagcuugaaggaagucauuuuaauugaaggaguuaggguuucuuccucacacuuucccaguccuccaggacucuucaucuuugauuucauacaguugguaacaucuuaacaaaugaccauaguauaauaauaaauauguauaauuauuuucuucugugucuggagggucuagaaaagcucaugccuuuuauauaggggaguguuauuuuccucauaaacaauuaccugaguuggaugucaggauagaucuagguuccaugcucucagauuuuucauuguaaaguaaggaaguuggaaauacuacaacucuuaaguuccuuucuagcucuaaauuuuuuuuuugagauggaguuuugcucuugucgcccaggcuggagggcaguggugugaucucugcucacugcaaccucugccucccagguucaagcgauucucgugccucagucuuccaaguagcugggacuacaggcaugugccaccacaccuggcugauuuugcauuuuuaguggagacaggguuucguguuggucaggcuggucucgaauuccugaccucaagggauccaccugccuuggccucccaaaaugcugggauuacaggugugaaccgccgcacccggccuagcucuaaaauuuaugagaauacgggucccugaaauucuuaguugauagacgcuaaaucauuggaacauguucagccggugcucaaaaugugcugcccauaaaugucacucagaagcauauuaaccuugcauuaaucuuuuuucuaccuguaauauaaacuuuuaaacuuucaaaauucaguguucagugucauuuuuaacuuggcgguuguuucaucuuguuacuuuggaaaccacagcauauauuuuauuuugguuuugcauuuugaaggaauaauagaaacuagaaaacucaggagaugggagcuucauuuguaauuaucucaaaaauuauuuucauuggggaacacaauguaccagugauuuuuuuaaaaagucuacuuacuauuaguuuuuuuaaacauaaaaauaugagcuuuauugagauaauugacaaauuuaaauauguauaguuaagguauacagcuugauauuuugguauguauauuuugauacauguauauugugaaauaaucaccauaagcuaguuaacguagccuucaccuuacauacuuaccauuuucuuuuaauuuuuuucuuuuuuuuguggugagaacauuuaagaucuacuuucucagcaaauaucaaguguaugauacaauauuguuaacuguagacacguugcuguacauuagaucuccagaacuuguucaucuugcauagcuagaauuguguaccuuuugaccaauaucuccccauuuccccauacgucaaccccugacaacuaguguucuacucuuugcaucucugaguuugacuacuguauuucuuaucuguuuuugugggaagguugauguauuaguuuccuggggcugccauaaccaaguaccacaaauugggugacuuugaacauaaauuuauugucucacaaaucuagaggcuaguucuccaguauaagauguggacagggccgugcucccucugaaaucuguagggggagcauccuuccuugccucuauuagcuuguguuuuugacgucacucuaccuccauugucacauggcugccuucuuccugaguaucucugucucucuucucuucuuguaaggacauaacccauaaagauuaagggccaccauacucugguauaaccucaucuucacuaauuacaucugcagugacucuguuuccaaauaugcucacauuuugagauacuggggguuagaacuucaacauuaucuuuuaggggccuacaauucaagcugucacaguugauuaaaagauuuugauccuuaauaauaauguaauaaaacuagaauuauuuccuuuguuuuuaauucauagucauuucaauaauaccacuacgacuuuuccaucugcugagcaaaucuuaucaaauacuucuuuguuucuugugucuaaguucaaauaaaagccauaguguggauucagagggaaugccuaaacuagucuucauauagagcuaagggaaaaaagguaaaugguuaaaguggguuucauauguaaugcauaaggaaaaaaguaagguagucauaaaaaauagacaacuugaaauucaccucauuauaucuggauuucccugacauggguaaaucuagugauaugguuguaggugacuggauggauuaaguuuuauauuaaguuuuuagaguuagggaaugguagaggauaggaaaggggaauuuuuauccuuccuguuuuguaauauuuuaguuggacauguuucaauauuuguguaugcauuugaaacugaugaaaggguuauuacauacuuugucaaucauuucuuacccuacuauaugugaaaaguaguaauuauuucagggaaaggugguuuacagaaauaggauaauagcuacagcaauauaccagucuucgugggcuuucacauauaguaauguaguugcgacuacgaaacaugagauuagucaggauugugauguuuuugcugacaaauaagauauuaauccuaauggaguauuguuuucccuugugaagucauauauucauuuaaguuacauuuuucugucuuuauccgaguguuaaaaauugauuauccagauaaccucaccauuacaguguuucuucuuuucucuucuuuuuuuuuuguuuucuuuucuuuuuuuccucuuuucucuuuucuuuuccccucccucccucccuuccucccuuccuuccuuucucccucccucccucucucuuucuuuuucucuuucuuucucucucucucuuccuuuccuuuccuuuccuucuuucuuuuauucuuucuuuacaacuuuucuuuuaaauauacucccuuccuuccuuccuuccucccucccucccuuccuuccucccucccuuccuuccuuccucccucucucccucccuuuuuuccuuccuuccuuccuuccuuccuuccuuccuucuuuccuuccuucccaacuuuucuuuuaaauauacuauaucuauuaaugucuguggucauggaaccauauaaaguaauuuagcaguuuuugaccaguggauuucuuaauacuuuugcagacuagcuuucuauuuguuuuuauuuuaucuuuuucaaggauuauaaguagguuggaaaauacuucuggguuuugcuuucuuaagugauuuuuaaaugcaucuaaaaguuuagaguaaaagugcccagaauccuugaccuuagucuuccuucuaugugaaaccaccaauuuuucccuuuuggucacuuuuuuacuguuaaggguaaaaacugcucugccuuaaaacuuuugugaagguaaaauaauaauguacguuaacauuuuggaaauuguaaaaugcaguacagauguaauaagauagcauuaacaguaauauuggaaaguaaauggaacauuaaacuuugauguccuaugauuaauauuguuauggcaaacauacuauaaguuuaggagucagacugccauuuuuuuaugaauguuaauaguuauuuuauaggaaauguaaccuuuuugguuagacucuugaaaauaagauuaguauuauugcuagcucuauuucaggaagauuuaucaaacauuuagaaaaauaaacacaguugauuuucauuauucucggugguguuauguuccauaaaguugucaaacaccgaauuagcgaauacugaaccauuacuccuaggggaaauaaaagauuaucuuuuuuugaucuucuaguuaauuauguaaauuaauacauaaccauuuuauguuucuguugaaaaacaucuucucaguguauauuguugauucauuaacauuuaacucguggccaacagcacuauaaccaugccugaaggaagcucaucuaaacauguauuuuaucaguaaagcaugucacagccuucuugcacuuagaaacacuagauagcacuuuagcauuauguuggggaccauuucaaacaaugaaauuacuaacaaaaagcacaaaaaugcaaaaagcaugguacuaaguaggcugcaaaaaaaaacaaaaaacaaaaaaaaaaccccacagguuuacagaaagagagcugaaacagaagacagagugcugccuuguucaaccucagcugggacucaaauuuuucuccacucugcgcauugucuguaaaugacugcaaaagccccuaguauugauuuuuggcuuacaaauaccagauguccuucaacuuacaauggggcuauguccugauaagcacuacuggaagucaaaaauacaguuaaugcugguaauaaaccagauaguccccgaccaacagugguuccacuuaauguuuuuuacgauggugagaaagcaauauacauuuaguagaaaucacaugcauucaguagaaaccauaaccccgacaugaguaaguugugaggaguuccuugacuuacaguggggccgcgccccaauaaacccauccuaacaucugaaaaucauuaaguagaaacaucaggaaccaucuuuauauuuuuaggaguaggugaauucacagacacaaaauccccaaauaaugagaauugacuguaugcugaauagugagaaaaugauuuggauuaaguuaguauuuuaguuguuaaaauuugauuuaguuacuuuuaucuugaauuucuuaaucuuucauaguaaauagaacauccucuacuuuugucuucugauuucucaaacaauguauauugccacaaaaacuccauuaucaaugauauuuguuacaaauacuuaaaauuaaugcuuucaccuuucauuugauaauaaggaguuugcuacuuaaaggaaucaugaauugcuuuguggcacaagaagacagaggaauucggccagugugaggcaucccuuacuuucuuuaacacagccgccugauagaacaguagccaugcucuuuaaguaacucuacucugacaaccucgaaggauuucugggcauaaaaauugggggcauccaauauagcaaagggguugagagcauggacucuaucuugguaccaucacuuaccagauguguggcuuuagguucauuacuuaaauucuuuguguguuaauuuuuaaaugacgaugauaaaauaucuaccugauaauuuuggugugagaauuaaaugaauugauacauggaaaguucauaaacuggugcccuccacguaaguucgugcuagauaaauguuagcuauaaucauuacuacuauuauuauuauccuuaauuuaaguagacucuuuauuucucccuacuccuuacugucacaagugauaaagcaaugggaauaccuguguuuuauauuucuuuugcauuuguaaccucucccaguacucauguuuguuacuaauaugguuagucauuuuucuccuauugauacugucguuguaggucagguaaacauguauguucaguccuucacuaugagugagccaaaaguucauaugaagacuucagcauugaguccccaaaggauuuuuuagaaaguucauuaauaucuucauuugucuucuuccaagaugagccucuugacugacucuucucagaaaaugauugacacuuuaugugagaguaaaacuuaaagugagcuaugaauuaauguuaaaaccagauuacgaaaaaguaagacuucauccuacgauucuaccauccuauuauccacucaccuuguacaaaaacaaaauccagaaacauuuucaaaaaggaaggaaaauucagucaaguauuuuggaaacugaguuccagucaucauggaguaaacaagcaauaagcagauuagguagcgcugcaauaaauuaaaauuguaacagagcuauaaauuagauucugaauguuuucuaaauuuauuuucaaacuugacuuuuaauauaugugauuauuaagauguaauggugaugugcuauguagauaugaaucuguuacaguaaucuauuuuucucuuaacauuuuauuaugaaaauguguaaacauacaauaaagcugaaaauuuuagugacuacuuauaugcucaucaucuagauucuauccuugaguaaucuauuuuuauaaagguauugauguaacuauuuuauaaaugaaaaacuacacacuaaaaaccaaauaugugaucuccagcaucacagaaaugaaauaaggauuuuuuuuuaacuuagguaauauugcuugaacuguaguaauucaaauguagcaauuucaaagguagaauuucccauguauuacuauacugcuucacaucagcucuauuaauaaaaguagaacaguugcaaaggaacuuuuaugaucuguuuugacaggacagacaauuuaaaaaguuguuaauaaagguuuuuagaauucacuauaagccuuucauguggcuuuaguuagccacauggagauacguucugggacgaaaguuggaaguauucucaagaaguaaaaaauaccaaauaauuuauaggggcacgagugguuugaaguacuguuuaggauuagagugggucuuggcauuuguccagaaaccagacuacuuugcacaauuauacuugaauuccuaaucauauccacuagccuacucucuuaaauagaccacagaaaccuugcucuuaacauuuaagacaauggagugucuugcuuucuagaaaugcuuuuauuuuuauuaccacuaugcaaauaaauguaauuuucacagugucauaacauugauuuugucauugaagauauuaucuauuuuuucccugacaguuuauguuaaaauacauuuagcuuuguuagguaagagaacuuugauacuuccuuuuccucuuuauuguguauacagguauauuugggauauauggcauuuaaggguauucuuuuagaagacuugucuaaguuguuaauaguuguaaaauaccacauauuaauuuuuuuucuacauuuaaaugaccaucguccuguguuacuggacuugucucagaaaugagggaaauauagggccauuauuaauuuuguauuugaaucauaucauuggcuauuaauaaucuucuacagucacaucuacauauauuagcagugaagaaucauuucagugacaauuuguuagucuucaaagagaaaaaagaaaaaucugaguuucauaccaagucuucuauaagaacaauucuaaugucaauguagagcccuuucuuuuuuguuuuuaaaacucucuaagauagcucuacuuuauauggaaacaaauuuucuaaagagcaggcaauggauuuauggaaauuugcacauaaacguguaaucacauuuugucuaaaaacuguaaaaauauuuuaacgucauucaaaacauacguuaaauguugaguaauaccaagaagcaauuugaucucauuugcagggucaacagagcaguuaauacaaugacaguagauuuggggaggcuuuugcguagaaucaaaucuguugggauaaugaauacuuaaauaguuuuaaacagcaggaaaagaugaaaaaacacacugaaacccuuuggaggauuaaguuaaauuuugaaaauaaugauugaagcuaauacuuuagauauucucauagaaacagaaaaaccaguuguuuaguauagcaaauauagauuacauauucuguagauugucauggcauuuuuuuguaaucugauuuuuuuuuucaauuucagaagauaaugaauaaacccuagguaacucuuucauuuccauucccuuaacaaauaacugcagucucucauagaccauuuugauuccugcugguuucucuaucuuguuugucugaagguagagcagagacaccucuguguauuguauuuucugucagcuaguucuuagaucuuucaacuauuuuuuuuuuuuuuuaaauccuugauacaugcuuuccaaaggcugaggaaacagaaagugagagaggggugaaagcuguauauaauggggauuaucuggagauuaguuaaaguuucacuaaugccauuaauuuaaauauuugacuccggcccuuucguguaugagauuuguuccgccauuacuucagguagauuucauuaccucgacuggacugccuaaauacaacuuuugugucagucaauaugguuauacuuauacuuaauuuacacaugcuaauggcaauauuagaucuauugaacagauaucaucaguaaacaguuaaugauugauauucagguccaacuuugauuauugaucauauaauauuuuguguaauuucugugguuauuauaaauauaugauugauaaccaguuauucaggcaauuugcauuuauaauuuuuuauguagauuuuacuaaucagcuagaaauaucucuucaugaagguaauuauuaguaaaaaaauuugugcagagaauugcgcagaguaucuuaacuuuauucuaacuuauccuacuacuaggaauguucuuaauaaucuuuauuaaaaacuuaguuucuuagauugucuguaccuguguuaaaauguggucuacagccauuuaaauaaaaggucucuauuuuaugacuuaugugaauuucggauuuguaacguauauauguauguauauuuauguuugugcauuugugcauaaguuaaaucuuugacuaaaagauggaccucaacaagugugggaaaguguuauaguuacaauauccugcuuuuugcuuuucuguauaagagacuugguagcugcaucauauaucauggucauccaaaccucuuguuuuaaaugagagacauaguuaaucauaauuaaaaaugcuaaauaaauuugaaauaggaacuauuugacccauuaaauaaaaagaucccaggaauucuuagauguaaaguuaucuaauucuugagauuuaacuuaaaaauauaaguauuuauuuauggguaguuuuaaauuugucuuucaagcauuauggagauuagaaauuuugugugcuuuuuuuaaauuugaagguccuuaauaaaacaguauguaauugugagaagcaagagugcugcagcauguugugucuuuuaaauaucuuugagaguaacagaaaagcccaaauucucuccuagugucguuuuuaaaaucaaguauugaaacugaauauaguucagcuaagcuuucuuugcugucacucuuaacauugccauaacucuacuuuccuagucauuugauuguacagaaaaaaguaaauucuuuuacuauguaaguauacccuuaucaucaaucauguacugcauaaugcauagaaaagaauacauguaacauuuuuugaagcauaacaguaacacaauacugaugauuucucacccagcuuaaaaacuagaugguaucauugaaucucuauauguugucugucccuauucagucacucuauuucccuucacccagaugugaucauuauucuaagauguuuucauucauuuccuuacuucuuauaaaaauaaugguuucugaauguauuacuaaacggcauauauuguuuaauuuugagcacuauacauuacauaauguaauuaccuauuaauguaauuauuauaauguaauuauacuuuuuucucuuaaaucuuguuuuaagauuuauuugagucuuggcauguagcuauaguuaaauuucaugcuguauacgauuuuauuacguggauauacuuguauucauuguaguaggguauauuggguguuccauguuuauuuuguuuuuugucacuaugaacaaucguacugugaagauuacugaacauguguucuaguaauaugugaguaaauucuuucauuguauaucuaagaguggaauaggugagucucacagagaacgugcauauucaaccaugcaagauaaugccaaauuggugauacacugauacacauuuccaccagcaaagugcaauaguucucuuugcgcugcagguuuaucaacucugacaaucuucagacuucuugauuuuuccuaaucuauggguauaaaaauaguauuucaucaugguuuuaauuugcauuuccuaauaaugagguugaacaauuuuuuuauguuuaucuuccauucucauuucugugaaaugccuuuuuuuuguuauuugucccccugcccccaauuuuguuuuauuagggguucuuauguauuguggauacagaugccuuuuguacauauauguugcaaaaaucuucucucuguuaaugacuugguucuuuuaugguauauuagugaaaagaacugaauuuaaaugguaguuaaauuuaucagucucuuauaugauuagcacuuuuugugucaugguuaagaaauuacuuucugucccaaggucucgaggauaucuuuauuuuuuuuucaaaggcuugcccuuaguguuccaaauuuauuuggaauugauucuuugaaaaggguaagguaguaguccaauuucauuuuucuccauauggauaacuauuuguuuuaguaacuuuauugaauaguccaguggcuagagugccaucugucauuucaugauucuuuuuuugccuaguucuguguugggcucuuccauucuauucaucaaguugucuaucucugcacaaauaguacaugauauaguuuuaauuacuauaauucuaaugagucuugauaucuaguaggacaaguaucuguauuuucauuaggagcugccugacgcauucauauaaaaugagaaucagcuuaucaaauuccuuggaaaaguauucuugugguuuuaauuagaauuuuauugaauuugagaaauuagaaguagaauucuuaaaaauguugaauuuucuuuuucauaaacauacuguaucacccucauuuauuuaggauuucuuuaauucugauuuugcuuuguaauuuucuguauucaaguauuguacaucuuuugcuaaauuuauuucuaggaguuuaauauuuuugaugcuuuuguaaguuuuaucuaaaaacuuguuuuuuaucuagcaaccuuguauaaauguucuuuuuaauucuaauaauuugcuuauacauuacauucuuugauuuuuaucuguagacaaucuuuuuuuuuuuuuuuuuuuuaaguucuguuucuuacuuuacugucuaggacaaccaagucauaauugagcuucuuuucuuguuccauguuuuaaauggagcgguauaaacuugucaucuuuaauauugauguuuggcguggguguuugaaaagguauucuuuaucaauuaauucggucccuuuuuuuuuuuuuuuugagacggagucucucucugucgccaggugggggugcaguggugcagucucggcucauugcaaccucugccuccaggguucaagugauuccccuuccucagccucccgagcugggacuacaggcgcccgccaccaugccuggcuaauuuuuguauuuuuaguagagaccagguuucaucauguuggccaggauuuucuugauuccuugaccucaugauccaccugcuucggccucccaaagugcugcgauuacaggugugagccaccacaccuggcuccucuauuuuuccaugaaaguauuuugguugucuuugguggugguggugguggccuuauguaaacucuucauugggcauuaaauuuuaaugaauacuuuaucuacuaaaguaauaaucauaugguuuugcuuuaaucuauuaauaugauaaauugaauauguauauuuuucuuuuguauuuauuuauuuauuuauuuuuugagacggagucuugcucugucgcccaggcuggagugcaguggcacgaucucaucucagaauguguauauuuuucuaaugucagacuaacuuugcauuuccaauuuggcaauauauauuaucuuuuuucaauaugaacagucuuggauaugauuuguuacuaagagucuuacauguguguucaugauuugagauuggcuucuuuuuuucuuacaccuaauuagccuguuuuuaauacuggccucagagaaaaaaaauuauuuuuuuauuuuuuauuuuugauucucagaagcguuuuaagaguggaaugaucucacuugaaauuugauagaagucuccuguaaaacuauguggaccuggugguuuuguauuugggauaagguggggaaaagguggaaauuaacuacaagucccaucucuauauuguauaaccaguauucacuuagucuguucuuuuuaguagguugaauuuuucuaggaauuagagcauuuauuuuuuucaugucuguuauuucugucuucucucugucuugucacaagguuucuauguuuuauuagucuugacccaaaaauuuaaaaaaaauuuuaguuuuuauugacacuauuuuguguuuguguuguguuucacuaguuuauacuauuacguuuguuaccuuuucuauuuacuugagcuaauuuugcuguucuuuuuguaauuuuuuagauuggguucuuaauuuuuagcuuuucuucuguaauacaaacauuaaagcuguacauuuaccucuaaguacugauuuuuguggccucucauacuauuuuuuuaaaaaauuuguuaaaaauugcuuuuggaccuaauguauuguuagauuuuauacauauguccagugugcuugagaaaaauaucucuucucugauuguuacauauaggguuugcuauguuuucauuaaaucauguucauuuauuaugugguucagauauucuguaucuucauuuuuucccucugguugucaaaaacaagauacguagaaauguguuugcuguauuacuuuuuauuuauauauugcuguauaaucuuugcuguauuacuauaccuugaggcuauuuuauuauguagagcaagcuuacaauguuucaguagcauauauuuuuaccguuuuuguuuuuuugucauuuuaaaguaccacauuacucuguguguuuuuauuuauuuagucugacagucuuuuaagaguuugguuuguuuguauucauuaugauagggguuuguuacuaccauuuacuuaacgacuacuuucuguuuuucucuuucugcgccccuccuccuugccuugccuuuuugauugauugaggacuguuugcuuauuaguuuugguguuuuguuuuguuuugcucauaauuccauuccuucuuuacacccauuuuuggaggcuauacacuauuucuguauccuuagugguucugaaacuuuacugugcuuacuuaaaaagaagucguaaguuaauaaucuuaacucauucuaguauaagacaaugauugugaaacaguuuaauuuuaaucagcuccuuuccugauuaaauguuuccagacuagugacuuuuaaaaugccaguugcuucuguuuaacucaaaaguuuguccggcucacaaaugccauuuuggaaaugccauguagccuguucuuacaaucuaagaguauucugcaauggaaaaccagcuucagggaggugcuccauuaggaaaaucuagaaaccaaaaacuguggauaaucacuuugcugagguuuucauucccugaagaagcaaaaguugcuagucucccuuugaacaaauuuuaugccuagcuuuucuuggguuuagagggcaaaauuaacuuuuuuuguugaaguaguguguuaugaaggcuaaagcgaacaucauuauuucaaaggaaaaguaaaauagaauauggucuuacucaccugguagcaauugcauaaaauaacguguauccaacauuaauuuuuaaucgguaauauuuuuuuccucuggagagccagcuucugcuaucugauaaaaaauauauauuauccuuuuauauacauggguuacaaaaaagucauuugacuaacuuauucaaauggccccuauuuaacgaaccucuguaguagauagcguggauaagauaaugaaguuucaaagaaacauuugagucauuuaguauuuuucaauaucuuuauaucuuaggacuuucucauuugucagugucucauuugacccauuucuuuauucuuauucuuuauucuuaacuccagauuuuuuaacuugauauuuauuuucuucuaagaaaaauuuaccaucucuuugaaacacuguaauuuggacaugcaaagaaaacaaaguugcaaaaauguaauuauuaaauaugccuccuuauucccaacugauucagaaccacugcaauuuuugggcaagcgcuuuaauuuaggauuaucaaacacugucucagcccaaaaucuccuuaagcugauaagcaacuucagcaaagucucaggauacaaaaucaaugugcaaaaaucacaagcauucuuaaacaccaauaacagacgcagagccaaaucaugagugaacucccauucacaauugcuucaaagagaauaaaauaccuaggaauccaacuuacaagggauaugaaggaccucuucaaggagaacuacaaaccacugcucaacgaaauaaaagaggacacaaacaaauggaagaacauuccaugcucauggauaggaagaaucaauauuguaaaaacggccauacugcccaagguaauuuauagauucaaugccauccccaucaagguaccaacgacuuucuucacagaauuggaaacaacuacuuuaaaguucauauggcaccaaaaaagagcccgcauugccaagacaauccuaagccaaaagagcaaagcuggaggcaucacgcuaccugacuucaaacuauacuacaaggcuacaguaaccaaaacagcaggguacugguaccaaaacggagauauagaccaauggaacagaacagagccuucagaaauaauaccacacaucuacaacuaucugaucuuugacaaaccugacaaaaacaagaaauggggaaaggauuuccuauuuaauaaauggugcugggaaaaguggcuagccauauguagaaagcugaaacuggaucccuuccuuacaccuuauacaaaaauuaauucaagauggauuaaagacuuaaauauuagaccuaaaaccauaaaaacccuagaagaaaaccuaggcaauaccauuuaggacauaggcaugggcaaagacuucaugucuaaaacaccaaaagcaauggcaacaaaagccaaaauagacaaaugggaucucauuaaacuaaagagcuucugcacagcaaaagaaacuaccaucagagugaacaggcaaccuacagaaugggagaaaauuuuugcaagcuacccaucugacaaagggcuaauacccagaaucuacaaagaacucaaacaaauuuagaagaaaaaaacaaccccaucaacaagugggcgaaggauaugaacagacacuucucaaaagaagacauuuaugcagccaaaagacacaugaaaaaaugcucaucaucacuggccaucagagaaaugcaaaucaaaaccacaaugagauaccaucucacaccaguuagaauggcaaucauuaaaaagucaggaaacaacaggugcuggagaggacguggagaaauaggaacacuuuuacacuguuggugggacuguaaacuaguucaaccauuguggaagacaguguggcaauuucucaaggaucuugaacuagaaauaccauuugacccaccaaucccauuacuggguauauacccaaaggauuauaaaucaugcugcuauaaagacacauacacauguauguuuauuguggcaguauucacaguagcaaagacuuggaaccaacccaaauguccaucaaugauagacuggauuaagaaaauguggcacauauacaccauggaauacugugcagccauaagaaaggaugaguucauguccuuuguagggacauggaugaagcuggaaaccaucauucucagcaaacuguugcaagaacagaaaaccaaacaccacagguucucacucauaggugggaauugaacaaugagaacacuuggacacaggaaggggaacaucacacaccgggaccuaccgugggguggggggagcggggagagauagcauuaggagauacaccuaauguaaaugacaaguuaaugggugcagcacaccaacauggcacauguauacauauguaacgaaccugcacguugugcacauguacccuagaacuuaaaguauaauaaaaaaaauuaaaaagaaauuuccuggaacuagcaugucagaauaccauuuuauguccagcuuaaaguuuagugugaaccuugaauuuuauuucauuucuauuuauauucagguuucuaaagaacaaguuuccaugaacaaauguggcuuucaacaggugaaaugauuugaguaauagaaaaaaauuagaauuugaaaaauuugaagaauuuaaaaaguuaacauauuugaagaauaugaaauacuaacauuagggaagauuaguuugauacuuuuaauuuaggaacuauuagagaaaggggaaagacaacuaauauuuuaggugauucuauuuagauaaauggcaaaauccgccuuggaaaagcuacauaauaaauauacaagucauuuguaaacuauucggaucacuuaggugcuuuaugguuaguauucauauuuuaaaauuaauguacauuacagcaaaauaacuguuuuguuuuaauauuuauaugcauucuauauaagggauaaccuuuugaauuguaaaaagugaaaccuacaaaguaaaaccuacaccuauuauacuaugauuugcaugauguaaggcuauaaauguauauuccuuuuucugaacuauucuuucaaggguugcaguaguacugucagcugcugauuuuucuuuuugaacuuaaacacagcuuuugucauugucauggaaauguuaccauguucuuuauuuuaaaauguauuuauaaaaaauaugaauuacuuuuuaaauaguaauaacuacucuuacuagugauauauauuacuuucaguagauguauuauauauuacucuuaguaauauuauauauguauacuuuaauaaacauguaaaaagcaugcaaugcuaagcucauuaguaauauauuaguaaugauacauagcaagcuuguucaacccaugacccgugggucacaugcgucccaggacguuuuucuagcccaacacaaauucgaaaacuuccuugaaacauuauuagauuuuuuuugcaauuuuuuuuaagcucaucgggugucauuaauguuaguguauuuuauaugugacccaagacaauucuuuuuuuaguguggacaccccugauauauaguuguacuugauuguucccaaggguuuuuaccacaggaacagaggaaggucacauaauagguaauauaagcugaugaugaauuuuacucauaauuuaauggccagcugucucagaauuuaagauuuauuuuguuugguguugaacucuauagguauaaaguaagccuccaaugugguaagugaugucaguacagugcauucuucaaacaguaaagucaauccugauuucuugagugguauguuugaaauaccaaauuccuuauugaaauggacagaaugaaggacuuggcucacagcaggcaacaggcaacaucuuguacauucuaauuuuugcaaagaaagaacgaaguuggaggacucauacuacuugauucugacguacuagguaaacauagaguaaucaaaauagugugguauuggcauggguugggcauauagaucagugaaacagaauaaggagcccagaaguagauccacacauaaauggucaguugauuuucagcagaaaugccaagguaauucaguagggaaaggauuucgacauaaaguguuagaauaacugaguaucuauacacaaaauacagcagguccuugaauaaugguucauucaacauuguauuguacuuacaacguucaugaggaaaaaaccugauuccuggcaggggccauuguguggaguuugcaucuucucccgugucugugugggcuuucuccguguauucugguucccuccuaaauuucagagaugugcauguuaagugaauuggugugccuaaauuguccccaccugagugagugaggggguguggggguuaugugaaagugugcccagugaugcaggagcauccuguccagggaugguucacacccugugcccugggcugcuggaacucuucagccacccucuacccugaacuggaauaaguggguaaacaauacucuaacuuguuuuuuauuaacuuuucuuaacuguauguauagcucacauuuauuucaaugcuugauauuagaaauauuuuggucuuuauuuaguaaauuuuggugauguugugaccagaaauaugacauaggaacuuaaaucuuguuuaugucaauuagccugugguuaaauugguuucaguauaugucauuucacauaaaguugcaguuuccaagaaccuauccacaacauuaagcgaagacuuacuguauugaaccuugauugugaccucacaucauccauaguuaugcauuguauaaugacauuuugaugaacaacaguccucauauauaauggugguuccagaagauuaugauagagcugaaaaauuccugucaccuaauugagguuguagucaucguagcaucgucagacagugcauuacucacauguuuguggugaugcugguggaaacaaacuugugcugccagcaaauauaauuauauguaguacauacuugauaauaaacaacuguguuccugguuuauguauuuacuguacuuuuuauuguuauuuuagaguguacuccuuauuuuuuuaaaguuaacucuaaaacagccucaggcaguucuuucaggagguauugcaggagaaggcauuguuauaggagaugacagcucuauguguauguuauugcucaugaggacccuacaguggaacaggauguggcgguggaagacaguagugauauauaugcuccugagccugugugagccuaggcuaauguguauguuugugucuuaguuuuuacaaaaaaaguuuaaaaaauuaaauaaaauaacuuuuaaaaauaaaaaagcuuauagacaaauacaaaggaaaauauuuuuguacagcuauacacuguguuuguguuuuaagcucaguguuacuacagaagaaucagaaaguuaaaaaaaaauuuuaaguugacauaguaaaaaaguuacagccaggcucacaccuguaaugccagcacuuuuaggagguuaaggggggaggauuauuugaggccagaaguuugaggccagccugggcaauauagcaagacaccaucucuacaaaaaauuuaaaaauuagcgggcaugguggcauaugccuguagucccaggugcuugggaggcugaggugggaggaccacuugagcccaggaguucaagauugcagugaacuaugaucauaccacugcacucuggucugagugacaaagucagaucuugucucuaagcacaaaauaaaaguuauaguaagcuaaaguuaauuuauuauuguggaagaaaaguauuuuuguauaaauuuaguauagccuaaguguuuauaaagccugcaguagugcacagauacauccuacgccuucacuacucaccccugacucacccagaccaacuuccaguccugaaagcuccauugugguaagugcccaauacaaguguaccacuuuuuaucuuuuauaucauuuuuacuguaccuuuccuguguguuuagauacacaaaucacauuguuuuacaguugccuacaguauucuauauaauaacauacugugugaguuuguagccugggagcaauaggcuauaccauauaaccuaaguguguaguaggcuguaccaucuagcuuuguguaaauacgcuaugauguuugaaaaaugacaaaauccccgaaugacacauuucugaggucauauucuuguuguuaaacauuaagugacacaugaccauacaaaaauuaauucaaaaugggucauugaccuaaauguaggagcuaaagcuauaacuucuagaauauaauguaagagcaaaauuuuaugcccuuggauuaaguaaaaaucucuuaggacaaaagcaagaaauaaaauaauuggcagguggaacuuaaaguaaaagacacuguugagaagaugaaaaggcaaaucacagaaagggagaaaauaauuugaaaaccucugucugauaaaagacuuguauccagaacaugcaagucuuaacauacaagucuuauaucuuaauagacaaaccaauuuaaaauggacaaaagauuugaauagagauguuacugaugaagcuguaugaauaacaguggugcuuacacaucauuagucguuagaaaaaugcaaauuaaaaccacgaugaaauacaacuacauacugacuagaaugguuaaaauaauuauaaaaaaacaggaugaggaaggauguguagccguugaaacucucauacauuaccauugagaaggcaaaaugguauggccacuugggauaacaguuuugggguuucuuacuauaaacauacacuuacuaccaugugacucaguguuacugguuaaauuacauccuccaaaaugguauguuuaaguccuaaccuccaguaccucagaaugugaccuuuuuuuuuuuuuuuuuuuuuuuuuggaaauagggucauugcaguggaacgaggaaacauuuuuggggugguggauaugcucuauaucaugguuguagugauguuacaggacuauacauuugucaaaacuuagcaguguuuauuucaaaauggugaauaaauuuuauaaauaaauuuauacuucaaagcugauuaaaaacauuugaaaaauacaauaaauggcuacauugaaaauguaaugaauauacuuuuaguucaaaaagugggugcagacgagcauucuggcuccuggagcggcugggagggcgacuuauaacuagaaugccuguggucgaauguaaaaacauugucuuaagaguguacagggacuggugugguggcucacgccuguaaucccagcacuuugggauuucgaggugggcagauugcuugaacucaggaguuugagaccauccugagcaacauggcgagacucccaucucuacaaaaaaacaaguguacaaaugcuaauuuuggcuaugauaaaauuucuaauagugucacuugcaaagucgaaaaauucaucucaauaauuuuauaaugacaaagacacugaugucuaggaguuaaauaaaauuuucguaaaaugucaucccgugguauccuugggggauugguucugggacuuccacagauaccaaaauucucaaaauacucaaguuccuuauauaaaauggcauacuauuugcauauaaccuauguauaucuucugguauacuuugauuacuuauaauaccaaauacaauauaaauaauaguuguuaaacuguauuggcuuuuuauuugugugauuucuuauuaguuuuuuucugcauauuuucuguuugugguugguugaaucuguguauguagaacccauggguacagagggcugacuguauuuauaauuuaccacauggggugauuuuuaauaucuguagcuaauaauuauuuuaaguggccauuugacuguuuccuugacauuccuaaaaauuuauauacuuaaauuggggaggaaaauauguuugcguucuucuuaguggauaaauggaagauugcguuauagucauauauucauagagcuuucugauauacccaguuaagcaauuuugauacauccuucuucguccuuccacgggacauugaccugucucuaguucugcacauguuacacuguauugcauuuagccuuuucauaacaauaaauucaauuagaugucauuuauuucuuuuaucccuacuacagugccuggcuuaugauguacauaaaauaaauauuaguggauaggaaaauuuuuuuauaaagaaucaauuuuuugccacagugcauuuuuucaugguugacauuuauucaagaagcauuuauugagcaacucuuauguggaaagcauuauacuggcugcuuugagauauauaaaagaacuauaacaucuaaacauuuaauguuagaaugaaauguaauuucuauuuaguauaagguauacuacaaauuauaggaugaagguggguaaucacuagagguuucagauggaucauagguaaaaaauacuggaaaaacaguuuagucugaugacaaaggaaaucacuuuuuaguagcuaugguauucaaaauaaucauaguuuaaaaugucauuuaacaguuucuggaauuuuuauaaaaucauucuccuugcugucauauuguuagauccagagaguuagacugugcaguaaaugagcuauuuuuuuaccuuagaaaagcagaagacuugaauuuucauaaguagacucuuagagguuccuucugaugcuucagcacauuuccuuuucuccaaagaaaugcuucagggccgagugcaguggcugacgccuguaaucccagcacuuugggagacccaggcgggcgaaucacgaggucaggagaucaaaaccauccuggccagcaugaugaaacccagucucuaccaaaaauaaaaaaauuagacggguguggcagcacgugccuguagucccagcuacuuggguggcugaggcaggagaauugcuugaacccgggaggcagaggcugcagugagccgagaucaugccacuaacgacagagcaagacuccgucucaaaaaaaaaaaaaaaaaaagauagauuuuuuuuuucuucauauagagugucaaauagcgcuugaaccaaagcccuuuaccucuccucauaggggcauugaacaguaauagaagcuuagaacauacuacuuuuuauauagaugucaguauagaucuauuuuaauuguuaaaauggaugucaggguuuucugugagcagugugcaacauaaggaauuuuuuuuuuugagauggagucucucuccgucgcccaggcuagauuguaguggcacaaccggcucacugcaaccucugccucccagguccaagcaauucuccugccucagccuccccaguagcugggauuacagcacgcaccaccaugccaggcuaauuuuuguauuuuuaguggagacaggguuucaccauguuggccaggcuggucucgaacuccugaccuuaugauccgccugccucagccucccagagugcugggauugauuacaggugugauguugcacacugcucacaaaaacugugguaagcucuuuucaaauaagaauuauauuuuuggccagugcuuucacuaggugaauugaaugacaaccaaaccacugucaggaggcagcguggucuggaagagcaguggagugugagucaaaacaccucauccuugccaucacaaaguguggagagucaucucagcagaccuuaguacuguugacuauaaacauuauugugauauaccuacccuaauuuagacuggaaagcaaguguaaaugaggauauaauuguggagccuucugcauuugucaaaacuaagaaauuaauauugguaacuuaauauuaacuaaacuccuggcuuuauaccaguuuuuccacuaauguccuuuuuguuucaggauaucacauugcauuuaauugucacaucucuuaagucuacccuauccccaucagucauucuaagcuuuccagauguuugaaaauuaauguuugccuugucuuaggaaucagagaauaugugcugagcauugcucagucuuuccuuguuaauucaaggguauugugaagcaucaguuaauauucugugccuucagaggcuguuuacauguuuaaaguuuucugacuuuaaguggcugugcucuucugguuagccccccaucagugugaccuaaucaaaaagccaaacagcaaucuguacuagaguucaaaaagagggagaagucccuuuuggaauuagggaaguccuucuauuuauuaauugaauucagauaaagaauauugaaagaggcaguagucaucagggagguaggaagaaauggcaugagcaaaguccugagaaguuuucuaaggaugcuggugaaagagugccaaacuggaagucauggaacagguuagaauucagguucugccacguauuagcucuggagccuugagcaagcaccugaccucaguuuccucauuuguaagacuagggacccauacuaaaugauaucuaaagaccuuucaauucugaacauccauaauugagucccaggccaaaugugcuaaguaucuggguuggaaguagugauaaagaaaauuacauaauaguaggagcugucagcuucacuauaaccccaaaggcaggugccaucacauacagauggagaaaaauugaguaauuugcacaacgucacacaucugguaaaugcaaccagauuuuuagaucuugugugauuuccaagccuuuucaauacaguuuacugcuuccucuuuuauuguuacaagaaagauuguucagaagaacuuucaggaugucuggugagcaaggaagcuuaaaagucaagucuuaugccugcacaacuagaaaaauaaaugaaagugccauuuaaaaaauuguuuuaaauaaaaguauauaacagguugagcaucucugaucugaaaucugaaaugcuccaagacgugaaacuuuuugaguuccaacaugaugcuacgaguuaaccugaacacauuuuuucauuguauccaugguauguucuauuuuuuuacuaaauacuuacaugugaauaaauauaagaaaaugaaugcuuacuaguagcauauaaauucaagaguaaggaaugauggugaugccagucaaccagauuguccacaugaguggcugagauacagugcuuucugauggcuuaguguguucaaaucuguuucaugcacaaaauuauuuaaaauauuguauaaaauuacuuucaggcuuaguguauaagauguacaugaaacauaaaugaguuuuguguuuagacuuuggucucauccccaguauaucucauuauguauaugcaaaucuuccaaaauccaaaaauauaaaaaaaguuaacacuucugguccuaagcauuuuggaugagggauacuuaaccugaauuauuguauaauauuugauaagacaaaaacacaagaaaguaaaauauaauaauuaacgauaaucaccauagacauaaucaauguuauuuccacccauccucuuuuaaaauacacauacuguauacacauauacaaauuguuuacacaauaugauuacugguguguauguauaguuuugugaucuacucuucuuucuuaaucugucaugaauauuucuccaugucauuaaacagucuucaaaaucuucaauuuuuuucagugccuacaucaugauugauugaaaaccguaagugauuuaaccguuauuucguuggacauuuaaguuauuuugaguuucacuauuguuauuuugcuuugagccuucuuuuacaaaaacuuuuauucacgucucuguuuuuuguccuaggauagcuucuuggaugugggauuacuuaaucaaaugacucuugauacauguggcuaagaaucuuuaaaaggcuguauuucuccuccgaucuagugguauuugagcauaacugucccuccacauuuuucccaaguacuacaauuucuggucuuugguagggccagguuuuguguuaaagauuauuuuuauuuuguugaguuugagaugacgguuggucagaaaaaguauaauguucaauaaguacugaaaaagugaauagugcaaaauauacagugcuacaacuaaaaauuuagaaacugacuauauguaauuuauauaaaauaggaugaaaucucuaagcgauaaauauauauaguuuguauuaucuauggcacuauguauggcaagaaggaugccaaauaucacuucagggcaaacccagaucauaagggauagaaguggaaaaaaagaaucuuuaguggcaauagagaauacuagaggugacagauagaaugcagguuuacuuuaauaggagauuguguuuucuauaaggcuuuauccuaaggaagauucaguuuuaauuuacuguguagaaacuacuuuuuguaauuucaagauuugugacauaauuccacuauuaugcugauauaauuuuuuaugucacuagauuaguguauugaucuucuuaaugcaucuuuuguuguuuuguaugcuuauagaugguaacauaauuccuaaagucccugugaaugguucuuacauuaaucacuauguuaaaagucuuaauugcucacuaguuucugauuuagcuuacuguacucuccaguaauuguucaguucuaagaauauuuuauggcauaguaguuauauaaugucaguggugcacugguuaauguucuagaauuaauaauacauuuucucuuuucauauuauguagaauuuucuaaauguuagaauuuaaagucagagaacuuacuaaguguuuacauaggacacuaaaauaagauuuuaccuuccucuaguaguauaccuuguguuuaugcuuuuacgucugcugcuuuauaagcagaaagagagggagggaaauggcaagaaagcauacagcaggaagagcugagaaucuuaaacugucauaaucuacuuuuuaaagacaaauguguaagcaaaauuacuugugcuguguaugaguaagaagguuguagagacguuuucucauuugaucaauuuuaaaaagcuguuauauuaugcugauuauuguuacagcuuuuugagguggugauagggaaguuuuccaaggaggcuggcaugccccuggcugagcccagcaaagcugcauuaccucaauaaauucaccacaaucuaaagauguuaaugaguuuuggcaaaaguuauaauagcuucuuacaucuuucugcacaauaggaguaacaguuagagagcccaggcaauuaugucacaucugaggauuggaauacuuucuuguuuucauucuuuuuuuccccauucuuucugcauaucugcucuccccgucuccaguuguuuugaaucauggcugagcauuuuaucaccugaugaguuuuuaaagcucuguaagcucagaccaagccccagacuaauacaucagaaucucuaggggugggaccugguauuggguaaguuuuuaaacuccacaggugauuacauuuggcagccaagguugggacccaugguuucagauguaguaaccacaucaauuaacuuaguaccucuuaagaagguugcuuauuagaauaaccugggagauuuucuccacacuguucccucccuuccacuucccuuauuaauuuagugagccaguguuaacugaugggaauauacacauacccuuggauauguugggacagaaaaaaaaaagacaacaaucaauuuguuaaguacuauuuuuccuacacucuuuuuggaauauagucugcuuauauaagugacuuuguaucuauccagcauuauuuuauguggauaauuuuguguuguucaguauuugcauaaucacugugagggcaaggaccuuguauguucuucuguucaucacuguauuuucaguacccacuagugccuggcacaugguagauaaucaguaaauguuagaagagugaaucaguaacacugaguaccccacauaagugccagcuauaguaugaagcuuuguaauuacauuguccaccaaggaaaaagaucuuccauaaagccacagauaagcaggaaauagauuuauugaauuuugagucuuucgcaggucagggauuccguguaggcauuaagguucugaacaaaaauguagcacaaaacacaaauacuugcuagcagaagauacauuuccauaccugcccucguauaucaaacugcaaaacauacagaaaaaaacuaauggacaaacaggugcuguuagagucuguguuuaguuuaagccucaugauaaacugggcuagagcuugacacauuuaucaacuguuaguuguauuuuaccuaaucauagccugucuuaaaggcagaaaaugaaaacaagaugaucugucacauaugguuaaguuguaauucagauuuacaauauauuggcgaaauggcuucaguuuuggaugagcccuuaaacuguacagugugcaaagaaugggggagggaagagaccuaagaaggguuaaguaaucuuagccaagauuucuaaaagcucuuauuaaucugauuuuucagaauuagaaaaucucuguugucagaguucuccaguuugggguuugauaagaaagcauaucauagaaauuacucugccuaccuaaaauccuuuaugguuuagauuuuauucuguagugccuuuacagcacucuuagugcuucagccauagccccaguuuugacuuauugggccccugucccucuuauuuuucaaauuaaaaauuacacagaaaacuauucagaguagaaagaguauaagugaaaacuagguuuccuuuucacuacagagcaccacauccuuuuuagagguaaccaguauuagcauuuccuucuguauuuuuacagaaagaguuaguucauauugccagcauacacaugcagguaguuuuuguaguuuauuggcaugaucaccacaugacuagaugacgucuuuaguuucuaacacacuuuucaaacccagcuucuuuccauaucucuucauguaauuaaucucuccucugcuuuguuuccauuugcuuuuuugucccucuguuaaacaccuguuagaggucugacauguauuauugggacuuaggugugguggucucaucucagguaucaucucgccuucuuacucuguacucuuuaccuagccuggcucaucccaccugcaggacauuaaggaccuguguaucaaggucucacaaauuuauaucuauaggaccaggccccuuuaucuuacuugucugucucuuugacauacuuaucuuuuggauaucucauaaacuucuuagucccaguguauccaaaaccaacuuuuuuuucaacauccauaucuuaguuaauggcauauacauuaucucagucauagcagucugaaaacuauaagcuauucucgaaacccuccuuuuccucacuuguccuauuucaaaacguaagucugguugauuuuuguuuuguuuuguuuuuuuccuccuaaauaacucucaagucccucuucuuugucucugguaccauauuagucuagccuaucaucaucuuucacccagauuacugcagugguccacccacagccccuccgggccuccuccagaccauuuuccacagagcagccugaggaggccuugcaaaauguccauauuaguuuaacacucccccuuuguugcuuaaaaucuuuugauagcugccuauuucuuuuaauauaaagacaagucuccuucauguagucuuacaagguccugccuagacguuuguuacagcuucccucauuaggucguuucauuguacuucccauguucucuucccuucugccacauugugcuuccaggcccugcuacuuguuccugauggccucagggcauuuuccuaugcuuugaaguccucuuucccagcccuuuccuuucagcuucuacugauaaacccccacugggguauuugaaauaaucuuuuaaauauugcuuccucugacucuucccuuaucucucuaacauuuccccggcauucaacaaggaauaccuugccuuuguagcguuuucuguuuuauguuuuuuugugaguuuauuugauuaagaucuauauccucagcuuggcugaaaucuccauuguauauuuaguuucuuguacagauuccuagccccaaaucguagacacucaauaacuccuuaaugaaugaaugaauuuguuuucuuuauugaaucuaacaaguacuguauuuuguauauuguuaaagcuuaaauacuuuuuuugauucaaaguaaauucauagguucacaaggcacaguauggauuaauaagcaauaccauuuccugguugguuguuauagagauuacauaagaauucacacauuuaccaaaacgaggucauucuugggaagaggaguaggaagauaaaaucaugggaaccacuagcacauaccuaggucugcccuuuuaguuaguagaauuauuuuucuacguuauuuccccagccacuccucucacccuaauugucuguauuauagcuuucccuaauugugaacuccuaauugcuuucaaccuaaauaaauaugauucuuucuaaaacacucaggaauaacaacuguucacuuauaaacaguuuuugaaguuuggaaagcaauauagagguuuggcuuuacuuuagaaaaauauuacagaagcuaccuguguucuccgccuacuucacacaugcccauuuagcauuugauguacuucauauaauuaaauuuguucugcauccuaaggauuuuccugagccccagccgccuugauaagguuguuaaaaugaacaacucauugcuaagauuaccuuuucucccucucuugggcaguagaacucagcugagagaauagcggcaacuaggagaagaaagggugauggguugagauuucuggagauuucagcugagggaguaaagaagcuucagaggauaaagauauucuuuaugucaccauuagcagagaagucaaggaucugcuggacagagcagcuuuuugaguguagguauuuuagcuaaguuggauauuauacaccacaaugaaugugaauauaaaaaacaagggauuuaagugugaaauugugaccacaguauuggcuaaagacaauauacuuauagauguugauauuuaauuucaccacacccacaguuuauccuggcaucccagugccugguccauaguaguuauucacaauguuguuuaacugacuggacuuggauguguguuuguguguguuuuuuaaauuauuucaccuuguguaugguuguacuuguagaaauguuuucaucuacauuuauauaaguguacaguacuuugcaauaaaaauaccuguaccagaauucuucucuuacaaaguguuucuuaugauuauacacaauagacuugacugcguuuggaugaugacugucauaauaggccuuaagauagacaaagcacaagcuuuauaguaauaguuuugaagaaagacuauaugguaauuacuagaucaagaaagcauuauugcauuaucugugcagauagaagccuuuaggcagaugccauaguuuuuuuacuucaucagucuuuuuauauguacaccugacugccagaaauaguuauuaauucuucaaugaagaugguuuugcagacugaauuuauguguauguauauagcacgcacacccagccauuuuauuuuuauguucaaucuaauuccuuuaaacaaaagacuaugaaauacuacuacuuuucuguaggccaugugauaagguuguuagggcuggacagaaagaaaaaauauauuuauuugccauacccugaauauaugaaaugaagacuagauuucaaaaaucuuacuuucaggcaucacaguaauuuacaaaaaggccaauaaguuacacaagcauuuguaguaauuuauguaaaagaugugaagcugguaagggaugguucaaaaacuuacauaucagaaucugcuuaauacaaauuuuaggaaaagaauccacuucuuuacaaggcaauacucugaucacuauuuccugaacaguuauugaagguguuucaagcaagaguuacauacuaguauagauuuuuaaugcaaauggccauauuuguuuugaaggugauaccuuguggguuuucuucaacucuuucaaaacuugaauuuuauaucauuuuguuuuuccucccauccccacauccuaagugcuaaaagacucuaaaacucaucuugucaccugcuguuuuguucaacgggauucucuucagaaauauaauccuaaaguuugggagggacucuuagaguagacacuuaagcagagauggaacaaagaauuaauaauccaaauuauaugaagcauuuaaaagucuguagaguagaagccauuacagaaucaccuuuaguacgugauuagauaccuuuauuucugaaucuguuuacauuuuauuuuuggcaggagcuggguaauuaaaaauauuuguauggauuuauugcuuucaaauuuguggugaagacauuuuagaagagaaucuuagcucugcauauacgacccuaggcaagucacuuaaccuuucuggcucgguuucucaucugugaaauugugauaaaaauacucgaacaggauuacuacuauugaguuagaugugauauaaagcaccuggcaaagagugggcacuccauaaaauguucuuucuuucuuuaguuauguuaauaguaaaauagagcucuggugugcuuugaaacuuccuucuuucuuguuucaacguacaguaauagguaagacuugaguaauaauccaguaauccuuucauguauucuagcuugaacauuuuuuuaaaggaaauaaaacuauauauaguugaaguuucuucguacuuucuucccagucucauuccuuuuccuuccggcccagaggcaauaacuauccuguauuuuugguccaugauuucugcauguuuucauacuuucacgguguauguaugcauucauaaacaauaugugggaucuuuuuuauguuuuuaaaacuugaauaaaugguauuaaauuacauguuuaauccuucagcuuaacuuuuuucacucagcauuauuuuugagagcuaucucuugcugaaaaauauaggucauucauuuuaauugcuguauaauuaucuauuuccuuauugguagacauagugguuuuaugcaguuuuuucaguauuuuaaacaaugcuagguuggauaucuucucauuuuuaauauucuucuuagaacucaggugugcuuacugaguugcagcuuaaucccugaaaugugcauuacugaccuacaaacguuuguaaugaacugauuuauaaucuuaauuaccuaacucauuccagucuuuucuaaagauuggucuaauuuaagggcuccucuuucuaaucucuccuacccccauuacucauacugagaugcuaacuugauagccucauugugggaaaagucguaucaacauuaggaacaguuauugcuuauuuuggugauauuaauagugauugauuuuaauuuucaauauuaugcauuuuaaguauaccaauucugaaguauacuuuugcaauagaauaugugugcaaauucuuaggacuauuaaaauacuuaguccaaccuaauggaguaaccuuuuguauguaauuucuuuuuaaauauguauuuauagugaauacaugagcuaguuuuauaauuacuauucucuguguuuucuagacugcuuuuuuaugcaguguggcauuguaccuaaaauuuuguaucuguuuuuaagucaaaaauacguuuuccaaauaaaauuuuguauagagucugaagacacuggauacauuucugagucacugagguauuuccauauaguuuggcacaauguaaaaauugugugauuuaacuuaauuaugacugaaucauugugaagugucuccuuuuauuagccauauuauuaaucugagugaaucuuaucuaguuguuaagguugagaaaagaaagguggcugacacacccacauccuauaagaaaauguaauacuuaaauuacaaucauuaagguguaacuaauucucccauuuaguuaggauguuggugaugucaagaauuaauuaaaauacuuugcagggguguccaggggaaagaauacagucguagguucuugaaguuucuguuucugguuaggccaguaaagccccuuccucauccucuuuuucucuuaucacuagagacagaaacuaaaacccauggcuuuaggcuguuaaaagcauaaaacaaaacagcacaacagcagcagcaaaauaaggcagguuggacaaguuugcuagagucugugugacauuuaaauaucuucguuaacccagcuguuuaagguauaugcucauugcuuuucagaaauuuugaauuuuaaaaauaucugaaaaugguugagugcugaaaguuaacagugcaggcaguuaucauugagaacaccugacuuucacacauuuuaacaccacuaacauuggcuaguccuuuuuauugucuagcaauagcccagaaauacuccuuuccuguuuaccucccaguuuguaguuucuaaucauaucaagaccuaguuuuuaaucacuuuugcugaaaggucuacccacucuuaaggccaggguagacuccuuguuuuauuuucuuuguucugcuucuucugccucugcuguuccaggagucuuccauuuuccuaucugcugugaaaugcuugcuggucacuuuucuaccuugguuuucuuuuauccuuaccucccuucuaucuggcugauuggugggcuuuccaugugccucucugugcacaggacaccucgccaucacuuuuacaaugcuguucccucuuagucauuucuuagucguuucaccacccuuuaaguuuccaggaauaaucuuuuucuuuuccucucguucuuugugaccagaauuuccuuauuuuuacaucucuuuucuccuugguuuauaaagauauguuugaaagaguaggaaaagaucagaggccagagugaauaccugccaacuacaugaacuuugagagccagaguggucaauucgaaggcacucugguuuauguaguuuuaaaaugucuaaccauauaucauacuuuucaguauuuuuuacugcagauauacaguaccuuauuuaauauuauagaagaaauaguuuaaauaaauuuuguggaccaggauuuaaaccaccuuaguucuaugguccaaauguguuucaaguuccaaaauaccugauuucagaacaaauuuuuggaacauacucguuuauaaaaguuaguaacucuuuuuauaaaccauuacuuacagaaacauugaccucuuauuuuaauauauaaauauuugcuuguucuaaaauuuauuuguauuuuuuaaauuaauagcuuuuucugggcaguuuuagguucauagcaaaauugagugaaaaccccuuguaucucugccccugcacagacacacaaccaccccugcuauuauugucccacacuacagugguauaguuguuacauuccaaucgauaaaccuacauuaacacaucauuaucaugcaaagucccuaguuuucauauggguucacucuugauguuguacauuuuauggauuuuuacacauauauagugacauauccgccauucauaccauacagaaaaguucacucccuuacagauccuccgugcugugccucuucaucccuuccaccccacuaaccccuggcaaccacugauauuuuuacuguuucuguaguuuugccuccagaaugucauauagauggagucauacaguauguagccuuuucauauuggguucucccacuuacuaauaugcauuuaaguuucauccauaucuuuucauggcuugauagcucauuucuuuuuagcaccgaauaauauuucguugucuggagguaccacaguuuauauauccauucaccuacugaaguaacaucuugaucaccuucaagauuuggcaguuaugaaucaagcugcuauucacaucugcaugcagaauuuuguguggacauaaguuuucaguucauuugaguaaauacccaggagugugauuacuggaucuuaugguaagauauguuuauguuuguaacaagauugccaaacugucuuccaaaguggacauccagaugcauaaaaaugaaucuagauauuuugcauuuccuguaccauuuuguauucuccacuagcaauggaugagaguuccuguuacuccacauuuucuucagcauuuguuguugguguuuuggauuugggccauucuaauagguguguaguggcaugcuuuucuuguuuuaacuugaaauucccuaaugacaugaguuugaacaguuuuucauacgcuuacuugccaucuguuuaucuuuggugugagguaucuguucagguauuucacccauuuuauaaucagguuguucauuuucuuuaguuuuaaugguucaucguauauuuuugauaacaguucuuuaucagguacaucuuuugcaaauauuuucuccaagacuguugccugccuuguucucuugacauugucuugcagagcaaaaaaaaucuaggcugcaguuacagauuuggaaguuaagagcauauuggugguauugggagccguaaaacugcauaagauaaccaaaacaguauauguagguagaaaagagaagaguguaaggucuuagcucuggaggacuggugauauuuaaagcuuagggugauaaggaauaggaauagagagugagaacgaggggccaggaaauguaggaaagcuaacaaaguauguuauucuaggaaugaaagagaaaguguaucaaggaggaugugauuggcugugucaaauguugcuggaccagucaaauaauaugaagauugagaaaugaucauuggguguagugaugaggucauuggugacuuuggauaagagcuguuucaguggaguaaugggaggaaaugccuguugggaaugaguucaaguaacaacagaggagagaaacugaagauagcagauguagauaagauuuccaaggaguuuugcugucaaggaaagaugauugagauggaaacucgaagggagagagaaauagagauuuuaaaaaauaauaauaaaguugggagaaagggcauuguuggauucuuauuggcaucacucaccagagaaggaaaaauggaugaugauucaagacaguggaagagacagagagugucggucaguugcuagccucuaauaugauuuguuuaaauuacaguggacucagcccugcaacugcucaugucccuuccugaccccuucccaucuugccguauguuuugacuaacagaugguacauuuaugagaaugaaaagaggccccuaauccagacagguagccaacacuaccuggauuuuaggacuggauuuuagccuucacuuguccuaaacuaggugucuuuggguacagcaaaguaaucauacuaccauagcuucucugcuuagucuacuccaagacaauaggaaaaguuauuuacuauccugcaauaguuaaauguacacuuuguccuauaguuaaauguacacuuuguccgauggcaaauagcaugauaagugggaagagagcacauuuaagaacuaagaauuuggugugggaauccaagcucuucuaucaacuggcaguaaaauauauuugaggagaguuuaaggcguaugagucgucuuaccaacaaguaauuaugaguuuagauuuuauuugaacuaucucucuuguuuguauuuuauaaaguaaugguguguuaagcgcagugcaccaaaauguaacuaagacuuaguagcaccuaggacucagaucuugguuuuucuuacaacauucgcacugaaaggaacccuggcucuuuggaaaaauguuugauuccaaggaugggauuccuuaugccaaaggaaggaaaugcuuaaaaaaaaaaaaaaaaaagaugcuaacauguugcaaggauauaggagucauuuugaaaggguuccccaucagccaaaucugcaauaauuuggguaucaaaauaauuaaagucaguaaugacuuauaaagcauugggaaaaaaugagaccauaccaguaauacuucuguacauacguacaggcaggagaagaggcucaagggguaacuguuaaguguagagaaaguucuagaauuggaaaaucaugauuuuauugcuguaacagaauaccugagacugaguagguuauaaggaaaagagguuuauuugguucaccugaugggcaucugcaucuguugagggccucaggcugcuucaacucacaguggaaaggcaggcaucaagugcaaagagaucacaaagcaagaggaagcaagagagagaaaccaaggaaagccacucuuuuuaacaaugaguucucuugggaacuaauucauucuugcuagagugaggacucaccccugagggagggcauuaauuuauucaugagggaucuaccccucugacccagacacuucccaacauugccgcguuugggggucagauuucaacuugaguuuuagcagggacagaucaaaccauagcaaucacaaauggaugcuaaaucuugggaagaaauuuugauaagaagcaggauauuugccuggucuugaagugucuguccaaauauugcuuauugguugcagggaaaagauaguaacuaagcaguaggaaaauuggauagcaguuugucuggaugaugaaacuuaacaucaccaaugagguacagguaggugcugugugccuccaaaugugauaccaugagaaggacacauacuauuucagccagacaccuacuauuucagccagaaaugcguuacaugaaucaaaucaugaggaaacauggcaagcucaaaaugaugagcauuuuuuaaaaaagaagacuagauucugcaaaaaacguuaauguuauaaaaguuaaagaaaggcggaaaggacccauauuaaaggagaauaaagacacaggaaauaacgugguuccaagacuggguccugcaucggagaaaaauuaauuuuuuaaaaggguauuaccgaaucaguugacaacauuauaauacaaauuguacuuuaaagaauuguauuaauguauuuacugaaauuguaacuguauuguaauuuauaggagauuguuuuuaggaaaugcacacugacauguuuauggggaaaaggccgugugcaacuuucaggugacucagaaaaaaguaugucucuaugcaugcuugcagguuuagagggguguguguuucgggagagagaggagcaaauggggcagagcagaaugcuaauggagacuggguaaaguuauaccaauuuucuuuguacuuuucuugcauuuccucuguaaguuuguaauauuuccaaguaaguucauacacacaugcacaugcaaacacauuggggcuuauuucuuuuauacuuauuuuacuucuuauugcucuagauugcuaauuuaccuuuaacacuucccugguuuuaggauauuaacauucauugcuaauauauguacauacugauuuuuaauuucuuuuaaauagugcugggccuaaaggagauaacauuuaugaauggagaucaacuauacuugguccaccggguucuguauaugaaggugguguguuuuuucuggauaucacauuuucaucagauuauccauuuaagccaccaaagguaagaagcuugaagugcauucuuuaguauuuaauccuucuccucuaaaaucgguuauucuagaacuuaaauguguauugaugcaguuauuuugauuucauugcuuuucauggauugauauggaaauuuucgcauaaucaagaauuuuaaaacaguaauugacuccuuucacaaauaauuuguaauaaacagaaagaguuuaauucuuaauuguaaauaaaacuauaccuugcacaucaauaaagcagauaaauuuuaugcuuaugagggagaagauccuaugaaccuucauuaauaccuuaauuaauaauaccuuaauuaacuauuaagguauuaaugaagguauuaggauaaaaaguaaaacuguuugacagcuuccagaaauaaggguuuaauaaugugaauuuugugcugaauaccuuuauagauaagcaaaaacuucauagccaagaagagggaaacuaauaauauuuaguaaacucauuuuguaccuucuguggguaugauguaguaguggaagcagaaugccugaguuuuguuggcucugaguucauuugaaguaugaauuagauggauaacagagaacggggugaguugugccuucuaaugaccaucaacuuugcaaagcuuaaauauaacaauuacuugaauggcucccuccgcuaacuucuguuucuacaauggucaagucagcagguaaaaaccacuggaauuaagcaugagcauuauuaugcuguuguuacagagaugucugacauagcaggggaaaguguauuuucaaguccauagcccuuaacuauggugaaauguuuuucuuuuccaacauggugacuuuuguucucuguacuuuuaaaaauuuauguugcagucuauaccauuuaaaauuuauguagccuguguguauauguauaugugcacauaaacggauuuauuuugugaauaaaagaggguuauuucucaguaacuuauugucuaacaagguaacgagugccaucuagugguauuuaccccaaaccgcagacaccauuuacucucaauuacagcuguuaguguuuaaagugcuuuaccguguggucccaucagcauguaagaucuugaaauuauuuuugcauauggggaagauuaauugaagaaaaagacucuuaaguuuuccuggacaccuuuuaaugaaaaacagaaauuggcuaauauaagaauuucacacuauauaguacuguauaugauuugccguaauuuugaugaauauaaugauuauaaauuuagcauguugguuuuuugcugaaauugcaauauaucaucuaauucuuuaguguucacucuguugcugagauauacaguauuaaccauuaagaucuauaguuggacaaaugaaaaauaagauuucugguauaaucuugguauuuggaacaauuauuucucugcaaugcuaaaucuuuuugaaguuuggaaaaguugagcuucuugaaggauaauaaauauuuaauagaaaucugcucaugaaugcuauucuguucacuaguuauagcugaaaauauauuuguaaaucacauauguauugagcaguaacgucagugaucugaacauaaauuauuucuauauucuagagcagcauuaauggaaauauaguaaaaucuacauguauaauuuuaaauuuucuaauagccacauaaaacauaaaacaauuuuaauacuauauuaguuaacccaacauauuaaaaauauugucauuucaacauguaauccguguaagaguauuguuaaugaaaucuuacacauuuucuuuuugguacuaacucuuugaaaucugguauuuauuuuacacuucuaguucgucucaauucaccuugccacaauuuaagagcuguauaugcacauguaacuaguauaugcuguauuggucagagcaguucuagaggggcauacucuccuccucccccacuaaacuaguguguugguccccuacccccucccugucaugcauucuuuucaggaagacacuuuugagagcauuuaauguuuuccucccagauucaacuuuugcgcucacaguacacugcuaguuuucaaaugaucagaaauuuuuuuuuuucucggcaacuccaauuaugaauuagcuauccaauuaguguuugugauuguuuugagacuuggcaguguuuguucuuaugauuuaucuucuuuucucacacauuucagggauauauuaguuuccuuuauccaguagcuaaaaaccuuguuuauuuuauuuuaauauuuuagccuaacaagacagugaaccagcuguagaaauaaaaggcuaagaaacagaaaggcagguagugugaaugauuuuaccaaccgucuucuaaauccuccaguauuuucuaacguuugguaagaaauuagcugaauugauacugaucuuuucuaguaagaaacugauguaacuuuuauguuuuaaaaaaaaaucuucaucaguuccucuuaccuucggcaccaaaacauuucuuuucuuccucacuuucugucuuucuguauguauguguacacacacaguuguauaugcuguggauguguaugcaaacagacguacccacacacauagauggaauuacuguaucaguuauuuaaguauaacugaucaguuccucacuuuaguucuuucuauacaggguaaaaacaaaaaauuuuuuucaacugagucaaaagcauuuaauuuuguuauuaaaccuaaucuaaguuuagcuccagucaaauaauuuaguaucaucuaugauauauuacccuucauuuuuuuuuaguguuuuaauugguaauacagcauucauuuuccuucuguuuuuaaugugacugugcuuagguuacuuuccgcaccagaaucuaucacugcaacaucaacagucagggagucaucugucuggacauccuuaaagacaacuggagucccgcuuugacuauuucaaagguuuugcugucuauuuguucccuuuugacagacugcaacccugguaagcaaaucuuuauuaacauguacaauaagacuacaaaaacgagugcuuuuuuuuuuuuuuuuuuuuuuuuuuuaguuagcuuuaaauguagauugagagguaaauguuauucauagaaagauccccauaaaacaguuugugaggaaauuaccaaugccauuugaaguagacuaggccaaaaguuucucaauaccuucauuuaauuuguuaauggcauaccacucuauaauuauuuugucaccaucauuaauggaaucucuacuuuuaaaaguauuuaggugcacagaccacuucuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuuguauuuuuaguagagacgggguuucaccuuguuagccaggauggucucgaucucuugaccucaugauccacccgccucggccucccaaagugcugggauuacaggcgugagccaccgcgcccggccgaccacuucuaacaagaguaaagcaaugugucugaaaccagugccuccuuuuccugcuccuuccaugcugcuguaugcuuuuaggcaacuacuuuaauaauagaaggcuucuuguucucccuuccuuuuuuaauuaauuaguuauauaaaguguaguaguaauggauauuaaaaugauagccaaugagaauugaacuagauuaugauuauauaaccucagauaaaaucauuuguguauaauucauaacuuuaaaaaaugccugccacaugugaacuucagaaacuuggguagcugacuugauaaagugauguuuagaccugaaauuucacacauuuuguuucguuaugugaccuuuuuuuuuuuuuuaaguugacuuacuucuaaauauuugauaagucacuaaagacuguuacuguuguuaccuuaugcucggcagagauacauaugcaauagauagugacagauggauauucauugugguauccuuuauuagaguauuggaaacaaccucaaugcccauuaauagauguaacguuuaaaaagaaugugacaacucuauaugaacuaauagggaaauaucuucaagauauauuaaguauaaaaggcacuggaaaaaaauacauauacacaacauaauauucuaaaugcuugucagugcauguaagaacucugggaaguaauguuguaaauggguaacaauuguuugccagggaaagaaacuucugagcaguuggagucaggaaggaagauaguuuuuuuuuacuggcuaugguuugguacaauucaaauauuguaccauauguacauauuuuuuuguuuuuaaacaucaaaauaaaaauuuauaucagguucacucucuaguucagaauucuacuuaaaacaaaauggcaaguaaguuuucaaguguaaauauugauagugauuagagucauaucaggcacagaaugaaggaagcauuuuauuugaaauagcaugguauuguaagacugggguuuuauuuuaaaauuaaccauuuuugaacuauucauaagcagaaauauaaccaccuaguauacuuccauuuugaaugaaaggccaaaauuacaaaauaguuuuuguauauuaaagacauaucuuuuauaaaagucaaaucuaacuuuuuauauauagcucaaaauucauuuuuuuuuuuaugaaggggacuuuccuaacuggaauauuaaaauauacauaugaucauguuacuuuaaacuuuuucuuuugaaaauuuagcuauuauauaugaagauacugcugaaaaauaagcauuucauuuuaauagaauauuagaacuauaccuugaagaagauaccacaaaauagcuuuuaauguucuuucugcuuuuccagcggauccucugguuggaagcauagccacucaguauuugaccaacagagcagaacacgacaggauagccagacaguggaccaagagauacgcaacauaauucacauaauuuguaugcagugugaaggagcagaaggcaucuucucacugugcugcaaaucuuuauagccuuuacaauacggacuucuguguauauguuauacugauucuacucugcuuuuauccuuuggagccugggagacuccccaaaaagguaaaugcuaucaagaguagaacuuuguagcuguagauuaguuauguuuaaaacgccuacuugcaagucuugcuucuuugggauaucaaaauguauuuugugauguacuaaggauacugguccugaagucuaccaaauauuauagugcauuuuagccuaauucauuaucuguaugaaguuauaaaaguagcuguagauggcuaggaauuaugucauuuguauuaaacccagaucuauuucugaguaugugguucaugcuguugugaaaaauguuuuaccuuuuaccuuugucaguuuguaaugagaggauuuccuuuuacccuuuguagcucagagagcaccugauguaucaucucaaacacaauaaacaugcuccugaagg

SEQ ID NO: 191205 - RNA, 25349 nt, Homo sapiens
gagcgccugccguuucucggggcgggacgggggggcggggacugggcggagaggcgcgugcugcugcgugcgugcgcgcgcgccgcgggcgggccagugaaaccggcggcccuggcacgugaccuaggaccggcucaccgggucgcuugguggcuccgucugucuguccguccgcccgcgggugccaucauggcggacgcggccagucaggugcuccugggcuccggucucaccauccugucccagccgcucauguacgugaaagugcucauccagguaugaggcgucgccgcucccuaccccgcccggcgccccguucggucgcugcugcucagggcgccugaggaucggcucagccuugcgggccuuucauucucccgagaugcugcugcuccuccgcugcccuuuaccuccccgcagggacagcuuccucagucccgcggccccgcuugggggccucgccgagcccucgccucgccgcccagcguugaggcccucuccucccuuagccaaccgccacccggcccugcccugcccggcggauccucugaacuuugguucuucgucacugagguggauccuggccggucgccaccaaaggcuuccgaacccucccucucgccccuccgaaauucacauucaccacuacuccccccaaaaucucagacgcaaaacacgaaauacucaguugaagacaaaugugaaguuaggugggaaccaacauuuuauuuuuuauuccuuuuuuuuuucuuuuuaugcuacuguuacuacugcuuuucuguuccgagguuuucgcaccagauacugagagaaacacaaggagcucauucagaaguguuaaugaagggguugcucugucagauuucggaaggaugcauugagcgcuuuccagcagcggcccauguggcuccugacaaugaaaaucacauuugucagagcuggaaauuagugaagcugaguuuuagcgaguuuaaacaugggaguuaguuucuaaucuacugucaaauaauuauuacaugguauuuuauauucacaugcagguaggccaaguaagugauagacuuaguguuuccaguuccuuugcuauaucccuguaaugggcaggucauucuuuuuuuuaugcuuuuacugagaguugacauaauuaccucaugcacugugccuaggaauggaacaguuuuuagaaccccugucucgccgucuacuuuucuguaaaaaauaggcaagacacuagagagggccccauuucuuauucuugaguuguugggaauccaaauuauuucuugcugaguagaccugugugaauucagauuccauauguuaaaggcuauugcaaauaaauucuuuguacuuagaacaaagacugauuagaauguacuguaacauccaaaacagaauuggcacauuuggggcuagauagcaucggaggugacagcauguugcaguauauaguaagaacccuuggggccgggcgcguucgcucacgccuucccagcacuuugggaggccgaggugagcggaucacgaggucgauguuugagaccagucugaccaacauggugaaaccccgucucuacuaaaaauacaaaauauagccaggugugguggugcgugcacguaaucccagcuagucgggaggcugaggcaggagaaucgcuugaacccgggaggugaagguugcagugagccgagaucgcgccauuguacuccagccugggcaacagagcaaaacucagccucaaaaaaacaaaacaaaacaaaaaagaacccacuacucaauacuucucugggagacgggguuuucuaaugauguucagagcucuugccccaaaaacuuugaauauucuuaauucugauuucacaacaucuauguguugccaaguagcccaggaguuuuggugaaauucccaaaugcucaguuguaaaaauaguuacuugggccgggcacgguggcucacgccuguaaaucccaacacuuugggagccugaaacaggcgguucaccugaggucaggaguuaaagacuagccuggccaacauggcaaaacccccucucuacuaaaaauacaaaaauuagcugggugugguggugggugccuguaaucccagcuacucaggaggcugagguacgagaauggcuuaaaccugggagauggagguugcagugaccuagaucgugccacugcacuccagccugggcgacaagagcgaaacucugucuccaaaaaauaaauaacuaacuaaauaaaaauaaaaaugguuacuugguagcacuuucagggagcucagacaggaguuauuuguuuauuuauuuguuguuguuuuugagauggaguuuugcucuugucacccagacuggcaugcaauggcacaaucucggcucacugcaaccuccgccucccagguucaagcgacuguccugccuuagccucuugaguagcugggauuacagguguccgccaccacaccuggcuaauuuuuguguuuuuaguagagacaggguuucaccauguuggccaggcuggucuugaacuccugaccucaggugauccgcccaccuuggccucccaaagugcugggauuacaugcaugagccaccacgccagcccaggaguuacuuaauaggacagauuaagagucacaacaauaaucaaaacuauguccuacagcauucauucugucaaguaucuguaguguuaaaaauccuggguauauuguacaaagaccaugguaaucauuaacuauauaaaauggacuucauuagcuguuaaugacagccuguguuuuuuuguuuguucguuuguuuguuuguuuuugagauggagucucgcuguugucggccucggcuggagugcagugacacaaucucggcucacugcaaccucugccucccggguucaagugauucuccugccucagccucccaaguagcugagauuacaggcgcccgccccuacgcccggcuaauuuuuuaguucuaguagagacaggguuucaccauguuggccagacuggucucgaacuccugaccucaggugauccaucccccucggucucccaaaguacugggauuacaaggcaugagccacugcgcccgaccgacagccuguucuucuaacaugaaguuagcuuguaauucuuuccuaagugaauuauccagcuauaucugcauuugccuuuugaguguuuugucuggguugccaaauaugcagcugaugcuggcguaauggaugucuucuaguuuuguucaaauacaaaaugugccuuagauuuuauuuagaagguauuuuugagcccccuuaguaaacuguagcuuuccuaacgcaaaaguucccuucuuucaguuugauauuagccuauuucagcuacaugguuuacgucauagaauuugaaccaaaaugaaacuuggaguuuauugaacucaguauuaccaacagaagaaaaaccuacaagaaugaugcuucaucauugccuuggaaaaccuaugcugcauuuuuacuuguguuuaaaaauaacccaaauuguguucuuuauucaagaccuugcaagcaagacauuucuggaaauauugcuuuaauauugauauauuccauuguuuuuaaaggugggauaugagccucuuccuccaacaauaggacgaaauauuuuugggcggcaagugugucagcuuccuggucucuuuaguuaugguaagugccuuugauuuauuuggguuugcaugacguugaggacugugauaggcaggaguuguuauugaaagaaaauauauagaaagcuuguuucuuugaaauuguaguauauccauuucucuugaccagaacuugacaacaucucugacuuguguucuuagcucagcacauugccaguaucgaugggaggcgcggguuguucacaggcuuaacuccaagacuguguucgggaguccuuggaacugugguccaugguaaaguuuuacagguaagaggaaaauuaaaucaaucuucccauagauguugcuuaccuguuaugcauaguuuguucuaaauaucaagagcaauuuaaaagauacauuuauaacccuguccuuucuuccucuugaaaaacacuuucuuuuuuuuuuuuuuuuuuuuugagauggagucucacucugucgcccaggcuggaguguaguggcgcgaucugggcucacugcaaacuccgccugccggguucacgucauucuccugccucagccugaguagcuaggacuacaggcucccgccacugcgcccggcuaauuuuuuguauuuuuaguagagacaggguuucaccguguucucaauauccugaccucgugauccgcccgccucggccucccaaagugcugggauuacaagcaugagccaccgcgcccggcgggacucagugaaauuguugcuguuacuuccaugaaauuuacauauggaaaggcaguugucaucuagccaaagagguuuguguauagacuuagagaaaaagagaaagugcugcuugagacuaaguuacuuuauguaacuguaaaguaagacaaacuugagguaaccagguacccugaauauguuccaaauguaguccagugaaauauuacaggguugguacuacacuuagcauccaaagcugcuuguacagucaagaagaaggaucuaugcagggcugagaaaauuauuaaccuuuacaagaaauaauuuuguaaacugaacaagaauuaaaaugaaauucaggaaauguagaagacagguuagauaauuauaucgauggaguaaauaacaaaguauagaaacaagugaaaauuuagagaccugaagcuauuagaauuaauucuagccaaggaccuggaauuuggccaaaauacauuacuuugcuuuaucuucacauuuguucucuugcccgugauuuuuuuaaacacaauucuuuuuacaagagaaaauguugucuauuuuugaaaucugauauggcuagaaaauaauaaaacugacauuaaaaaauaagaaaacaauaaaacuggugguuacacaagaaggagcucucaauugauaauuuuauuuucaccuagcucacauucuauuuccaaaauacgccacaaaaaauuccucuugcaagaauuuuucucugggcucuggcaguauucaugaucucuucucuagaagagaaaaaaaaaaccucuugcuuguuuuagaaaccaucagauacaaaggagaaagugaggcgauuucagcucuucagucuuaauaucaauucucuguccuuuuaugcagggaagaaaagagucuugcccuaauuugguauuggucaugcguuuuccaugagaaaagugggaacccugggcuauguuuuuacugacuuauuuucuguuaaaacugaaaguucuuggccaggcgcaguggcucaugccuguaaucccagcacuuugggaggcugaggcggguggaucagccgaggucagcaguuugagaccagccuggccaacauggugaaacacugucucuacuaaaaauacagauguuagccaggcgugguggugggcgcauguaaucccagcuacucaggaggcugaggcaggagaaucgcuugaaucugggagguagagguuguagugagcugagauugaaccauugcacuccagcagugagccgagauugcaccauugcacuccagcugggugacaagagugaaacuccaucuaaaaaaaaaaaaaaacagaguucuugaauuuucuuuuuuguuguuguucuuauuuuguaauuauuucuuuaaauuuauuauuauuuuuuuagagacaaagucucacuauguugcccagucuggucuugaauuccugggcucaagcaguccucccucuucggccuuccaaaguguugggauuacaggcgugagucacugcgcauguucccuuuucguuuuuuggguuuuuuuguuguuuuuuuuugagacagaguuucacucuuguugcccaggcuggagugcaauggcauggucucggcucacugcagcuuccaccuaccggguucaagcaauucuccugccccagcuucccacguagcugggauuacaggcaccuaccaccacgcccagcuaauuuuuguauuuuuaguagagaggggguuucgccaugucagccaggcuguucucaaacuccugacgucaggugauccgccugccucagccacgcaaagugcugggauuacaggcgugaggcaccaugcccggccccuuuucuuuuuuucugagauggagucuugcucuguugcccaggcuggagugcagugaugugaucucagcucacugcagucuuuaccccccggguucaagcaauucuccugucucagcuucccaaguagcugggauuacaggcgcccgccaccaagcccagcuaauuuuuguacuuuuaguagagauggaguuucaccacguaggccaggcuggucucaaauuccuaaccucaggugauccaccugccuuggccucccaaagugcugagauuauaggcgugagcuaccgcacccagccuucccuuuucuuuuuuuuuuucuugagacggacucuugcucugucaccugggcugcagugcaguggcgugaucuuggcucacugcaaccucugccuccuggguucaagugauucuccugccccagccucccuaagagcugggauuaaaagcgugcgccccaaugcuccgcuaauuuuuguauuuuuaguagagaugggguuucaccauguuggccaggcuagacuugaacuccugaccucaggugaucugcccaccucggccuccuaaagugcugggauuacaggcaugagcaaccacaccuguccccuuuucuuuuuucaaagaagaguuuucaugaccauuugcuuuucuuccaacugaccaauauguuaaacuuagcaacaaguuuaucuuggagauccauauuuccaguugauuaaugaguagaaguuaacugaagauuugcagcuuaaaaaaaaaaacaaaaacuuuaaaaaaaacuucagcuaauuuacuuucugucaguagaguuuucauuuuaugucuucuuucacaugacacuguaauaacccuaaucauccuuuuucuuuuuuucuauagcauuaccaggagagugacaagggugagguauguuggagcugauuucuaagcaugagggccuuucccuugcaaguuguuacugcuuuuggggccucuuuuggagaaaagccaaguagucagucuccuauucaucucagugaguguuguccuaugggguggccaccaguuuggacaguucuguuugaaaccaucaggauggcugggcaugguggcucaugccuguaauccuagcaguuucggaggccaaggugggaggaucacuugcaucuaagaguuugagaccagccugggcaacauagaccccuucucuacagaaaaucaaagauuagcggggccugguggcacauaccucuguaucucagcuacaugggagguugaggugagaggaucacuugaguccaggacgucaagacugcagugauccaugaucacaucacugcacuccgcgugagugacagagcgagacccuaucucaaaagaaauaaaaaccgucaagaucggccgcccaugguggcucaugccuguaaucccagcacuuugggaggccgaggcagguggagaucacgaggucaggaaaucgagaccauccuggcuaacacggugaaaccccgucucuacuaaaaauacaaaaauuagcagggcgugguggcgagcaccuguaauccuagcuacuugggaggcugaggcaggagaagcacuuguacccaggcgguggagcuugcagugagccgagauugugccacugcacuccagccugggcgacagagcgagacucugucucaaaaaaaaaaaaaaaaaaaaaucaagaucucuauuuucuuugauuuugauuuccaggaguuaggaccuggaaauguacagaaagaagucucaucuuccuuugaccacguuaucaaggagguaagagaugaauuacauccugugcuguuugcccagaucaaacugugguguugcaacuauggaaucagaaucaucaggccuguguguucagugucuguucccaaaugaaauuaaaccuucaaauuaauuugggcuuuacuacauguauaacauuaaaaagagagaggaucagugcuugcuguucagaauagaugcauuucaagaaaacucauuuugcccacacauuccgucuuuagaauacugaaagucuucuaauaguguugaaaaccucaggaauaaaaguguuaaaauaggccaggugugguggcucacgccuguaaucccagcacuuugggaggccaaggcaggaagaucacuugaccccaggaguuagagaccagccuaugcaacauagugagacuuccucucuacaaaaaaaauagaaaaauuagcuaggugugugguggcacauaucuguagucccagguacucgagaggcugcggugagaagaugacuuaagcccaggaaguugaggcugcagugagcuaugauugugccaccauacuccagccugugugauagagcaagaccuugucuuuagaaaaaaguauuaaaauagcgaccaggcccuuuguauguuggauaguaucuaugcagaaaggcucuuuugacauuuuucugacucugaaaaguuccucaucacccauuucccacccccauaugcugccauagguguuucugugccuggcuuucagaacuauucucuuauuacuuaagucuucacauugucuuaauugucauuaaugaagucacaauuauccaggaaaugcagccauccaaaauacauauuccaaaggcugggcgcaguggcucaugccuguaaucccagcacuuugagaggccgaggcgggcggaucaccugagguugggaguuggagaccagccugaccaacauggagaaaccccgucucuacuaaaaauacaaaaauuagccaggcaugguggcgcaugucuguaaucccagcuacuuggggggcugaggcaggagaauggcuugaacccgggaggcagagguuguaaugagccaagauugcaccauugcacucuagccugggccacaggagugagacuccaucucaagaaaaaaaaaaaaaaaaaaaaaaaauauauauauauauauauauauuccaaaacaaacauuacuaaaggucuggaaaccagauaaauuagcucuauuuucuguaaauuuucaugaaauuaguuugcuuaaaagcagggauacggccgggcgugguggcuuacaccuguaaucccaacaccuugggaggccgaggcgggcagaucacgaagucaggagauugagaccacccuggcuaacacggugaaaccccgucucuacgaaaaauacaaaaaaauuagcugggcaugguggcaggcgccuguagucccagcuacucgggaggcugaggcaagagcauggcgugaaccugggagguggagcuugcagugagccaagacugcgccacugcacuccagccugggagacagcgagacucccucucaaaaaaaaaaaaaaagcagggauacauguauuacuaugcaauuaguauuuuccuuaguuugcccauccagucccauaggaucuuaugcccuuggagaaggggugagggcugucuuaaaacucagugacuaggccgggugugguggcucacaccuauaaucccagcacuuugggaggcugaggcgggcagaucacgaggucaggcauucaaaaccagcuuggccaacauggcgaaaucccaucucuacuaaaaauacaaaaaaaauuaacugggcaugguggugugugccuguaaucccagcuacucaggaggcugaggcgggagaaucacuugaaccugggagguggagguugcagcaagcugagaucgcaccacugcacuccagcccgggcaacagagcaagacucugucucaaaaaaaaagaaaagaaaaaacucagugaccauaaagauacuguuuaaaugcaaaagccggccaggcacgguggcucaugccuguaaucccagcaguuugggaggccgaggcgggcggaucaugaggucaggagaucgagaccauccuggcuaacacggugaaaccgucucuacuaaaaaauacaaagaaaaaaaauuagccgggcaugauggcgggugccuguagucccagcuacuugggaggcugaggcaggagaauggcgugaacccgggaggcggagcuugcagugaaccgaguucgcgccacugcacuccagcgugggugacagagcaagacuguccuaaaaaaaaaaaaaaaaugcaaaagccaaugguagaccugcuuacauuugcaaucccagaaccuaaaugcaaagauuauaauuuaauuuucuuuauuacuuccuuacagagcccuagaguagaaagauaaacuaggaaaaacacagcagcucuaagauacugcacaguuacuggguuguagucacaaaacaaaauuguucucuucucccaaaaaugugaguagagacuaaauggagccugucauuuaucuagaaugaugucagacucuccaaaaucacuuaccaauaagagagcaacuuaauaaucucaauaaaggccucauauuuuuuauuucagcuuaaugacuuuguuggugaccuuuccuguuucuuuauuuuuuucucuuaccuguaaaauugagaaaacaacagaagccugcuuugcagagaaauuuugagaaguaacuauaauagaacauugagauccaugagugaaaaguaugauaaaaugacaaugaaugagaucuuucacaucccauucaaacucuucuugacuccagccagggcaggagggcugugucauucacuuucuuauccuauaccacgauauccacccacauuccuucucacaggcauuugagugucauuuguuuagauuucagaaguguguguugauuguuucuagacaacucgagagaugaucgcucguucugcugcuacccucaucacacaucccuuccaugguauguuugcaguugacaacugaccuuucuuuuauaaccugaucucuccugaccacuuagauagguugacgugggaguugacuaaaaugccuugccugcauguuuuuguuugcuugcuuguuuuggcuuuuauccaauuuauccagauagcaaaaugucuuuagguggaaaaucuuuuuuuuucccagggcuaucaaaaucuaucuuaacauaguuuuuuuuuguuuguuuguuuuuuguuuuugagacggaguuucacucuuguugcccaggcuggagugcaauggcacaaucuuggcucacugcaaccucagccuuccggguucaagcaguacuccugucucagccuccuaaggagcugggauuacaggugcaugccaccacgccuggauaauuuuuguauuuuuaguagagauggggcuucaucauauuggucaggcuagucuugaacuccugaccucaggugauccgcccaccucggccucucaaagugcugggauuacaggugugagccaccgcaccuggccuuaacauaguuguaaacaucuuuucucuauauuccacagugaucacucugagaucuaugguacaguucauuggcagagaauccaaguacugguaaguauuuuuguuuucacauacucaaggagaucuuuugaagccaaaguacuagaauaauacuacuuuguauuuuuaugauacccuuacaauuuguagaacaaauucguaucugaugucauuugaucugcacaaaaaacaauaaaaugggagaaaauauacccaggcagguuuaguagccuacguaggauuucagaguaaguugcagagccccugacuccauaugacuauaccccuagguaguuaauauuuucacuucuaucuccaaauuuagcuaucuuugcagagugagagagugcuagaaaagugugagggaaggaggucguggauuugaccuuguccaaugugauaauugaaauuauuuuguuuauagcuccaaaagaaucuuaauauauuuuaccuuuucuucuuguguacguaguggacuuugugauuccauaauaaccaucuaucgggaagagggcauucuaggauuuuucgcgugaguaaauguugauuaguguguaauuuuugcaugagugggaaacguuuucugaaaguaagaauagugagucuuuguuuaauccuuggggaaaacguacucccugggcuuaccucacguuacauucuauuuaggccccuuauuuuuuuuucuuuuuucucugcagaaaggcauauuuaggccccauaugacuagaauuaucuuguaaagaucccaaaccuuuacuucuagauacuuaaaacauuugaggccgggcgugguggcucacgccuguaaucccagcacuuugagaggccaaggcgguuggaucaccugaggucaggaguucaagaccagccuggccaacaugguaaaaccccaccucuaggugugguggugugugccuguaaucccagcuacucgggaggcugaggcaggagaauugcaugaacccgggagguggaaguugcagugagcugagauugcaccacuguacuccagcccgggugacagagugagacuccgucucaaaaaaauaauaauaauuaauaaauaaauaaggaauuucuuuuuuuaacaaaggacuuaauuccaaguuucuacccuuguaguaaacucccaauucuauauagauaauaaaaugagaaaaauuaaauguugaaaaauggggaaaucaucuuaacuuguauuuuccuuaccguaaaagaguaaguuuuugcaaggcuugaauuuacuuuggaagaacuuagacuacuacccucauucuucuaugaggaaaaauuuugcaucauuaccgaaaugguguuuuuuguuuuuuuuuuuuuaauuuucagaguaucuccccauacggauuuugaauaucauaaauacccugugagauaggcaggacagcuauaauuaguaucacuuuagagauuaaaaaacauugaugcucugagaguuucaucugcugccugucacaucgcugcugagugcuggagcuggcauuugaagcuggucuucaauccguggggaaaugcucuucccacuauuccaugcugccucaccuaggucacccagacccuagaaaugugguuuuugaugccucucaucuguaucuguacuugggaccauucuugcuuuguaauuuuucucgucuuuugcucugccaaauaugaauaucagauagcuuagcaaaaucauuuuuuuaagcuagucaaagcaaaacaauauuuaagucucuucugcaaagcaccucgcaaaucuuuugccucccugcuuacaguuaugaauaguaaggugagccacugaggguauagccgaccugcauuuuaaacauaggaacaaaagucacuggagaucagcuucaaguacagcuguguuaacgagaaugaacuagguaugcgggcuggauucugguguuugauuccuuuuuuacuucccuagaauguuuugugaccucuaauuauuugacaaacauuuguacugaagagccugucauguuacugaucacauuuuuugguucuuauuuuuauuguuucuucauguaggggucuuguuccucgccuucuaggugacauccuuucuuuguggcuguguaacucacuggccuaccucgucaauaccuaugcacuggacagugggguagguugugaccuucgugagaugugcucaccuuggcuuuaaucuggcagcuagauuagcuuuuaaaguaagaugggccgggcgagguggcucacaccuguaaucccagcacuuugggaggccaaugugggcggaucaccugagaucaagaguucgagaccagccuggccaacauggugaaaccucgucucuacuaaaaauacagaaaaaauuagcugggcgugguggugcgugccuauagucccagcuacuugggaggcugaggcaggggaauugcuugaacccaggaggcggagguugcagugagccaagaucgcgccacugcauuccagccugggugacagaaggagacuccauuucaaaaaauaaauaauaaauaaauaaacaagaugacaguuugcuacaugccagacugaacaauuauauagcuaaaaauuaucagucaaauuuucaaaugcuaaugaaaugagcauacuguucacuguagaacgauacuguuuacuguagaacgauacacguuaaaaguccguaagaugugacagaguauacccaagagacuuagcccuguguuacuucagggcuuuaaagagaucacuucuuuacugauacuuaacuugagagaaccugggaaagcaggacaucuuuaugguguaucgggggcuuuucaucuaaucuggacuuaagagggugccuguauugggcuuucuagaaaccucagccuuuugagaaucagucuuaucuagaaguugucuuucuuaucucagcaguuguggggccucuuguaugucggcagcuccauagcaugaugauaaauugaacacaucacaggguauaugacuaaauccauguuguaaaccucuugaguacagagagggauuuucuucaacgcaucugguagaaagcuagcuguguaaaacaaagguagugaauugucccuuagauauacuauaaaugugguuuuccagggacuguauuucuaggaugugugaaaagguuaucaaucucauuuucuuuaguauuugaaauccuuuuacauucgucccuaaagcauuuuaguauaauaugaauuugucuguuaauauugaaucagguugaucauuuugaccacugccuuauuauucuaauaaucaguguuuuaugguuuuguccucaaaauuaguuuuagacaggugugguggcucaugcuguaaucccaacacuuugggaggcugaagugggagggucacuugagcccaggaggucaagguugugagaucacagcucacugcaccuccagccugggcaacaagagagaugagauccugucucaaaaaaaaaaaaaaaauuaauuuucaagcugucaaacugauaauuuagagauagacuauauugacauggagagcaaggcacaguagcuccagccuaugauuccagcgacucaggaggcuuaggugggagguuugccugaagccaggaguuugaaaccagccuaggcaacauagcaagacaccgucucuuagcugggcauaguggcuuaugccuauaaucucagcacuuugagaggucaaggugggaggaucucuugagcccaggaguuugagaccagccugggcaaacauagggagacccuuaucucaaaaaaaaaaagacaccauuucuuaaaaaauauuuugaaauuagcugggcguggugaugugugcuucaggaggucacugcacuucagccugggugacagagugaggcacugucugaaagaaaaaaagaaaagaaaagaaaaggaaaaaagaauauauugauguguuguaguguuguagguaauuaauuuaaggcucuuuuccuauuuuagguuucuaccaugaaugaaaugaagaguuauucucaagcugucacaggagugaguuuuuuaaaauccuuuuaaccuucuaggaauaguuguguuuuguuuuguuuuccuuuuaaaucuggcuugugucaucacugcuuuaagauaaccagaugucucacugggacaucucccugaaauuuguuauauuugucaaagguaagaauaacucaguuuucggccaggcgccauggcucaugccuguaauccuagcacuuugggaaggugaggugggcggaucaccugaggucaggaguucgagaccagccuggccaacaugaugaauccccgucucuacuaaaaauacuaacauuagccgagcgugguggugcaugccuguaaucccagcuacucgggaggcugaggcaggagaaucacuggaaccugggagauggaggcugcagugagcugagaucacgccacugcacuucggccugggcgacagagugagacuccaucucaaaaaaaaagagagaauaacucaguuuucgaaggaaccacagacucacaugugaaaauaaagagaguaaggcagaaccccugccucacauccugcaugguuugguacugcuuagcuuucauaaggggcgugccuuuccuccgaaauaauauuguucaggccagacaugguggcucacaccuguaaacccagcacuucgggaggccaaggaaggaggaucacuugaggccaagaguucaagaccagccugggcaacugagcaagaccccauuucuacaaaagugaaaaaaaaaaaaaaaagcuggggcaggcgcgguggcucacuccuguaaucccagcacuuugggaggcugaggucgggaguucgacaccaccuuggccaauuuggagaaaucucaucucuacuaaaacuacaaaauuagcugggcaugguggugcaugcccguaaucccagcuacuugggaggcugaggcaggagaaucgcuugaaccccaggaggcggagguugcaggagaaucgcuugaacccaggaggcggagguugcagugagccaauaucacaccauuacacuccagcgugggcaacaagagggaaacuccaucucaaaaaaaaaaaaaguaguuggguaugguggcgugcgccuauagucccagcuacucaggaucagagaauucuucuggccuuuuguuaaaauguuggaugcaguggugugcuaagaggaagaagcaucuccaggcucaaaacuguaacuguugucuuuccaggguaccgaugaagcgagacaaguguuagagugucucaccgcaguggcacuaggccuuuaagguaaaggaaaggagaauaaagacuaggaaugaucuaauaacagcugccuuguuuccauuuuacaguuuuuugcgaguauguugaccuaucccuuugugcuugucuccaaucuuauggcugucaacaacuguggguaagcacuuuguauuucuuauucuaguaggugguugacuguaugcugacaggcggagcagccuuguagaaauuuaggaaagaugaaugaucaguaucaaucucugauugguauuuuuuuaaaaagggggggaggaaaaguauaauugauaccauuagaagauuccuaauuuuuuucuuuguaugcccuaugcagcagcagccucaauuuguauuuauuuauuaauuauuauuauuauuuuuuuuuuuuuugagauggagucuugcuauguugcccaggcuggagugcaguagcaugaucucggcucacugcgaccuccaccuccuggauucaagugauugucccgccucagccuccugaguagcugggauuacaggcauucgccaccaugcccagcuaauauuuuuguauuuuugguagagacaggguuucaccauguuggccaggcuggucucgaacuccugaccucaagugauccacccgccucagucucccaaagugcugggauuacaggcaugaaccaccaugccaggccaauuacuauuauuauuuauaguuuuuguuuuuguuuuuguuuuuguuuuuugagacagaaucucacucugucacccaggcuggagugcaguggugcagucucgcuccauugcaacagacaccuccuggauucaagcaguucucaugccucagcuucccaagaaguugugauuacaggcaugugccaccaugcugggcuaauuuuugcauuuuuaguagagauggggucuugcuauguuggccagacugguccugaacuccugaccuccggugaucugccuaccucggacuuccaaagcgcuggaauuaaaggcgugagccacugcaccuggccuauuuuuauuuauuuuuaauuuuuuuagagauagggcugcaaugugguggugaaguccuagcucacugcagccuugaacuccugagcucaagggauccucccaucucagcuucccaaguaguugggaguacaugugcaugccaccaugccuggcuaauuauuuuuugugaagacacagggucucacuuuguugcccaggcuguucuuaaauuucuaggcucaagugauucuccuuccucagccucuuaaagugcugggauuacaggggugagccaccaugcccagccaacauauuguuauuuuaaaucuuuaucuuuucuaugaaagugacaaaagguauaucagggauuaaaugacaauccauaccuguuuuuccuaggggcuuuauggagaaagugaguuuuaaagaaccagaauuaggauauuuagucuauggaaaguuugaugaccuuuucucuguauugguuagaagggcagguuuugguauagugguagacuccauugauuuccaaauucuagaugccaagugacucuacugaguugggcaaaauuuugccuuuuuuuuuuuuuuuuugagauggagucucacucuguugcccaggcuauagugcaguggugcaaucucgacucacugcaaccuccaccucccagguucaagcaauucuccugccucagccuccugaguagcugggauuacaggugcccaccagcaugccuggcuaauuuuuuguauuuuuuuguuguuguuauuguugagacagagucuugcucuguugcucaggcuggauugugguggcgcgaucuugguucacugcauccuccaccuccuggguucaaguacuucuccugccucagccuccagaguagcugggauuauaggcacuugccaccacccccggcuaauuucuguauuucuaguagagacaguguuucaccauguuggccaggcuggucucgaacuccugaccucaagugguccacccuccucgaccuccuaaagugcugggauuacaggcgugagccacugcacccagccuugccuuuuuuguuuaauucaaaauucuuuucccauaugguaccugacauaucauuaaacauguuacuguuuucaaauaagaucagauagcuauguggaguuuugaacauuuuacauuguuuguuuucugguuuuguuuguuucauguuacuccuggcaagcugugauguuuucugauacguagagcaacugccauuuuuuagcacaguguaaacuugaaggaugaauuaaauguauuauuauuauuuacaguuuuuucaagaugaagugauuauaccuaaguaggaacauauauaucuacuguuuauauccguuuucauguuuaguaucuuugugaacaccaguuaguuuuuaaaucuccuuucccugcucuuuuuuuuuuuuuuuuuuuuuaaaaaaagacugguucuuacucugucacccaggcuggagugcaguagugcaaucuuggcucacugcaacuuccgccuccuggguugaagcaauucacaugccuuagccucccaaguagccgggauuacaggcaugcgccaccaugccagcucauguuuuuguauuuucaguagagaugggguuucaccauguuggccaggcuggucuugaacuccugaccucaaaugauccaccugccuuggccucccaaagugcuggaauuacaggugugagccaccgugcccggccaccuuucccugcucuuuaaucauguaaaugcuguguucuggaguuucauuuguccacaaaggaaaagucuaaauguuuuagaaauuaagguugaaguuuauguuuauuuauuuauuugaaaccuaaauauaggggaggaauucucuuuuggaugcuugaucguuccccugcuucaauaugauuuguuucauugaacuaaaaugaucucucagggaaucuucugugcagcagaauauuuugacaagguuuaucaacgucucaagagaaugguuaauauuaacaugaauagcuccauguuuuuuucuauuuuagucuugcugguggaugcccuccuuacuccccaauauauacgucuuggauagacuguuggugcaugcuacaaaaagagguauuucuuuuucucugucucucucauuuuauuuuguuuuauuuuuauuuauuuguuuucuuaaauauugucucuggaaucccaaguuaacucuuguagcucacuuuagcuagaguuagucuagucugccaguuaauguacacuuuacaguguucuguguuuucacuuuggcauaauaguaaaaugugauguuuagaaaucaugagcaggaguaaugaagaagaaagaaucccuagaugagaccuagaagccauuugagugcccacauucaacuuacaaauacgauccagguagauuauuauccugguaaaaugauggccuugauuuuagacucuuuuuuucccccaaacucaccuuucauaaccacuuauuugucacagugguauugacagagcuggucuuauacuucuagagucuuguuaguggaugauuuugccuagauaccaauuuaggguuuguuauuacuaugagguguauaaucugcaacaaaaaauuauuuauuaucuaggcaaagcuuuauuggaaaauaaaauaaugggcugggugcaguggcucacgcuuauaauucuagcacuucgagaggucuaggugggcaaauugcuugagccuaggaguuugagaccaguugaggcaacaugaugagaccucauugcuacagaaaauacaaaaacuuagccaggcauagcaccuauagucccagcuacccaggaggcuaaggugggaggaucaccugagcccaggaggucaaggcugcagugagccaagauugcaucaccgcacuucagccugggugacagagugagacccuguauccaaaaaaggaaaauaaaauaacggcuagguaugguggcucaugccuauaguuccaguuacucaggaggcugagccaggaggaucacaugaguccaggaguuugaggccagccugggcaacacagccagacgugucucuuaacaaaaaacuacaggccaggugcaguggcucacagguguaaucccagcacuuugggaggccaaggcgggcagaucacuugaggucaggaguuugagaccagccugggcaacgcagugaaaccccaucucuacuaaaauacaaaagaaauuagcugggcguagcagcgugugccuguagucccagcuacuggggaggcugagggaagagaauugcuuuaacccaggagguggagguugcagugagccaagauugugccacugcacuccagccugggugacagagcaagacuccaucucaaaaaaaaaaaaaagacaauaacaacaacaaauggauuggcugugggcuaaauuuagcacaggaucacuuaaaaugauuaucaguuuaaagcuguuuuugaagggggguccacuucuuaaaagauuguagaagaaagcguauaaagaagcucuuuguugcauuauuuuauagcacuagugauauauaagagaaaggccuuugaaaucugaaugaaaaggccuaaguguuguuuguaguugcucuugcuuagugugcccacaaagccccucugugaauccaagcuugaauacuugaaugauuucaguacagaccuacuaugaacauugugcauuucauucugaguuuuacucucuauuguacaguguggucccuguuuaaauggaaaaaauggccuuuccuuccuuccuuuucugacuaacacucuguuauaggaagaaagcagacagagaauggauuacggugucaaacacacuuaaaguaggaacaguuguuccuguaggugcuuacaacaacagcaaaucuugauugggcauuuacuguauaccagauaucaugcuaagagcuuuucuuacaucagcucauguaauccucaaaacagcugugugagaauaggugucauucuuaaucacccauuucacauaugaagaaacuggggcuuagagcaguuuagugccaauuacauaaugcaaggucacauggccuauauuugggaaggcucagauuuauacuccagaguguacucaguugcacucagaacauuauuacuuuauuuuuauuuacuuauuugguucuuuauuuuuuagagacaagcucugucgcccaggcuggugugcagugguggcaucacaacucacuguagccucaaacuccugggguaaagcaauccuccuaccucagccucccaaguagcuaggacuacaggcaugcuuccaccauguccuguuaauuuuuuuguuuuguuuuguuuuugagacagggucucacucugucacccaggcuggagugcaguggcaugguauuggcucacugcaaccucugccuccuggcugaggucucuggcucaagugaucgucccaccucagcaucccagguagcuuggacuacaggcacauaccgcuaagcccagcucauuuuuuuguuuuuuguuuuuuguuuuuuuuaauuuuauuauuauuauacuuuuaaguuuuaggguacaugugcacaacgugcagguuuguuacauauguauacaugugccguguuggugugcugcacccauuaacucaucauuuagcauuagguauaucuccuaaugcuaucccuccccccucaccccuguuuuuuguuuuuuguuuguuuguuuuuuuguuuuguuuuguuuuguuuuguuugagacggaggcuugcucugucauccaggcuagagugcaauagcacgaucuuggcucacugcaaccuucaccucccagguucaagcaauuccccugccucagccuccugaguagcugggauuacagguguccgccacuacgcccggcuaauuuuuguauuuuuaguagagaugggguuucacuauguuagucaggcuggucucgaacuccugaccucaggugaucugccugccucagccucccaaagugcugagauuacaggcgugagccaccaugucugcccaauuuuuuguauuuuuuguagcaacgggguuuugccauguugugcaggcuggucucaaauuccugagcucaagugauccuccugccuuggucucucaaagugcuaggauuaccggugugaaccaucacacccggccuuuaauuuuuuaauuucuuguagagauggggucuuacuauguuguccagguuguuauuacuuugauuauaagauuuuauaaguaguccuuagaaacaugauuucauuucauuaagaaauaaauaggccggguaugguggaucacacccguaaucccugcacuuuugggaggccaagauaggcggaucacuugaggucaggaguuugagaccagccuggccaauauggugaaaccccaccuccacuaaaaguacaaaaauuagccaggcacgguggcgcguuccuuucccagcuacuuaggaggcugaggcaggagaaucgcuugaaccugggaggcagagguugcagugagccgagauugcaccacugcacuacagccugggcaacagagcgagacuccaucucaaaaaagaaaaacaaagaaauaaaugaaagcuagcacuuacugaauguuaggcacuguucuacaugacucauuugcuaagccagcuggaaaguggcaaagccagaauccaaccugggcguucugucugcccagaguaagaacuuaauaaggagaaauuguaguuaguucauaguagcucagccuuucagagaauacuaauccuuguucuguagugauagucccaguuuuguccuagauuuagucacgucucccaauuggaccucucugcugauuuggauuggcugaucucaucucgcuagauauuauuuguguuuuguuuuguuuuguuuuccaggggaauaugagccgaggaaauagcuuauuuuuccggaagguccccuuugggaagacuuauuguugugaccugaaaauguuaauuugaagauguggggcagggacagugacauuucuguagucccagaugcacagaauuaugggagagaauguugauuucuauacaguguggcgcgcuuuuuuaauaaucauuuaaucuugggaaaauucagguguuuggugucugccuuuuuuguucuuuuuuccagcacaacauaacuuaccacugauacucccccuuuaguuauucugaauuaggauauuuuugcuccaaauucuuauuuuacuuaaccagaagggaaaaaaaguuguauuuuccugaagcuacaggcacuuugucaugugauuuuugagucucaauuuaaggcuuuguaaaaugaagaguagaauuccaagaaaaaugagaaauaauuuuguaaaacuuaacaaaaucacuaaauuaaacuauaugggagguuaugaauuacuuuuucuuggguagacccuaaaaugucaguagcaugcaccagaaucugacucccauuaugcuucuaagcacauuucauugaccuugucucucauacuucaagaaaaggacaguacauugcuacauuacccuagaaagucugugugaggaucugccccuucagucuguuauugcaaaguaauaaaaugucaccuacagggagccucugagccuacucuaguucaagaggcuaccugaaaaaaaauaaauaagauaaagggucagcaacaacaaagaaaaagacaauuacagaaaauaagcaagauuuggaaaggaaguauaauggcacuuuuuuccucaaaggaaguucuuguuuucacauaaaauaugaaaagcagauccugcaggaguaacccccuucuuuaagagccaaguauuugccagugcuuaaauuacaccauacaguucuaauuauauauaaucuuuuguucuucaguuuuuuguuuuguuuccuuuuuguuauuguugccgaaggugaguaguuuugcauuucugaugacagccuuggaaaguauauuuguaacuccaugucugguaaugccaacccaagucgacaugggucuuaggacacugaccaccucacaugccauacccucaguuaagcauguuaacauuuauaggaggaaaaaaaucacuuugggagaaaauaaaauucaacucaagcauaaagcuucuguuuacucaggccuucuaaaaagcagguuaaaaugcucuaaaaugagaaagccugugguuucacuuauuuauauaacucacugggacauugccaaaugaguaagcacuuaauucgcugcuucugagacuucucugucaaaacagccccacugauaauauuagacagaacgagaaugcaggggucucuucccuccccugggguuuaggaagcucaugaggagcucggcuuaaaaugucuuugaugucucuuccuuugucucaaaaaguaaugucaauuuuauauacuauuucaauauuacuaucugcauuuguuuuaauauaaaaauguuugcugccuaccuuuuucucccaaaaaaucuuuaaguaaagaugaucugggaaaaugugccauguuua

SEQ ID NO: 191206 - RNA, 8032 nt, Homo sapiens
uacccucuccaacgcagucauuuauuaucgcguaggugauaauguguggacagagacaacucagcuagagguggcugugucaggggcugcuggugccaaccucaacgggaucaucuacuuacuagggggggaggagaaugaucuggacuucuuuaccaaaccuucccgacucauccagugcuuugacacagagacagacaaaugccaugugaagcccuaugugcugcccuuugcaggccgcaugcacgcagcugugcauaaagaucugguguucaucguggcugaaggggacucccuggugugcuacaaucccuugcuagacagcuucacccggcuuugccuuccugaggccuggagcucugccccaucccucuggaagauugccagcuguaacgggagcaucuaugucuuccgggaccgauauaaaaagggggaugccaacaccuacaagcuugacccugccacuucagccguaacugucacaagagguauuaaggugcugcuuaccaauuugcaguuuguguuggccuaaggcuguggggaggggaggagaacugcucacuccuuuucccuccccauacaaacucaaaguccccugggccccaauucagaguuauguuuuuuuuggcacauacuagaaaggcagugccucagcccuucccugaauccauggagguguucuguuuggggcuuuuuagacugcugcugcucagcugguugcuugaacugacaguaggccagccuguucucugccauucccuagucauccugugccucaccacagcuugcuuagagcaagccuuuucucagaccuuaggcacagccucuccucuuuaccugaucaauguuaaauguaagcaccccugaucccaggacauaaggaaagaugcccaauuguacuuuuguucuauagccugugaaauggcuaguugaucauuuuuccacaaagaauuagguguuaagaguuuuccuucaggcuuuacuuaggagaauggacuaagcugaagguguacuucaccagcaagagucaacucuagaauucaggauguuccuucuauuguuuucuuauccaucugucaggaaauguaacuuugguuuuauuuuuggcuuauuccaagggguaagccagaaaauagaaaugauuauuucugauuaauagcagaaacuuuuucaaucucaaauauauaaggugucugcucuuuuaaaagcucuaagcuaagucaagagcuaggaacuguugauacaaauaaaaguuuuugaagggauaugugugucuguguugaauuccaaaggggugacuuugaaggggugaggguguuucauucccucaggggaacucauuacguaccaucacauggcucagucugcagcaguccugacugcagcccaugcucccacuucuccagauaggaucccuacuccacagggccagugagauucagauucugacaguggcaaagagccagaggugagucuccuuuuuucaagugcuaaauguuuuuugaguuguggugcuaaauauuauuaggcacaauauuagguacauaauagauuuuuguuaaaauacuucuuuagcccuauucaagaaaagaugauagccccaucccuguccuguaucccaugaauacaagccacacuaaaucuuuuccuuucuagccacacaacaguguuauuucaagaaaacaaaacaagucagagaaagaaaaauuaccuauuaccuauuggcacauuucuguuacgucaagucugggcuuaagcccuguugguccuguuaagcucuuuuuguucuguaucaagcaggagugucuugaguucuuucuaauccccauacaucaugucuuugaaaugacaaaagucccauccuuuguugcccgugcaguaaucugcuuguggaacucuuuaagaacauccagcuggccaggccugauguggauguaugaccggaucuuggcgauggcucuuacagccuccucuggacuccauuugugcaccugaaguacaggguugggaaaucagcagagaaagaaagaagcaggugucaaggugcccuugacccaugagcaggugcuaaaggacucugagauuucauuucuuuggaaacucuauuuugcaggcauuaaaaaucaugcugcuuguauuauaaaugggagaguacuguaaccacugcagucagccagucucacaauacuaugcaacaggucagguggaaagucagucuuucuacccaauucuugcucugccaaauccuagaaaaaggaaguugcacaugggaagcugagauccuaaguucaagacugccucagccuacuccacguccucuccgagcugggcuuuugguuacaagaauuucuaggaacgaguaugcaauagauguuuuuaugcaacuugucaccauggcuagaaaaacaaguaacucauaauuuaaauaggaggguuaacauguccuaaggauacucauugguuuagaacucaacagaaccaagaaaauacagauuucuaacuugcuaguucaauucucacuuggugcaaaauacccuccugagacccugcuuccagcagagcccuuaugaccaaaauuuuaauauuacucaacuauauacacacuaguccacaguaacacaaggccagacuuagcuauucacaugacuuagaaaaugcucugugggagccagacauuuuguaacuuagguuacaaaaugaugauggacuacaggguauuuguuucuccuaaauauuuuuaaagcaucccaccugccaauuaugacacauuaauaggcagaauccaguuuggagccuguuuccagaaacuaauauccagaacuuuacucuggaauacuugaagaaacuugaguacuauaaagcugaaaaugaucagcacuauuaucuaugauauuguuuccugacaugguauuagaacaagugucuagccuuuugcugggguugaauggcuuuugcaacuccguuuuuagagugcccgcuauaggccagcacuugauguaauuucuuauuuaaacuucauaauacauuuaguuugagaaaacauguugcauaaggcagaagucacuuuugcugauccucacuggcaggcagcagagccccagguuacccugucacaaggcucaggugcuuuccaucauaccaaaccaccucccaacagccugaaaucaagcacacagcuccuuccaacaaggcccaccaguagaccaugcuauugaaguucuggaaaucugcuauaaaugggaccagaaagacuuuuuuuuuuuuuuuuuuuuuuugagacaguuucacucuguuggcuaugcugcagugcaguggcacaaaucacggcucacugcagccucuaccuacugggcuccggugauccaucucagccucccaaguagcugggacuacaggugcacaccaccacacugagcuaacuuguuguauuuuuuguagagacgguuuugccauguugcccaggcuggucucaaacuccugggcucaagccauccucccaucucaagccucccaaagugcugggaucauaaguguguaccacgaugcccagcccagaaagaacuuugguaccugaaucagguaugcugccaccauaguggcacuccuggagcgcccagccuuacaaugcacguaaacacacuggcccagcgacugguacuugagagcaaauuggacucccuucuggagguuguccaagguggggaucccagucaugucuacugugcugagccgcagcugcucgacuccuagucucuuccacuccuggaaccagguccaccaguaugaaaaagagaaugaaaaaaaacuaugugggugggaugauaaggggcucccaagaagcagcaaagcaacaaggaaguuucaggguuuacuacaaugggaauacacuguugccuguuuucuaaaauagaaacuucuuacagaaaugcuuuuuuuucccauuccaggugaggacagaaaugucuuuaaaauggcuggccuacaugguugguuuuucaucaagcaacagcuaugcugcugaguuagaauuauguccaagauuuaaaguguuccuuuuuuuuuuuuuuuuuuuuuuaaagacagagucucgcucuguugcccaggcuguaguacaguggcgugaucucagcucaccacaaccuccaccucccaguuucaagcgauucuccugccucagccucccgaguagcugggacuacaggcacgcgccaccaagccuggcuaauuuuugcauuuuuaguagagacgggguuucaucauguuggccaggcuggucucgaacuccugaccucaggucauccgccugccucagccucccaaagugcugggauuacaggugugagccaccacaccagcagguaaaguguucuuaaacuacccuuuggguacuugaauauuuagcugcaagauauuagcuauauacauuuuagcugcaaaaaauucagcugcaaacgucuuaacauuuuauuuuggccgggcaugguggcucacgccuguaaucccaacaguuugcaaggccaaggcgggcagaucaccuaaggucaggaguuugagaccagccuggcuaacauggggaaacccugucucuacuaaaaauacaaaaauuagccaugcguggugguggaugccugugaucccagcuacuagggaggcugaggcaggagaauuguuuaacccuggagggagagguugcagugagcagagaucgcaccauuguacuccagccugggagacaagagcaaaacaacaucucaaaaauauauauauauuuuauuuuagagacacgaucuugcuaugucacccaggucagagagcagugguaugcaaucauggcuccuugcagccucaaacuccuaagcucaagcaguccucccaccucagccucccaaguagcugugacuacagcugcaugccacugugccuggcuaauuuuguuauuuuugugugugugcagaugggggucucgcuauguugcccaggcuggucucaaucuccuagccucaagccauccuccugucucagccucccaaaaugcugggauuacaggcaugagccaccaggcccagccaguguaauuuuuuugcauaauuuuggcaccuguguagugauucagcugcagauuugggguacaauauuuugccaaggcuuucuauuucucuguccauaagucucuuuuuuaccacuguuuuuugagggaacauaugguagaaaauaggguuaucauuuuaaaauuaaaacaaugggccgggcaugguggcucaugccuguaaucccagcacuuugggaggccaaggcgggcggaucacgaggucaggagauuuagaccauccuggcuaacacggugaaaccccgucucuacuaaaaauacaaaaaaauuagccgggcaugguggcaggcgccuguagucccagcuacuugggaggcugaggcaggagaauggcaugaacccaggaggcggagcuugcagugagccgagaucgugccacugcacuuccagccuaggcgacagagcaagacuccgucucaaaaacaaaaacaaaaauaaaauuaaaacaaugcacugaccuucauuagugcaauguuaucacuuagaagaaauagguggccaggugugguggcucacgccuguaaucccagauuuugagaggccaaggugggcagaucaccugaggucaggaguucgagacgacuuuggccagcauggcaaaacccuaucuccauaaaaaauacaaaaauuagccaggcaugcuggcaggcaccuguaauuccagcuacuugggaggcugaggcaggagaaucacuugaacugggaggcagagguugcagugagcugagauugcaccauugcacuccagccugggcaagggagugagacuccaucucaaaaaaaaaaaaaaaaaaagaaaagaaauagaaauaaggucucuggcaacugggcaaacuuuaugcuuuaagacuucagauaugcuccagcuacucuuguuauuaaccucuuaauaaugaguaucagagacuuuaugguucuaaaugaagaucaguaauucuuuuuuuuuuuugagacggagacucacucugucgcccaggcuggcgugcaguggugcaaucucggcccacugcaacuucugccucccggguucaagcgauucuccugccucagccucccaaguagcuaggauuacaggcgccugccaccacgcccggcuaauuuuuuugugugauuuuaguacagacgggguuucaccauuuuggccaggcugaucucaaacuccugaccucaggugauccacccaccucagccucccaaagugcugggauuacaggugugagagccaccacgccuggccaagucacaaauauuuucaagguuucaaaaaaauccucagguugaaauaauaguaucuucaucaugcuauaucaguaaaacaaaugagaaagauaauuguuuagugcuauuagaugccaaacgcuauaaagauagggcaacauuaaaaaaaaaucaaauagcucagauuguagauaacaucuucuaauaaccauuguggaagauuccacaaacaggccagucacauuuaaugaaaguuauguuuuaggccuaaacuuuguuaugagagaacuuuggaguuccaccaugauuucuaauauaugacuaaaaauucccccaaaucagagccaaaugaacucuacaguuuucaauggauaguuuuaugaaaaaucuggggaggggagaguguuaagggggugcuuuucgucuuacaguuggcagggccuucaucuggaaucccuaacacugggaaugcugacccauacucagagcucaaaguauagaaagaaugaaugaaaucaggaaggcaugggaaaguugccuuucaauuuuaguuucugauuuugguuaccgaaauaagaauacauuacauuuguucacaaaggagaaaucaggcuuugucaacuuccacuuuuuuuuuuuuuuuuuuugagacauuguuucacuccugucgcccaaggcugggcuggaaugcaauggcgagaugucggcucacugcaaccuccaccucccgggcuaaagugauucuccugccuuagccucccaaguagcugggaguacaggcgcacgccaccacucccggcuacuuuuuguauuuuuguagggacgggggccucgccauguugcccaggcuggucaggaacuccugggcucaagugaucugcccgccuccuccucccgccucccaaagugcugggauuacaggcgugaguccccgcgcccggcccaacuugaacuuuuaaauaaacgccuuucacagcuucuagccuaccuccaggugccauuuagaggcacagaccggaggcaaagcagcuugagacaccuggcuccggugcauggugaccucccccacacuucucuagccgucccaggcucagggcggugggcgagggggagcgggcccccgagccugccccucggcccggucccucaccugugaagaguugcacaggaaccucgucucguacuccucguucauggugaucaccccgcgcacguucucguccuguaccagcugccgaggcaaagagguggcucagcaaagacgguggagaccccagcggcccgacagggacggagcggcggggacggggcaggggcccgggcuccccggcccggcucaccuggcgcgucaagcuccgcaacggcagcgcgcccagcagcacgguggggucgaugcggugguaccagucccggugcgcccgacccggcaccuucccgcggaacaggguguagagcagcgucggguagaagagcacccgcgccaggccggccuccagcagcgcgguggccgccaucccggcccggcgcagcggcgacccgucggcccccgcgcucgcgguccggacccgcgagaagagcaggcgggugccggggcggggcugccagcugcacuaggccucucgcgggcucgcaccgggugacggcggggacuggccuggacucugggggacuggcgggacucuggaggagggcccggcggccucggag

SEQ ID NO: 191207 - RNA, 8032 nt, Homo sapiens
cuccgaggccgccgggcccuccuccagagucccgccagucccccagaguccaggccaguccccgccgucacccggugcgagcccgcgagaggccuagugcagcuggcagccccgccccggcacccgccugcucuucucgcggguccggaccgcgagcgcgggggccgacgggucgccgcugcgccgggccgggauggcggccaccgcgcugcuggaggccggccuggcgcgggugcucuucuacccgacgcugcucuacacccuguuccgcgggaaggugccgggucgggcgcaccgggacugguaccaccgcaucgaccccaccgugcugcugggcgcgcugccguugcggagcuugacgcgccaggugagccgggccggggagcccgggccccugccccguccccgccgcuccgucccugucgggccgcuggggucuccaccgucuuugcugagccaccucuuugccucggcagcugguacaggacgagaacgugcgcggggugaucaccaugaacgaggaguacgagacgagguuccugugcaacucuucacaggugagggaccgggccgaggggcaggcucgggggcccgcucccccucgcccaccgcccugagccugggacggcuagagaagugugggggaggucaccaugcaccggagccaggugucucaagcugcuuugccuccggucugugccucuaaauggcaccuggagguaggcuagaagcugugaaaggcguuuauuuaaaaguucaaguugggccgggcgcggggacucacgccuguaaucccagcacuuugggaggcgggaggaggaggcgggcagaucacuugagcccaggaguuccugaccagccugggcaacauggcgaggcccccgucccuacaaaaauacaaaaaguagccgggagugguggcgugcgccuguacucccagcuacuugggaggcuaaggcaggagaaucacuuuagcccgggagguggagguugcagugagccgacaucucgccauugcauuccagcccagccuugggcgacaggagugaaacaaugucucaaaaaaaaaaaaaaaaaaaguggaaguugacaaagccugauuucuccuuugugaacaaauguaauguauucuuauuucgguaaccaaaaucagaaacuaaaauugaaaggcaacuuucccaugccuuccugauuucauucauucuuucuauacuuugagcucugaguaugggucagcauucccaguguuagggauuccagaugaaggcccugccaacuguaagacgaaaagcacccccuuaacacucuccccuccccagauuuuucauaaaacuauccauugaaaacuguagaguucauuuggcucugauuugggggaauuuuuagucauauauuagaaaucaugguggaacuccaaaguucucucauaacaaaguuuaggccuaaaacauaacuuucauuaaaugugacuggccuguuuguggaaucuuccacaaugguuauuagaagauguuaucuacaaucugagcuauuugauuuuuuuuuaauguugcccuaucuuuauagcguuuggcaucuaauagcacuaaacaauuaucuuucucauuuguuuuacugauauagcaugaugaagauacuauuauuucaaccugaggauuuuuuugaaaccuugaaaauauuugugacuuggccaggcgugguggcucucacaccuguaaucccagcacuuugggaggcugagguggguggaucaccugaggucaggaguuugagaucagccuggccaaaauggugaaaccccgucuguacuaaaaucacacaaaaaaauuagccgggcgugguggcaggcgccuguaauccuagcuacuugggaggcugaggcaggagaaucgcuugaacccgggaggcagaaguugcagugggccgagauugcaccacugcacgccagccugggcgacagagugagucuccgucucaaaaaaaaaaaagaauuacugaucuucauuuagaaccauaaagucucugauacucauuauuaagagguuaauaacaagaguagcuggagcauaucugaagucuuaaagcauaaaguuugcccaguugccagagaccuuauuucuauuucuuuucuuuuuuuuuuuuuuuuuuugagauggagucucacucccuugcccaggcuggagugcaauggugcaaucucagcucacugcaaccucugccucccaguucaagugauucuccugccucagccucccaaguagcuggaauuacaggugccugccagcaugccuggcuaauuuuuguauuuuuuauggagauaggguuuugccaugcuggccaaagucgucucgaacuccugaccucaggugaucugcccaccuuggccucucaaaaucugggauuacaggcgugagccaccacaccuggccaccuauuucuucuaagugauaacauugcacuaaugaaggucagugcauuguuuuaauuuuauuuuuguuuuuguuuuugagacggagucuugcucugucgccuaggcuggaagugcaguggcacgaucucggcucacugcaagcuccgccuccuggguucaugccauucuccugccucagccucccaaguagcugggacuacaggcgccugccaccaugcccggcuaauuuuuuuguauuuuuaguagagacgggguuucaccguguuagccaggauggucuaaaucuccugaccucgugauccgcccgccuuggccucccaaagugcugggauuacaggcaugagccaccaugcccggcccauuguuuuaauuuuaaaaugauaacccuauuuucuaccauauguucccucaaaaaacagugguaaaaaagagacuuauggacagagaaauagaaagccuuggcaaaauauuguaccccaaaucugcagcugaaucacuacacaggugccaaaauuaugcaaaaaaauuacacuggcugggccugguggcucaugccuguaaucccagcauuuugggaggcugagacaggaggauggcuugaggcuaggagauugagaccagccugggcaacauagcgagacccccaucugcacacacacaaaaauaacaaaauuagccaggcacaguggcaugcagcuguagucacagcuacuugggaggcugaggugggaggacugcuugagcuuaggaguuugaggcugcaaggagccaugauugcauaccacugcucucugaccugggugacauagcaagaucgugucucuaaaauaaaauauauauauauuuuugagauguuguuuugcucuugucucccaggcuggaguacaauggugcgaucucugcucacugcaaccucucccuccaggguuaaacaauucuccugccucagccucccuaguagcugggaucacaggcauccaccaccacgcauggcuaauuuuuguauuuuuaguagagacaggguuuccccauguuagccaggcuggucucaaacuccugaccuuaggugaucugcccgccuuggccuugcaaacuguugggauuacaggcgugagccaccaugcccggccaaaauaaaauguuaagacguuugcagcugaauuuuuugcagcuaaaauguauauagcuaauaucuugcagcuaaauauucaaguacccaaaggguaguuuaagaacacuuuaccugcuggugugguggcucacaccuguaaucccagcacuuugggaggcugaggcaggcggaugaccugaggucaggaguucgagaccagccuggccaacaugaugaaaccccgucucuacuaaaaaugcaaaaauuagccaggcuugguggcgcgugccuguagucccagcuacucgggaggcugaggcaggagaaucgcuugaaacugggagguggagguuguggugagcugagaucacgccacuguacuacagccugggcaacagagcgagacucugucuuuaaaaaaaaaaaaaaaaaaaaaaggaacacuuuaaaucuuggacauaauucuaacucagcagcauagcuguugcuugaugaaaaaccaaccauguaggccagccauuuuaaagacauuucuguccucaccuggaaugggaaaaaaaagcauuucuguaagaaguuucuauuuuagaaaacaggcaacaguguauucccauuguaguaaacccugaaacuuccuuguugcuuugcugcuucuugggagccccuuaucaucccacccacauaguuuuuuuucauucucuuuuucauacugguggaccugguuccaggaguggaagagacuaggagucgagcagcugcggcucagcacaguagacaugacugggauccccaccuuggacaaccuccagaagggaguccaauuugcucucaaguaccagucgcugggccaguguguuuacgugcauuguaaggcugggcgcuccaggagugccacuaugguggcagcauaccugauucagguaccaaaguucuuucugggcugggcaucgugguacacacuuaugaucccagcacuuugggaggcuugagaugggaggauggcuugagcccaggaguuugagaccagccugggcaacauggcaaaaccgucucuacaaaaaauacaacaaguuagcucagugugguggugugcaccuguagucccagcuacuugggaggcugagauggaucaccggagcccaguagguagaggcugcagugagccgugauuugugccacugcacugcagcauagccaacagagugaaacugucucaaaaaaaaaaaaaaaaaaaaaaagucuuucuggucccauuuauagcagauuuccagaacuucaauagcauggucuacuggugggccuuguuggaaggagcugugugcuugauuucaggcuguugggaggugguuugguaugauggaaagcaccugagccuugugacaggguaaccuggggcucugcugccugccagugaggaucagcaaaagugacuucugccuuaugcaacauguuuucucaaacuaaauguauuaugaaguuuaaauaagaaauuacaucaagugcuggccuauagcgggcacucuaaaaacggaguugcaaaagccauucaaccccagcaaaaggcuagacacuuguucuaauaccaugucaggaaacaauaucauagauaauagugcugaucauuuucagcuuuauaguacucaaguuucuucaaguauuccagaguaaaguucuggauauuaguuucuggaaacaggcuccaaacuggauucugccuauuaaugugucauaauuggcaggugggaugcuuuaaaaauauuuaggagaaacaaauacccuguaguccaucaucauuuuguaaccuaaguuacaaaaugucuggcucccacagagcauuuucuaagucaugugaauagcuaagucuggccuuguguuacuguggacuaguguguauauaguugaguaauauuaaaauuuuggucauaagggcucugcuggaagcagggucucaggaggguauuuugcaccaagugagaauugaacuagcaaguuagaaaucuguauuuucuugguucuguugaguucuaaaccaaugaguauccuuaggacauguuaacccuccuauuuaaauuaugaguuacuuguuuuucuagccauggugacaaguugcauaaaaacaucuauugcauacucguuccuagaaauucuuguaaccaaaagcccagcucggagaggacguggaguaggcugaggcagucuugaacuuaggaucucagcuucccaugugcaacuuccuuuuucuaggauuuggcagagcaagaauuggguagaaagacugacuuuccaccugaccuguugcauaguauugugagacuggcugacugcagugguuacaguacucucccauuuauaauacaagcagcaugauuuuuaaugccugcaaaauagaguuuccaaagaaaugaaaucucagaguccuuuagcaccugcucaugggucaagggcaccuugacaccugcuucuuucuuucucugcugauuucccaacccuguacuucaggugcacaaauggaguccagaggaggcuguaagagccaucgccaagauccggucauacauccacaucaggccuggccagcuggauguucuuaaagaguuccacaagcagauuacugcacgggcaacaaaggaugggacuuuugucauuucaaagacaugauguauggggauuagaaagaacucaagacacuccugcuugauacagaacaaaaagagcuuaacaggaccaacagggcuuaagcccagacuugacguaacagaaaugugccaauagguaauagguaauuuuucuuucucugacuuguuuuguuuucuugaaauaacacuguuguguggcuagaaaggaaaagauuuaguguggcuuguauucaugggauacaggacagggauggggcuaucaucuuuucuugaauagggcuaaagaaguauuuuaacaaaaaucuauuauguaccuaauauugugccuaauaauauuuagcaccacaacucaaaaaacauuuagcacuugaaaaaaggagacucaccucuggcucuuugccacugucagaaucugaaucucacuggcccuguggaguagggauccuaucuggagaagugggagcaugggcugcagucaggacugcugcagacugagccaugugaugguacguaaugaguuccccugagggaaugaaacacccucaccccuucaaagucaccccuuuggaauucaacacagacacacauaucccuucaaaaacuuuuauuuguaucaacaguuccuagcucuugacuuagcuuagagcuuuuaaaagagcagacaccuuauauauuugagauugaaaaaguuucugcuauuaaucagaaauaaucauuucuauuuucuggcuuaccccuuggaauaagccaaaaauaaaaccaaaguuacauuuccugacagauggauaagaaaacaauagaaggaacauccugaauucuagaguugacucuugcuggugaaguacaccuucagcuuaguccauucuccuaaguaaagccugaaggaaaacucuuaacaccuaauucuuuguggaaaaaugaucaacuagccauuucacaggcuauagaacaaaaguacaauugggcaucuuuccuuauguccugggaucaggggugcuuacauuuaacauugaucagguaaagaggagaggcugugccuaaggucugagaaaaggcuugcucuaagcaagcuguggugaggcacaggaugacuagggaauggcagagaacaggcuggccuacugucaguucaagcaaccagcugagcagcagcagucuaaaaagccccaaacagaacaccuccauggauucagggaagggcugaggcacugccuuucuaguaugugccaaaaaaaacauaacucugaauuggggcccaggggacuuugaguuuguauggggagggaaaaggagugagcaguucuccuccccuccccacagccuuaggccaacacaaacugcaaauugguaagcagcaccuuaauaccucuugugacaguuacggcugaaguggcagggucaagcuuguagguguuggcaucccccuuuuuauaucggucccggaagacauagaugcucccguuacagcuggcaaucuuccagagggauggggcagagcuccaggccucaggaaggcaaagccgggugaagcugucuagcaagggauuguagcacaccagggaguccccuucagccacgaugaacaccagaucuuuaugcacagcugcgugcaugcggccugcaaagggcagcacauagggcuucacauggcauuugucugucucugugucaaagcacuggaugagucgggaagguuugguaaagaaguccagaucauucuccucccccccuaguaaguagaugaucccguugagguuggcaccagcagccccugacacagccaccucuagcugaguugucucuguccacacauuaucaccuacgcgauaauaaaugacugcguuggagagggua

SEQ ID NO: 191208 - RNA, 23088 nt, Homo sapiens
cucaaagaaaaugaacggcacccuggaccacccagaccaaccagaucuugaugcuaucaagauguuugugggccagguuccaaggaccuggucugaaaaggacuugcgggaacucuucgaacaguauggugcuguguaugaaaucaacguccuaagggauaggagccaaaacccgccucagagcaaagguuagggcuuuggguuuugguuuaucuuauuuuuuccacugacucucagagcaggugagggcuuuggguuuuuaacaggauacaaaaaauuggauuuuuauauguaauuucuuucaugugcauucucucugucauugccagaauacuccugucugucugucuauuggaaaaaaucuguccuuuuauaguaguaauaucuuguaauccaaacauauuuaauggcuuuaaaaaguuaagguguuagcaugaggauaauuuguaaauugggucuugggcaguccuuugugaggguucuaaauuuaagagacagacucacgugagugucuuauuugaccuugggaacagauaacaaagauaaaauugaaguuaaaccacauaaaguuuucuuuaguguuugggcuagcauaagcugaaggagaaagacuguccacauacccauugguuucuuguuaguauuacagaggccuugcgggauaguuuaucaaauagaaaggauuuguuuaggcagcuuguuugcuguugccacaaagugaacaggagaggaaaggcggagcugcuuccagaauugccuagcagaguggaaguuucacaagacugaugguagauagguauuaacuuugccccguauauacacacagacauguucuuauuuuccauuuuaccaguuuucaaauaauuuucugugaaagcuguccaacagugcaaauguaagcaagcaugauuaucauauugaaacuagcuuaauagcagaggaucuagaagcagaggaauuacuuucucuuuuuggcaugguuaacuaaaaauauaaaguauaauaguuucugaacaugacuggcaauauaaccuucaguaauuuguaguucuaacugcugcagcaugauuuaaaaaaaaaucuauauuguaucucaugagaauaugggagugucagaacauuuaagcccaagauuuacaagauauacuuccucuccuacuacccaaaauaaagauacaaagcacaaaaucuacagaucugaggcagcaccaugugcuuuuagaagcuuaauuauauuugaugagaaccaagaguccaaaaaaagauguuaagaggugcuugcucuuaagucauuuuauaauuuaauaagugauaauuauguuugaggcauaugguagaaucuggcuacgaaguagggagugguuuauucugagagagcagggaaagaaagaguuccugguagacuacaggcugcaaaaguauagagccccaucugucuucuugucucauauaccaccugguguuccaaguaggguagguugagucaaauggcacaugaccuuucuuuaugagaagucguauuuuccagagaaguuacaugagcagcuaaauaagacuuauaguguaacuaacuaggaggagacuaaaacaauaaaguguauagaaaauaaucucuuauuccucugcuagauauucuauucguucuuuuccacuacccucccccucucacuaauuuuaauaaacccagcccucuuuuaagaucugaucugucaguggaggaaggauugcucuaggaauucucugcuuuccaaaguuugauuuuaugaaaucuuauuuauugcagggugcuguuuuguuacauuuuacacccguaaagcugcauuagaagcucagaaugcucuucacaacaugaaaguccucccagggguaagaaagcucccacuaguaaauggaaaugugguaacuuugauaugugggauauacuuacacauaucagacacacacugaaaaccauuuuggggaaaagguaacugcugcaggaauugauguaaaggaagacauaaagggagcaguucagagauuaccugacauuaguucucucucagucaagagucuuguguauuuugacuucuugacucacauucuguuuucuggggaaagaucaugaagcagacaugaguucagagagaacucuuuaaagcucuaguucugguauuuuagaguccauauguauuuuugaauaccaucaauauauacagugauaauaaucauauuuuuccuuuucagaugcaucacccuauacagaugaaaccugcugacagugagaagaacaaugguaagcaaauguauacaaucuuccccuuaagauuucugccuaggccaggcacgguggcucacaccuguaaucccagcacuuugggaggccaagacagauggauugcuugaggccggaguucgagccagucuggccaacauggugaaaccccgucucuacuaaaaauacaaacauuagcuggguaugguugugcaugccuguaaucccagcuacucaggaggcugaggcaugagaaucucuugaacccgggaggcggagguugcaaugagcuaagaucaugccaguguacucccgcccaggcaacagagugagacucugucucaaaaaaaaaaaagauuucugccuaguuuguuugcuguucuuagguuaucugaauugaauugugcuuuaaguaauccguugucuaaguugucucaguuuuuucuuuaaaaguaugaugaagaacagagcugacagagaaauauuauaagaacauuguagaaugaacuggaauauacuuggucaguauaauuucuuuuggacaggaaugagggggcaaaaugaacaaauuaggaaggagaacuuaauucucgaauuuuuuuuuuuuuuugagauggagucucacucuguugccugggcgggaguacacuggcaugaucuuagcucauugcaaccuccgccucccggguucacugcauucuccugccucagccucccgaguagcugggacuacaggugccugccaccacgcccggcuaauuuuuuguauuuuuaguagagacgggguuucacuguguuagccaggauggucucgaucuccugaccuugugauccgcccgccucggccucccaaagugcugggauuacaggcgugagccaccacgccuggccuuaauucucaagaagauagucaggaccaggugagguggcucaugcuuguaaucccagcacuuugggagcgcacggcgggcggaucacccggccaacauggugaaacccugucucuacuaaaaauacaaaaauuagcugagugugguggugcaugccuguaaucccagcuacucaggaggcugagacaggagaaucgcuuggacccaggagacggugguugcaguaugcugagaucgugccacugcacuccagccugggugacagagcaagacucugucucaaaaaaaaaaaaaauucagaaaaguagacaguuacauucacugaaagguguauucucuuccacuugucauaucaagugugaaaaccucuucuuucuuuaguaguauugccaguaagagcaaacaaugcuggcugggcacaguggcgcacaccuguaaucacagcacuuuaagaggcugaggccggaggauugcguaagcccaggaguuugagaccagccuuggcaauaagagugaaaccucucugcaaaaaauuagcuggguguggugguacauaccuguggucccagcuauucgggaagcugaggugggaagauugcuuaaacccggcaggucaaggcuguagugagccaugaucaugccaccgcacuucagccugggugacagcgagacucuugucucaaaaagaggaaacaauacaaaggacuagggaagaugccaaguacuucacauuuaauagcaacugcuacccuuugaaguaaaccugauuauuccuauuaguuagaugaggaaacaggcacagaaugguugaguaacuuucacaagauuacaaagcuaccauauuucaucuaaaugcuucuaauuauaauuuuaagauaacauugguuauaaaaagagacgugaagccgggcguggugggucacaccuguaaucccagcacuuugggaggccgaggcggguggaucaccugaggucgagaguucaagaacagccugaccaacauggagaaaccccaucucuacuaaaaauacaaaauuagccaggcauuuuggcgcaugccuguaaucccagcuacucaggaggcugaggcaggagaaucacuugaauccgggaggcggagcuugcggugagccgagaucgcgccauuacacuccagccugggcaacaagagcgaaacuccaucucaaaaacaagaaaaaaagagaugugaaaaauacaaaaaacaaaugugugucuuugaaucuguaaaauaugguacagagccaggauucaaacccaggcggucuggcucccaaaucugugccacauugccucuuuaaguaguaauauucaagucuuuucuguuuuacucucuuagcaguggaagacaggaagcuguuuauugguaugauuuccaagaagugcacugaaaaugacauccgagucauguucucuucguuuggacagauugaagaaugccggauauugcggggaccugauggccugagccgagguagguaguuuuagcuuuuaaauaaucuuuugguuuuuuguuuugguuugguuugggguuuuuuuuuuuuuggagacaaggucuugcucucucucacccaggcuggagugcaguggugccuucacaacucacugcagccugaaccucccaggaucagccuccugaguagcugggaccacaggcaugcaucaugacacccagcuaauuuuuaaauuuuuuauagagaaaaggucucccuguguugcccaggcuggucuugaacuccuggacucaaacgauccugucaucuuggccucccaaagugccaggauuguaggugugagccacugcaccgggcuuggaaucuuuuuaauuugaccgguggaaacuagcaacagugauucccuagccaauauggcccagucaagauaaagagguugggccugcugcuuccugcuguauaucuauguccugucuugacuccuccuaucaguucauucuuuuugucucccagccccucuaaggagucuacauucuauauuucauugucauguauuaaaauuuucucuuuuggugcuuugcaagauccuugaugccaaaauggaaauacuuucuucuuccauuuucuuuuauuuucaagaggaacuagaggauaugaguccuccuuucuccugucaagcauuuuuuuuuucugucagugguucuguuuuuucauuauagcacauaucacccuguugcaacauaccagcacaugauucccugaaaacagggacugugucuguauugcuagcaugauagucagcacauaguaggugcucaguuaauguuugucagagaaauaaaugaaugcaugaguuacugacucuucucuuaccagguugugcauuugugacuuuuacaacaagagccauggcacagacggcuaucaaggcaaugcaccaagcacagaccauggagguagggagcagauaggugauggggaaaauuccucagcuugggaaugcugggacaguuggccauuaaaguccagcagcaugugcagcaucugauugcccagaagguuaaacagccaacaucuuaaaguuaaaaaccacugauuucuuuaaaauuaacguauuggaaaugcucucccuaccccuuuuuuugagauggggucuuacuuugucaccugggcuggagugcagugggaauaucauggcucacugcagccccaaccacccaggcucaagugauccccccuaccucugccacucaaguagcugggacuacaggugcacaccagcacgcccaguuaauuuuuguauuuuuuuuuaauagcgaccguuuugccauguugcccaggcuggucuaaaauuccugggcucaagugauccacccgccucagccucccaaaguguugggauuacagucucuucucucuugugucuaucaugaggagaaucauuuggcagugaaugaaauuagaauguaaccugcaugucauccaaaaggaagauuuuuuuucuucuuuucagauggaggaauuugacccuuucguuauggucuuuucacaggguugcucaucacccauggugguaaaauuugcugauacacagaaggacaaagaacagaagagaauggcccagcagcuccagcagcagaugcagcaaaucagcgcagcaucuguguggggaaaccuugcuggucuaaauacucuuggaccccaguauuuagcagugagucuuugugguuugcuuucugcagacugugcaagcucccagcuguuccuucuucugcugucccuagccaacaaacacaguggcauuuacaacuuuuggcauauagaaauuauauguaaaaauucagguaguacuauuucuuuuaguccuguuagucucuuucucucucuauauauauguaucucuggacaugcaucucugguuauaucuugaggcuuuugcugcaacuaaagugaauuccugguuucccguuuuaaagauuuagaaacaucuuguguccuugccuccaagaaagaaauuccugagggaaucuuaacuaccagugucuuucuccauaucucuuucuaccagauguagagggcaucauuaaaauccuuauugagucuuuccuaaagaguaugauaaauguuucuuucagcggacuugagagaucaagagauuuuuuuucuuuuuuugcuuuauuuauuuauuuauuuauuuauuuuuugagacggagucucacucacucugucacccaggcuagagugcaguggcacaaucuuggcuuacugcaaccuccaccucggguucaagugauucuccugccucaacuucccaaguagcugggacuacagacacacaccaucacacccagcuaauuuuuguauuucuaguagggaugggcuuucacuguguuggccaggcuggucucgaacucacgaccucaggugauccaccugucuuggccucccaaagugcuggguuuacaggugugagccacugcgccuggcggagaucaagagauuaacaugaacauuuuuaaaugagcauuacagguguauauucaaguuuacuacauuguaaauagacuuccuuuaauuugaucucucuguugucgugagccaaaagaagguugucuaguccaaaagaaggucucgccccaauuugugauuuagauuuacuaggucugcaguguauauguuacaggggauuauuaauggaaaagaauugggccagcacaagacaguuaaaaccacccauuugugagucaaagaggaaaaaggucaucuuaggcuauuaauggugaaaccacuagauuuguauggaugauacaaaaauauucacauagaaauagcuaguauagucauuuauuccucaucauuucaaguauuauucuguauggaaacagacaaaaggcacugauuucugucucccaguacugaauuuugguuuaguuccagugguuuucauauuucuaauaucuuauaagaaaucccaguuuaggccgggcgcugugacucacgccuguaaucccaacacuuugggaggcugaggugaguggaucgccugagguugggaguuugagaccagccuggccagcauggugaaacccugucuauacuaaaaauacaaaaaaauuacaugggugugguggcaggugccuguaaucccagcugcucgggaagcugaggcaggagaauggcuugaaccugggaggcggagguugcacugagcggagguugcagugagccaagaucgcaccauugcacuccagccugggcaauagagcgagacucugucucacaaaaaaaaaaaaaaaaaaaaaaaaagaagaagaaaaaaaaaaaaaaccccaguuuauccuagcuaguauuucucugaaguuuuuuuaaaaaaauauaaagaguugggguuguuuuguuuuguuuuguuuugaagccucgcucuguugcccagguuggaaaacaguggcgcaaucucugcucacugcaaccuccaacugcaagcagcugggauuacagucaugugccaccacgccuggcuaauuuuuguaguuuuaguagagacaggguuuugcuuaugugagccaggcuggucucaaacucccgaccucaagugauuugccuaccuugcccucccaaaguucugggauuacaggcgugaaccacuggguccgguuauauuucaacagaaaaaauuguuucuuagugcugaaacauugcuuauauguucagaaaauucagggagguuuuagucaucugcagaaaugauaaugcuuugaaaauggucuacaugcuaugcauuugcuuuucuuagagacuuuuggagccccccuuuagggaagguuaaccuuuuuguugucauugccacuaccagcaaguacaugauggcauguguugagagcuguguucucuuuguuuugguuagacaugauuccugcccuaagagcuaaucucauuuggagggaaaugaagggaccaaguacaguauucaccguccaccaguuaggacugaacacauagcccaagguguuuaagaagaaaaaggccaggcgcgguggcuuaugccuguaaucccagcauuuugggaagccgaggcaggcaaaucaccugagguuaggaguuugagaccagccugaccaacauggugaaaccccgucucuacuaaaaauacaaaaauuagcugggugugaugguacacaccuguggucccagcuacucgggaggcugaggcaggagaaucgcuugaaccuggaaggcggagguugcagugagcugagaucaccauuguacuccagccuggcgacagagcgagacuccgucucaaaaaaaaaaaaaaaaaaguguagacgugggugcuaguggacugugugauaguacaucaucauuaauuaugagguucuuucuggacuauguggacuugaguuagccaggcucuacuguccuggaggaguugguuuuuaucuuuuuauccuuugagaagcggggggaaaggguguauaggugcauuuuuucccccauucuguuccuggagguuuguagaccuccugaaacuuauccauggucucuagccuggaaggauuugcggcgacagagaaaccaggucagauguuuauaggaaugggaaacagguugaauaaaaggauccuguacaagaauaccaauuuuccauaaacaauacuaauuggguuuaguuggagcaaaaguuuucagcaagcugguuagaugaagguugugguuugccaauauacaaaguaaacuaaugccacaaacucagggacaggcccucuuacuuuauuugucaugggaccaucauugaaggagaacguacucugaaccugguauagacuaauccaucagucauuuggucaucugcaacagggaagaccaguuuggaggggaggaaguaaauaagguuggauagauguguagcuggagugauuauuagucaugugguccauugugaccaauaaaggguaacuccaagaaauacuaugaaauguuuagauuugauauuuaaaauaguugugugaaguagaaauugaguauccagauggaaacaaucugcagagugagauguguggaccuaacuaaggagaacuugggagaggguagcuggaaauggcauucauucauucgcagacaauaaucacaguugacugcguagcuccucaaguuuagcuuauuauccugcuguaguucuguccuuugcugugcugaauucugcugcccagggacuugagcuuggcucaguauucagugaacauacuaucuucugggccagugcuuuagcuguguuuuuuuuuuguccugugcugucauaagccucauguuucuguuguguuggcuuggguucuugucuuugacuuucuucucucugggggccucugcacucucgcuuugcugugcuguagaguuaucccagaugcagaaccagcccucacucucacucuuguucuguuuuuugguguaaugucuagcuuuauuugcagcuccuucagcagacugccuccucugggaaccucaacacccugagcagccuccacccaaugggagguaaguguuucacugcugcagaggagcagcagcacccaggccagcagacccagcuaacaacagucuugggaguuuggcaucguuucugugaaaacauuuuuuugcuuauuauguaaaccugaccuaggauaaacaucccaggacucaauuuucuugucucuauacaguggcucuauggcuaguugaugccacauugcucugacguuaucuggugccuccuaaccuuuuaggucacuguugaagaagaauauggaaaagggcuguuuagcuccuauagacugaggcuguucucugauaaggggaaaaaauugcaagaacucuuuauuuccauuauaaagugacuuuuccagugacugcagaaaagccaaagauggcuuccaugcaaaugcccuaccuugaagcuucuagaacccaggcauuugguuuaccuguguaucuucuuguuucuuaggugaauuccuauuuuguuguugcuauuaucguacacagaaaacuuaaauggagugccacaacaaaccugagcuagggcccaucaggagucgguuggggguagggcaugggacagcuucaaagcugccugugccuacacccucugcauuggauuuaggcuaggccaaaugugcauuugagaaaggcauaguuuucagugaacugcauuuugcucuuugaaaauuuuugauagucauucacuuugucucaggaaauuauaguuggcuauauuuuuggaaaguugcuagauuguaaucuguauuguauuuuaauucucguuuacucuuuccacuccccccaccccucaccccauccaucuuuccauugucuaguaaaugguuugcagcagcgacagcacaguuuagauuccuucuuccccuuucaacuguguugucugggcucuacuuggaagucuuucacucagugauuuuuccucucuccucuuucuggugaugaaucugcuauucaagugacagugucuuuauucuuugugucauugcugcucugcuguguucucccuuguuugcuccugggccuucugcaucugccauguuuucugcguguuccccucuauuacagagagcgaauccccuguaaagugugagugaggggccuggaugcagucccauucugugcuguagguuuuggcauuguucuccugugcuccuggcccuaugguaggcaguuuuucuugguuuccuaauugcccacaccuuuauuaauguacacuuggcaugguaugcuauuggauuagccaucucuucucugaggaaaugauuucaaguuucuuaaugagugauacaugaaucauuuuuggagcccuguaauguuguuuguaaggcuuaucuagaacaguuccucuuugucagggaccagcccucugccagugugugcuugucauugcuggaauggauaugaagcacccuuaucugcuggcuaaucucuugcuuuggauguuguaggguugaaugcaaugcaguuacagaauuuggcugcacuagcugcugcagcuagugcagcucagaacacaccaagugguaccaaugcucucacuacauccagcaguccccucagcgugcucacuaguucagguaagcaugaggaugacccagugugccauuaugugccuuggacagaugcuuuguguuuaaaggcagaguccagagagggaaaauaguuaacaccuguuuccagagaggucagauuaugagcaacaaauuuucaaaugucaucuuuuguacuuaagagaaaucuuccugauuuucaaugugcuguggccauuauuugucucuguccugcaaggacaguuguuagaauuaguaacugaaaaccucuuuacaaauagcauacuuggauagugacacuuuuucuuguauuuggcgagaaugccagugauggguugaauuuuaacuccuugcuuucuaauagcaggguccucaccuagcucuagcagcaguaauucugucaaccccauagccucacuuggagcccugcagacauuagcuggagcaacggcuggccucaauguuggcucuuuggcagguaaggggcagcaccuggcugucaucagacuauucuuugugcagguagcacaucuuaacccugguaggggcaccacuggaaugauugcaguggcccagugaaguuaaaaauaaucaugagggccaggugugguggcucacaccucuaaucccagcacuuugggaggucaaggugggcgaaucacgaggucaggagaucgagaccauucuggcuaacacggugaaaccccgucuccccuaaaaauacaaaaaaauuagcugggccugguggcgggcgccuguaguccuagcuacuugggaggcugaggcaggagaauggcaugaaccggggaggcagaaguugcagugagccaagauugcgccacugcacuccagccugggugacagagcgagaguccgucucaaaaaagcaugggauuuuuaaaucagaccugaguuaaaucccaccuguguccguuagcuagcuauaacuucggaccaccuuucuaaggacauuuucucaucuuugaagugggaauaauagaauacuuugaaggauuguuaaaaauuaaaugaggccagguacaguggcucauaccuauagucccagcaguuugggaggccaaagcaggggaucacccuaggucacaaguuccagaccagccugagcaacauagugagaacuccaucucuacaaaaauuaucuggguguaguggugcaugccuguagucccagcuacuugggaggcugaggccgggaggauugcuugagccugggagcuugaggcugcagugagcuaugauuguaccacugaacuccaaccuaggugacagagugagacucugucuccaaaaaaaaaaaaaaaaauuagaacauagguaaagugcugcugagcacauugcauaguacaguagaugacacauagaauguacuuaguaccuguuaguugcuguuuuaaugguaggguucacccacaucuugucagaaaucacauguaccccuuugaguuugcagucuugggccucuucuuuuaugacauucuagcucauuaugagaaaguggcagaauagccagauagaaaauggaggcucucauuccacagauuggaugaagguaauggggagcacaacacccgcguauggcauuucuuaauguccccauuagcaaggccuggugaauguccugaaaucuagccagucagauaguuucuucucagggagaaacuaagagggagauaaaggggagaacuuuggaguuuucccucuucuagaugucccaaguagacuugucuuuggcaucaguuuagucuuucuaguauauuaauccuucucuuccuccaaccaaggaauggcugcuuuaaaugguggccugggcagcaguggccuuuccaauggcaccgggagcaccauggaggcccucacucaggccuacucggguauccagcaauaugcugcugcugcgcuccccacucuguacaaccagaaucuucugacacagcagaguauuggugcugcuggaagccagaaggaaggugagugcaaagggagaucggggucagguauggggggcgguuuuccuccuauaccagaacggaaaggcagagcaaaggcugagggaaccaguuaggucgucagaccauuguuuuucuuugacagugucaaguguagacugagaaacccugugaagugugaucugcuuuuuaaauguuuucuggauguggcucaaaucagaaccucugugugcccucuugggauggggcugcaguuuuuagaugaagcaacagacacugaccuuaucgggucugacacauuugacaagaauguuucuguuaggaggucuucucuacagauuacaaaucuaucagaggaucuucugucuggaugucuucuguuucagugucccuuuuagcuauaucauuuggcauuuuccucacuuucugauugauguuuguccugauugaagacaaacugaggggugaugggacagaguuuggcccaugaguugauggagugggaaguaugucguuugacacaaaugguauucaauuuaggagaaaaauaggagagacucuuuagccagaaagaggccugaaggugacuuacaugaauagaagguccugcugacaccucugugcucagauuugacuggguuuuuauaaccaggagcugguauaagcacuaauguaggaaaaagaugaguguccucuugucacagcagaaaguccugguucaucucuccucaccugcugugaaucacuuauauccccuagggaugugguaguaggagaauguagcgugaaccaauauuuuaguggagacuguggagacagacaauaaauaaaugaaagcaugagguguuucagaugauccucuggagaaugacaagccgggaagagagauagggagugucagaggcacugcauuuuaugcagaaugcucagagaaugucucucuagauugacauuuaagcagagaacugaaggaaguaggaagcaagucaugccugaaucuagagaaagaagaguaacaggggcauaggaaaagcaaguacagaggcccugaggcagcaauguucccugauguguuugaaaaaaacagggaggccaggguggcuggagaauggcuggacugcaauuguaauaaagcuuuuugguuagaaaaucauugaguaggcugggcgcaguggcucgcgccuguaaucccagcacuuugagaggccaaggcaggcagaucaugagaucaggaguucgagaccagccugaccaacauggugaaaccccaucgcuacuaaaaauacgccaggcaugguggcgccugccuguaaucccagcuacucgggaggcugaggcaggagaauugcuugaacccgggaggcggagguugcagugaccugaguucacgccacugcacuccaaccugggcaacagagugagccucuaucucaaaaaaaaagaaagaaaaaaaaagaaaaucauugaguguaaauagucagaugaagaauguauauucuguuuuuaagcucaguguuaaucaugggugcauuuuuaaaacuaauuucuuauuuucccauuuacauaugaugaaacucacugauuuuggcauacagcuauaugaguauugacaaacaguccuaguccugcaaccaucaccacagauuaggaacauuuccaucaccccuagaaauucccucgugccccuuuguagucauucccugcaucuggcaacuaccaaucuguuugcugucccugugguuucuaggcauuauuuggaaaccuguuuuguuuauaaccccuuuucaccuccucuucuguguuccucucugagccuacagucucuguuuuccugcuccacacacaagucggccugcuuuauuaucccaacacuccuccuccugcggguagaauuucucacauccucaaugagauggagcuuggcugaaugugagggaaggaaucuguuuuaauguuugccuuugguuccuugcuuuguauuuagagaaucuguuuaguuccccagaugaaucucuguuuuuagggauugugacaguuuuaacauagguggaaaugaaagaucacuggugcagggcgacgagcauguuugacacugauacuuuuccaauuccuggguauuuugaagguccagagggagccaaccuguucaucuaccaccugccccaggaguuuggugaucaggaccugcugcagauguuuaugcccuuugggaaugucgugucugccaagguuuucauagacaagcagacaaaccugagcaaguguuuugguauguuggcuucucucuggugucaggaugggauuaguauuuuaccacugagaaagaaggagcucacugcagaaagaucugaauaugaguuugugguguuguuuuaacuuggccaugggcaggucauuaugaccucuuuuugagccccaguuucucauugcuguaguggagguaaggauuucuacccacacuguugcuccagagagaaaaauaauauauggaaaaugguuugcaaaaaaaccuuuaaacaguccagguuugugccuguaagucccaguacuuggggaggccaaggcaggaggaucgcuugagccuaggaguucgagaccagccugagcaacagagugagaccucauggcuacaaaaaauuagucagacgugguggcguguaccuguguucccagcuacuugaggcugaggugagaggaucaccugagcccaggaggccaagguugcagugaaccauggucacaccacuguacuccacccugggugacagagcaagacccugucucaagaaaaagaaaaaaaccuuuaaauuaccauguagcuguuaagugguacuauuaagaaccuaauuuauuucguaugacauaauguccagauuucuugucccugcugaauaaaauugggauuugagaugaagcacauaagguaucuugcauaaggaggacugagaaucuccuugccucauuaugucccucaccuagguuucugcuuggacacacagguuuuguaaguuacgacaauccuguuucggcccaagcugccauccaguccaugaacggcuuucagauuggcaugaagcggcuuaaagugcagcucaaacguucgaagaaugacagcaagcccuacugagcgugcuccccucugagacuggagugagagggucuucugguaagugggggaggagcacccuuaaugauucgaagcccugaggcuguguguugacagcccuggacccugaucccugccacucucgcaggcacagcuugcccugaagacucggcuacugccuucugugggaguuucgcuucguacagaggacaaguuugugcuuugguuuccaguguuuuacuuuggaguuuaggugccauauccugagguuuuuuuuguuuuuguuuuuguuucuccuuuauuuaaaguuugcuguguuuguaaccaguguguguugagaaggaccaacaccaaaccacccuggggaagggggacagggaaacauuuaacacagacgaugaucaggauuugccccaaaccaccccaagagagaggacugaguggaacaaaaaagugacccccagaaccucucuuagugugaggguggguagaaugagaacugacaccugggagcuguggggagcagagcggcuuuggggaagaguggagugacuagacaccuaaugcccuggcagcuggagacucaaacuccuguacagcuaccuucugggaaauaguuuuugacaccuauuuuucagauucuuguccggaauuucugcugcucuuuucaaaaaagggcauuaacaauucucuggaaauaaagcaccuguuagccugacauaugcaaaaagcagggcggcaucacccauuacgagcucccccagccagcagucaguauuggauuggccuugccuggcugguggcaguuugggagaaacagccaaagagguuaguuuauuucaacaccaaauuagaccauggcccauuuccaacgggucucuuuaaaggccucuauggaauacauugccugguuuccuucuuugcaguucaccacagcaaggaaugucaccuccaucccaagccaccauuuucucaugaaggcaaauccaagaagggcuugcaguucuugcugaaggggguaccauuugugggcagagugaucaauaccaucuaguugggggaggaggagcuuauuucuugguguacuugaaucagaaggucccugcaagccaguaugcuucauuugccaguggccagaaauucucccuugccuccuugauugaggugucccagauguaguauucccacaggggucuggcaggccccuccuguaaccacuccagucacauuuucugcucuugaggcagaggugacaucaggacguuuacagccuccacaugaauugaguguucauuuaccucaguauuaccguguucauuuuuguccucgugcuacaguuagcucccugccgccucuugcaggucuuacuucagcucuugccugugacccacacagcuucugggcucugccucugcucuaagaagugcuguggggguagagaaccaggaaggacaugcuguugggaauguacaccugggcagagguggcccuguuaagaugugacuguagccacagccagggaugggaucccugggucucuggaaucugaaaccucaacaaauaccagucuugaccccuagcagcagagauaagaauaaagggguugguuugcuauuaagucagaugggggcucucuccuugucaugcugucccuguggguaacagacagggauugaccaucuuacuguuguacagguagcuggugguguuggauuaucccauugaagcugggacagcuguuccuuucucauagugauaacuugggucuguuguccucuaaggaacgugaaacauacacuucuuaagcugaaccacguaaacuugaaauucugcgcacugggagaaauguguccuguguuucaaaggauaaaacuguucuaaaggcuuccagggucaugaugggauuuuuuaaauaaaugcaaaaaauaaaaauaaaaaagaaaaaagaaaacaaaaaaaaaaaagaaaaaaaugcuagguuggggaggcgcuguucugaaucccaaccggcuggaaccaagaaugucguuucuauuuuuauagaaguuuuauacagcuccgggguggagaauauuuauuaccuaaauuauaucucuggaaaaggccaggauuuuguagaauccagaaugugauuguuauacacacagggugcuguguaugauugaaacuacugacuuucuguggcccguuugcagcccagcuaaccugcccaaggggaagguguuaaugcugugaauuggcagaggagagagcugugcuccauagggugcugccggugcugugcucccuagccuucuguucugucuuccuccuuagccagaacgccacucccuucccacauccccuucuucucuccgccuucccccaucucaccauuauuuguccauggauuuguccugggcucugggaccuuaugaaaccccuuuccuaaugacauaagaggccaaggugcaauccacccaccuuugauaccagacccugagggcuucauaccugcugauggguuuucuuuucuaaaaggaaugcucgccccagcaggguccugggcugcuugagcagccagcuggugagaccaugcacuucucuguucucuccucccccugcccagugaguuagcacagcaguagcacugcccuugagcacaguucuuuccccaggccaaagaugguuuugugaagaagcugcuccccuacaagucucacgugugaaagggcucagcucagaguggagacucgcugucaagucuuaagcaauccuuuucuguugugugaagguuucacuuacaauguguuuucugcuguaguuuuguuucuuacuuggguuacaucaugaaauugauuugccuugaaugcagccagaccacugucuccuggguuccccuugaguggccagggccuggauggaagcuaagagcuuggauuucugggaacaaagggccauccccauaagauugagcagaaauucugguccucuucccugaaaaauuuuccccaccccagccagcaucuucugcuuccccuuggguugugaccagggaguggggagagaggcugaggcucugcuccccuggagaccuucucuuaggaguugggugcuucauggaaaauccaagccuuagguucccuucugucucuggcaauuagauguguucuugguguccuccauguccuuuuugacuuuucccuguguccauuguuagcaugugcaaaaguucccugucauuacccaaccccugcccgcccaccucauuucagggcuguacacacagugaguguuccuguucucucucucuuuguuuggauguauugcucuguguaacucagugggucucccucuuucugguuuguuuuuuuuucuagauuccugccguuuguucaucguugugccuaaagcaugucgauguggcgucaaguacaucguccaaaucccugucucuucagcuucucugaugcuugaacucucaccuuugaccuuguguugaccuuugaugcugauguguauuuuuauuauguuuguuucuuucuucguuuuuuuuucuuuuuuucuuuccuuuuuuuuuccuuuugugcugccaaauugguuuugcuagaacgacugcugaaggggaaauauuuaaacuugcauuugaauauaaaaaaaaucuauuuuucuagaacuucauaagauaaccacuugauuuugugauuccaauucuuuguaauugucuucagagcagcccuacuagcacauaccgcgugguguuuguauuucugugaacacacagccaguccguuucuaggcuuuguuucucugugugcuuaguuuuaaagacaacuuugaaguaaacaaugaaauaaaagaugucacuaaaaccucugaggcuccugagcacauuuugcugauacagucuguggggcuugaggagaccgcauguauuguucuuucuuuuguuuuucuucugaguucucaacugcggagagcaccugaacccccuuuccuuuuugaccgcaggcugcacuuugggccccagccagcccuuuuucuuuuucuuuuucuuuugugguucuucccuggagcgacucuggggaguccuggauaucccgccugccccuuccccucagccccaugcuuguuccaacagucuccacagcaaaaugugaugcuuugauuuuuuuguuguuguuuuuguuuuuguauuguuuuuguguuuuuguuuugaauuuuuuccuuuccuacuaagauuaugcccagaaaaaaguuuugcauguuuccugcuguuucuucacaccuucguauauaucaccuucaccucucuguuuucuauaguuugugcaaaaacugaucgauuuaaaaggguuucaaagaagcuguuuuaaauuguuguaggguugauuauuuuuuucaagauuguauuguuuaauuuugaaguggcaacuuucuccucuauugcccuuagagcguuugccugugcacuuagacugucacuucguguggccuccaggucuuaccggggcuuccgggaggcuggcugcuuugcucagagagggugggaagggggccuggagagacacgagaagcagagguagagccuagaagguggcagcagguggguaagaggcuuauuuagcacauuaggggcagugagcaccuggaggaaggagggcgcucccaaucacccguaggaggccaucugcacaccaagcggcaauucaccugcuggcgcuuuuccuaggugacaagcacaauacuacagucuucacacuguuuacagcccugggcaccagccacccggcacuggcucuucaucacagcucugcucuugcuuagcuaguggggugggggaaagggcagggauuuguuuuuuuaauuggguggagagccaaacagcuacugucccugggugccaagcaagccaguuuuuugguucccugagggaaacugacccuccucucuuguggcaccauccagccucagggucuuggagacuugaguaagaaugugaguggagggggagaggugaggagaggagcacaggguggaucuguggagggaagagguuacagggggaggagcugaugauagaucccacccagacuuaagcugcuggugggugggugagcugggaaguaggacuguccagggaaggguggagagauguagcuaggggcuggggagggggagguggaagcgcuauugagcauccuccacaccaagguugaugaaggaagggaucccagcaggguuucugcucuggggcuggcagguugccugguauuaugcccaaggccgcucugccugggggaaagggcagccaggcagaggcccagugucugguaggcugcugaauuuccuggaaggggugauuggauggaaagaggccagaaaccccagccugagagacugcugugcaccccacagucugacugcacagagccgccucuguuggcaggaggcacugaggcuccccuuccuguguauugagaagcaguguuugccaauauauuuugcuuucaauuccaagaggagcucugggaaaaccuguggauaaaaccaaaugccaaauguuggacguuguuuccuuuuccuuuucucucucugauuguuuuaauuguucuguggugguuuuaauggauuugagacccuggagcggcagcugccuuucugauuuccagcugcuuuuugugaauaauuuaaaaagaaaaaaaaaaagaaacuuuacauuuuggagacaaaccugugugaguuuuuuauugguacaaacguuguauuuaacacuagggguuuuguacaguuuuuugccuuuucuacuagaaaacaauguaaagugauuucacaaugugaagagaaaaaaaaauugccacuaugaccaaacgcacagucuguucugcagcaacaacgggauucaaucaacucagucgugauucagccguagaaaugcuuuuccuuuaucuuguuugagcuuuuccuuucuuuccuguuuugauuugcaaaagaaaaugucuuuuuugugugaacuuguguuguacucuguagaaaauuauggauuuuacuuuaaugguuuaaaaaaaggcaaggagagcccucgucgcuuuucuuaccuaaucacagaguuuguguagugaauuuaaaaagaaaaaaaaauuguuauaaguuuggagcaagggaguauguguuucaaaggaaucuccuuccuuuuuuuguguguuuuuccuuuugucccaauggggaaccuaaaucuguuuuaauugcacagacacauggacaaaaagucauuuuguaucugccaagugugguaccuuccuuuguuuauuugcuauuaaacuguuugagaagaa

SEQ ID NO: 191209 - RNA, 102776 nt, Homo sapiens
aauaaagaacgaggacacugcggggugugcggcggcccaagcgguuucaaacggcuuagagcaggccgcuugguucugacccagcugaggugaguggucggugggccugccccacccgcgaggcccucgagugcaggcaucgcgcgcgcagaggagccccugaauccugggcggcuggaggucuccagacgcgcgccccacuugccccacgaacccggcaggucugaggcggcgaagcgagccggaggccgggggaccugcggcgggcagggccgggggcgugggcgcucgugugcggcggaggccgggguugggcuccagguggccagagcgcgccgcagcguggcgcggguggcagcguccgcggggcgcgggcggugcagggccgcgccuggcggcagcgauuuaccaagacuagggcgggggccccgagagccggcccugcuagagugccucucgcguaauugucaagugaaugaauaaguaagcgccuacgagggcuguggugguugcgaagggccuugucgcccuggagcaaggacagcggcaccggggccuggccgcacaccugugucccugcuggcuugcugcgaugugaacgauuccgaucauccaccaccccgcccuuaacgacuggcuuucucucucucaacgugucgggagcguucugguguccuuccagcccuggagguguuggggaaccaauacaauagccagcaguguggguugggccuugcuacuuuaaggucgggcucggugaacuagauucuuacuuuugagcucuccccucuacuuguaaucgugguaauuguugagcaggauugaaaugcauuccguuguguuucuuggauagaaaaugaugaaaggguuguugccagaguggcuaguguguguuagaaaauauauucguguugaugaaucuuaacaaugaguuuuuuauucagcaucaauagagguugaagugguuuuugcagaacuugccccaaauuuaugcguggcucuaauuuaauucucaugggaccaaggcaucaaaucuuggcccagaaaugcugccugucuuaugcauaauuauaguaauugaaaacucauuuuuagaaaggugagcuccuccuuccuccauuuucaucacccugaaaaguccuucuuuugaccuaaagagccaauaaauuaagcuaagaaucuuuugaaacuuuaagaaauuguagaagacuuugacuucucugaagugacuggacaaacuguaaugcuuuuaccaaauuuaaugauauagauaaaggugaaaucaauuuauuuugcaaccauaaguuaaaucuaguugguaaacucauguaaaaaaauuuuuaaauaagauuuuaggcugggcgcgguggcugacgccuguaaucccaacacuuugggaggccgaggcgggcggaucacgaggucaggaguuugagaccagucgggccaacauggugaaaccccgucucucucucucucucucuacuaaaaauacaaaaaauggcugggcgugauggcgggcgccuguaauccuagcuacucgggaggccgaggcaagagaaucauuugaacccgggagacagagguugcagugagccaagaucccgccauugcacucuagccugggugacagagcgacccucugucucaaaaaaaagaaaaaaaauuuuuuaaaaggcuguucacugaggcaauggcaagcaaagguauuccguaacaauuaacaugccuuuuacuuuauucuccauuacuuuaaagucuugaucaguuuugaauuauguuugaauuaugaacagugggugugguaauuccaucgcagucuucuacuacugacaguucaguuuuagcagcaccuguuuuuuugguguuuuuuguuuguuuguuuguuuguuuuuuaccuucacgguuuauuguaaaggaugcuacaaagcauacagaugaagagaggcguagggcuuguagguaugggagaaggguguggagcucuuaugcucucauaugaaguguguuugaauauaccaacucuccuguaaacuuuuaucuuaauuccaucaacacucacuuucuuuuccuuuuuuuuuuuuuuuaagacagagucuugcucuuucgcccaggcuagagugcaguggugcgaucucagcugacugcaaccucugccuccuggguucaagcgauucugccaccucagccucccaaguagcugggacuucuugugugcaccacaaugcccagcuaauuuuuuguauuuuuaguagagacaggguuucacuauguuggccaggcuggucucgaacuccugaccucaaaugauccacccgccucagcuucccaaaguguugggauuacaggugugagccaccacaccuggcuaacccucacuuuucuaacuguagcuucuauuaggacuuuaucaacagguuuuguuuuugcaauacuagguaggggaaguguuccccagccagacauaauauccauuccuaauaaaacacauuuacauauaggagacacagcuuccaacuuucauaguucugucaacacuuacaucuuuguguucucucaauuuuuuuuuuuuuuuuuuuucaaucagaucucacucuuucgcccuggcuggagugcagugcugcuauuaugggucacugcagccuccaccuccagggcucaggugauccucccaucucagccuuccgguagcugggacuacagacgugcaucaccaugccuggcaaauuuuuuuaguuuuuguagcgaugggguuuugccuuguugcccaggcuggucucgaacuccugggcucaagggauccuuuugucucggccucccaaaaugcugggauuacaggcgugaaccacuacgccuggccuucucuuaaucuaacuguagcccuguucggggcuucaccaauggcucuugguacuacuguaccuggggcuuccauaugaaggagucccaggaauuucuuuuugccacucccugaccauuuuaccuacuuauauacagaaggcuugggguccccagcaggugguugagccaagagacccuugcccauuugccagucuuuaucuugacucaucuaccuauuguuuccacaauuucagaucagauuucucauuguaaucugccuccugacuuacaauuucuccaaacugggguaaauauagcaaacuuguuuggaaccccuuaauggugggagaccagcagggucucccuuuggcucccaggcuagucuugaacuccugggcucaagugaucauccugucuuggccucccaaagugcugggauuauaggcaugagccaccacacccugcuaccuuacuucuuuuuuuuuuuuuuuuuuuuuuuuugagacggagucuugcucugucacccaggcuggagugcgguggcgcgaucucggcucacugcaagcuccgccucccagguucacgccauucuccugccucagccucccaaguagcugggacuacaggcgcccgcuaccaagcccggcuaauuuucuguauuuucaguagagaugggguuucaccuuguuagccaggauggucucgaucuccugaccucgugauccgcccgccucggccucccaaagugcugggauuacaggcgugagccaccgcgcccggccuaccuuacuucuuaauaaccauuuaaaaauuuccaccuuccggguugaauccauuugcccucugucucaccauucucuuaaccuaaugguuuuauuagcaucuguaagacccacgagaggaaacugagacagcacauuugauaaggcuucucgaacugucuuuugauuuugcaacaguaagguuauccacauuaaggggucacccuuaaccacagcauuuaccaugacuggguagugggcauauucagaggguaaauguccuagucaucauaaagccaguuucacauggcuugcauaugaaguauaucaguggcucuaucuggaucugggguguuccacuuggcauuuauggaaucagacuguccccuucaggaagcuuaugauacuaauguacaaagugaaacaauuccuucacauuguacccccugguuucaauaguucuuugauuuuugcagaccaccuucuuuguuaccagaggucuuagaagcacuuucuguugucccggcauacauuuuucccuugagggacagcuuugagguuaguggccuaagcucucacauucacugaaagcugagcuuggucuagcgggaagguccaacccaccacuuucuuuuaauuucauuuuagcuguuacagauaacaauaaccaagggauuuaacauuucgcuuuuuuuuuuuuuuuuuuuuugaaccaaagucuuacucuuucuccagggcuggagugcaauggcacgaucucggcucacugcaaccucugccucccaggcucaagugauucuccugccucagccuccugaguagcugggauuacaggcgugagccacagcacccgccuaaauuuuuuguauuuuuaguagagauggaguuucacuguuagccagauggucucaaucuccuaaccucgugauccuccugccuuggccucccaaagugcugggauuacaggcgugagccaccgugccgagccagcauaucacuuuuuuaauacuaguuugcauuuccuugugcauccugugaaccaacucccaggcaguuggauccaucucuggauuccauggauaacuuuuaccuuuaguaauugaugacagcacagcuucagcucuuuaccaugggugaccacuuggccaccuaagaaucaaaguucuuuaucccuauccuuuuauccuuuuucuucccaaaccauaugugucugugagccaagucauucuagcaaaucccaauucugacgccaauucugagaauauagaauaagaaacuuuaauaaguuuaucuuauacucucacaauacagaaaacuucugugaccucagaugugugagauuuuuuuccccacacaccaagcaaguaguucuucagcaguggacacuagcuguguguccucuaauucaguucaauucugacaccuuuuuuuuuuuuuuugagacagaauugcucuguugcccaggcuggagugcgguggcgcagucuuggcugacugcaaccucugucucccggguucaagagauucuccuuccucagccucccgaguagcugggauuacaagaacccaccacaacacccaucuaauuuuuuguauuuuuaguagagacgggguuucuccauuuuggccaggcuggucuugaacuccuggccucaagugauccgcccgccucagccucccaaagugcugggauuacaggcaugagccaccucaccuggccaauucugacacuuucuaucuggagguagugucagaucccacagguugaggguuuagucccagaagacugcccccaacucagaugccaaucugaagccccagguuuuuuuuuaccugugcuucuguaggcugacuauaaaaaugggcauuccuaauaccgccccccauucccugccuuggguuugauuaauuugcuagaccuguucauagaacucaggaaaacacauuuuccagccaguuuauuauaaaggauauugcaaaggauacaaagagcuauauagggugagguauaggggaagaggcauggagcuuccaugcccucucugggcacaccacgcuccagggaccaccauguguucagcucucagcuucuccagcagcaaaguuuuaauugcaauaaauuugaguaccuuaauauuaugaacacuguucuagguuuuugguaagcaauuaaaaauaauaaacaacuuuaacagugccuuaggauaaguguuaaaaauuuugacagggaaugaguauguuaagguaaagccaggcucucuuaugcuccuuuaauggggucuuauucauucauugaacagauauugagauugaugcuuaaugucugucacacauuguucuagauucagggaauacacuggugaaccagaaaaagacaaaggcccugaccuaagggaguuugacaguuuuaucugucaaacaauuuacuguagcaaauuauaguuucuguaaucccucuggggucagcucugguccuugaauaaaauacaugcccagauacuuuuacuagcaguagcuaacauguauugaaugccuacugggucccacauuuuguuuaauuaauuaauuaauuaauuuuuuugagacaggaucucacucugucgcccaggcuggaguguaguggugugaucauggcucacuguagacucaaccuccugggcucaaucuguccucccaccucagccucccaaguaggugggccuacaggcacaugcuaauuuuuguauuuuuuguagagaugggguuuugccauguuacucaggcuggucucaaacuccugggcuuaagcaaucugcccuccuuacccucccaaauugcugggguuacaagcaugagccaacaugucccgcuacauuuuaucuuuuuuuauccucacaauguuuuacagaugaggaaacugagucuuuaaaaggcugugcaacaugcucaaaaucauagaacuaagugauagaaucugaauucaaacccaagucagucugucuccagggccuuugcucuuaaccuaugauuguacuacgugaaguagggaucuguaggagaauucaggagcaauuucuggguagaauucccccagccccuuuuaaaaaaguacuucuaucggagaugugaugaaauaugaaugacaggcaugauaguuuuuagaggaaagauggcauuuaccauauggaagauggacaacugugacagugguggcgguggguagcuaaagggacgcauaaaaauugaguucuuaaucuaauuaggauucuugguagucaauguuggagaguuuuaagguuuuuaaaugauuuuccuauucuugccucuggaguuuagaauacauuacuuagcucauuucuaucagggcaguuacucuaccuacuugauguguauaacuccaacacauuacgcuuauucuuuucggucuuugcauucuguucuggaacuucucacuucacucuaccccuacccccagccuguauuacuggcacucucaggcuucaacuuaaaugucaucuccuuaaagagacacuuuucugagcucugaauuagaggagcccucuuggucacuuuuacuucacuuuuccuuauuuacuucauagcauauauuguuauguaauuguuuauuguuugucuauauauuguuagauuuucucauaaaaaugaaagcagaacauagauuuuuuuuuuccuuugagguuaccucagugacucaacaaugccugcaacaaacuagguggucaaaaauauuuguugaacaaaauuggccaaaacuggcaucaucuucucugaacaaaaaagugauaaaaacaguaucugacuauucaguuggcuguguuucugugucuuuauuuauuuuuuuuuauuuuuauauucuaaaaauguugcgacaaugguggcucagcaauuuuuuuuuuuuuuuuuuuuuuuuuuugagauggggucccacucugucuccuaggcuggaguguguuggccugaucucugcuuacugcaaccuucaccucccgggcucaagggauccucucaccucagccucuaguggcugggacuacaggcgagugccaccacacccggcuaauuuuuuuuuuuuuuuuuuuuuuuuuuuuugaagaggcaagguauuacuauguugcccaggauggucuugaacucuuggacucaagugaucugccugccucggccucccaaagugcuaaagugcuaggauuacaggcgugagccaccgugucuggcugucauuuuuuucuuuuuguggagacacagucucaguauguugccuaagcuggucuugaacuccuggccucaaacaauccucucgcuccagcauccaaagugcugggauuacuggugugagccacugcaccaggcuuguuccuguguuuuuggguguaagcaguaucuuaacagucucaauuagucuuaaaauuauuuuagacuaguucagaaagucuuuaagaaagcuagaaaaauuauacaucugaauuuuuuaaaaaaauuuuaaucuguuuugagagguacuagucaaauacauuguaagauguccuucuauuggaauuugucugauguuuuucucauuagacuggaguuacagguuuugggcaggaagaccacagagguaaagugccauuuucaucacaucauaucaaggguacaugcuaucaacaugauuuaugacuuaauauugaccuugacuguucauauugaccugaaauaguguuugugagguuucuacagugaauuuacuuuuuuuuccccuccuuuucuauacuguauucuuugaagggaagucacuguuugcagcccacacuuaaggaauggggaguuccuugaucuuaggguggaguaccuacuuaauuuauuugaaauucuugucucuccuuucccauuuauuaguuuagucaaguauuuacugauaauaguguggacucaaguauauuuauuuuauauuuuagguuacacuccaauauuacauuauuuuguuguucagguuguuccagcuuuguccuuugggagcuuccuguauuccuuuaacauacaugugugugugugugcgcguauuuguauugaucuuugaguacuuccuuacuaucuggaaauguuccaggcucaucuuguguauuucuugucccagugcuagaaucagccauuuccccaaggugcccugguucccuuauuggagaaugcuauuagaaacaagaccuggguacugaguguucucuuugcuacuggggugucauuucuuuuagguccuuucaacuguuagagcaaagaaauauaugaauguaugcuaaccccauguauauagacauaucuauaaauauuucucuauguagccaucugugucuauauuaaguuaaacgaguuccauagaucacuuucaguaguaugggcgggggggaaaaacaugaguuccuacuggugucuccaauucugauccauuaucacauagaucauucuagccuccuccccuugcugaucuuugaauuuccauucacaauagugaaaaaccuaauuuccaccauccauuuauuuaauuguccaguuccauuauauauggauauacauacauggauagcaguaucagaauugcuaacccauacuccaugaaaaaaacuuuaucaacuagaguacauacuucugugcaguuccuuuugcccuuaaucuuucagacuccacucauuaccaaagcuacuuaggucagaaccuuuuucccacccccuuuggugaaguuguuucacacaucuguaauauagauucccuugucauagucuucauucuuuucugcaaucucccagucuccuaaaugacuuuuuaaaauuugcauacauuaaaguucacucuuuaugucauaaaagucucgaacuccugccuuggccucccaaaagugcugggauuaacaguacaacccacugugcccagcugacauaaauuuuuaauucaguuggauaaauaccuagaagcagguugcuggaucauaugguaagacuaguuauaguuuuguaagaaacugccaaacucuauuccagaguggcuguaccauuuugcauuccuauuagcaaugaaugagaguuccucuugcuccacguucuuaacagcacuuaguucuaucugguuuuuggauuuuagcccuucugguagguauguaguguccccacuuuauuauuauuauuauuuuaaagagauggggucucacuguguugaccaggcuggucucaaacuccuggccucaagcaauccucccaucucagccuccugaaaugcuaggauuauagguuugagccacugugccugaccuaguguucucacuuuuuaaaauuauucguuuucacgacauuaccuuuuuugaaaauaaauguuaguuuuuuaagaggaaacuuuuuaaaaauuaacuuuauuuuggaauaauuauagauuguuccaacagaaaaguugcaaagaugauguguaggauuccugcauaccucucacccagugugcccuguuauuaacaucguuuaaacaaacuccagauucuguuuguguuucaacaguuuuucuauucaugugcccauucuguuucaggauccaauucaggguaacauauugcacuucguggucaucucuauuagccuucucuggucuuuggcaauuucucaguccuuccuuguuuucaugaccaugaccauuuugaggaguacuagucaguuguuuuguagacugcccuucucuuugucuuugucugauauuuuucucaugauuagucaagaauuacguguuuuuggaaagaauaccauagaauaccauaucauaucagggguuuugugauauccaugugacaucauuagugauauuaaccaugaucacuugauuaaguuaguguuugcuagguuaaguauuaaaguuaguauuuuucccuuucuauagcuauucuuaugaaaaugaguagccaggucuagcccacccccaaagugggugaagggauuagauuccacuucccggaguuaaggguaucuacauauauucggaauuuuguaaggaagauuugucucuuuucacccauuuauugcuuuauuccacuguuuguaucuuauggacuaguguguaugugugaguguguauuggcuuguguauauuuauucuguacuuugagauuuuauaaucuauuuuuuuccgucgaauaauuccagcuuugacuguugggagcucuuuuugguuggcuccugugucccuuugacaugcccccaucuuuuuaauuuuuuuuuucuuuuugaacacuuucuuauuuucugguacuuuaauaugcuccaggcucaucuuuuauuuucucugcucuaacccuagaauuagacauuucuccaaagauuucugguuccuuuugcuugguauuuagaaaccgagaucuggauacucugccgucugcuccuugcuaguggggugucaguguuucuaggccuucucagccaaaacagccagguaauauauauauguauuuuaaaggauaaugguggaugauuauucauuuauacuuuauuuuuauuuuuuuaguugauauuuuauuuuauugacuucucucaaacagauucuauucacucuucuaugcacaauuucagccugcuugguucuuuaaaucaauugcuaaauuagaaagaaggcacugcuacaagauaacuagaaguguuagcuugaucacaaaggucgcgaaacgaaagcuguaaaauauaaagccagccugagcaacauagacagaccucauaucuaggaaaaaaaaaaaaaauuagcugggagugguggugcaugccuguggcccagcuacuugggaggcagaggugggaggauuacuugggccugggagguggaggcagcagugagccauguuugugccacuguauuccagcccagacgacagagugagacccugucuaaaaaagaaaagaaaaaucucuauccaguacauaaaaauauuuuuaugcuuuagagggcugccuacaaauuuugagcaauguuuaauaugggagauuccuccaaaccuauggauaguccccuugaauaucaccaaauagcauauaauuuuuuaauagugaaucugcuuucuauaggaugaaaaggaauagauugcuuguacacccagagaagcaguuuguuuuagaccagagaggacuugccuuacuugguccuaagggcuguaacccgacuuaggcuucucuuuuuuuuuuuuuuuuuuuuuuugagauggaguuuugcucuuguugcccaggcuggagugcgguggugcaaucucagcucacugcaaccaccgccucccagguucaagcguuucuccugccucagucuucucaguagcugggacugcaggcauguaccaccaugccuggcuaauuuuuguauuuuuaguagagauaggguuucacuauguuggccaggcugguuuugaacuccugaucucaagugaucugcccgucuuggccucccaaagugcugggauuacaagugugagccaccgcaccaggccaaguuagcccacucuuauaucaaaggacugaaauauagguuuguuuaagucugaaaucaaccuaaaaucucucaaugacacugggaugaugcuuauaaugauauaguaaaaggccaagccggguggaucaccugagguuaggcuuucaggaccagccuggccaacauggugaaacaccaucucuacuaauaauaucaaaauuagcuggacgugguggcacacgccuguaaucccagcuacucaggaggcugaggcaggaaaaucacuugaacccaggaggcagagguugcagugagccaagauugugccauugcacuccagccugggcaacaagagcaaaacuccaucucaauaaugaugaugauaauaauaauaauauaauaauaauauaguaaugauagcugugguuuacugagugcuugguauuugccaugaaaucuguuaauacuacuacuuacuuagcugggcccaguggcucacaccuguaaucccagcaguuugggaggacgaggcgggcggaucacaaggucaggagauuaagcccauccuggcuagcacggugaaaccccaucuuuacuaaaaauacaaaaauuagccgggcaugguggcagacgccuguagucccagcuacuugggaggcugaggcaggagaauggcgugaacccgggaggcagagcuugcagugagccgagauccgccagugcacuccagccugggcgacagagccagacuccgucucaaaacaaaaaaaaaauuaauaauaauaacaauaauauaguaaugauagcugugguuuacugagugcuugguguuugccaugaaaucuguuaauacuacuacuuacuugcauaaaauccacuggauuuguuuaauuugacccuuuccaaucagccuuucucuuauuuggucacaugggucauauuuuuguucuuuacucuugccugcaucuuuuagagauccacacacaugccugaaacauucucuguugucccuacuuuuugccuuugcuuggauaaccccuauuaauuucauuuaguuuucagccugaguaucacuuucacagggagaccuucccugaaccccgcugccccagucuagauuagauuccuccgucauacucucuuauuguacuuugccucagggcuauuguggugcacagccuauacucagcaucuagaugagcaucuaacaccgaauagccucacacuaucugacaagcacaguugucaggacaggagaauaaugugaauauuugugggaaaaaaaauuuuuuuuuuuuugagauaaacucuugcugugucacccaggccacagugcaguggcucaaucauggcuuacuauaguuucaaccuccuggguucaagcaguccucccaccucagccucuugaguaacugagacuacaggcgcaugccacuacaccuggcuauggagggaauucuuaacauguaaaaggcaaaaucucauuuaaucuuuacaacaaugauuagaugagucauguuaggcaaguuacucuguuugccucaauugccucauuauuaaauagggauaauaauaucaacuucaagguuuuaaggauuaaaugaguaaauacaugugaagugcuuaggauagugccuggcacauaauacguguucaagaaguguguguuaaauagggagcaacaugaagaugguauuguuaugaugauugauaaaacugaggaucagcugguuuguggcagagcaagguuuacaacucaaucugucuaccuccagagcucaacaugacuccagguuugcacuaaauuuaaucuagaguagagcuuucuacaguaagauuucuuucaagcaacuguuuuacugccauggcuuugccaaagugaaagauucuaaaaaugaaauuacccucuuuuaguggaucuuauaauaaaaaaguaacuaacuaggaaaauaguggcaaaaaucuuagaaaauuucaaaauaauauuacugagugauuuuuuucacuuugaaaaggguuuacuucagaauuuuauuaaauauauauuguuuucucaacacauuugaaauacacauucuacaaaauuuucuuuauaagaccaggcgcagugguucaugccuguaaucccagcacuuugggaggcugaggcaggcaguucacuugaguccaggaguucaaaaccagccugggcaaguggugagaccccaucucuacaaaaaguaaaaaaguugggcaugguggcaaacaccuguggucccagccacaugagaugcugaggcagaaguuuugccagagccccggaagucgaggcugcagugagccauguuccugcuacugcacgccagccucaguaacaaagcaagacccugucucagaaaaaaaaaaaaaaaaaaaggauaaguuuauuguauauuuaagacuucugacugggugggguggcucgcaaguguaauaucaacucuuugggaggcugaggcaggaggacugcuugagccugggaguucgagaccagccugggccacauagugagacccugucucuacaaaaaaauuuaaaaauuagacagaugugguggugcaugccccaguaguccuagcuacucaggaggcugaggcaggaggcucacaugaggcugggaggaugagacuagagugagcaguuauugcaccaccauacuccagccugggcaauggagcaauacccugucucaaaaaacaaaaaacagaaagacuucugugacuugaugaaauggugccauuuuagaaauuuuacacuagagcacaaagcacuaugcaaugcugggauaaugaauaagacucaguuccuucuuucaaaggagauaucauguauacaaaaaauguuaagagagagagugaaguguagccuaugggaugaguauaggcagaugauccaacuucaagccucuaagugggaauuuuaaaguuuuaaagcuuuuaaaagcauuauuuaucaucuaagcgggaguuaaauaaagaaaaaguaaaugaaaaaaauuuaauaauauaaaaaauacaaaaacauuauuauaaaagaugcugaagcucauuauuaaaaaucagaaggcauggauggguauuaaaguucaaaguaaaaguuuuuucaaaaaaauuucuuugcuuaacccuuagacacacucucagaagucaugguuaacaauuuuuuucuuuuuugagacugauucucacuuuguugcccagccuggagugcagugacgcgaucucggcucacugcaagcuccgccucccagauucacgccauucuccugccucagccucccgaguagcugggacuacaggcacccgccaccaugcccggcuaauuuuuuuguauuuuuaguagauacaugguuucauccuguuagccaggauggucucgaucuccugaccucgugauccgcccccaccuuggccucccaaagugcugggauuacaggcaagagccaccaccccggcccaugguuaauaauuuucuacagauccuuccagaaaauguuuaugugcauucaaacauguacaaugauguccuaguuuucuauggcugcuguaacaaaugaccacaaacuugguggcuuaaaaaaacaggauuuauucucucacaguauggaggccagaaauccaaaaugagucuuauggaccuacaucagggugucagucagcagggccacacucccuccagagccccuaggaaagaaucuguuccuugccucuuccagcuucugguggcugcuggcacuccuaggccuguggccaucuuucucuacucuauucuaauuuuuuuuuuuuuuuuuuuuuuuugagacggagucuugcucuguugcccaggcuggagugcgguggugccaucucggcucacugcaagcucugccucccagguucaugccauucucuugccucagccucccgaguagcugggacuacaggugccugccaccacgcccggcuaauuuuuuguauuuuuaguagagacgggguuucaccguguuagccaggaugguuucgaccuccugaccuugugaucugccugccuuggacucccaaaguucugggauugcaggcgugagccaccgugcccggccuacucuauucuaaucuuucucugaucccucuucauaucacuuucuccauugggucaaaucucccuccgucuugcccauaaugauauaugugauugccuuuacccacccaaacaauccaggguaauccccccaucucaagauccuuaauuuaaucacaucugcaaagacccuuuuuccaaauaaaguaacauuuacaagucccagggauuacaacgugauuucuuugggggucauuaucagccuacacaaaugcauauguaaauguguaugugagauacacacacacacacacacacacacacacacacacacacacacacauacaaaaaaggaauuagacuucauauacugucuugcaaauuucuucuuaaaacuuaauggauuucuuccacauaggcacauuugacccuugagcaaugccaacguuagggaucccccugugcagugggaacuucacauauaauuuuagacacccccaaaacuuuacuaauagccuacuguugaccagaagccuuauugauaacauaauuguuuaacacauauuuuguauauguauuauauauuguauucuuacaguaaaguaagcuagagaaaagaaaauguuaagaaaaucagaaggaggaaaaauauuuuuucucgcuccaucguucaggguggaguguugugguccccucuuggcucacucuuucugggcucaggcaauccuucuaccuuagccucccgaguagcugggacuaacaggcaugugccaccaggcccagauaauuuuuuguauuuauuuuuagagacaguaaguagacugucuuuuaaguaaaguaagacuuuauugcccaguaaguagaaaauauauuuacuauucauuaaauggaaguggaucaucauaaaggucuucauccuugucauccucaugucgaauaggcugaggaagaggagggguuggucuugcugucuuaagggugacaggggcagaagaaaauucacaugcaagucaacccgugcaguucaaauccauguuguucaagggucaacuguauuuauauauuuacuucugucuuccauaucaucuuuuguuuacuuuaaauauuugcaaagcaauuuuuguauagacgaaugucucauuuuuuguguaugguaaaaaacaauaguauaaaauuuaccaucuuaaccauuuuuaaguguacaguucaauaguguuaaguauauucacaucguuaugaaacagaucuccagaacuuucucaucuugcuaaucugaaacucuguaucuaaauauuucucuuaucccccucccaagccacacccccaccccaucuuugguuacuaccauucuacuuucugguucuaugaauucaugaauuugacugcauaccucauaaaaguggguucauacaguauuugacuuuuuuugugacuguuaguagauuuuuuucucuaauuuuuaaaauguuuaauucgcucauaagcacagcacaggguauuauccauuugugugugcauacacacauacacucauuguacuauguuuauugcaguuaacugaaguccuaugucacuagaaugcuauguaacagaaaauguuggucauaccucuugugauaaauauuuguuggguacuuauuuuguaucacacauuggaagaaaaagauaauuaagauacauuccagcccuugcccuugaggaacucacaaucugaugagaaaggcugaucugcaaaccauuacccucagaacaguuaagcuugaugggaauauaaugaaugaaggucuuaauuaccuaauucagagguauucuuuacaguuaaaugcauuguagaaugagacugucuuggcaguucaaaaaucagacuguuuuaaucugaauccauuuuuuacuuggcaacuuuauuuauuuaucuaccccgcccccacccaaguaaggaaaagauacuuggcaacuuuagcuuaggguucucuaaaaccuucagaauaagaguaaccugagucugcucccugguggagcaaucuucauaacuguucuuuggauucuuaaauuucugcuuuauuccuguuguggauaggagaaauuggguuacuuacaaauggucuuuaagcuuacuacauugauuccuguacugaucugaugauggcccaaggcuuuaaggagguguguugauucaucuaaauuagguggaguaauauggacuuaaaaaaagcacauaucuuuccuguugguaugaugggagacacaaaaugcagucaaaccuuguaaacuaggauucaggacaaacuccuccuacaaaaagaaaauuaaaacuaguugcuaaccuuuggagaucucagagacuaggacuuaacuccuugaaauauuaaugccguuucuacuacaauuuucuuaagaacucuucauauuaaauuagaugauugcacauuacaauuguauuggcaugcaagauuacuuacauagacuuguacauuuauuuacguugacuuuuaggucaauuuuugaaagaucacauuuuacacacaagauggggaagguuauuuuucuuuuuuucuuuuauagagguaugguuuugguuaguuguucaggguggagugcuguggugcagucuggcucacugcagccuaguccugggcucaggauccucccaccucagccuccggaguagcugggacuagucuuguaccaccaugcccagcuaauuuuuuauuuuuuguagagauggggucucacuuuguugcccaggcugguauuuuucuauuucaccuucuauuaccuuccugcccaucuuguaucauuguccaggauuccuccaguuuuguaaagaacgaauuccgugaaaaggugagguggagcauuguaggaucuuuuccaggccuuugaguugccauuugaagaacugcucgaguccaaaggagguuaaugaaguaagcagcuuacauauaaugaggggcuauguaucuaccuugaugcuuuggcuguuaccugcaguaauuuuuuucacccuuggaggagggauuaggauugugauagugggaacuggucaucuccuuuguuucuggaauauuacguguaauacuaccaaaaaaagagguccacccaacugcaguagucuuccuaguugguccaucauuugccucuugccugggaaagccuaggaccuagaagcagcgccugaggccugcaaaccucugggcgaagauacacugcggccccuuuaagcuuucagagugugcggagaggggagcugaggguggggcgggcacucugacaguggcgcuccgggccccgcccucggaggaggcguuucccagcggaccgcagcaccaaugcugcugccgccgccgccgccgccugccggguauuccugcugauccugcucggaccuuagcuucccugaccucucccugcccggggagcguaagugucaaaccacgggcaaagggcaagcaucccgcgaccgugcugcaaguccugguggacaguacuggggacuuugcuggccuaucagaggcuaaggcggcgaaagagcguaaacaaugccggcuccagugagcuaaagccaggguaucugcucuacuucuggguggugacagcagccguagggugcuuguuugggcaugcagugggugagcagugcccacgaccuggcuuugcccccaccugguucuuacuuggggugaggagaggguugcuuuuaccagaguauaacccauuugagcugaauggguggagcugaaucucucucucugggccuuggauccuuacccugguauuugaagaccuugguagcuuugggaugaguaagcauuagguuuucagcuaccuugguacagucgagcaguaacuccaaguuguccuaauucacagccagguuuagcugucucuccagaggccuguguuggugguaucccguaccccuuuuggauauguugacagugaacaucucuuaggaagaguccaguuaaccuuuccuccugauauaaagagcacaaugugaaagagacagcucuuuaccccucuccaucucugaaggaauuugugggacgccacugucccaagauuaggaaagcaaacacaccaaaguuugagauaaucugcuagaaaacuguucagauuucuggccgccugguaaugcagaauacuccggcaagaggauaacacuuguccuuguuaaugggaaauaccuggagacagugaguuuuuuuuuuaauuugagggaaaguguugucauuuuugccaccugcuacucagagaugggauuuugucagauuuugguuaaauaauaaaaaucuuaaguuuucuaugacaguuacauaguuguuguguuucuuuaauccaguuguccuuccuagacaugguuugaguagauuucugggcauguguaugcauugcuuuuuuaaaaaaauaauuucuuuuuuuuuuuuuaugagccuaucaucacacucaguggucauucaaauggguugcuuuuugauggagcagaaguuuuucucaaacuucuguuaaaaucauucugugcuucugcaauagcaucuccuuagccagaggugagaguccaggaaugguaaucaaauucagaucucuuguauugugauagugaagagcuuuuguaggucaagagcuugggaauuugccauaaaaaagucauacugccagugguuuuucucuaaguagaagagaaaauaaucuguacaguagcucuguaauuacucuuauagacuaucaaaauacaggaauuuaaacuaaaaagacaccacacuugggcccauggguuguagggaagagagacagacugagaaguaggagacauagguucuaggcccagcucuaguauuacucaugacuuaaucucucugucccuuuuaaaugguugguuaaugagaaaaugcacagauuuuggggucucuuuuaugaugggauauagugcauauuuaauaggaaauuuguuauuuauuugaacacuaaacugaaaaaucagacaauuuggaauuuauucuaaguucugccuucauguauaaccuugaaaacauuucuuaaccucuagucuaaaaauaaacaauuaugccuaaaccuuuucagcaauagcauggacuauaugguauuugagcucuuaggaagacauuuuuagaucagugguauaugauuauaauauaucuguaaaacauacuuacuuuagcugaccuacuugucuuugccucaguuuuagacugggauaaaaucugagagcucugaauaauugaaauuucugaauaugugucuuuacuagggacuagaucaaauaaaccacagcaagcauuauguauaguucaaauuaaucuucuuaaugcuucucuuuguuggcaauuuuauuugcucuuuaggcaucaaacucuacuguguagcaaaaacuugguucuuauaucuguuuauaaaauccagaucagucugcucaucccuauaugauacuuuuaacuuuuugagaaacuuccaaaugguuuuacacagcagcuagaccauuuugcauucacagcagcuggaccauuuggcauucaacuuaaaaaauacagagguauaauaauuuuuauuguauuuuacagacauacuaguauucaguuggugggggugguagggggaagacugguccugaguuugaaaagcacaguuugaugaacaugugaacuguuuccagcuuuugacuacuaugaacaacauugcuaugacuaucccuauauaggucuucugguguaauuugcaucaguuucuaggcuauacaccuaggaauggaguugcugggugguagggcauguguaucugauaaugccauacuguuuuccagacuguuaaacuauucugucucccaucauugguguauuugaguuccugcagauucuccugacuccuuuaaauuacacugcugcuguuucauggcaauccuagggauuuugaagaaaaaucuuaaugaaaguuccacauauccuaauaaacuuuuacaauuccaucuuucucugggacauuuucuucuuugccaugggagggaacaaaauguaaaggaagaagcauagacuaugaaucuuaguuuaauuucauugcuuaccaguuuuguuguuuuggcagguuacuuaauauuugugaagcuaguguguaaaaugagaauaucuuuccuucacauaguugaugucaguauaaagugaauuagcguguuuaaaaaguacuuugcaccaugccugauucagaauagauauuaccagaguauauauucaauaaacaaauauuuauugaaaacauauuuuaugucaggccagaacuagggauggagaauuacggaggaccgcuucuauguuauuaauaauauugaaaaaucggccagccugggcaacauaguaagaccccaucucuacaaaaaacuaaaaaauuaguugggcauggugacaugugccuguagucccagcuccuugggaggcuaaggcagaagaaucacuugaacccgggaggcggagguugggaggaucacuugagcccaggacaucaagguugcaaugagcugugaucacaccacugcacuccagccugggugacagagugagacccugucucaaaaaugaaaaagaaaaauuggaaacaauuuaaauguccaaugguaggguugguaauuaugguacauuuguaaaauggagugcuauguagacuuuaaacaucauauucucaaaucugggaaaauguuugugaucauauaacaaaaauguuguaaggggauuaugccugucuuuuucauaugauuuauauuacuacauguguauugaaaaaaaacuggauacguacuuuaguguucaucaugguuauuagguggugguaaaauuguauuuuaauacuuagauuuuuuucuguaguuacuaaauuuucugcaguuuacacacauuacuuuuauaagaaaaagguguugucuagauagauagcauaggggugggugcgguggcucacgaucagugggaucacuugagcccaggaguucgagaccagucugggcaauauaacgagaccuugucucuacaaaaaauuucaaaauuagccgagcaugguggugcacaccugcagucccaccaaauccuagcuacucaggaggcagagguggaaggaucgcuugagcccaggaggcagagguugcagcgagccaagaucguguucauuccacuccagccuggacgacagagcaagacgcugucucaaaaaaaagaagauagguagcauaaaguuauuaaaaggauguugacuuuaaaccucacuuaaaaacaugguuuacauaaagaauauguauaaagguucauucagggauuuaauuuuguacuuguuuauauaaacauugacuagucauguuugcuagaauuagggagcuuggcaguaucaacauuuuuacauauugauucuuuccuuuucuuucuuuuuuuuuuuuuuuuuuuuuuugggacggagucuguugcccaggcuggagugcagugcgaucucggcucacugcaagcuccgccucucggguucacgccauucuccuaucucagccucuagaguggcugggacugcaggcgccagccaccaagcccggcuaauuuuuuguguuuuuaauagagaugggauuucaccguguuagccaggauggucucgauccugaccucgugauccgcccggcucggccucccagacugcugggauuacgggcgucagccaccacacccgacccccauauugauuauuuucuauaaguaauucuaggugaaaguaugacuuuuuccaaaacuuuuuucuuggccuuuuaaaaggccauuuagcucagcaauucaguuuuauuccagcuucguuuuauaucuaagaaguucuuauuugggaaaauaaaagcaucauuuuuuagaaaacaaauuuuugguuuuuuugagacagggucuugcucuguugcccaugcuggaguguaguggcaugaucacagcucacugcaacuucugucucuugggcucaaguaguccucccaccucagcuucccgaguagcugggacuacaggcacacacaccacuacgccuggcuaauuuuuguguuuuuaguauagaugggguuccaccauguugcccagacugcaauauauuuauauuuauauuuuuugagugacuuuauuuuuuugagauggagucuuacucugucgcccaggcuggaaugcagugggacaaucuuggcucacugcaaccuccuccucccagguucaagcgauucuccugucucagacuuccgaguagaugggacuacaggccugcaccaccacacccagcuaauuuuuguauuuucaauugagacgggauuucaccauguugaccagacuggucuugaacuccugaucucaggugaucugcccaccucagccucccaaagugcugagauuacaggcaugagccaccacuguguccugucuuuugagugacuuuaaaaaaaaaauucuauuggccgggcgcgguggcucacgccuguaaucccagcacuuugggaggccgaggcggguggaucacgaggucaggaucgagacuguccuggcuaacauggugaagcccugucucuacuaaaaauacaaaaaaauuagccgggcgugguggcgggugccuguagucccggcuacucgggaggcugaggcaggagaauggcgucagcccaggagguguagcuugcaguaagcggagaucgggccacugcacuccagccugggugacagagcgagacuccgucucaaaaaaaaaaaaaaaaaaaaaguccuguuaauugaauuaaguggggaucugacgaaagaacgggauuuuuacucuuguuguugcaugaaugauaaaauaauaaucucagaaaaguuauuuuugucuuaagagacugccugguugcuaagcagguuucuaccuuuaucugaccaggaaauacucuuaauucuaaggaaaaccuggaagcacaaugggagaugacagugagugguugaaacugccaguugaucagaaaugugaacacaagguaagauucuucuggaauucgauuuucagugucguuggcuuguuuugugagcaguuauacuaucaucuuacuuagaagugugugaaaacauuggcaguuucaaaaauacugaugccuuguuagauauguuauuuuuucucauugaaaauagguuucuguagcucaacuaaaaauuuuuuugucucuggaaagaauucaaagaaaagauauuagugaagugaaaaguaagugguaucuaugaaaaguaacuggcuaguuuuuucaucuccuuguauauacaguacaauauacuucugguaccuaaguacuuacuaauauuuuauuauauagagacucuucuuuugagauguguucugaauuuggccuuagaaauccagcauuuuuuagguucucugauuuauaugaucggcauuccaauauuuacccucagaaucuaccaaucuuuauuuucuaguuuaugcuaguaagauacaauuuauuacaucaugucauuauuuggugggcauccuuucagauuaucuuauuuuuuccccaacuauaccucuaguuucuuucauuuuuaaucauuuuaaacaaacaucuaccaucugguagauuuuagaauuucauuucuucuuguaaauuuauucuacuccaaguccucagguuuaccacuuuauguucuugacaguucuuuuaaaguuuguuuugaaucugaguauucaagauuuaugguuguugauuacuaaaaauacugaauaaaauauacuaacuuacacaguuguauacauacaguucuaccuauguagaguagaaauuuggagccauggucccuauauccuccacagaaccacuccuucauccuauauaauaaauuagccaaggccgaauacuguaucaaaaaucaacauguagcucuucaaauaaggccagauuaaaagugagcuaguugguuuuuauucuaauucgcauagaaauuguugguuauguaguacauuaaauugcaacaaaaauugggggagaauuuuggaacuuauuuagaaucguuaacuauaaugcuuuuuuugguagauauuguauauucucacugaaaggggcagacaauauagauaaaucuuagacuuuccgauuuuugauugguuaauaugugcuaagaguuuuucaaucucgugugauuugguacuuuauuuuucccauuuuuugagcauuuauuguguguuuuugaaacuuaaagcauagagauguuaaaucuguuuagggaacacucauucuacuuuauagaaugagauguugcccaauuuuaaaaaauaaaaaaauaaaucugguuuaaauugguuaguaaauguucaacuaugauguuaauuuauguuauacuucacucuaauuuugcagaauagguaaugccuucuuccuaaugaaugcaucuuauaguggguuaggcagcauuccuuccuuagaaggaagaguuuuuucugugagcauagcaccugccccaaaucacauuuucaauuacauuaauugaaucaauucaauuacauuuucaauuacauuuuuacuuacauuaaacaaauaacauguaaauuauuucuguuuuucaaucauauguugauccuucugucucuuugaucuaauaguguugaggacaaacaucuaauucuuuacuaaugcuuaacacaguaaaugcaaauucgaucaucccacaaacuaacuucucauuuaacugcccccaaaucauuucauugcuuucccauugcucuuagaauaaugaguggaaucuuuucuuuggccuucauaguccugcaugaucuggccuuuuccaauccucuccagcuuacuuuguaccauacuccccuucucuuucuuuauaggagugggaaauaccauauucccugcugccauagggccuuggaguauacuguuccuucuggaauguucugucuccccuuuugccacucuuuccugauuaguuccuauuuaucuuucagggcucagcucaauuaccauuucucaggaaauuuuuucuuaacacuaagacaaagccuuuuauaauauauacuuucauagcaccaaguugcuucuccuuuguaguacuuaaugcuuuguuaauuuuaaauuuauuuguauuauagcuuaauguccccuccugcuggaguguaagcuccacaagggccagagcugaauugauuuuuauuuauuaaacaccuguugaauaaauuaaugaaaaaagaauaccucaguaaaaauguccggaaucuacuagcugaaauuaauauacaguguaauauaaagcuaccuaaugauuauacaaaaauagaaccaaaaaacagcauauacuuuggagacggggcaguuucaucagggugauuucucauguuugaguuaucacaucuuuaauacaauauuauaaagaaguaauaauucuuagauacaaugugagauucauuuauaauggccuauuaugaauggcagaguaucauaaacacuaaacacuuguaagaaguuuauuagcuaaucuuuuuugaaaacugccaauuucuuaaacucuuuuuucauuucuagucaugggguccuuuguuuacauuaccugacauaggauauucauuucuauucucacacccuccccccccagauuaauaguagaugauaauaucauuaaauuauguuuuguuucaaaauacuacuuuucuuuuagcuguggaaagcaagguuaaguggguaugaagaggcccugaagaucuuccagaaaauaaaggaugaaaagagcccagagugguccaaauuuuuaggauugaucaaaaaauuugucacugauuccaaugcagugguucaauugaaaggauuagaagcugcacuuguuuauguugaaaaugcccauguagcaggaaaguaaguacuuucuuuccaacuuuacugauaaaaaccccuguuugguguuacauaauguauguuuguagaucacuguccuuaguuauuagcaguuuuagaauagaugaauuuucuuacuuucguaguuucuugauacuuguuuuucauucagucuuuauucucagaaaucuaaauggcacaugagaucuguagaggaguaaauuagaaauaauauuuugaggguuuaccuuaagguuugaugaccaagugguuuuccuuuuaagcuuuuuguaugggaauuauucuaaacuaaaaggaagagucuuuaguaacuucaaaaagaaacugagagauugucaguaaaggaauuaucagaauuucacugaagacauuugggcauuauagaaaacuaaauuuuuuacaaggguuguuagauaggugauguuagaaucaugucuuucucccuuuguucauuaggcauuuuuauuucuugggggagguaaugcuuacuaaacaaccucagugacuccuggccaguuuaacuugaucugugaaugacagauuucuagucauccuacuaucccauaccucauagaccugauuuuccuaacucuagucucugugucauugaaaggaacccuccauacaaaaaaaaaaguugaaacacuugacuuaauugcacaagaaauauauacuugacuuacuucaaagauuauaccaauaaagaucaucauuaauuugacaauuugguuaacuggcaucacuggguuuccuuuaccguuaguaaaacuaucacuuuuuaauuucucuucugauacuagaagcgguuuuuugauaaaugcugcauguaaucucaacccacucaguucuucugauucccgguaguguagguuucauuucauuuagaggagauucaaagcaguaaaguuauuguaaagucuuauuaaggagucaagaguagucuuuuauuauuaaagguacauauccguucccucugugaagaaauucucuuuuccuaaaaaguguuuaaaacgacuuaaaaaauuuuuuugcccagaugcaguggcaugugccuguaguccuagcuacucaggaggcugaggcaggaagaucgcuugagcccaggaguuugaggucacagugagcuauaaucccaccacugcacuccaacugggugacagcacaagacccugucucucucucuuuuuuuuuuuuuuucuuuuugauacacaguuucguacuuguugcccuggcuggagugcaauggcgcgaucuuggcucaccacaaccuccaccucccagguucaagugauucuccugccucagccuccugaguagcuggaauuacaggcaugcgccaccacaccugaguaauuuuguauuuuuaguagagaugagguuucuccauuuuggucaggcuggucuugaacuccugaccucaggugauccacccgccucagccucccaaagugcugggauuacaggcaugagccaccauacccgaccaacccugucucuuuaaaaaaaaaaaaaaaaaaaaaaaauugaaagcaagcauucuguaacccuacuuuuguaaaguauauuuguauguccauauacacacacacuuagagaaaggucuggaaggagggauaucaaaaaguugaaaguaguuuucucuggguggugggauuucaagggaucuuuaauuuuuuguuugaauuuucuacauuuauaaacuguuacuaugccugcuaugacaugucuuaaaauuuuauguuuaacguuaaguuuuuaaaauauucuugaacauaaauuuaaaaauuaaagacucauuuacuguauuucuagcauuuguaaaaguacuaguacacccccuuuccgugaccuuuuuccaauucuuacuacuuaagugggauuuuuguucuuuauaauauguuacagaaccacaggagaaguugugucagguguuguaaguaagguguucaaucaaccuaaagcuaaagccaaggagcugggcauagagaucugucuuauguacauagagauugagaaaggagaggcuguucaagaagagcuccugaaaggcuuggacaauaagaaucccaagaucauaguggccuguauagagacacugaggaaagccuuaagguaagacuuuguuuuagcuuuguuaacuagagcagcaguccccaaccuuuuuggcaccagggaccaguuucauggaagacaauuuuuccauggaagaauuguguguuggggggaaugggggggucguuuugagaugaaacaguuccaccucauaaggagcaugcacucuagaucccucacaugugcaguucacaguaggguuugcacucguaugagaaccuuaaugcccugcugaucuggcaggaggcagagcucaggggguaauucucgcuugguagcuguucaccuccuguugugugccugguuccuaacaggccacuguacuggccacagcccagggguuagggaucccugaacuagaguaucucaauugaguuuggauuccggguuuaaacagaaauggaaacugcagaauuugacuuggcaugccaaaacaagcaagaaagugaccugaauaaggaaagucauuccccaaguguggcacuucauguugacuaauuuuagccuucaaguguguuguguaguuauuuuaucugaaucccuuucuaaugaagaugaauagagauuucugaccuguuaucagauuaagaauuaggcuuuucaguugggggcaguggcucaugccuguaaucccagcacuuuggaaggcugaguuaggaggaucacuuggggccaggaguuuaagaccagccugggcaagauggcaagaccccugccacuauaaagaagcugagguggggaggaucucuugagucuagaaguucuaggcugcacugagcugugauugugccacugcaauucagccugggugagagagcaagacccugucucuuuaaaaaauaaauaaauauggccaggcucaguggcucacuccuguaaugcuagcacuuugggaggccaaggcaggcagaucacaaggucaggaguuugagaccagccuggccaauguggugaaacgucucuaccaaaaauacgaaaaaauuagcugggcaugguggcgcaugccuguaauuccagcuacucggaaggcugaggcaggagaauugcuugaaccuggaaggcagagguugcagugacccaagaucaugccacugcacuacagccugggugacaaagcaagacucccucucaaaaauaaauaaauaaauacauuuuaaaaauuggccuuuugguggaaaagcacugaaaagaaaaguacuggccuuuuguuggaaaacuacuccucaggguauuuaagcagcucuuuuucucuugcuaucuuaaguauagacuuucgaagucuauacuuugagauguuggcuaaagauaaaguuuguggacuaaagcuaaccuuuauuuaggugccuuuuuaguaaaguagaagcaaaugcuauaugccuuuaaagagacgcacagugaaagcaaauagaaaaguaacuuuugcucuuauguaguaaguucuuuucaacccuagacuuucuuguuuggccaugaaauuuuucaugaauaggaucucuuucaggaacaaguggauguaauuugcuauggaaaucugaauuagacagaucacuaguuuguucagacuuggcaguucuucuaaucugguauccuguccccaaguacugucuauaucagauauuuuagaaagcagcuguaguaaaauccucacggaaugaagaucauccaucucaccucucaugauuuuguguaugaccuacaucuuggagaaaaauguuuccuuugguguuuaucuucugugaaaguauaaaaacucuuguauuuuguugaaugaucuuugauuuauaggucuuuaauauuguuuuuugcuuugcucauaauguacuuuuauaaaauuugacuugcuuagauucuuacgugaaugaaguuuccuuguuucuagccuauuacaauauaguaagcagauguuuuucugaguaguaaacaguaugcucauucuauuaucuuagaaauuuagugacucaucuuaguuaucagaacuaugcuuauaucaauaaaucuuuuguguccuuagugaugucuaaauuuuaaaaaauacuguaaucuuuuuuuuuuuuuuuuuuuuuuuuugagacaaggucucgcucugucacccagacuggagugcagugguacgaucucagcucacugcaaccuccgccccuggguucaagcgauucucaugccuccagccuccugaguagcugggacuacaggugagcaccaccacacccagcuaauuuuuuuuuucuuuaauagagauggguuucuccauguuggucaggcuggucuggaacuccuggcaucaagugaucccaccucggccucccaaagugcugggauuacagacauaagcaaccgcaccuggccuauaaucuucuaccuuuaaauuacaaguuucuagucuggagugcuguguacucugguuauuucauuuuuuagcuaaacugggagaauaaggguaggaaaauaacaaguuacguauaucucauguuuucuucauagauguuguuauguagucccaucccugugugguucuuuauuuguccuaaagcauuucagagucuauaguuuaacuagguagcucucugggacccucaagaaccuugaggccaaacugcuugauccuggguuccagagcuugcuaaagcuuuguuagugagagcuucaggugaccagaaacauuugugguaccuaaaacagguuucuaguacccuuuuguguuuucuauaguaauacguuuaguaucaaaauuagguuuuauuuuauuaaggugucuauuuuccauguggacuugcuccaucuuuuuuuucuuacagaaggaggccaggauagagaaaaaagauucagaugaaacaguaauaauauauaggaagauuuaagaaaucucaaauguuagguucuucaggcaccauguuaaauaucccuaaaacaaaaugguuuauugccacuauaauuucuuauuuuuuguuuaaucuuaaaggucagcugagccaaguuaaaauguaauuuuuuuaauaauauaaaagcauuuuaaaaaaucuuagagauuauguagguuauucucaugauauuuguacuuaaacuauaucacauagccagguaucuuauuaaaaauucuuuuuuuauugugccuguagucccaccaacucaggaggcaggaagauuacuugagcccagggggugaggcugcugugagcuaugauugugucacuguacuccagccugguuaacagagugagacacuaucucaaaaauaauaauaauaauuaaggccaggagcaguggcucaugccuguauugucccagcacuuuggguugggaggcugaggcaggcagauugccugagcccaggaguucaagaccagccugggcaacaaggagaaaccccgucucuacaaaaaauacaaaaaaaaaauuagccgggcaugguggugccccucuguagucucagcugcuugggggacugagucuggagaauagcuugagcagggaaggucgaggcugcagugagcugugaucauaccacugcauuccagccuggaugacauagugagacccugucuccaaaaaaguaaaaacaaaaaccaagaaaaaaaaaucguuggaguacacuaguagcuauuacugaguaauuuuguugcauuugcucacaugagauaaauuugugcacauuagauaauagauaaauaauaauuuggguccuacuacucauacagaauuucaguguucuuucauaaauaaaucucuccugcuccagaaucugauacucacaaauguuaauagugauauuagauagcuaaaauuggccaguugggaacuugaaaauguaaucuaugacagauauguaagguuaaacacacuuuuuuuuaauuuuauuuuuuuuuugagacggaaccuugcucuguugcccaggcuggauggagugcaguggcgcgaucucggcucacugcaaccucugccucccggguucaagcgauucuuccaccucagucucccagguagcugggauuacaggcgcccacuaucgugccuggcuaauuuuuguauuuuuguagagacaggguuucaccauguuggccaggcuggccuugaacuucugaccccaggugaucuaccugccucagccucccaaagugccgggauuauaggugugagccacugcgccuggccaaauaugcuuuuugaaagaagucaaaaugcaacauuuuccccauagaaaacugaaguaaagaaagauuuaagaugcccagaguuauagugugauagccacaaagucaggaacaaaauauugccaagauuugugaucuaucuagguaaaugaaucacuuuaauuauaggagcuauuaaagguuuauuaaaaguagauuucauucauguaaauauuuauaaacuaguuuauauuuguaagcuuuuauauguauauacauacauauuugugguauuaggcugggugugguggcucacgccuguaauccagcacuuuaggaggcugaggcggguggaucaccugaagucaggaguuccagaccagccuggccaacauagugaaaccccaucucuacuaaaaauacaaaaauuugcugggcgugguggcgcaugccuguaaccccagcuacuugggagacugagacaggagaaucaccugaacucaggaggcagagguugcagugagcugcaaucaugccauaccacucuagccugggcaacaagagcaaaaugccaucugaaaaagaaaaaaaaaggguauuaaacauguugauccuuuauagguuuuaauuauuccuagucugcuuaccuagaaaguuuguuuaaaaaugguaauauuauuuugggcccuacacauuaaauaauauucuuagaagaacaacaccuuaguagguaagcaguuaugaguuccuuuucuuuuguugccuuaaaaaaaacugaacuuauauaauucuucuaauauguagauauggaacuauguuugaaugaagaaaagcuaaugcuuuauuuaauugcauugcacguugacaguuuuuucccaauuuuuuacuuguagugaauuugguuccaaaaucaucuugcuuaagccaauuaucaaaguguugccaaaacucuuugagucucgagagaaggcuguucgagaugaagccaaacuaauugcuguggagauuuacagauggauucgggaugcucugagacccccauuacaaaauauaaacucuguucaggugagacaaaaaguuuucugguugcuuucgcacaagguuaauaugaaaauauuuucuuccuaucguuguugauauucuguccuuaaaaauaauuauuuuacauucuuaauuuugaaaucagcuuuucugagcauagcuaacuuucucagcaauucucuuggguggcagaacuuauuaucugugugaaguacauucuuucuggcuuuuuauuacaauugguuuuggagacucuucugaugauguaaauguaucugaauuaaugaacuaaugagagugucuuaaaaagugggacuuacuguucuuucuuagugcuuagacauacgucuuccuuauaguaaauucaaguugguuugacuuaugcuguaaaagaaauaaaauuuaauuauauauuuucuuccgcuggugcagugguucacacuuauaaucccagcacuuuggcaggcccagggagacagaucacuugagccuaggaguucgagaccagucugggcaacauggcaaacccuaucucuacaaauaauaaaaaaaaaauuagccaagcaugguagcacagccuguaguccuagcuacucgugaagcuuaggugggaggaucaccugaaccuggggagguggaggcugcagugagccaaaauuguccagccugggcaaaagaguugagacccugucucucaaugaaugaaugaaugaaucuuucuuguuugcccugguagagccacauaaauaagaaauuagaggccaggcacgguggcuuauaccugucaucccagcauuuugggaggcugaagcaggaggaucaccugaggucagaaguucaagaccagccuggccaacauagugaaaccucaucucuauuaaaaauacaaaaauuagccggaugugguagugcacaccuguaauccuagccacucgagaggcugaggcacgggaauugcuugaacccaagagguggagguugcagugagccaagaucauaccacugcacuucagccugggugacagaguaagacucugucuccaauaaaaaaaaaagaaagaaauuggguccugauaugucaauaaauguaaguauuaaguauguuaacuaaugguggagaugcagauauuauuuaaauauuauaugacauuugcaguugaaagaacuagaagaagaaugggucaaacugccaacaagugcuccuagaccuacucgauuucuucguucccaacaagaacuagaagcuaaauuggaacaacaacagucugcugguggagaugcugaaggagguaagccaauuuuaaacaccgguuucugcaaaaauuagcaagaacuggcacugccaugagaaucuguguucauuaggcauauuuuguaggauugccuuuaauaaaauauaaguugcauguagcuuuaauaacucuggucccuucucuauuaaaauuucaucaggguugugaaaggacugauaacugauaaguaaaacaauucuaagcauuuuuaagguuuguguuguuuuucuccuuaaagguggugaugauggugaugaggugccacaaauagaugcuuaugagcuuuuagaagcuguagaaauccuuuccaaacuucccaaagacuuuuaugacaaaauuguaaguaauaguuaaacuucuuucauuuauuucuuguaaaauaauuacuugaauagaauuagaauacucugcugagcccuugccugaugcacccccuuccaucccauaucuucccuaguagagugaguuaguugcuucuuccucuuugcucccacacuacuuuguacauauauauauuauagcacuuuuuuaaaacaugucuugccauaaaaccagaacauucuugacuuccuuuuucuaauuuucucucugguuuuuaacacuaaagagcuccggauuccuccccuuucuccguuucuacugccacuacuuuaccccaagguuucuugaccuuagcacuguugacauuuuuugucagcuguccugugcauuguaugauguuuagcagcaucuuuggcuuuuauccacuagaugucaguaauaccaucucccuaagucaugacaaucaaaaaugucuugaaacauugccggaaguucccuaggagacaaaaucauccccaguugagaaacacagucuuaucccaaccaccacuguaguaguggguuguugguuaugugauuguucuuuucuggucuuuuuaauguugucaguguagaaauuccucuccuguaauugugcugcugugagaugggugggcuagaaaugcuuucuauuaauguuuucuguuugacaucugcuuacuaacguuugccuagaaaaugagaaugaaacgucuauggcauuguuuguuuauuauauuacuuuaguuauaacaucuuaugaaaauacuuuuuauauaugaacaaaaauuuauauauaugaacaaaauguucugauugccuccacaguuuuauuuuuuauuauuauuacuauuuuuuugagacggagucucgcucugucgcccaggcuagagugcaguggcgcgaucuuggcucacugcaagcuccgccucccggguucaugccauucuccugccucagccucccgaguagcugggacugcaggugccugccaccacgcccggcuaauuuuuuguauuuuuaguagagacaggguuucaccuuguuagucaggauggucucgaucuccugaccucaugaucugcccuccucggccucccaaagugcugggauuacaggcgugagccacugcgcccggccaguuuuauaauuuuuuaaaaaaauuauguaucuuugaauuagcagagugcaauaaauagacuuuuauuccgcucucuuauuuccuguuacaaaugacucauauuguaucuugcaggaggcaaaaaaauggcaagagagaaaagaggcccuggagucuguagaaguacuaauaaaaaaccccaaacuggaagcuggcgauuaugcagauuuaguaaaagcauuaaagaagguaaauaugaggacuugcaguacugguauuguaacagccaucaggccuuugaauuucucaucagucaucuuuuuaauuacacauacauugccacuuaaggaacauuacugaugguauuugaauuacagacauacauuuuuaaaggguuguuuuaaauuccuguuguggguuaguuucauuuucaaucuuuguuuuuugucacuuugacuuuagguaugcuauuugauagcuucuguaacucucuaggaaaagagaguugcugaucuagaacuacauuuuccaguuuuauaauucuauaggaugagcuauuuaaguuagcuguauuuaauuggacaaauauuaaacaugaagauagcaaaugauaacacacuacuuuguaucaguauguaaagaguauacgaauaugaggucaguucugaaacagacaaguacuaaguaagagauaaacauuuuuaggaaauaaucuuuugguauugcaaguugaaugcugcugguggacauuuuguauguaguaacuuuuuaugaaaacuguaaguauagaucaaacacuguggauaugauuauagugcuuaagaacaaacucugaaaacaucuucaugaauauagcaagaaugaaaauuuuguuuuguuugcuuccucagucugaaauuacagaggauuacaauggugaggggaggaaguugauuuuuaauuauacgcacaccuaagucauuacuuguaguaguuauauucuguaaagccacugcgaacacuaaauuagugaauauugaaucauugcuucuaagagaaauacaggguuaggauccugcaacccuuuggucacaacauuuccaucaaucaguacauaacuuuguuuuauucuguuuggagauagcauauuuaauauauguuguugauucauuaacauugaacucuuggccgacaacacuguaacucuugccugauugaagcuuuuccuaacgcauauauuuucucccuaagguacaucacagccuguuugcacuuaggaauacuagacagcauuucagcacuacacuuaggggccauuuuaaacaacaagagcaccaacaaaaaacacaaaaaugcaaaaacauggcacugaauaaaccaugaaaaagacacuuguuuauaguguaaaagcuaaagcaagaagguagaguguuaucuugucuaccucagcugggaaugugcacaauagacaacacaaaauguucacagcucugaacuugucuguaaaugaccaggaaaguaccaugaguguugauuuggggauuauaagcaaguuuuagcaaguaggugaauuugcaaauauggauucgugaaugaugaggaucaacuauauucuaguaguuaaccuuccuaggcuuuccuucagugggacuuggaggcagagauaugauuugugaaaucuuuguucagucaucaauuuuccaucuugaagaguuacacucguguaaaauaaauuaaaagagaguugcccuaggggaaaaagaguuuuaccaaccuggaaccugggaggaaagaaugggaaggggaauaguagagggcacugagacaaggaaagucagguuccaguggcauaugaagagagcuacagauucucugucaauucuuccagcauuugguuauuaauuagaaaucuuauugcucuggugcugaauucucgaugugucaaagaaaaccuuuucuuuuuccuuaucauuaauauuauguguuuucuacauguauuuucuaaggauauuagcuucucacacaaagacaguucugugguuuccauuggcauugugaauguaaauauaaucucuugcuguacuauauaaagagagagcaucauggauuuuauauuugaguagacagacaauagauuucugagagaucuaggguagcaguagaaacuucuuucccuuuucacguggugggguggagggaaucagagaccacaaacaaguaaaaagaaacugaauuuuguggcuaaaauauuuaaaacaaugaaaaguuaacuucaguuguaaaaauuaaccugaaacgacauuuucuuuucuuuuugccuuaaguagugacagagacauuuuauuuuuuuuauuuucuuuuuugagauggaguuucguuauuguugcccaggcuggagugcaguggcacgaucucggcucacugcaaccucugccucccguguucaagugauucuucugccucagccucccaaauagcugggauuuauaggcacuugccaucacacccagcuaauuuuuguguuuuuaguagagacgggguuucaccauguuggccaggcuagucucgaacuccugaccucaggugaucuacccuccuuggccucccaaagugcugggauuacaggcaugagccacggugcccagcugacauuuuauuuuuuguauuugauuuuaguuauauguacacacaaacuuuguauuauguugacuuccuagaaacauaacaaaaguggggaaauggugaaauggaaaaaaguggggaaauggugaaauggaaaaaagaggaugagauugaagaauagauuacagaccaauccuuuuucccuccuuauaauuaucucuucuuuguauuguauaaaucaaguaaucccauuaauuucucaauuuuuuuccuuuaaugaaaguaguaaaaaggcauuaacuuuaaaauuucuuaugauauuccugaaauuauuuuuaaacuguuuugaguugucaccugauuuagcauauucugugggcuuuccuguucucacagauuauaguucuuuuuuuucuauuauuuuuaauugauguauuuauuuuugagacagaguugcgcuuugucacccaggcuggagugcaguggcacgaucucagcucacugcaaccuccaucucccgaguucaagcgauucuccugccucagccgccugaguagcugggauuacaggcgcgugccaccaugcccggcuaauuuuuuuuuuuuuuaauuuuuaguagagacaggguuucaucauguuggucuugaacuccuguccucaagugauuugccugccucagccucugaaagugcugggauuacaggcgugagccacugcgccuggccuauaguucuuuuauuuauaagaugccucccucccagcucaucgcuucuuugauuuugucaugugccuaugccuauggacauuugauuuuuuauauauauauaauuuauuuaucuuuacauuaagauuuggauuuucgaagugcuuucuuauauaaucuuuagacuucuaugugguauuaaucuuuuuucacuuguucuuucuacuuuuccccccuuaauuauugcuuguuuucaucauaguuuucuaaacacaguaauucauaauggguuucauuaauuuguuuccuuuccucugucaacggugugcuuuaguuauuauuaacuaguggcuuuaauuucuaguuaaagauaaauaccaauugauaauuacuuuaaagcacuuuguuuuaauacuguaggccucaauuuaugagaaaagugacagcacuuaaaacuguacaagauuuccuauuguuuaaauuauauugagauuaugagcuaaagcuuccauucccuggucuagaacagaaauuacugaaaagacagaagucauuguuuuucuuaccucugaaauggaguccccccucauauguuacuuuucuuaaaaauaaacacuucuccaucuucccuacucucauuucccuguugagaauaacuuguuuaugggaauaaacaaugagugucaaugagugugacaggcagguauuauauuaggguaucugguccauugcucacuuauaaguuuauuugagccuuugcaaucuugaaauuuaacagauucgcaguaucuucuucaauacuauacaauaagaucaugagugucuagagucuagcucccacugguuacuguuccaacaauggauagggagagguauucuccuaagaaaggaauagaaugauaguuuuuuaacugagcccauaugacaaaaucacccuuugagccauuuaaaaauacugauguccaaauuucaucccagauucauugaacuagaauuuguuggaaugggaucuuacauguuuuugauguccauuccuagaauauauauuuagaugcuaaauauaaagccuagcaucuaaaucauaucugagagguauuuugauaaggaaaaauaaucagaacauuuauaaauaccaauagugauuucaauacagaaaugaauggaaaauuuuuuucuucauagacuuacaguaauuagagauuuaacaaaauguuuauuaggacccugaucucauccucucguaaggaaaagugaacuuaacacaaguugagagggagaacaugcuuuacuuaauaaaaggagcaaaaacuuuggagucagaauugaccuggguuugaaucacacagcauuaccauuugcuaacuaccugacuguaagcacauuaaucuuuauuuaauuuuuagaaucuggcuggguacaguaggucacaucuguaaucccaacacuuugggaggccgaggcgggcugauugcuugagcccaguaguuuaagaccagacugggcaacaugaagaaacucuguuucuacaaaaaauagaaacauuagcaggugugguagcaugugccuuuagucccagccagucgggaggcugaggugggaagaucgcuugaaccugggagggggagguugcggugagcugagaucaagccagacucugucucaaaaaaaaaaucuuuuugaagucugcacuuuuuuguuguuuuuuuguuucugagauagugucucgcucugucacccaagcuggagugcagugguaugaucuuggcucacugcaaccuccgccucccagguucaagagauucuccuaccucagccuccugaguaccugggacuacaggcgcaugccaccaugccuggcuaauuuuucuauuuuugguagagacaggguuucgcuauguugcccagguuggucuugaacuccugggcucaagcgauccucccaccucaaccucuuaagguccugagguuacaagcgugaaccaccaugccuggcugugaaucugcaaaguugaaauaauaauaguccuuaccucauaggguuugggugaaaauuaaacuuaaaaaggauuauaaagugccuacaaaauuuuggugccuaauuuguuuuuucaauaaauguuaguuucuuuauccuuauuccucagcacuuaaggagugcauauaagugccaaguagaacuucuuucauguugcauguuaggaguuguuuaaugcagagaaucuagaauaaagcauucugcuuauggaacaccacauuguagggacuagauaaaauucaaaguagacuggaggcauuacucuuacugggaaaagagugaaaaaagaagaguugggggcauuuaaaaauaaagcagccgugugugugugugcauuuauaaauaaagcagccgugugugugugugugugugugugugugugucugucugucugucugucugucugucuugcucugguacccaggcuggagugcaguggugcgaucugcacucacugcaaccucugccucccagauucaagugauccuuuugccucagccucccaaguagcugggacuacaggcacacgucacacugccuguauuauuauauaauaaagcagcuuuuuaacaccaacugauugggcaguguaccacaguaaaaucuuaccaggaaggaacccagucguagucaguaucuuguuaaauugacacagaugcagcuacuacccgugaguuuagauaagugcugggcuuuguggguuguggcauaggagggcaguaauauaagcagugcuagaggagaaucgacugagacucugaauugaagcuuaaccauuauuagaugacugaaguggcagccucaaggccagaagcucccucagaagaaugguucucagaagaaugcaguagcauucacaauuuagaguccccauggacuuccugaagguaccugcagccguuuguacuggugcuucuugguuaugaauauuagagcuguugcccugugaugucuuucagagauacauugccuuuucauuuuccuugucccaaagcaaagucagcagaccucucgucucucugccauuaucagggucauuuccugcacaguugaacagugcugacagcccagacugccacuacuggauagugagcaauuugauguugugguuuuaucuauguuuuauuaguagaacuuuaagauagaagacuaaacauaaugaagggaagcucccaaauucgauacaaugaaagaagaauuucuccucuguuguaguaaauaaaauuggucauauauuagcauaagagcuuucagaguucuuuuuuuuuuuugagauggagucuugcugcguugcccaggcuggagugcaauggugcaaucucggcucacugcagccuccgccucccagguucaagugauucuccugccucagccuuccaaauagcugggauuacaggugccugccaccaugccugcuuaauuuuuguauuuuuaguagagacagggucucaccauguuggucaggcugaucucaaacuccugaccucaggugguccacccaccuuggccucccaaagugcugggauuacaggugugagccgcugcacccggccucagaguucuuuugagaauaaaauuucaauacccuucuacauggcugugacuauuuuguuuuccuuuuuaccccccuuuguagguuguuggaaaggacaccaaugucauguugguggcuuuggcagcaaaaugucuuacuggccuggcuguugggcuaaggaagaaauuuggacaauaugcaggacauguaaguaacacuccuuuuuagauacagaucaacaaaauuuaucaaaaaugguaggccuaguuugcuguuugcuuuaaaacaacuccuuggcauagauguguauauacuguacaaaguaaauuucucucuguuuuguuaauauucagcauagauauaucuuagaaauuucaguagaugucaguuguaacaaaauuuauaggccuuauguagaaagucaggcacuaggccuaaaguacuuaguugaguuuauuuauuugcuuauuacuuauuuacuuacuaguaucuugcuuuguucuuacaacauuauacacaucauaacaagaugaaacaaaacuuguaacgaccaggaccagaaugaaaaugagagucggaaaggcaauguaaaacuauaaauguaaaacugugagguuaauauauaaaauguguuuuacauuguuuuccuauuuuaauauauaauuuacuuacauauuugagacauuuuauauagguuacaauguuauauauuuuauauagguuaucuccguuuuacuuauucaaagaaaaucugacuggagacauuuguugacuuacuauuuguauaaguuuguuuccaaucaaauuugguaauaauuuuaauuaagauguuuucuuuaacuguggcaucuguccuuuggccucuaaauccggucugcauuacuaagaauggcucagcauccuaaaaauugaccuuauugaucuuuagaguuuagcuugcuagccccuucaucauuugauucccuagacugacuuaggaguuuccuaauagucccuagucauguguccauuuuauauugugaagcuaauaccuagccucacaugagcuaugguauuuggagcuugcuuacucauagcauuaaaaauaaucucagagaacuuaacugaagaaaaagaagacacuaccaaauaaaaauaaaucaugacuggcuuauuacuagggaaauaaaaauaagggucuguaaaacccuuagacauauacaucauaaauugaaauaaaauuaaaaucuauuuuuauagcaaucaauauuauauaauaucgauguguauaugccauuuugaucaauuuuauauuacuuaggauauuuuacacuuuuauauugggaauaauuuuucaagauaaaaaacaauuuuuuccuacaccacuuaaauaucaguucagagaauaauuuuaguuuuuuuuuuuugagacagggucucacuuugucacccaggcuggagugcaguggcaccaucucaguucacugcagccuuaaccuccuaggcgcaggugauccucccaccucagucuccugaguagcugggacuucaggcacaccccacaccaugcuugaguacuuuuuguauuuuugguagagaugggguuuugccaccuugcccaggcuggucucgaaauccugagcucaagcuaucugccugccucagccucccaaagugcugggauuacaggcuugagccaccacacccggccuaaaauucauuuuaauuuaccaaauuaugguuggauaauuaacuggcuuuccaguuugaguucugauucuggcuuuguuucaguuuguuguccugguuaaagaaugucucuauugcucuguaguuuggggucucccccaccuuaauacuguaauauaugcgguguuuaguaucaagcauguuacugacuuggcuuuauuuucuuuaaauguuuacaaacuuuuuggcaauauuuauaaaagugaauguuagcuuuauagacauuaaaauaucuugauuuucaaguuuauaacuaguauuaaaaagucuuguauuuuuccaugggaaccauaguccuugaacuauaccaaguagucuauaaccacuucugugaaaucuugaaaacaauuauuucuuguuuuuggaugccauugagcuuugcuguguccuuuggaccuuagaaauuuucuuccccagccugggcaacauggagaaacccccgucucgacaaaaaauaaaauaaaaaauuauauuuacagggaaauggucaagaaauuaagaauuaaaaaaaaaaauagcagguguggugacauauaccugaggccuaccuacucgggaggcugagaugagaggauuacuugagcccaggaggccgaggcuucagugagccauguucaucccacugcacucccacgugggugacagagcagaggcggcaaauagguugagaagcacugccauagugggagagaaugagaauucuucauuguuccggcauaagauacgauguccuucaugaaaggaaaugacuuuuuauuccacuuaaauguuugcuuuauugguuuguuuugguggagacaaggugguuuuuuagaaaguaaguuuuauugagauaaaacuugcauacuauaaaauuuacccucuuaaagugauuuuagaauauucacaauguuacauaaccaucagcacuaucuaauuccagaacaucuucaucaccccaaaaagaaaccccuugcccauuaacagucucuccccaugcugcucccugcccuugacucuagcaaccacuaaucuacuuuuuugucucuggauuuaacauuucauguaaauggagucauacaauacauggucuuugugacugcuuuuuuuuuuuuuuuggaagacagggucuugcuguguugcccaggcuacaauacagugaugcagucguagcucacugcagcuuugaccuccuggguucaaguaauccucccaccucagccucccaaguagcugggaucauaggcacauaccaccacaccuggcuaauuuuuuuuuguuuguuuuaguagagacaagaucucacucuguugcccaggcuggucuugaacuccuugccucaagcaacccaccugccucagccucccaaagugcugggauuacaggcaugagucacugugcccagccugugacuggcuuuuuuuuuaacuuagcauacuauuuuuaagguucagccauguucuaggauauaucaauauaucauuccucuuuguugcugaauaaugugcuagccauucacuuuuacagguugugccaaccaucuuggagaaauucaaagagaagaaaccucaagugguacaagcccugcaggaggcaauugaugcaaucuuccuuacuguaaguugacagcaugaguuuguaguuuuaucugaaguaaaguuuguaaauauaauauuuugauuguucuuuacaauugaaaaaagcucauuaaccacauuuucuuucuaaagaccacacuacagaacaucagugaggauguuuuagcaguaauggauaauaaaaauccaaccaucaagcagcagacaucucuuuuuauugcaagaaguuuccgccacugcacugcuucuacccugccaaagagcuugcuaaagcccuuuugugcugcacuacuuaagguacagacucucuuugaaguugggggaauauuuuauaccuaggcaagauucuuuuccugcaaauuauguacagugacuacuugacuuucagacuauagagguuaugaucuuuugaggagcagagccuuugcagcuuggaaacugaauccaaauucuccuguguuccucuucuugaaagaaagcacaaguuaguguuaugauuccauuaacuguuaaacauguuguuucuuacuugucccauauacugguguucagcugaaucuggccaagcauaggcaucaaauguggaguauuugaagaucauuugggagugaguuauuuuagauagaggguaagaggaaaaggaaauacuuauuugcuaaauggauuaccaaggguuuccuuaacccgaaaaauuuuuguuuuuuuuuuuuuguuguuguuguuuuuguuuuguuugagauggaguuuagcucuguugcccaggcuggagugcagugacacaaucuuggcucacugcagccucugccuccuaggcucaagcaauucuccugccucagccuccugaguagcugggauuauaggcaugugccaccacgcccggcuaguuuuuguauuuuaguagagaugggguuucaccauguuugccagacuggucucgaacuuggccucccaaagugcugggauuacaggcaugaaccacugugccuggcccaaaaagaauuuuugaaagaguaacugucaauuggcacaaggaaagcuauacuuaguuccaguaaauuguaaaaagcaaauucuuuaucuagcaaccaucagucugaauuaaaaugaguaaugccuaaaauaccuugcauuaauaucauuuugcuuacuucuggacuauagcacaucaaugauucugcuccugaagucagagaugccgcauuugaagcauuggguacugcuuugaaggugguuggcgagaaagcaguaaacccauuccuagcugauguggacaaacucaagcuugauaagguagguuaguaauggauuggacugaaauuggacaacauuccugucucuuugcaucauggcuuugucucuugacaguuauagaguacugguaguuuugaugaggaguucuugauuuuuuuuaaauugccauuuauaguaggaaagaaaugcauaauugaaacaaguuuuggaggaugcucucugguacuuuuugucuucaauuuugucuguuguuuuauuaagaaaaaaaugcugauaucaccucaggaaauuuauuucauccuccacugauaguucagaccgaguuugaaaacuuagcuuuugagaauuuaaguuucauuccaggcuaugauggugauaauuguagaaauagcuuucaaauuauaaccgaaaaaaagcugagugaccaaucuguagagaaggugaaaacaguucugugagauaaauuuauuucuaagguccagaaaauuaccuucuuauaugugaaugucuuccauaaacaauguggucauuuuaaguuuauuacaauucuaauuuguaaagaaauaaaauguaagauuaauaucuuacguaugucuaucuacugccaaaaaaguguagauaauuuaucuuuuuuguugaaagggaaauuuuuucucugaaaauuuuuuuuuuuuuuuuuuuuuuuuggcaaugaaucucacucugucacccaggcuggagugcaguggcacaaucucagcuuacugcaaccucugccuucugaguucaaaugauuuucgugccucagccucccaaguagcugggauuacaggcgccugccaccacgcccggcuaaacuuuuuuauuuuuaguagagaugggguuucaccauguuggccaggcuggucucaaaccucugaccucaagugauccacccaucucggccuuccaaagugcuaggauuauaggugugagccaccuugccuggccauuucucugaauucuuauguguaguugugguuuagaaauguaauaacguagugguuguguuucaaaguugggcuuaaugauguucaucucacuuucauucuccagaucaaagaauguucagaaaagguagaacugauacaugguaagaaagcuggacuagcugcugauaagaaggaauucaaaccucugccuggaaggacugcugcuucaggggcugcaggagauaaggacacaaaggacauuucugcacccaaaccaggaccucuaaaaaaggcaccugcugcuaagguuaauagauuauuuaaaaauagaaguuaguaaggaagggucugagucucagguucgugguuguuccucuaaaauuauuuuguuugagaaaugaauucauuggccacauuaaaaauacagcagaaaaucuguuaaugaagauaggauauuccagcaauaaauucagcuguuuggagcuuuaauagagauaaaaauggugaugaaggcacagaaguguguuuugucaauuuaacauaaaauuuacuaucuuaacuuuuuuuuuuuuugagauggagucucgcucuguugcccaggcuggagugcagugaugcaaucuuggcucacugcaaccuccgccucccagguucaagugauccuccugccuuagccccccaguagcuggaauuacaggcacgugccaccaugccaggcuaauuuuuguauuuuuaguagagaugggaauuugccauguuggccagguuggucuugaacuccugaccucaggugauccacccgccuugaccucccaaagugcugagauuacaggcgugagccaccgugccuggucugucuuaacuuuuuaaugugcaguucauuaauauuaaguauguuuauaauguugugcagcaucaccacaauccauugccguaaugcuuuucauguuuuaacacugaaacucuaugaaucaauuaacuauccucccauucucagcuucuuccagccccuucuuucuguuucuaugaauuugacuacuuuguuuuuauuuucuauauuuuuuagagacaaggucuugcucuguuguccaagcuggagggcaguggugcgauuauagcucacugcaaccuggaacucccaggcucaagugauccuccucacucagccucccaaguagcuaggaugacagggacuugccaccauacccagcuuauuuuuaaaaauuuuuuauagagggccucgcuguguugcccaagcuagucuugaacuccuggccucaagugauccuccugccuuggccucccaaagugcugagguuacaggcaugagccaccaagccuggccuugagcaucuuuucaugugcagguggcaaucuguaguuguauaguucuucuuggaaaaaaauaucuacucaaguucuuugcccauuuuugaauuggguuguuuugaggcaaggucucacucuguuccccaggcuggagugcaauggcacaaucacagcauaccucccaggcucaagcaauccucccaccucagccuuuugaguagcugggaccagaagcacgugccaccacacacagcugauuuuuuauuuuuuaauauuuuuguagagacggguuucacuguguugcccaggcaggucucaaacuccuaggcucaaugaauccuccugccuccgccucccaaauuccugggaucacaaaccugagccacugcccccaggcuuaugaugcuuuugcccucuauuuuguucuaaagauuuuauaguuuuaggucuuacauuuaugucuuuauuuugacuuuauuuuuauauacgguguccaacuucauucuuuuugcauguggauauucaguuuucccagcaccauuuguugaauagacuguccuuuccccauuaaaccgccuugguacccuugucaaaaaucauuuuacugcauaugcaagggaggaguauuuuuuuuuuguuuuuucugagguggagucuugcacugucacccaggcuggagugcaguggcacaaucucggcucacugcaaccuccacccccuagguucaagccuccucaagcgauucucagccuccugaguagcuggguuuacaggcaccugccaccaugcccagcuaauuuuuucuauuuuuaguagagaugggguuuugccguguuggccaagcuggucucgaacuccugaccucaguugauccgccugccucagccccucaaagugcuggaauuacaggcaugagccacugcgcccagccaggaggaguauauuuuaaaggaucagaaaguaucauuaaauaaugaaauaaaauguggcaacacacuuaacauuaauaacuaauaauaccaauuggucauuuuacugauaaugccgauggaucacaucacugagucuucaugccaguccagguguuuacaccuuuguacaguguagaaguggggcaaaugccuaguggcaauuacggcauucuuuuaaugagcauguguccuguggacucucuuaagagugagaguuaucugcugcagaugcaaaaaguuuaacucuccuuccccacgccagccccaucuugaaccacucagcauggaguuaggggaagagaacugauauuuagugagcaucauuuuaugaaacacuuugccuuuauaaugucauuuaaucacuguaacaacucuugagguagguauucauuauccuuguuuuuccaaaaaaugaaacuaagacucagggaguuuguguccuacacaugcucugauauuuuuauuguugauuugauuguuuuguuuacuguauccccacaccauauuguaagcuuuuaaaggauagagaucuugucacugcuugauccuccaugcauagaauaguuucuggcguauaguagaaaccggguaucuguuuguggaauguguagaguggcagagcugggauuuacccugaguaccucuaguuacagacucuacuuucuuucacauuaugcugucuccuuggcauucuagaacaggaaaucggcagcuauuuucuccuuucucacuaguuccuguuucucuggacaauuaccuggacccaaaaccuuaaaagauguguccagauuuucuugcuguaacccacuugccucuuaccucuuuaaacccuuccauguucaugcuggcugaccuucucuuauuaugaggaauuaucuuaaaaauuaaaaugcugggagcaaccuccuucuauucccauucugaaaaagauaaguaggacaauaucagcagcacgugagccacugagccagcuaucauguagaaugauaauucugucuuuuuuguuugguugguuuuguuguuguuguuguuguuuuuguuuuuuuuugagacagagucuccuuuuaucccccaagcuggagugcgguggcacgauuucaucucacugcaaccucugccucccugguucaagugauucuccugccucagccucccgaguagcuaggauuaaaggcaccugccaccacgccuggcuaauuuuuguauuuuuaguagagaugagauuucaccaugucguccagccuggucucaaacuccugaccucaaauuaucugccugccucagacucccaaagugcuggaauuacaggcaugagccaccaugcccagccucgauaaaucugucaauuaauaaauaaaaauugaugucuguuaacaacaacaaaaagaauaguagauuuguuauuugaaguaucucuccauauagagaaugcuauuacagagaaagauccagaagagguauccuaguuaaucaaagaguacagaauuuuccauuuuuaggguuagaaugcaaauccuuuuaugggguuauuacugugaaccagcaaaaccauacugucgauaugacaugguaaguauuacagguuuccauuuaguuaaaaacuaguauccuuaguuuugcuaaauacaacuuacaauauuggaauauauucaagauaacauuaguuucagaacaggucuggauguugaagacuaauuugauccccuuucauuuuaucuuuucuuuuuagguuuggggcauuucauaacaaauauccaaaauagguacaaggaacaaugugaauggugauguguguugccauaauacaguuaucauuugcuguguacauuguaauauacuacuuucuugugacuuuuucccccguacauauucugcuuuuguaucuugggacuuuugaaaacuggaguggaaugaauuuauuuauuuugagacagggucucacucugccacccaagccagaguauagugacaugaucauggcucacugcagacucaacuuccugggcucaagcagcccucccaccucagccucccaaguagcugagacuauaggcauacaccaacacaccuggcuaauuuuuuuguauuuuuuguagagaugggguuuugccauacugcccaggcuggucucaaacugcugggcucaagggauccuuagccucccagagugcugggauuacaggugugaacuacugugcucagcuacuugggaagcugagaugggagggcugcuugagaugggaggcucgcuuaagcccaggaggucaaggcuauagugagccgugaucaggccacugcacuccagucuggaugacagagcaagacccugucucagaaaacaaaaaaaaaaaaaaacccaaauaaauguaaaaaaaauaaagguaucaggaugucauucucaaauuaauuuguaaauguaguauaauuucaggccaucacuucuguuucauuuaucucauuaauucuaaauucaaguuuuuaauauggggucuacagauuaccccauggguggucuucagggcuucugucugaccuugaaacugcuaaauuuuguagguacaaaaaauguuuauuuuaggguaaucccucauuuuaaucaaauuuuuaagggagugugugacucaauaaaaguuuaaaaaccacuguuuuaggccggguucagugauacaugcuuguaaucccagcacuuugggaggccaagacaggaggaucucuugcagccaggaauucgagaccagccugggcaacauggcaaaauccugucucuacaaaaaaaauuuuuuuuaauuagccaggcaugguagcacacgccuguggucccagcuacacaguaggcugaggugggaaggaagaucccuugagcccaggagguugaaccuguagcaagcugagcuugugcagcugcauuccaggcucgacaacaauaugagacacugucucaaaaaaaauaaaaauaaaaaacuccacuauuuuaaauccuuaggugguuuaauuuuuauuuuuuaaauuguuuuuaggcuggugggccaccaaaaaaggggaaaccagcugcaccaggaggcgcagggaauacuggaaccaagaacaagaaaggacuggagacuaaagaaauaguggagccugagcucucggucaguauuaacacacugagccugaaaaucaugaacccugcaaagugagaccaaugagaagacuggaguucuuugcuggguucuacaacguacaguuaauugauauuuuuuagcuuauugaaacugccuuggacaaucuccuuuaucaaaguauaauagaagccucagaaacuauagcauaccuaugggaguauucuuuuaguuuuggcuggaguauguuuacguucuugucaucuguucccuuaagcaauuccuaauucuaauauguuuuuguaucuuacagauagaaguaugugaagaaaaagcuucagcuguucuucccccuaccuguauacagcuucuugacagcaguaacuggaaagaaaggcuggcuuguauggaagaguuccagaagguagugcauagggaagaauugagugugaaagaaaauuagauuauauggaagcagcgaaauugaugaaugaaggauuuguccuaauugcuguguuuuauaaccggugaacacguuuuauggcauuaaagaugaggugggacuuuuuauuucuuguagcuguguaguguuugcuaucuuuaaacaucaguauucuauggccuuuauaagcucaugacuuaauacuuaagaaaauuagauucuuauucugaauuauaaggcuuagauuauuuuuuuauuuuuugagacggaaucuugcucuguugcccaggcuggaguacaguggggcgaucuuggcucacugcaagcuccaccugcuggguucacgccauucuccugccucagccuccuaaguagcugggacuacaggcgcccaccaccacacccggcuaauuuuuuggauuuuuaguagagaugggguuucaccauguuagccaggauggucuugaucuccugaccucgugauccgcccgccucagccucccaaagugcugggauuacaggcaugagccacugugcccagcccagcccagcuuagauuaauuuuuuaacuaugguacuugcucauaaacuuccuaggcaaauaggucacucuacuuaaaccaccccucauccaguacuuuuucuccccuuuaucaucaugauuccuugguagaauggacauuauccauugguaugaaaaccucucaaaaaccuguguuguaaaggagcauggcaguucauuuuggcauauaccgggugauucuaaugaggaacgguaaggagaaacacugcaagagcacugucacuuauggcagaagccgucuaguccugcgucugcugcccauuggguuuagaucugaguuugugcaucuuugauauucgguacuuuagaacuucaaaucuauucugcuuugcuguuuuuaggaaaaucaaggaagagaaaauacauauaagcaguuucugccacacacuaggcaaaugaaaacuauuauuuugcauggagcaaacuauuugugaauuccugaaaugugagauaaacguucagugauacuaauuuaacagccauauaccaagcaucuagcuuaagaaauaaagcauuauagacauaaaaacacaaagaaauaaagcauaacagcggaagcuauauaagcucccucaauaacccuccucaguucuauuccacuccuuucuucagagguaaccacuuacuugacuuugguauuuacucuuccuuuggaaguaaccuuuaacccuuaaacucuuauucucuuauuuuacuucaaggcuguugagcuaauggaccgaacugaaaugccaugccaggcauuagugaggaugcuagccaagaaaccuggauggaaagaaacuaauuuucagguauuuuaaaaugugagauuugaugucuuuuauugaaguaauuuacauuacaucauccuauggaguaauacagcagaauaguuuucguaaugauuuuuuuuuuuuugagacggaguuucgcucuuguugcccaggcuggagugcaauggcacgaccuuggcucaccacaaccuccaccuccuggguucaagcaauucuccugccucagccucccgaguagcugggauuacaggcacccgcuaccaugcccggcuaauuuuguauuuuuaguagagacgcgguuucucuauguuggucaggcuggucucgaacuccugaccucaggugauccgccugccuuggccucccaaaaugcugggauuacgggcgugagccaccgcgcccagcuugguaaugauuuuuaaugaacaauggggugugugcauuuugauugaacacauaacuacaguugacucuugaacaauguggugauuagggguacuaccccuugugcaguugaaacuucacauauaacucuggacuccccaagaacuuaacuacuaauagccuacuguugccagaagcccuacugauaacauagucaguuaacauauuuugaaugguacauguauuguauauuguauucuuacaauaaaguaagcuagagagaaaaugugauuaagaaaauccuaaggaagagaaaacauauuuacuauuuauuaaguggcaguggaucaucauaaaggucuucaauucccaucaucuucauguugaauaggcugaaggaggagaaagaguaagaaaagggguuugucuugcuguuucaggaguggcagaggcagaagaaaauucaugcauaaguggaucuucgcaguucaaacccauguuguucaagggucaacuguauaacuuuauauaauuaggaauuuauauguguauaaauauguaaauauguauacauccauauauaauuuguauaauuuagauauauacauuuuuuucuucucauuuuuaggccuagaagccuccuuauccaaucuuuacauauucaagggagaaauaaacagugagauagcuuuuuuauuugauaggauaaaaaauaagugcaguccuuaaauugccagugaaaauuuaccacauaaucaauuguauagccccauuaacugauaauagagcugaaauuuagcaguaccaaguuauuagucuaagggguggguauagagggaaguauaggaaagugcugcaggaaggaaaaugagaaaaaguuuccuucucuuuuucuagauguacauacaauagaccucaugcuaaacaaacuugaaauguaucagguuuauuauuggcauccugcuagucucuuuuugguuucucuucugcugccaccucuuguuuucugucuaggauguuuagcucccucauacacugugugucccuuacauuguguuacauagcaccuuauucguauaggccagcuccacaaaggcuaaauauucuaaaagauucuugaggugcccucuuccucucacaccaccuucuuuuuuuuugagaaagggcuucacucaguuguccaggcuggagugugguggugcaaacguggcucacugcaguguugacaccuuaggcuccagagauccucccacuucagccucccaaguagucgggaccacaggcgugcaucacuacaccuugcuaauuuuuuucucaaauucauagacaguaugaaguguaaucucauugugauuuugauuuucagccaccaaagacucucuccuugguuaacuuaaugaccagcuaaugacuggagagauuuucuuaaaugccuugaaccaaugugaucugucucccacccucugccaagggggaagguguguauguuugugugugugugcgcgcugggucaugccagagauacucaggcacuuuacagcuuuacccuggaauucacuuuuuaagcaaggucuugaaggucagucagagauuagggcccuuuucagucuuuccugggcauacacauaaccuugaauauucgcaugaccuucuagauucucaaaguccucuguggauaucuuauucccuagguccuuuuauguuuuugaccaagcuggguucccccagcugguauuauggacuuacacaguucugauguuagauguuaaacaguugccacucauuguuuucguuguuuucaacaaaaucccuggggauagggcuuuucccacugagcuagccagaguccagucaaauaacaggacuuucaaauggagcuuuucuaggaagcugccagacaagacaguacuuugggucaaaacuuuuugaggagguccaaaccugagcuguccccccaccugccaguggcugcacagcucuagguuuucauaguugccaugguuacaagacuucagguuuugaaggcuacuguggagcuggaagaaaaggggagcaaggcaaguuaaaucaccagaaaccucacuguccuuacuaaaauucagcauccuuucuuuaaaugguucuuguauguuacaagccuuauuuaauuuucagaguugugagauaaguugauuuggauaguuuuugccaguguucuuuguugcuuuugaggaagaucaguuuuucagagguauugacuccacaauugcagaagucccacccaagauaauuacauuucuuugguuuguuuuuugguuugggaauuuuuuuuuuaauuuuuuaaauuuuuauuuuuucacaugccugcuaugucaaauuuuggggguuugagacaaagucucacucucuugcccaggcuagauagugcaguggugucaacaugucucucugcagcuucagccuccuggguucaagugauccucccaccucagccucccaaguagcugggacuacaggcgagggccaccauacccaacuaauuuuuguacuuguuguagagcuggggucccuccauauugaccaggcuggucuugaacuccugggcucaagcauuccccucgacucaaccuaccaaagugcugggauuacaggcaugagccaggcgauaauugcauuuuaaaagaggauguuuguguggcugggcacaguggcucacgccuguaaucccagcacuuggagaggcugaggugagaucccacuugagauccacuugaggucaggagaucgagaccagcccggccaacauggugaaaccucaucucuacuaaaaauacaaaaaugagccaagcgugguggcgggcgccuguaaguaaucccagcuacuugcgaggcugaggcaugagaaucgcuugaacccaggaggcagagguugcaguaagcugauaucucaccacugcacuccagccugggugacagaacaagauucugucaaauaaauacauaaauaaaugggaguauuugucaccuaaauuaaucuguauaauaggauuucuaguggcguaacaaaaaaaguuaaaauauucacacaguacaaagaaaaauauuuaugagcaaagggguccuuaaucccauaggucugccaucacaauaauaucuuuaaauuauuuuccacagaucuuuuuauucuuauacuuaaaagccaacaaguucucuaaaaucucugaaguucuguguugcauguguguauaagaggguuguaguguuuuuguaggcagcccuaguaguaauucucaguuaugcagucaguauaguaauuuauuguguauuuuaggguguguauucaguacuaaaugcaaauaaucauaagaggaggaaaauuuaaaaaucagauuuuucaauuaauaaacuuucugugcaauauuacuuguuaguauuuuggaacacugaguagcuuuuuuucccucucuucacugucaguuaaguaauugguaacaauuaaaggauacaaauuauuuugcauauuuguuuaaaauccugauuuuacuuuaguuguguuuccagcugucccuaaccaugucauaucuguuacaugcuguuaauacaaguaaauaaauaaauguccuuggcuugcucuuagcuuuaugauacugauccuuguucaggugaugcaaaugaagcuucauauaguugcuuugauugcccagaagggaaauuuuuccaaaacgucagcucagguuguauuagauggccuuguggacaagauuggagaugugaaaugugggaacaaugcaaaagaagcuaugacagcaauagccgaagccuguauguuaccauggacugcugaacagguuagugacacagaagucuuauuccucuaguuuucccaauuuuuucccccaaacuuuaagcuuacuaauuaaacauuaguuuuuaucuucucaaguaaaaucuuuuuugauacugcauuuuuuuugagauggaguuucacucugucgcccaggcuggaaugcaauggugcaaucucggcucacugcaacccucccggguucaagugauucuccugcuucagccucccgcauagcugggauuacaggcaccugccaccacgccugccuaauuuuugaauuuuaauagagacaggauuucgccacguuggccaggcuugucucgaacuccugaccucaggugaucugccugccucggccucccaaagugcugggauuacaggugugagccaccaugcccggcccuuugauacugcauuuuuauuuuuaccuuaaaaaauacucuauugccuagugaugaaaauucaucuuagucaaaaauauucggucagacacagaggcucacaccugcaaucccagcacuuugggaggccgaggcaggaggaugacuugaggccaggaguuugagagcagccuggccaacauggugaaaucccgucucuaccaaaaauacaaaaauuagccaggcgugguggugcacaccuguaaugccagcuacuagggaggcugaggcaggagaaucacuugaaccugggagacagacguggcagugagccgagaucacgccacuguacuccagccugggcaacagagugagacugucucaaaacaaauaaacaaaaaauucuauagaaggugaaagcccacgagcuugaggcugcaaugauugaugauugugccacuguacuccugggugacagagcaagacccugucucuaaaaaaaaaaaaaaaacauuauaaugcagaguaauugcugcaaagcuauaaauaguccagaaugccuuuaguccuacuaucauuucaccucauuuucuuguguagguucacucuuguuccuaaggcauucuugcaguuguuuuagcgucagaaaacuaguuuaaugcacaucugccuuaaugucaugcuguauuucuauaagaaauacgagauaaaacacagaucugcuguuuuucccuuuucagguugugucaauggcuuucucacaaaagaaucccaaaaaucagucagaaacucugaauuggcuaucaaaugccauaaaagaauuugguuuuucuggguaagucagaacgaaaucaaguggaaaauaguuaaauguucugucagucucuaagucgugcuguuuauaauaauagcuauugcuguuuauuucugaagagugagagcuggauugucucauuuauauaaaagaaaauuaccuuuguucucaaaggucuauauuggcuuguguuccugcuuuuugauguucacugaaagaguucucuacguuauuuuuccuuaagcauuaauagcugucccacagaaaauccaguuccaagaauuucuagucaaauacauuaggaaauuucuguauauaauuacauuuguuuaaagaccuauaguaugccuuggcgaauuaacugcugucagaaauccugcaauagaagagcuuguuuaacuuuguuuaacccacuguucccaaacuuauuugcuuauagagcacgguuguuuauuuaaaacaaaacuuuauacaguuuacuuuaucccagguacuuuuaaaaagcacuuucuaaaucauaauucauuugauuuaaucaucauaacaacuaagcgagguauuauauuaucccuaucuuauagaugaggacuaaggcacagaaaguuuaaguaauuugggcccaucauaguuaggaaaguggcaaaaccaagauuuuaauccaggcauucugguuuggagaaagaaugauguagcugcuauacuauguuaccuuucucugugccaugcuacauuuugcaacaugccuguuaauaucuuguaaaaggguauuuugaguucuacugauugaaaaaacacuacucuagaaguuacucaaauaacaaagaacgguuuguuauguuauuaucugugguguucgcccauaguugaggguauuguuauaauuccucuuaauuguauagucuuugauauaacacacaucucuuggcaugucacuuauaaaagccauauauuuuccucuuuuuuguuaugaucuuucauuuauucauuuauuaaacaauuacauauuggccacuacaauguuccaauuguuuguuccaguccuucagaauacaucaugaacgaaauuaaauuucuguuucaugggaguuacauuugaguaaagaaagauagguaauaaacaguuaaaaauauauauauagagagagagagacagagacagagaggcaggcaggccgggcgcgguggcucaugcuuguaaucccagaacuuugggaggcugaggugugcagauuaccugaggucaggaguucgagaccagccugaccaacauggagaaacccugcuucuacuaaaaauacaaaauuagcuggguguggugguguacgccuguaaucccagcuacucaggaggcugaggcaggagaaucacuugcacccaggaggcagagguugcagugagccaagaucaugccauugcucuccagccucggcaacaagaacaaaacuccaucucaaaaaauauauaucuauuuuuuuuuacauauauauguuuauguaaagcaggaugaaggguuaaauggaauaaugugguauaguuuagaugguguuguuuucuauauaguaguugaagaguucuuccugaaaaaaugacauuugaguagagaccaggacaugagagagcaagcugugauaaucagagaggagcauucuagaccaagggaagagcaaaugccaaaagcucugugguaggaguacaugugauguauuuaaaauagcaaggagugucuuuucuucagaauguagcuguaggacaaugagugaguggguaggaagugguaggagauaaagcuagagaaagaauaggggcuaggucauguggggccucaacauuuugaauaaguugggaaggcauuaggggcuuuugagaagaguaacagguucauauucugacuguugucagagaagacagagaggagaucaaagacaggaagacgaauuaguaggcuauuggaauaauccugucgagaaauucugguggcuuggacauagauuguagaaguggaaguguuauaacugauaagauauuuaaaaaguagaauagaacaagagagagacaagucagggauaacuucaaaaagucaaggauagccugaauaacuggaagaacaauguggcucuuuacugagguguagaagacucugggaggaacagguuuugggacuggagugaggacaaucaggaguuugguuucaguauauuagauguaggcugucuuccaggcauacaaauggaaauaucacaaaggcagcuggaugaugugaaucuggaguucaggagagaguucaagauuggauuuaggaguuguaauuaagcauaauaggauugucagccuauagauaguauuuaaagcucacuuuaaaguuaguguaggaggcugggugugguagcucaugccuguaaucccagcacuuugggaggcugaggcaggcagaucacuugagguaaggagugcgagaccagccuggccaacauggugaaacccugucucuacuaaaaacaaacaaacaaaaaaaauuagcugggcaugguguuacacaccuguaaucucagcuacucaggaggcugaggcaugagaaucgcuugaaccagagaggcagagguugcagugagcuaucauguacuguacuguagccuaggugacagagcaagacucugucucaaauaaauaaaauaaaauaaaguuaguguaggaagagaaaaagugagaacuuugccaaagggagccaguccuagagucuggcuuuauaaaacguuauugaguauuuugaggguuucauuuguuugcuuuuaauucuaaauguuucuucuagguugaaugucaaagcuuucauuagcaaugugaagacagcucuugcugcaacaaacccagugaguacauaacaacauauauagggcaguauugccaucuuuguggauuuaaaaaguuauuauugccaucuuugugauuuaaaaaguuauuuuucuucugucuggcaggcugugaggacugcugccauaacccugcuuggcgugauguaucuguauguuggucccucuuugcgaauguucuuugaggaugagaagccugcccuccuaucccagauagaugcagaauuugagaagguagaauuuccacaaaugauacaaucuguuaguggacuugagaaucucauuaagacuaaacuguuggguguaguggugcacgccuguagucccagcuacucaggagccugaggaaggaggauugcuuaagugcagauguuuugggcuguagugugcuaugccaguuggguguccacacuaaguucagcauuaguauugugaccucccaggagcugagaccaccaguugcccaaggagagguaaacuggcccagaucagaaacagagcaggucggccaggugcagugguucaugccuguaauuccagcacuuugggaggccaaggcaggaggacccccugagcccaggaguuuaagaccagccugggcaacaaaaugagaccuucucuacaaaaaaauaaucaaaaaauuagccaggcauaguggcacaugccuguggucccagcuacacaggaggccaaggugggaggaucaccugagccuaggagguugaggcuccagugagccauguuuguaccacuguacucaagccuaggccacacagagagaccuuuucucaaaagaaaaaaaaagaaagaaagaaacagagcaggucaaaacuccagugcagaucaguagugggaucacaacuaugaauagccacugcacuccagccugggcaacauacugagacucugucuuucuggaaugaagaauauguauguauuugcuuuuaugcacaauaaaguauccauggaagaguucauaagaaauugaugauuuuggccgggcuugguggcucacgccuguaaucccaucacuuugggaggccaaggcgggcagaucacuugaggucaggaguuugagaccagccuggccaacauggcaaaacuccaucucuacuaaaaauacaaaagucagccgagugugguagcacgcccuggaaucccagcuacuuaggaggcugaggcauaagaaucacuucaacccgggaggcauagguugcagugaaccaagaucaugccacugcacuccagccugggugacagagcaagauucugucucaaaaagaaaaaaaaaaauuuuuauguuuuguuuguuuuguuuuuggguuguuuuguuuguuuguuuguuuugagguggaguuucacucuuguugcccaggcuggaguacaauggcgcuuccugggcuuauuccaaccuccaccuuccagguucaagcaauucuccugccucagccuccucagcugggaagcugggauuacacgcacgugccaccaugccaggcuaauuuuuguauuuuuaguauagacgagguuucaccguaucagccaggcuggucuugaacuccugaccucagaugauccacccgccuuggccucccaaaguacugggauuauaagugugagccaccacacccugccuucuaguagguuuuguauaaaaauaccuuuugacauauggucucaaaauuguaaucuagguaguagucaaauuaccuacuguguaaauagguauuacaaaggaaugagaguuugacacaggcacccucucuaauuuguuuguucccauauccuauauaaauuucauuagccuuacucauucauuuguguauagaugcagggacaaaguccaccugcuccaaccagaggaauuuccaagcauagcacaagugguacagaugaaggagaagauggagaugaaccagaugacgggagcaaugaugucguugaucuuuugccgaggacggagaucagguagguuccagucugugaaaugguuuauuucauucauuguauugaauucagaauguugucuucuuuuugaauucagugaggggaacuuaacgugauaucaucauuuuuuuggagucuggaauuaaagguuauuuucuguuuuucagugauaaaaucacuucagaguugguaucuaagauuggugauaagaauuggaagauuaggaaagaaggccuagaugaaguggcagguauuauuaaugacgcaaaauuuauccaaccgaauauaggugaacuuccaacugccuugaagggucgacucaaugauucaaauaaaaucuugguauguagagcauacggcuguucuuuuuaucuccccuccccacugcugcaggaguuaccuuuucaguguagccuucacuugcaaaaaauaagugguuacuuuauuugcuuugaacuagaaauagcugccuuuaauuuauuaaguguaucucaagauaugaugguaguuggcagauuuauucaucaaauuuuuaugagucucagaauuugcuuuuugcaggaauccaauauugaauauauuuguauaaaacugcuuguaauacauguaaacauaaugauuucugauuuuuaaauguggauuuuuaugucaggauuuccuuaaacuagguuuuaccuuaaaguuguaaaguacuaugaucucuggucuaaaauucugauaaucuaguuuuacgaacugaugauaaaaaggccacugccuaaaaauuaauuagaauaaucuaagucgaauagcaugacaagccagugucucugucucuugaguaggccaaaaaucuccugcuguauugacaguauagcagcaaauuuacggaaguuugcacacaacuugcuuaucguuucaacauaaaguauuggcucuuuccacucagguacagcaaacgcugaauauccugcaacaacuggcaguagccaugggcccaaauauuaagcaacauguaaaaaauuuaggcaucccuaucaucacaguccuuggagacagcaagguaaaccuaacucuuuucaccaugccuccauucuggaauaggccagccauauuuuuggguuaaagauaauucucuuuuuagagucauguaaagaccugauaaacuuuauaaagaugaaaauauuagaagaaaaacaguaaacauuuuuaucuuccaggcaguauuaaggugaccagguaucacuuauuaguuuugugacuuuuagauaagcuaucuuuguugagggucaguuucuuuaucugugaaauuucuuucuuacagaauuaaaugagucuguauguaagguacauuuuauugugccugucucauauaguaugcacacaauaaaugguugcuauuaugauuauaacguaauuguguaacauuuugcuauagugaauaaauaugugaauuuggaguucauuaaguuauuuucuacuuuuauuuuucugaacuauuagagugggaucuucuaguaguucagcaagauauuuguaguuucauaguucuagaagucacugaaauaucauugaagguuacaauguuuagccguagacuaaauauuugaauaucucuauacuguuguauaauuuauuuaacuugaggaacuuuauuuaauauaauuugugcuuuuaauauuaauguaaauuaauauaaaaauauaacuaauuuucagucaauuuauuagcaguuucagucuuaaccauuaugaugucuuuaacauuuagaauuucauucuuuagcagacagacauggacguaaaugcccccaacuacucaggaaacaaaauauaagaguuauucuucuuacaugauauuuuaugcccagaucacucacuguuuugccugauuaacugaguacacaaguuuuacaauuuggaguuuuauauuucuacuuuacuuuggaguuuuaguacaaucauagaacuaguuucuguuucagagaagaugguuucauguauguucaugugggccuuagauaacccuccauuguucauguucauaaagcaacagugaucacccccuaccuccaaacuguaguagauauuauuuuugcugauuaucuucuccauuuagaacaauguucgagcugcugcccuagcgacugugaaugcuugggcagaacagacuggcaugaaggaauggcuggaaggagaagaucuuucugaagagcucaaaaaggaaaauccuuucuugaggcaagagguuaguaucauaaauuaaucaugugcauuacucaugucauuuacuuccauaggggcuugggccugucugauaaauacgcauuuaugguuagaaugaguuucauuauaaaacaguuaauaaaaugaaaucacauuccuggggccuuuguauucaugugcuuccauuuuuuccuuucacaugcuucuuuaucaauaacgcuuuuuagaggacuaggcuuuuuguggaauuuuucccuuuucuuaaacauuuaaaugguaaaaucagagguuuuguguuuuuuuuauuauuauuuaagcucugggauacaugugcagaacaugcagguucguuacauggguauacaugugccauggugguuugcugcauccaucaacccgucaucuucauuagguauuucuccuaaugcuaucccuccccuugccccgcuaacccccgacaggccccacugugugauguuccccucccugugcccguacguucucauuguucaacucccacuuacaagugagaaauugcgguguuugguguucuguuccuauguuaguuugcugagaaugacgguuuccagcuucaucaaugucccugcaaaggacacgaacucauucuucuucugugguugcauaguauuccaugguguauaugugccacauuuucuuuauccagucuaacaugaugggcauuuggguugguuccgagucuuugcuauugugaauagugcugcaauaaacauacguaugcaugugucuuuauaguagaaugauuuauaaucuuuuggguauuacccaguaaugggauugcugggucaaaugguauuucuaguucuggguccuugaggaauugccacacugucuuccacaaugauugaacuaauuuacacuccagccaacaguguaaaagugguuccuguuucuccacauccucuccagcaucuguuguuuuaaugaucgccauucuaacuggcgugagaugguaucucauuguguuuugauuugcauuucucuaaugaccagugaugaucuuuuucauauguuuguuggccacauaaaugucuucuuuugaaaaguuucuguucauauccuucacccacuuuuugaugggguuguuuguuuuuuucuuauaaauuuguuuaaguuccuuguagcuucuggauauuagcccuuugucagauggauagauugcaaaaauuuucucccauucuguagguugccuguucacucugaugauaguuucuuuugccgugcagaagcucuuuaauuuaauuagaucccauuugucaauuuuggcuuuuguugugauugcuuuugguguuuuagucacgaagucuuuguccaugccuauguccugaaugguauucuagguuuucuucuaggguuuuuaugguuuaaggucuuagguuuaaaucuuuaauucaucuugaguuaauuuuuauauaagguguaaggaagggguccaguucaguuuucugcauauggcuaaccaguuuucccaauaccauuuauuaaauagugaauccuuuccccauuucuuguuuuuugucagauuugucaaagaucagaugguuguagaugugugguguuauuucugaggccucuguucuguuccauuggucuauauaucuguuuugguaccaguaccaugcuguuuugguuacuguagccuuguaguauaauuugaaaucagguagcgugaugccuccagcuuuguucuuuuuacuuaggauugucuuggcuauacaggcucuuuuuugguuccauaugaaauuuaaaguaguuuuuucuaauucugugaagagagucauugguagcuugaugggaauagcacugaaucuauaaauuacuucaggcaguauggccauuuucaugauauugauucuuccuauccaugagcauggaauguucuuccauuuguuuguguuuguugagcagugguuuguaguucuccuugaagagguauuccuagguauuuuauuuucuuuguagcaauugugaaugggaguuugcucaugauuuggcucucuguuuguccauuauugguguauaggaaugcuugugauuuucgcacauugauuuuguauccugagacuuugcugaaguugcuuaucaguuuaaggaguucuugggcugagaggaugggguuuuguaaauaugcaaucauguucaucuguaaacagagauaauuugacuuccucucuuccuauuucaauacccuuauuucuuucucuugccugauugcccuggcuagaacuuccaauaauauauugaaaaggagugguaagagagggcauccuugucuuaugccgguuuucaaagggaauccuuccagcuuuugcccauucaguaugauauuggcuguggguuugucauaaauagcucuaauuaaaaucagagguuuuaaucagaacauaaaaauagaggcugggugcagugacucaugccuguaaucccagcacuuugggaggccgagcaagcagaucacuugagaucagggguuggagaccagccugcccaacauggugaaacccugucucuacuaaaaauacaaaaaauuagcugggugugguggugcgggccuauaguccuagcuacucgggaggcugaggcaggagaaucgcuugaauccaggaggcagagguugcagugagcugagaucacaccacuguacuccagccuggguaacagagcaagauuccaucucaaaaaaaaaaaaguccaguugcaguggcucacgccuguaaucccagcacuuugggaggccacgguggguggaucaccugaggucaggaguucaagaccagccuagccaacauggugaaaccccaucucuaccaaaaauagaaaaauuagcugggcaugguggugggcaccucuaaucccagcuacucaggaggcugagacaggagaaucacuugaaccgggaggcggagguugcagugagccaagaucgcgucauugcacucuagccugggcaacaaaagcgaaacuucgucucaaaaaaaaaaaaaauagaacauucaaaaauccaucagaguaaucauaacaacagaauaacaaaauuugugauuauaucaacugaugcaaaaaaggcauuugacauauccaacaugcauucaugauuaaaaacucuuagcaagucaguaaugaaagagaauuaccucaacuugauauaagcaucugcauaacaaccucuacagauaacaugaaacuuaauggugagggccaggcgcgguggcucacgccuguaaucccagcacuuuggaaggccaaggcgggggcagaucacgaggucaagagaucgagaccauccuggcaaacauggugaaaccccgucucuaccaaaaauacaaaaauuagcugggugugguggcaugcgccuguagucccagcuacucgagaggcuguggcaggagaaucacuugaacccgggaggcagagguugcagugagccaagaucgugccacugcacuccagccugagugacagagcaagacuccgucucaaaaacaaaaaaacaaaaaaaaaaaagaggaaucacuuuacaauuagcuuacuauauugcuaauguaaucaagacacugugauagugguagcaggaggaugggguggagauagacacguagaucauuggaacaacagagagaacccagaaauagacccacacuaauaucaacuaauuuuuuacaaagcuacaaaaauaaguccgugaaggaaguauagucuuuucaacaaaugauucuggagcaauuggacauccauaaacaaaaaaaugaaccucacccuaaaccucacugucucaaaacagauuauggacuuaaauuugaaacauaaaacuauagaacuuuuaagugcaaacuagaaaaucuccaggaugggaggcuggcaaagaauucuuagacuuaaaaccaaaaccauaauccauaaaaggaaaguugauaaauuggaccacaugaaaauuaaaaacuuuuacucugcaaaaaaaaccacaugaaaauaauaaaacaagcuacagaacaacagaaaagauuuguaagccaguauccaauaaaggacuaauaucuagaauauauaaagaacucugaaaacucaacaguaacaacaacaacaacagaaaaaucagaaaauggguauccauggccaagccugugaguagugagcugagaucaugccauugcacuccagccugggugacaagagcaagacuuaauuuaaaaaaaaaaaaaaaaaagaugcucaguguuauuagcaaccagggaaaugcaaauuaaaacuguguugaaauaucacuauacaaucaucagaauugcuaaaauuaaaaauaaugguaacgugaaaugcuggagaaaccuaaacagucaugcauugcugcuggaaauguaaaaugguacaacuacuucaggaaauaguuugguauuuucuuauaaaacuaaacgugcaguuacuauaugagccagcaauugcacucuuggacauuuauuucagaaaaaugaaaauuuauauccauacaaaaaucuauguacaaauauucauaacaacuucaaucauaguagccaaaaacugggacuauagcucaaggguagagcauuuuacugcauaauagccaaaaacuagaaacaguucagauaccuuucaguaggugaaugguuaaacaaaucucuuguacauccauacauggaauacuauuuagcaauuaagaacaaacugcugguaaauacaauaauucagauaaaucuccaaggaauugugcugcaugacuaaagccaaucccacuggccugcgagccaagauuaugccauugcccuccagccugggugacgggagugaaaccuugucucaaaaaugaaaaauacaaauaugaacuauuuuagggauauagagaagaaaaaugucaacauaaggcaaaaaauaagaagucuugguaaaauuuguaaccuucugaucacaauaagugcuuugggucuucuagcuaaauauuuuucagaacuaaagggagauaaguaaaaguuuuucaucuuuaagauguauuaaagcuuuauaauuuaauacccaaauauaguccaaagaaauguguccuuaucuuaaagaugauugucaucauugcauauguuauuuaaauuuagcacaguucuugaauuaugaaaaguacugauuucauauuggaaaguuauagugugaaagcuaauucagugcuugagacuaaugaaaucaguaagccugagaucauaaaugauaacagucuucauuugaaguguguaacuagucuuuauuucuuuuggcagcuucugggcuggcuggcugagaaacuaccuacucuucguuccaccccuacagaccuuauccuuuguguuccucaucucuacuccugccuagaagaucgaaauggagaugugcgaaagaaggcccaagaugccuugccauucuucaugaugcauuuaggauaugaaaaaauggccaaggcuacugggaaacuaaagguacuacuucuuguugcugcuacugcuguuaaaagcuauuaaaaaauauauuuaacaugggccuggcacgguggcucacgccuguaaucccaacacuuugggaggccgagacagguggauuaccugaggucaggaguucaagaccagccuggccaacauggugaaaccccaucucuacaaaaacaaaauuuagccggguuugguggcacaugccuguaaucccagcuacuugggagggugaggcaggagaaucgcaugaacccaggaggcagagguugcaaucagcugagaucgugccacugcacuccagccugggcaacaagagagaaacucugucuuaaaaauauauauauauuaaacaugaauuuauaugaggaaaaaaccauauuaccuccugugagucucaauuugaaaucguaacaagcaaaaauaaaauauuaagcaguguagaaguaaaaaucugcugaccucacaggggugaaaacugugaccuucuagaaugauaccuaccuuagugugacuucauaaugugugugacuucucugacaccauguacugccucccuuacuucagugguauuucaaaacuaggagcucaaucauuuguuugacagaggauuuguucauaagcuuuguaugacuuuaucauuuaugugaccucucacuuuuuaugucauuuugucucucuagccaacuucuaaagaucagguauuggccaugcuagagaaagccaaaguuaacaugccagccaagccugcuccacccacuaaagcaacuucuaaaccaaugggaggguccgcuccagccaaauuccagccugcaucagguaacucuaucuuaagaagguuaaaggggaaggaaauagcccugaggaacucuaaaaagacauucagccuugucuuuuuuaaaucacauuuccuuacagcguagauccaagcucuccuuccuucucugcuuacuuuccuuucacaaacacuugucaaguagucaaguaccuauuuuaugccaggaacuguacuaaggguacaaacgugacuaauuugguuucuaauucuaaaaaguuuuuuuuguuuuuguuuuguuuuuuuuuuuagagauggcaucuugcucugucacccaggagggaguguaguggcgugaucauagcucacugcaaccucgaacuccugggcucaaguguuccuucugccucauccucccaaguugcugggacuacaggcaugcgccaucacaccuggcuaaauuuuuuacuuuuuauagagaugagguuuuguugugaugcgcagguuggucucaaacuccuggccucaggcgauccucccaucucagucuccuaaagugcuggacuuacaggcuugaaccaccacacccgaucccaaaaggaguuuuggaauaguacauuaaaauaguccuuucugaaguguugcauccuacauuuccacaacuauuuucugcuccuggauacuauaauuagaagaggaauugggagaaucuagcuuaauccacuuuauuaaccuucuuuaagggauaauucuugauuucuuuauccugauauuaaaauuccauaauaggcugggcacaguggcucaugcuuguaaucccagcacuuugggaggccaaggccaguggaucauugaagucaggaguuugagaucagccuggccaacauggagaaaccccaccucuacuaaaaauacaaaaauuagcugggugugguggugcauaccuguaaucccagcuacucaggaggcugaggcaggagaauugcuugaauccgggaggcagagguugcaguaagccaagaucacgccagugcacuccagccugggggacagagcaagacucugucucaaaauaaauaaauaaaaauaaauaaaauuugauaauauauaaccugugaccaauucauuuuuagacuuacugcuuaaacaaaacaauauucuugaauuuaguggaauagaaauuguugaugcuauaaaguuagaaauuuuacagccugagcaacauggcaaaacuccaucucuacaaaaauuacaaaaauuagcuagucuugguggcgcacaccuguggucccagcuacccaggaggcugaggugggaggaucgcuucagcccaggagguugaggcuucaaugagccacgaucgcaccacugcacuccagccugggugagccagaacuagucucaaaaaaaaaaaauuuuaccuguguaaaacucuuuauuaaaguacauauucaguuuuuauugaaaucuugcuauguagcagauacugaauaucaaagaugucuuuaccuuuaagaaaguaucagucugggcugggcaugguggcucacgccuguaauuccaccacuuugagaggacaaggaggucaagaccagccugggcaacauagugggacccugucucuaaaaaaaaaaaaaaaguuguuuuaauuaguugggcuugguggugcacgccuguagucccagcuauucaggaggcugagguaggaggacuguuuuagccagggaggucaaggcugcagugagcccugaacgugcuauugcacucuagucugugugacagaaacccugucuaaacaaacaaaugaaacuacaguuuaaauguugguaaaugagauacagauuuucugaauuaauuucucucuuacgcuuaaagauuuugggagaaaaauuauuaggaaaaaaaaaucuaagccaggcacagugacucacgccuguaaucccagcacuuugggaagccaagguggguggauugcuugagcccaggaguuugagaccagccugggcaacauggcgaaacccugucuccacaaaaauuacaaagaaaauuagcugggugcgguggcacgggccuguagucccagcuacuagggaggcugaggugggagaauucauugagcccaggaggucaggacugcagugagcaccgugaaggcaccacuguacuccagccugggagauagagcaaaauccugucucauaaaaaaaaaacuaacugaaaacaucuuauaaauugauacauuuaagacugcaagcuuccuugucaucauuauauauuuaaccuguccaaaauaaaaugauauuaguuaaaguuuauaguauauauauauuuuuuuccucaaagcaccugcugaagauuguauuuccagcaguacagaacccaaaccugauccaaaaaaggccaaagcuccaggauuauccucuaaagcaaagguauguuaacucuguauacuucgauguagacuugcuuuuaaauauauuuuauauacugagucauucuauuaggaaggaucauauuauauauaaaagaacaucacugcuguugauauuaucaaauuauuuauacaaauuucugugguucauuuuuaauaagguccuaaaacggagacauccugcucucaagaggugcugucaucuuccuuucauguagauuuucggggaaagauuuacuuuauugaaagaagaaagggccgggcacaguggcucacgccuguaaucccagcacuuugggaggccgaggcaggcggaucaccugaggucaggaguucgagaccagccuggccaacauagcgaaacccugucucuccuaaaaauacaaaaauuaguugggcaugguggcacaccuguaaucccagcuacuugggaaguugaggcaggagaaucgcuugaacccaggagguggagguugcagugagccaauaucucgccauugcacuccagccuggaugacagagcgagacucaggaaaaaaaaaaaaaaggagaaagcauuuguagcucuggcauaauaaacacuuuaggcugauuuggauuuaagaaaaggaaguuaaaucaaccuccuucaaauuuggcacuguugucaucauauuagaagauguuucgguuagucugcagggaaauaucuuuugucccagugggauuuauuuugaugcaucagcaauucuuucaauauucauggagaguuggacaauuuaaagcaguguguucaaauguucaacuuuauccucugggugauuuuuucauuuaauuaaguuuuaaaaucacaguaaauugucauuaucucuaucaagauugagauuaauaaacauauucagaguguuaauuauuuaacacuuacaaaaggaaaauugcaaaacugugcaauggguaaugaaucuaauaguaagucuaaauagagaauuauuuaauuuacuuccuguaauugaugaaaaaauauagagaauguuuuuuaaccaguacauguauuauuacacccccauuuuggaguacacacucuagggccuuucuucuaaauauuacaauuaaccauuuuucuucccuaugcucaggcccuuuaacuccucagugaauuaauuuaaauggguaauuaucuucaacuauccaaugacguuguucuuuuccugucugccuguccucaucccaaauuuaacaagugcuuauuuuaguuuagaucacgaguguuuugcaguauuuuugacuccguucuuaaugccauaauuuuuuucccaaucuuuuuaaacuuacgaagcaguuucauauaaaugaucucauauuuguuuggucugaaugacauuaguguuuauacuagaaagaaauuguggccaacuagaaauaguggccaugcuacauuuauaauaauaaugauuccaguaaugaaauuugaauuuuaccuuaaauauguguacuauuguuuacuauuuucuuucuaucugauaugaagauuuuaaaucuuggauuauuuuuuaaaaccacuuuagugacuuaaauauuuaaagcauuucuuguaacuuucucuagaagcaaguucaaaaggucuucaguuacacuguuaugauaagagauacauuuaaauaucaauggaaagaaacagaaaagcuuucaaacuaaguguuuggaaauguguaaaugccauucaagaugucauuaauggcugagguggguggaucacuugaggucaggagcucgagaccagccuggacaacauggugaaacccugucucuacuaaaaauacaaaaauuagccaggggugguggugggcgccuuuggucccaccuacugaggaggcugagucaggagaaucacuugaaccuaggagguggagauugcagugagcugagaucacgccacugcacuccagccugggcgacagagugagacuccgucucaaaaaaaaaaaaaaaaaaaaaaagaugucauuaauauggaaagcuauaaauaguguugaagauuucaagaaaacaaaaacaaaaaguuugugaccuagacuaaugaucaguaauagcaguuuuuccaacuacauaacaugccaguccaagaacuaaccaacaguuacuuaagaauauucucagaaaaauuucuagagaaccuguucaaaaacauauacaagauucugugaugcauguuuuuuucaugugaaauaucacguagaaagauaucucuguuuucuacagugcccuuuuacugggcagcagcaucauauucuuaaggagaaguggccaagcuaaucaguauucccugaaccuugguuguagagugcacaagggaagaagaugccaagcaaaaccagcuuaaaggaggaugaagacaaauccgggccuauuuuuauuguuguuccaaauggaaaagagcaaaggaugaaagaugaaaaaggauugaagguaaggaaggauuaagaaucgucaggagauuuuugcuuguauuguuauucaagaauaguuuugcugucugaauucauguuauuguuuaauaucuaggaauuaaguguuucuuuugcuuauaaauuauauuauuuaguuuaugggagcauuaauuccuacaaaagaaacuauagaauagaguuauugccuauuuuucccuguaaauagaaauaaaugauuuaguagcuuuuuugguaucuucauugauuuuuuuuuuuaauuaauuggauguauaagcuucuucauuaauccuucuuuuuaagaccuuacaaggcagacuuugugacuguauaaauggcuaguucagucauuuauguuacuuugauuucauuagauacuuaaauuuguuuucaaaauacauaaucuuuuuuaaaaauuauaugcaguacagaaagugcaaaguauaguaagaaaagcaugucucuguuccaguaucccuccacagggaggauauuaguccucauuuuuucaauguauuacuccagaaauauuuuauaccucuacuaucauauguauauuuuuauauagcccuccuuuuauacagauggcauauacagacaugccguacuguuuguucuguaucucacuauuuucuuuuaaugauguuugaaauaucugaaagaucauucguaucuguguauauauguguguaucacuguuuguauuggugcauuguauguauguaccuuucuuuauccuucgcccacuauguuggacauuuagguuguuucuggucuuucacuauuacaaacacugcugcugugaauaucuuugaauguaggucuuuguacacauaugugaguguaucuauauuaaacuccuagaaugaugauaugcauaauuuugauagauauuucaaauuuucucucuaucaaagauguggcagcaguguccaccauguuauauaguuauauguaggauuaauuuuuuuuuuuucuuuaguaagaauugcaaggccaggcacaguggcucaugccugucaucccaacaauuugggaggcuaaggcaggcaaauugccugagcccaggaauucaaaaccagccuggacaacauauugagacuucaucucuacgaaaaaaauuuuuuaauuagcugggcauaguggugcaugucuguagucccagcuacuuggggggcuaaggcagaagaaucacuugagccugggagguuaaugcuacagugaucuaugaucaugccacugcacucugccaugcccaggcaacaggugagacucugucucaaaaacaaacaauuccaaaaauuuuuauuccuagaagauuuucagaguuguuaagcuucaagaaguaugacaccuugaaauuugcauucauauuuaauuacaaaugaauauuguugaauuuuuaaauauuuuauuguuccugcagcugcauuauauaaggcucucuaccucauuucaguugaacacccuguagccccuuuucaccguuuguuuuuuccaggugcuaaaguggaauuuuacuaccccacgggaugaauacauugagcaacuaaagacucaaaugucuagcuguguggcuaaaugguuacaagaugagauguuucacucagacuuucagcaucauaacaaagcccuugcuguuaugguugauguaagucugcaauagauaaauauacauguauuucagacauguaaaaauaccgagcccuaugaaauaaucugaaguuugcaugacuuggaaguagaauauacuauguucucuauuuuuagagcugucuuguuauuugguagaauaaaugaauguguguguauauuuuuuaggucuuaauugaaggcuuaaaaaucugucauuuucuuuuugggcuccaauaaaauuuaaaagacacuugccuaguagaauuaagauuuugauuauucuuauuugugggaguuuuguuuuguuuuauuuuaagcacuuggagagugaaaaagaaggaguuauugguugccuggaucuuaucuuaaaguggcuuacccugagguuuuuugacaccaauacaagcguccugaugaaagcacuagaauauuuaaaauugcucuucaccuugcuaagugaagaagaauaucaucuuacugagaaugaagcaucuuccuucauccccuaucuugucgucaagguaaugugguguucucucucugggagacugcuuaaguucccagcugaccucaguuucuguacuuuuauuuccucucccuuuuuuacugauuauaucacgguaccuucccuacuuaucccuauuucccuauucuuucaaaacauaguaaugcaugggagaaucauugcuacuuaggaaaugccucacuuaaucauuauuuuccuuaucgacuagguuggagaaccaaaggaugucauucguaaagauguucgugccauccugaaccggaugugccuugucuacccagcuagcaagauguuucccuuuaucauggaaggaaccaaauccaaaaacucuaagcagagagcaggugaagcaaacaguuuaaacugagaugugaaucucugcagcaguagccuauagaagaaauaguuuauagaugaacaaauaaauuucuccagugccuauguaguugauuccaaccuccugauuuagacugugagagugaugaguugcacacugguggagccaugguaucaggugauacaggcaccacucaguaucacccuggugacaaaaucaagugcacaggggccaucugacucacaggcaucucuuccuuucaggagcacuugcugaaauaccauuuuuucacugauaaaaggcaguaaacaaaaaauccuaggcagagccagaguaagguuuuaguccuucauauaugccaagggaaauuucucuaguaaggauaagucucugucccaaauauguguugucucauuaaucuagccuuucucccccaucagagugccuggaagagcugggaugucugguugaguccuauggcaugaauguuugccaaccaaccccaggaaaagccuuaaaggaaauagcuguucacauaggagaccgugacaaugcuguacgcaaugcugcacucaacaccauuguaacgguguacaauguacauggggaucagguguucaaacugauuggaaaugugagugacuucucugaacacugucagcaugucgugaaaagaauugcaagaucuccuagguguuagguuuccuguccucucaacuguagcuaaguuuuuacuacuuuuuagucaacucaaccuaucaauguguccuagaauccagauagacccuugaggugucucugauuaggcuguuuuaauggaaaucaaguuuucuuuucugagcauucuauucauagcaaauuugcuuuagaaaugagugcuauuuuugaaucaagaaaucugagcuagucccggguuuaaauucugccuggcagucugcucuguaauuuuuacugcaucgaguuuuugguuaaaaagugcuuauuuguguauaguguggaugcuaguaucugucagaucacaucuugcgcuacagccgugagccaguuuuucacucacauuagguucugccucugaccucuuauuucguuugagugagucuggaccuccgucuucaguuaccucauagugucaccauguauuuacacagggcuuaaauauguuuacuuauauuuucuaauuaaauucucacuacuacccagugaagaauauaaagcaguugggaauuuuacagaugaccaaaaaugaaguuucuugcccauagucacacagcuagauaguggugacaaaacaaaaaaugaggaagcuucauuuaauuuuugaccuuuuuauuuguaguuacuaauuggcuuucuuuuuuuuaucguuucuuuuuuuuuuuuuuuuugagacagggucuugcucugucaccuagguuggagugcaguggugugaucaugguucaccgcagccucgaccucccaggcucaagugauccucugacuucagccuccugaguagcaaggacuacaggcgcgugccaccacacccagcuuauuuuuauacuuuauguauagaugggguuucaccauguugcccaagcuggugucaaacuccugggcucaagugauccuccugcuuuggccucccaaagugcugggauuacaugcaugagccacugugcccagccccucuccuucuuucauaucuccucuuccuauagcagcuaggcagguauuaauaguaguugauuuugaaauguggugcuuugaaaguaaacauguccuaacauagaagguucuauuuguuuugauaugaaaauagauauuauuguguuauccaguuagguuucuaaauuuggccucuuuacagcuuucugaaaaggauaugagcaugcucgaggagaggauuaagcggucagcaaagagacccucugcugcaccaauaaaacagguggaagagaaaccucagcgugcacagaacauaagcuccaaugccaacauguuacgcaagggaccagcugaggacaugucuuccaaacucaaguauguagauagagauacuugucugagagcaucuccauggccuuugccuugugugcucacagccuguccuguaacauaaucuugaguucuuguagccauuaucaugcaugacagagugucuggguaaauguauuguaaccaaauguuugauucuucagucuucauugucuuugucuuugucucaaaaccacuucuaaauggucuugugccuucuuucacugcuuuuccguggacagaauuauguaucgcacuuauaggauguaaguacugccugcuaauuucucauuagcagggcucuuauaucuuucuaacuucugacuuggauucauccccucuggagggugacuagcuuagaguuuauaaucaggguagaggguguccauaaguaccccaugaaucaagucuuccacaaaaguucaaugucauguggcuaaaauacugauucacuuucuucuuuguguuauacuugguugugcuuaguuuccuauucuugagauaaggcuaauuaaaauacaugcaacccaaaauuggcuuagggacucaaaauacugccuccuaagcaagacagcucuauuuuggguugugucaugaguauaauuuuaacgaacuugaauuuggaaacuuugaaucccuauuucuuggauguaaagcuggcccugaccugucaagagugaauauucuaaaaaggggugacugguggucucacaaaauauaaaaugugcugaacacggcauggaaugguacuuaugauuagcaaaauuaaagcacugguuaauuugguggaaaagaaccagccagucuaaauuuuucuuauauauuugcucauaaguagugaacuuugagucaauacaaauauauuuuauuguuuucugccccuucaggaauagaaauacaagguuuguuggcuuuagugaacuagaacaaauacuuauaacuuggcagguaauguaaguacaaauuaaaguuaucugcccucuuaggauauucaugaaccaauguuguuaccuauuaaaggcacuugcuuagacucagggacuuaaaucauucaggggggcugaaaccagaaguugaacaucuguccugaagcuuuggggcaacugacagugcuacucuugcccuuugguuaagaagucucuuuuaguucaggagccuccuuuugcuucccuuagccaagcccgaagcaugagugggcauccugaggcagcccagaugguccgccgagaauuccagcuggaucuagaugagauugagaaugacaaugguacaguccgaugugaaaugccagaacuuguucagcacaaacuggaugacauuuuugagccaguccuuauuccugaacccaagugaguuaaacucuuucauuuaaauaugagcaguucaugaugaucagacggccuacgugaaaugugcccuuuguaaugugcaguuaaaacuuuuuagaacugauuauuuuuugaaugauagcaguuguuaacuaagaccuggaccuaguggagaauuguauaacuccaacugacugggaugucuuguaauagagguugaaguuuucucuuuguucugcuaucuaggauccgggcuguuucuccacacuucgaugacaugcacaguaauacagcauccacaaucaauuucauuaucucccaaguagccaguggugacaucaacacaaguauccaagcucugacacagguaaugggugugcucccgugacagggauuccauugguggacauagaggcuauaaaugugaugaauugcacacucgcagagucauagcauuaggggaugcaggcaguguuucauacuuucccgaggaaagaaaugcacaggugccacucagucaucacuugccucagaggaugugacucuaauagagccuuauuuuuuuuuuuuuuuuuccucuuuugagaccaggucucacuauguuguccaggcuggaguacaguggcuauucacaggcacuaucauagcacauugcagccccaaacuccuggacucaaguaauccuccucucucagcuuccugaguagcugggacaacaggcuugcaucacugcaccuagcuaagccuugcauuuuuuauaauugcauugauucaccagaggcuagagauaaaacagcagcuaacaaguaaggaccaacucucauggaacuuauuuagauuuuaguggacagagacaaguaaacaagaaaauaucacacaguuguaacaacuguguaaauauaacuuaaaugggguaaugacggaaaggaagugaguagauacuuagacugggugaucaggaaaacucugauauccuuggggcuuagaguaugccaaggagaggaaagagcuaguggucaaaggccuuagggcagaaaugagcgugaaguucaaggaaauaagagaagguucaugugccuggagcauaguguuaaagggggacaaugauacagaaugagauuugagaggcagacagugaucauaucauguagggcuuuaaaagcaccagggugaguuguuuggauuuuauuucaauuaugauaggaaaccauuagaaauuuuuuaaaagagaagucauggguggguaugguggcuccugccuggagucccagcugcucaggaggcugaggcaggaagauugcuugagccugggagguugaggcugcagugagcugugauugcaccacuauacuccagccugggugacagagugagaccaugucucaaaaaaaaaaaaaaaaaauaggccaggugugguggcucacaccuguaaucccagcacuuugggaagccaagguggguggaucacgaggucaggaguucgagaccagccuggccaauguggugaaaccccgucucuacuaaaaauacaaaaauuagcugggcaugguggcgcacgccuauagucccagcugcucaggaggcugaggcaggagaaucacuuuaacccaggaggcagagguugcagugagccgaaaucgugccaguguaccccagccugggugacagagcgagaucucgcuccaucuccaaaaaauaaacaaauaaauaaauaaaauuuaaaaaauaaaaaauaaaacaacccaaagugaaucaacaacaaugugacaaaaugaaaauuuuuuuguaauuuuuuuuuugagauggagucucgccguugccaagucuggagugcaguggggcgauuucagcucacugcagccucugccuccuggguucaagcaauucuccugccucggccucccuagcagcugggauuacaggcacccaccaccacgcccagcuaauuuuuguguuuuuaguagagacaggguuucaccagguugaccaggcuggucuugaacucccaaccucaggugauccaccugccucggccucccaaagugcugggauuacaggcgugagccacugcgucagggugauaaaaggaaauuaugugcuacacugauaggauccagugacaguuccacaucacuuugcugauaauucuaauguugcauaaccugaaucaugggaaacaucagagaaauacaaauuaaggacauuuuauaaagauucaaggucaaagcugggcgcuguggcucaugccuauaaucccagcacuuugggaggccgaggugggcagaucaccugaggucagggguucgagaccagccugaccaacauggagaaacccugacucuauuaaaaauacaaaaaaaaaaaaaaauagccgggcauaguggcacaugccuguaaucccagcuacuccggaggcugaggcaggaggauagcuugaacccgggagguggagguugcuaugagccaagauugugccauugcacuccagccugggcaacaagaaugaaacuuugucucaaaaaaaaaaaaaaaaaauucaagguccagaaagucaaggaaacacugaagaacuguccuacacuauaaagagacugagagacaugacagguaaaugcagugcaugauucucgacuggucuuuugcuuuaaaggacauaauugaggucauuagagaaaauggaauggggucugaggauuagaugguaguaacaucaauguuaauuucuugauguugaugguuuuauuguacuuaugaaggagaauguccuuguuguuaauaaguauacccuaaaguaucaggguauggaacaucagauugacaacuuacucuuaaaugauucaggauaaaagaguuccuuuacuacccuuucaacguuucuguaauguacuuuuuuuuucaccuuugcagguuuuuuguuuguauuaauuguggaagaaauuacucuggcugcucuagagauaagauuauaugcauggcaagagugaauucagcaauuuuuuuaggaaguuguggccaaaauuuauaugaaagauauuaugugccacuaggaugauaauggugaagaggaaggaagucaugguuucaggguuucuuuuggaaguagaauccacagaacuugccaauagauuagauauaaacaaugccuuauuaucauuagugacaaccaguguacugcaacagaacacuggaccaguaugugagaaagcugaguuuuugaguuuggaccaguagucugaucuuucugagccucacuuuucaucuguuaaauggagaucuuaauaucagcccugucugaagagucuaaaaagcacucuuuuuaauaaauugaacauuuaaacauaaguauuuuuguuuuguuucugagacggagucucgcuuugucacccaggcuggaguucagugucgugaucucgguucacugcauccuccgccuccuggguucaagcaauucuccugccucagccucccgaguagcugagauuacaggugccuaccaccaugccaggcuaauuuuucuauuuuugguagagaugggguuucaccauguuggccaggcugaucuccuacucgugaccucaagugacucaccuaccuuggccucccaaagugcugggauuacagaugugagccacugugcccagccaaacauaaggauuauuauucccugaacuagacaaugagccucuuagaaucgaaccugugacuaauguaucuaguaucuugcucaguaaauauuugccgaaugacugaaucccuaaggacuaguuauuuauauuuaaauggggccaggugcgguggcucacgccuguaaucccagcacuuugggaagccaagguggguggaucacgaggucaagaguucgagaccagccuggccaacauggugaaaccccgucucuacuuaaaauacaaaaauuggcgugguggcaggcgccuguaauccuagcuacuuaggaggcugaggcaggagaaucacuugaaaccggaagguggagguugcagugagccaagaucgugccacugcacaccagccugggugaaagcaaaauucucucucaaaauaauaaaugaauaaaauaaauaaguaaaugggcuuuuuuuuaagguaagacuuuagaaguacuuugcuaauaaauauucuuauggagaaguuucauauagugucuuccgcuauuuuagaaguaugaagcuuggaaaauauaucuugaaauuuuuguuaucagaucgaugagguccugagacaggaagacaaagcugaagccauguccggccauauugaucaguuucugauagccacuuuuaugcagcuaagacucaucuacaacacacacauggcagaugagaaauuggagaaggacgagaucaucaaguuguauagcuguaucauuggcaacaugauuucgguaagggcaccucugcagaauuucagcuucccaucaaucucucagccuacagagguucaaaagccagaguccaugcagauguugcagugaguccugugucacuugguagaauuuuacaugcauuguauauagcaagcuacugauggcuuccauuggauguuuggcuacacuccaucccaccuuacuguuaggauauaaaguaacaugcuuacagacuaccuagcuucuuccggccaguuucuucaucaggcaugguaggccauagcugccuuuccacagauaaguaugguucuauuaaaaaugcuaauuagccugguuugaucaguauacauuguauacauguguugaaauaccacucuguauuccauaaauuuguacaauuauuacaugucaacuaaaaauaaaagggaaaaaauuuguuaauguuuuaccuguagagcagauuauaaggauaauaaagacauucucacucagauuucaauauucuuucuuaaacuggggcuaaaaggguggacuuaaugacaccaacuagccagaaauuacaaauuuggcauaacaguaaauaauuucacauguaaaaacaaauacuuuggccaggcacaguggcucacaccuauaaucucagcacguugggaggccaaggcggguggaucacaaugucaggaguucaagaucagccuggccaagauggugaaaccccaucucuacuaaaaauacaaaaaauuagccaggccugguggcgggcgccuguaaucccagcuacucgggaggcugaggcagagaauugcuugaacccaggaggcggagcuuucagugagccgagaucgugccacugcacuccagucugggcaacagagcaagacucugucucaaaaaaaaaacaaaaaauuucacaauuagaagcacaccgauuaauuuugccuauuacuagaggcuugggggaguguggugauuuuguuuuuucuuuaauacucugaauuuuuacaaauauaacauagccgggcgcgguggcucacgccuguaaucccagcacuucaggaggccaaggcagguggaucacgaagucaggagaucgagaccauccuggcuaacacggugaaaccccaucucuacuaaaaaaaaaaaauacaaaaauuagcccagcgugguggugggugccuguagucccagcuacucgggagacugaggcaggagaauggcaugaaccggggaggcagagcuugcaguaagccaagaucacgccacuggcacuccagccugggcgacagaggagacuccgucucaaaaaaaaaauacaacauaauugaauauuuaucagaauaugccacccacauuucuuuacucucuauauugaguuuuacaccucccugacacaaguaugucuggauagcuguuucagauagagagccuugcccgggaggccuccacuggaguacuaaaagaccuaaugcauggccucaucaccuuaaugcuggauucucggauugaagaucuugaggaaggacaacaggucauccgcucugugaaccucuugguggugaagguucuggagaagucagaccagaccaacauccugagguauaucuguacucucagccaauagagccuggggcauccucgcuuuuguuuacacuuagaaaccauaauguccguaagucaacuuccuaggcaaccuaacaaucauaaucaacuuccuaggcacacuuaaaguuauagcuacaucaguuauaacuauaucaguuaaaacuuuaagugugccuaggaaguugauuuauuacucuucuucaucauggaccaaagguauuuuagccugagaccauagcuaaaacuaguaaauacuuaguuagccagccaauaucaugcauuuucuauaauaggacuguaaaguuugucaguuacauuuuucuuguacauuucagguacauuuuauucuuucucagcuaccaaugacaaugaaaaauagagucacaaaccuuacacuuaccaaguggugacuuaaaaggcuuaaacaauguuuauuuucuuaacugaaugucagguaguccaggacaauuccugauccaugaccucucaguuuauuagaugaauagaguaaucucacuugcccuuucaacugcugauucuaauuggaaugcagguuugaaacuuaaugcuguuguguuggguuuuucuuccagugcccuacuuguuuugcuccaagacagccugcuagcaacagccaguucucccaaauucucagagcuuguuaugaaggugaaguugaaaugauuugaucucuuuucuuucaaagaugcaaucacuuuguuaaaaguauggggaaagaggaauuggagcuaagaaagacauaggcucaaaucaaccaagucacaccugaaaauauauuuuucguaauaaaaauauuaauaaauuuuuaaaaauuuagccaggugcaguggcaugcaccuauaguagcagcuacucaggaggcugaguugaggagauuacuugaacccagaagugagcuugaucauaccacuacacuccagccuuggcaacagugagaccccaucucuuaaaaaauauauauaugguuuuuuauauauauguguauuauauauauguauauauguauuauauauguauaucuuaauauguuauauauguauauaauacacguguguguguguguguguguguguguguguguguguguguauauauauauauauauauauauauauauauaugaauuggucuucaguuuuucccuuccuacaauuuauauucuaaguucaggccuaaacaguucguggccucaaacagugaaagggaggaaauauuuuguaaauauuuuacuaauucucugaggaucaaaaggaaagaaguuugaaacagauuucauuuauuuuggggaaaaagauaucuacagcccuaugauauuuggucucuuuugugaaagagaccaaaugaacauauuuauaacauuguaauacuguuauuacacugaauuaguaucagauauuuuguccccuugcauuagauuugguuaagcaacaugaacuacuuuacucucaggaacgaaggaaacccaagagagaauuucuaccagguuaaaugauggccccuagcucuggggagugggaaggaguagagauggaugauuagaugaaugacuggacacacuucagcuggugucaugguagaagugauuaaaaauuuucauguuuuagcagcugaacuugaaagauaugaugugccacauuuauagcccuggccaucuuuuagaagugagcucaaagcuuagggaagaugaauggugacaaauuauccucauucuucagucacuccuaacucuuuuauucuuuuuucaauagugucucuggagaaugguucgacuguugccugauaccaucaauagcauuaaccuagacagaauucuucuggauauccacauuuucaugaaggucuuccccaaagagaaacugaagcaaugcaaaagugaauuucccauaaggacccuaaagacccugcuacacaccuuaugcaaauuaaaagggcccaaggugaguaagaaucgcaacuggucucugagggagcuugagagaaaaucauggaaauggcagugcuaucagucaugcaugugucucccucagauccuggaccaccuaacgaugaucgacaacaaaaacgagucugagcuggaggcccaucucugccggaugaugaagcacaguauggaccagacugggagcaagucugauaaggaaacagaaaagggagcaucucgaauagugaguggccugacuugaaagauugagggacaugaggcuacaccggaagugaucuuaucuaagguguaggucaccaggauaugcuuuccgaagguccaaggugaaggcucauggacugguugaaucagucuccugcuguggugcaguaaccauuuccaccuugaaauuuuaaaaucuaaacuaaguauaaccauguguuuuuugguccccaagaaagaugccuaaggcauuggucaccagauaaauagcuaguucugcuuaacauggaaagaauaugucaguuccuucuccaucaaguugagguggaaaucugagacuggaggcauucaguaacacagaauguuagugcuucugcugcaagaccugcaucaucggugcaucuguuaucuguaggaacauaccaauaaggcccagauuuugagauauuuucuguucauauccaaccaucaguuccuaauuaauaacucaagucuaaccaauucuuccuaugucuuucaacuuuucaggaugaaaaaucaucaaaggccaaagugaaugauuucuuagcugagauuuuuaagaagauuggcucuaaagaaaacacuaaagaggugagagugaaaggguuaagcagaauaggggucugcuuuaugguaaagggacacuaacauucauccccaccucuucccuuuuccuguucaccagggacuagcagaguuauaugaauauaagaagaaauacucagaugcugacauugaaccauuucugaaaaauuccucacaguucuuccagagcuaugucgaaagaggccuucgggugauugagauggagagggagggcaaaggucguauuuccacuucaacagguaugguuuccuguuauagcuccaggaauaagcucaaaauagcuccuagcacaggaaccugaaguuuugguuaguuuaaauucauauccaugaaccucaauacuuaauggucaccaaauggccuucccauugcuauauccaguggucaauucuuagccaccugaauugacccaucaucaguauuugacaaugguaaauaaauuguucccugcccuugagacagcuucuucacuucgcuuccaguucuccaugcugucuuguuuuccuccagucucacuggcuauuccuucuuggccuuugacugauucuugcucacuugcucugaccucuuuuuuuuuuuuuuuuugagauggaguuucacucuuguugcucgggcuggagugcaguggugcaaucucggguucaagcuauucuccugccucagccucccgaguagcugggauuacaggcaugcgccaccacgccaggcuaauuuuuuguauuuuuaguaaagacgggguuucuccauguuaggcuggucuggaacuccugaccucaggugauccgcccgccucagccucccaaagugcugagaugaugcucaugagccacugcgccuggccucacucugaccuuuuaauguggacaucccccaggguucagucuaugguugucuucucucuuucucuuauuuccuuaaugaguucaucuacuuucaccacuuuaaauaacauuuaaaucuccagcuuagaccuccuuccugauuuccaaacugcuauauccuacaugauaucuccaccuggguuucaaauagauuuuuuuuuuuuuuuuuuuuuucuugagacggagucucacccugucacccaggcuggggugcagugguguaaucucagcucacugcaaccuccgccucccagguucaagugauucuccugccucagccucuugaguagcuggaaccacaggcgggugccaccacacccagcuaauguuuguauuuuuaauggagaugggguuucuccauguuggccaggcuggucuugaacuccugaccucaggugauccacccaccuuggccucccaaagugcugggauuacaggcuugagucaccaugcccagccucacauagacauuguaaacucuacaugucaaaaacuaaaguccuggccaggcaugguggcucacgccuguaauccaggacuuugggaggcugaggcgggcagaucacgaggucaggaguucaagacuagccuggccaauauggugaaaccccgucucuacuaaaaauacaaaaauuaguugggugugguggcgugcgccuguagucccagcuacucaagaggcugagauagaagaaucacuugaacccaggaggcggagguugcacugggccgagaucgcaucacugcacuccagccugggcgacagagcgagacuccaucucaaaaacaaacaaacaaaaaaacuaaaguccugaucaucccguaagccugauccauugacuuuuguuuuguuuuguuuuguuuugagacagucucgcucuguugcucgggcuggagugcaguggugcgaucuuggcucacugcaaccuccaccucccggguuuaagcaauucuccugccucagccucccgaguagcugggauuacagaugccugcuaccauggcuaauuuuuguauuuuuaguagagacgggguuucaccauguuggccaggcuggucuugaucuccugaccucgugauccgcccacuucggccucccaaaguuccgggauuacaggcgugagccaccaugcccagccgauccauuuacauucuucuccaucuugguugauggcaacuuuauccuucgaguuuguucagauccaaagcuuuugagucuucucuuccuuuccgucaggaaauuauuuuggcucuaccugcaaaccauaugcagaauucauccacacuucucuucacugcuaccaccuugguguguguguucucucucaucuguauuacuguacuaucuuccugcuugaucucccugcuuccacccugccuuccucuguucuuuucuacacauagcaucagaaugacucuaaugaaacauuuuccagaggcucucccuuucacucagcaaaagcaaaaggcccuuuaaaggucucugagguccuguguuuauaggacccgccagugccccuaguaccucaucaccuaguccucuuccuguuguuucacuccagccccaccagcccccuuguuucuuuuagagucagggucucgcucucucacucaggcuggagugcaguggcgcaaucauggcucacuggguucaagcaguccuccugccucagccucccgaguagcugggacuacaggugcaugccaccaugccuggcuaauuuuuguauuuuuuguagagacaggguuucuccuuguugcccaggcuggucucuaacuccugggcucaagugauccacccacaucggccucccaaaguucugggauuucaggugugagccaccacgccuggccucccccugguuguuucuggaacacaccaggcauaugucuucuuagggccuuugcacuggcuauuucuuacacauaaaugcucuuccuuagauggcuuuguugccuagcucccuuuccucuuucacaucuuuguucaaauaccaccaucuuagugaaaccuuuuuuuuuuuuuuuuugagaugaagucuugcucucucgcccaggcuggagugcuauggcacgaucuuggcucacugcacccuccgccucccaggcuuaagagauucucuugccucagcuucccgaguagcugggauuauagacgugcaccuccacgcccagcuaaguuuuguaguuuuaguagaggcgggguuucaccguauuggccaggcuggucuccaacuccugaccucaguugauccaccugccuuggccucccaaaguacucccaggcaugagccacugugccuggccaguaaaaccuuauuguuuaaaacuugcaaccuaucccucaccccaccauagcacuuacaccucuaacauacuauauaauguaguauuuauuagguuaauuguucagcaucugugucuagucaugcauaucaacauuuugcccagugauggacugcauauaugaugguggucccauaagauuauuuauuuugagacagggucucacucugucauccaggcuggaaugcagugacgaucucggcucacugcaaccuccaccuccuagguucaagugauucuuuugccuuggccucccgaguagcuggacaguugcgugccaccacacccagcuaauuuuuuguguguauuuuuaguagagacaggguuucaccauguugccccagcuggucuugaacuccuggucuuccuggucucaagugauccccccaccucagccucccaaagaccuaggauuacaggugugagccaccauacccagcuggagcugaaaaauugcuaucaccugaugauaccauagcugucauaaugucauagcacaauuauuuuuguauaaguuuaguguagccuaaguguacaguguuuauaaaguugacaguaguguccuaggcuuucaccuucacacaccacucacccagagcaacuuccaguccugcaagcuccauuccugguaaauguccuauacagguguaccauuuaucuuuuauacaacauucuuacuguaccuucucuauguuuagauacauaaauacuuuguguuaacauugccuauaguauucaguacaguaacaugcuguacaggcuuguagccuagguguguggcagguuauaccaacuagguguucacauaacaaugaaauuaucuaacaaaugcauuucucagaauguaucccugcccuuaagccacacaugaugauauuuguuaaaugauauaaaugaaugcaguaacuaaguuuaagcugaaauguuacugcccccacagugaaaaagucccuauucgagaauuacugcucacaggaucuagagacaaacagaagacuuaggagguuucaguuauagaaaauagcuaucaugagccuuaaaccaagacaagacagacccaacugcaaaagugcccucucaucaguucuaugcuuaguucuuuccgaguuuagugacauucaccuacucuuacauuugagaauguguuugccugucaaagcaugucccuuuguguuuuucagacccugaucauauccacucucagccuguaucuugcugggcugaagcuucaguuaaauuuuguucucuuaaauaggaguucuuuuuuguuuuugacaccuuaaauuacgccuuuccaagacuuuacaaguguuuuuauuuuuugagguuuuuuugagauagguucucacucugucacccaggcuggaguacaguggugcgaucucggcucacugcagcuucugccuccuggguucaagugauucucaugucuuggccucccgaguagcugggauuauaggugugugccaccacccccagcuaauuuuugaauuuuuuuuaagaggguuucaccauguuggccagguuggucuugaaccccugaccucuaagugauccaccugucuuggucucccaaagugcuuggauuacaggcaugagccacugugcccagccagggucucuuuuuguugcccaggcuggucuuuaaugaaaaagaccucuuaggaguuaaaguguggugugcagaauguccaacaguaugccacauguaaacauaccaugguuugaucagggcaggcauccuauccuuguuuccaaagcccuuuuuggggauguucaacgugugauaauuuuggccuaaacagcacauuugcaacccaagcauguauucccacugauuauuaaauugauuuugugccuuagaguauucagacaucucauauugcuggcuuuuacauaauucuucauucauuuuucacccccucagaggauucuccucaucuuuacauuaaaggaguccuuuuucccuggaguaaccuuucuacuuuucuauuuaccauaaggcaguguuuccucccaguaccuuaccuuuggggccuguggaaugcauuugcauugauaccaagugaaauauuuuaaaggcccgcauuguaucauuguucauucucagaaauuuaggaagugugauggauuuuuuguuguuuugguuuuccucucuccugccagaauauugaucuuagugguaggguuacagacacuccaguucuaugcccucuuuagauaauuguuggacaccuucucuuccccaugaauacaccauagccuuggacaccuugcuuccuucacagguucaaaugaguuucuccuaugugacauugguccaaacuuaaucuaauucuuccaaacauuuaagguccucggguuuuucaguugggcaauuacaguaugcuuaggaguagcuucagcuuuuuggauugcccaagucagcccugggauuacuggaguacaauccccugcauaacccaggaugcagauggaugacccaauuuacauucugccuuucuauaucaguuuuuugcauucucaagaagcuuauauuguauauuucagagcacccuuaucaccaacuccagguagauucuuguggaauuugucguuuucaaguauaggaaauucuuaauuguucuuuuuggugggagauuaaccaaggcacuuuagaagggggauauguggauaucugaauauucuuucuacuuuuuccccucuaggcaucuccccucagauggaagucacaugugugcccacgcccacaagcacaguguccuccauagguaacacaaauggggaagaaguggggccaucugucuacuuggaaaggcuaaagauccuccgacagcgauguggucuggacaacacaaagguacugcuccuuuucuucugugcaguucagggaggguagucacaagcagguccgaggcaggcuggcccacagagaaguggcuuagucuugcuguaguucuggagcugcaucuugaccugcuugaccugaccuuagacaaucucucuccuucucucaauagcaagaugaccgaccuccuuugaccucuuugcucuccaaaccagcaguuccuacugucgccucuuccacagacaugcuccacagcaaacucucucagcuccgggagucacgggagcagcaccagcauucagaccuggauucuaaccagacucacucuucaggaacugugaccuccuccuccuccacagcuaacauagacgacuugaaaaaaagacuggagagaauaaagagcagucgcaaaugaagcugccccacucccccggcacccugcagcuuuaguuuacuaaacuagaaguccucauaguuuaaaauggccucagcaggccuaguguauacaaacugguuguauguaucaugccguggagcuagggggaggagucauuguggcacaaguauuuguacauacucugcuucucucugucagcguccugcugcucuagaagacuguccguggaugaguuuaguguacagacuuguaaacagcugcccccucucugcucagucuaguucccagauccuuuucuuuucuuuuuaauugcucauuuguaaaauuguccuaaucuuuccuagcuuuuuaauaguuaauauuagaaacucuuuaauaguuuuccuuucaguuugugagcucuucucugucgcccugaagggucacuguauucuguaugaaugcauggcaugauacaacuaauuuaagagucuuuuauaaauaaaguuugcauuaacuauaccugac

SEQ ID NO: 191210 - RNA, 194951 nt, Homo sapiens
aggggauuaaugaagagccaccagacuaucuuuauggagaaucuagauugggaaguuaagcuaagaaugugcauuuuugaaaaaguuuuuaugguagaagagaauguauaucagaggaaagaauguagagaagaaagcaacauuguccacugggaauugauaaguucugcguagaauuuagaguuauaaggacuaucucauuggcuccuaaugaaugcuaaauaacaaauggaaauugcugugagugucaugaagcaaucuuaggaauauuuuauuauguuucugcaggaaauaauuggcagaggcuuaaguugaauugaggccaagaaauuuggugguguugaugggagguuacagggauagagcuuaucaacuuaaucaacuuaucucaugcuuugugauagaaguucauucagcuuuuuuucuuuuuguuuuucuuuuuuuuuuuuuuugagauggagucucacucugccgcccaggcuugagugcaguggcacgaucucaguucacugcaaccuccacuucccggauugaagcaauucuccugccucagcccuccuugcguagcugggauuacaggcgugugccaccaugcccggcuaauuuuuuguauuuucacucagcuuuuaacuuacuugguuaaaucuugugguguucugucaauguuagauuggguucucuguugacauuuccuuuaaaaacuggacggguucagaaugugacugaauucugucuuuuaguaagaaaguucuuggagaugauuaaagauuugaacuucuagaacuuaagcuggaacagaguuauguauaucacuugaaaaagauuaguuuuguauaucguuagaaaacaauugauuauuuuuauuaauaaaguaguaauuuaauuuuuuuuuuuuccugaagagaugaggucucccuauguugcucaggcuggacucaaaacuccugggcucaaguagcccuccccaauagcuggaacuacaggugcaugcaccuggcuuacauuuuuuuaaauuaauuuuuuuuuugagauggagucuugcucugucaccaggcugcaggcaguggcgcaaucuuggcucacugcagccucugccuccuggguucaaguggacuacaggugcgcaccaccgcacccagcuaauuuuuuguauuuuaguagaaaugggguuucaccguguuggccaggauggucucuaucuccugaccuugugaucugcccaccucggccucccaaagugcugggauuacaggcaugagccaccucgcucggccauacauuuuuauacuguauaauuuucacaauauuuucaauauguguuaggaaacuuauaaaacuuuuguuuugaucauguagcuuuauggugcuuauuaauaucaaauccaaacauuuugguccucaagcauauuggugaauguugucuguuuaaguugacaauuuuuagaccgggcgcgguggcucacaccuguaaucccagcacuuugggaggcgaagguggguggaucaugaggucaggagauugagaccauccuggcuaacacggugaaaccccuucucuacuaaaaaauacaaaaaaaauuagcggggaaugguggugggcgccuguagucccaguuacuugggagacugaggcaggagaauggcgugaacccgguaggcggagcuugcaguuagccgaguuagcaccacugcacuccagccugggcgacagagggagacucugucucaaaaaaaaaaaguuggcaauuucucucacacuuccaauuuaucucacucuuaaaggaauaagagaaaauguuuuguuguuagcacagagaggugucuuuuucuaagauaugccucagccuugguagaguuauuuuggaguggaauccgcauuuuuuugcccagugguuugguuuaccccaaaaaaacuuagguuccuuuaaucacagucauucuuguuucauucuccaauuguuccucauaaacucagagagagcuuucagugucuuaauuucuguuuguauagaaaugcugugguacagccuguccugugguuuggggucauuuauauuuuaucuuuucaggcucccccaaguuaaugugaucaauuuuuuuuugcacagcuaaaauuaguuacugauggauaaaaauuuuaugauuaguuauugucagcauguauuuauguguccaguaguauguggcagccugccaauguaauguaaggagaaaauagauuaaguaaucaggagaucuggguuuaagcccuagguuuacuaccugagaagucuuguacaaauuauuuaaggaggcuguagggaagguuaauguccuuuauugagcauuuacugugucauguucuuuacauguguuauuucauuuauuacuuauaagaguccuuuagaguagauguuaauuuccccauagagauacuauuuuuccauuuuuuuguugaagcccagugacaguaaauaauuuaaccaagaucacacaguagguauaguagagcugugauugaaaucaaaggcuuugaaugcuuuucugagucuguauuuaaagaauggaaaaguaaaacauccaucauaauacuuuuuuuuuuuuuuuuuugagauggaguuucgcucuuguugcccaaucuggugugcaauggcgcgaucucggcucacugcauccuccgccuccuggguucaagcgauucuccugccucagccucccugguagcugggacuacaggcauguggcuggcuaauuuuuguacuuuuuuuuuuuaguagagacggguuuucaccauguuggucaggcuggucucgaacuccugacuucaggugauccaccugccuuggccucccaaagugcugggaauacagguaugagccaccgugcccggcccaucauaauacuuaaguugauuacauugagaaaaaguaugugaaaaugcuuuaaaaggauaaaguacucuucaauuguuaacuuccaugcuauuuuacaacaacaaugaacagauguuauuuaaguucuugggcaacuugcuacuuucuguuuauuuuuuuugagauggagucuugcucugucauccaggcuggagugcagcugcgcuaucuuggcucauugcaaccugcgccucccagguucaagugauucccccuccucagcuuccugaguagcugggauuacagacacgugccaccaggcccagcuaauuuuguauuuuuaguagagaccagguuucaccauguuggccaggcuggucuugaaccccugaccucaagucaucugcccaacuuggccugucaaaguucugugauuacaugcaugagccacagcacccauccuccuucuauuucuuuucugacuuauuuuuugucucucccucugcucuuaggguuaauaaucuucacuucucuaccuaaauuuuuuucuucauuguguguuguuuugguaccguguuuuuuucugaggucagaaauauucccaucagacguuguggagcuauuucuugauugugacuguguguuucaacccuuaccuaugaagauguuuguucaucuagcaaauauuuauugaagacucauuagauguugggauacaaagguagacauagguguucuuauggucuccuuauggaguuuauuccaguggggaguauagguauuugauaaauauugaaauuuagacugaaacaaguauucugaaggaaauaaacaagggcugacagagggaagaaggagugaggcgagcccuggguauuuacagggauuagagucuucagucauagcauccuuaauccccuugaaaaguuggaaucacgaaucauaauugcguaaauuuaaguuuccuugcugccaucuaagucuucagucuucauuuaagauugauugcuacauguaauaugugucugauauuuaauguaugauaauacuggguuuuacauagucaaggauaacuaggacuuauaaauaucuagcaugcuugacuaaugaguuuaauuuuuuacuuuuuuuuuguggcagggucucacucuguggcccaggcuggagugcaguggugcaaucuuggcucacugcagccuccaccucccggguucaagcgauucucgugccucagccucccgaguagcugggacuacaggugugugccaccacguccggcuaauuuuuguauuuugaguagagaugggguuucaccauguuggccaggcagaucucgaacuccugacuuuaggugaucugcccaccuuggccucccaacauguugggauuauaggcgggagccacugugccugaccugaaguuguguuucuuuaaaaugagcugaagcaaauuuuauauuucaugauuucaucacuuauuucuacucucuagaauagaucacagguauauauaccuauaguauaaugaagcaucugaaauuuugcugaguuggagaggauuaauaagcacauuugauuugcagagaaaauuggaguauuuuauucuaggcgaccacugaaaacaggacagaaaaauaucucuccccagacuuuugaauagcagcauaguggcacugaguccuggagccaagcagccugguucaaauuccagcaccccugcuuacuagcuauacaacuugggcaaguuacuuagucucucugugccucuccucaucuguaaaauaccauacaguuguuguaagaacuaaauuaguuaauauguauaaagcauuuagaacagcacuaggugcuguauaugccaguuguuaguaacaauguuauuauaacaaaauaaaguuuuccaaaagaacacaugauaaugauucuuagauugaaguuuagaugcuuugggaaaacuuuaauagggaauaggaaguuaaaacagcauauuugucccucuuuccccacaguacccuucaaaauaaaguaaaaggauauagguucaaauccuagcuaggaaaaaaaaaguaaaaagauggaucuuuauuuuuaauuaaaaaauuauuuuuuuauuauuuuuuggagacagucuugcucuggugcgguggcacaaucuuggcucauugcagccucugccuccuggguucaagcgauucuugugccucagccucccgaguagcugggauuacaggugugugccaccacaccuggcuaauuuuuguauuucuuuuaguagagucagaguuuugccauguuggccaggcuuguguugaacucuggcuucaagugaucugcccaccucgaucucccuaagugcuggaauuacaggugugagccagugcguccaguuuuaaaaaucauuauuauuuucggcugggugcaguggcuaaugccuguaaucccagcacuuugggaggcugaggcggguggaucaccugagguugggaguucaugaccagccugaccaacguggagaaacccugucucugcuaaaaauacaaauuagcugggugugguggugcaugccuguaaucucagcuacucgggaggcugaggcaggagaauagcuugaaccccggaggcggagguuguggugagcugagaucaugccaucacacuccagccugggcaacaagagcgaaacuccgucucaaaagaaaaaaaaaauuauuguuauuuuccaauuauaaaagucuuuaugccuggugugguggcccacaccuuuaaacccagcaauuugggaagcuaggaauauauauauauauauauauauauauauuuuuuuuuuuuuuuuuuuuuuuuuuuuuuugagauggagucuugcucugucacccaggcuggagugcaguggcgugaucucagcucacugcaaccuccgccuccuugguucaagcgauucuccugccucagccuccugaguagcugggacuacaggcgugugccaucacgccuggcuaauuuuuguauuuuuaguagagucgggcuuucaccauguuagccaggauggucucgaucuccugaccucgugguccaccugccucggccucccaaagugcugggauuacaagugugaggcaccaugcccagcguuuuuuuuuuggaauuauuuauuuauuuauuuauuuuuauugaucauucuuggguguuucucgcagagggggauuuggcagggucauagggcaauaguggagggaagcucagcagauaaacaagugaacaaaggucucugguuuuccuaggcagaggacccugcggccuuccgcaguguuugugucccuggauacuugagauuagggaguggugaugacucuuaacgagcaugcugccuucaagcaucuguuuaacaaagcacaucuugcaccgcccuuaauccauuuaacccugaguggacacagcacauguuucagagagcacagagagcacagucgcccaggcuggagugcagugaguggugugaucucagcaaccucuaccucccagguucaagcguuucuccugccucagccuccugaguagcuggguuuauaagcacccaccaccucauccagcuaauuuuuguauuuuuaguagagacaggguuucaccauguuggccagucuggucuugaacuccugaccucaggugauccacccaucucagccucccaaaguguugggauuacagguguuagccacugagccuggcaacaauuuuuuaaaauuagcuggaaaugguggugcaugccuguauuuccagcugcuugcgaggcugaggcaggaggacugccugagccuaggagaucaaggcugcagugagccaagaucacaccacugcacuccauccugggcaucaucauggcaagacccugucucagaaaaauuaaaaaaaaaauucuuucuagugauuauagcagaguguguauuuuucagucauucauuuguuuuuuuuguuuuuuuucuuuuuauuauuauuauuauacuucaaguuuuaggguacaugugcacaaugugcagguuaguuacauauguaugcaugugccaugcuggugugcugcacccacuaacucgucauuuagcauuagguauaucuccuaaugcuaucccuccccccuccccccaccccacaacaguccccagagugugauguuccccuuccuguguccauguguucucauugcucaauucccaccuaugagugagaacaugcgguguuugguuuuuuguccuugugauaguuuacugagaaugaugauuuccaauuucauccaugucccuacaaaggacaugaacucaucauuuuuuauggcugcauaguauuccgugguguauaugugccacauuuucuuaauccagucuaucauuguuggacauuuggguugguuccaagucuuugcuauugugaauagugccgcaauaaacauacaugugcaugugucuuuauagcagcaugauuuauaguccuuuggguauauacccaguaauaggauggcugggugaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauuaugguuuugauuugcauuucucugauggccagugauggugagcauuuuuucauguguuuuuuggcugcauaaaugucuucuuuucagaagugucuguucauguccuucgcccacuuuuugaugggguuguuuuguuguuuuuuuuuuuuuuuuuuuuuuuuuuuggaaauuuguuugaguucauuguagauucuggauauuagcccuuugucagaugaguagguugugaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuuucccaugccuauguccugaaugguaaugccuagguuuucuucuagcguuuuuaugguuuuaggucuaacguuuaagucuuuaauccaucuugaauuaauuuuuguauaagguguaaggaagggauccaguuucagcuuucuacauauggcuagccaguuuucccagcaccauuuauuaaauagggaauccuuuccccauugcuuguuuuucucagguuugucgaagaucagauaguuguagauaugcggcauuauuucugagggcucuguucuguuccauugaucaauaucucuguuuugguaccaguaccaugcuguuuugguuacuguagccuuguaguauaguuugaagucagguagcgugaugccuccagcuuuguucuuuuggcuuaggauugacuuggcgacagucauucauuugauaaauguuuguugcauguguauuccuucaguaggcagugaggauaccauaaugcuguguauuauguacuauggcuuuuuuuuuuuugaguuaugaaauaucccugugaggccuuuuacaacuauuucuugauugugauucugcaucucaauucguaccuuuucagacuuuuguuuaucuagcaaauauugguucugaucagaaccaguccuuauugaaugcuuugugccagguacuguaguaagcgcuuugcauugauucuuuucauuccaacuaacaaccuuaugacguaaguacucuuauucuucucauuuuauugauguagcaguuguggcacagagaaauuaagcaauuugcccaagguauauagcuagcaaauggcagaaccaggauucgcguccaaacaaccuggcuccacauuccccugcucuuaaccucuaaguuauacugauucuuaacuacuaaacacuuuaaaacacuaggucaauauagugagacuagaguggaaaaauagauguccaugccuguauggagauuauaguccagaggaaagagagacaguaaacaaauaauuauaccaauaaacauauaauugcagugugugccaaaccuaugacagaagaauaaaaagagauuauaguaggggaaccugaauuaaacuggagguuugagaaauauuuuucugaagaagugauacuuaagcagagacuagaaggauagaaagggaagggaauagcauguaugaaauucucaggaugggagagaacuugacacauuugagaaacuggaagaagguugauaugguuggaauacagugaacaguaggggauggaggaaagaggcauagaaugaggauagagacuuaggcaggacuaugucaaggcuuucgaauuuuuuuuuuuuuuuuuuuugagacagggucucuguuccccaggcuagcaugcaguggugugaucacagcucacuguagucuugaccuucuaggcucaaggauccucccaccucggcuucccaaguagcugggacuacaggcacccaccaccaugccuagguaauuuuugauuauuuguagagacaaagccucacuauguugccuaggcugaucucaaacuccuggacucaagagcuccuuccccaccuuggccucucauaguggugaaauuacaggcaugaacuaccacacccagcaaggcuuuuggauuuuuuuuuuuuuuuuuuuuuuuugauggaguuuugcucuguagcccaggcuggagugcagugguguggucuuggcucagugcgauuucugccuccuggguucaagcgauucuccugccucagccuccugaguagcuggcacuacaggcacgugccaccacauguggguaauuauuuauuuguguauuuauuuauguauuuauuuauuuauuuuuugagaggaagucucgcacugucacccaggcaggagugcaguggugcgaucucggcuugcugcaagcucugccuccgggcucacgucauucuccugccuuagccucccaaguagcugggacuacaggcgccuaccaccacaccaggcuaauuuuuuguauuuuuaguagagacgggguuucauguguuagccaggauggucucgaucuccugacuucgugaucugccugccuuggccucccaaagugcugggauuacaggugugagccacugcgccuggccuaauuuuuucauuuuuaguagcgacaggguuucaccauguuggccaggcuggucuugaacuucugaccucaggugauauaccugcuuuggccucccaaagucccgggauuacaggugugagccaccguaccuggccagcuuuuggauuuuuauccugaguauaauuagaagauuuugaagguuuuaagcaugaguaucaugaccuuauauaugauuuuaaaacguuacucuggggccgggcgcgguggcucaugcuuguaauccuagcacuuugggaggcugaggcggguggauugcuugagcucaggaguuugagaccagcaugggugacaugguaagaucccaucucuacaaaaaguacaaaaaaauuagcugggugcgguggcucacaccugugcuuacagcuacucaagaggcuaaggugggaggaucaucugaucugcggagguugagacugcaguuagcuuaaaccaugauacugcacuccaggccgggugacagagcaaggcucugucuccaaaacaacaauaacaacagcaacaccccauuacuguggguacauuguggggagggguuuggaaagagaagaaaucggggaaguaugguuaggaaguauugcagugguccaggcaaaaggcgaugaugguuuggauuagacuguaggcaguggagauagaaguagaaagauucaguagauauuuuagaauuaggacaggcaagacuuaauggauuggaugugugggaagaagaaggugucaaguaugauuccagauuuuuggccugagcaucuggguagaugaaggugguguuucugagauggaaacauuggaggaggagcagauuuggauuagaguuggggaguggaaugaagaccucaguuuuagucaugcuaauugugagaugccugugaaaacauacaagugcagauaucaaguaaguagucuuuaggcugauucacaaaaguagcgcuggagagaaaucuggaugguauuaguauauagaugguauuuacaaccaagggaaauggaugagaucuccuagagaacaaguauagaguaggaggagaagaccacacuccaaggaauucaagagaaaauguaagagcuuguuauuagagaaaccaacauaggaacauauuucaggaagggaguaaucacuguacauuguuggauuugucagcacagagaucauugaugauuauagcaagaacaauauuggaggaaaguagggccagaagcuaaauugaauuggguuuaaggcaugggaagggacgaaguggagauggucuguguauuuugauuauugacauguguaggcugggcguggugacucacgccuguaaucccagcacuuugggaggcugaggcagguagaucacaugaggucaggaguucaagaccagccuggccaacauggcaaaacccugucucuacuaaaaauacuaaaguuagccaggcgugguggugcacaccuguaaucccagcuccucaggaggcugaggcaggagaaucacuugaacuggggaggcgggggauauagugagcugauaucaugucacugcacuccagccugggugacagaacaagaauccaucucaaaacaaaacaaaacaaaacaugucuguuuccucauaagaaguauacucuaagacaguaagauccgugaagauaggagcuguaccuuuccauuuuuuguauucuuggcugcuuagcuugguaucuugccaggauguuguauuaagagagaaaagggugaggguaugaagauauuugcaaaauggugagaguaaugauucucuggccuuuuuauguuggccuuaaggguuuaucuacuuuuuauguacuuacuuacuuaauuuauuuauuuauugagauggaguuuugcucuuguugcccaggcuggagugcaauggcgugaucucggcucaccacaaccucugccucccggguucaagugauucuucugccucagccucccgaguagcugggauuacaggcaugcaccaccacacacggcuaauuuuguauuuuuauuagagaugggguuucuccauguuggucaggcuggucucgaacuccugaccucaggugauacuccugccucagccucccaaagugcugggauuacaggcgugagccaccaugcccggcccuuuuuauguacuuuuaaaauuugcuauguuuagccuuucuuuuuucaccucccuacugaaugguucuuuguauuuugguauuacuggcuuuuaaaguucauuccuuaucuuuuuuuuuuuuuuuuuuuuauugcuuucuuguggucauuguugcuauagcuaauuagcugaggugcuugguuaaccucuuuauucauucacuuguuuauuggcucuuauuucuauguacugaauguauaauugugacaaagcucaaagcucuauacuuuuuuuuuuuuuuuuuuuuuuuuuugagacugagucucucugucgcccaggcuggagugcaugcaguggugcaaucucggcucacugcaagcuccaccucccggguucacaccauucuccugccucagccuccugaguagcugggacuacagacgcccgccaccaugccuggcuaauuuuuucuauuuuuaguagagaggguuucaccguguuagccaggauggucucgaucuccugaccucgugauccgcccaccucggccucccaaagugcugggauuacaggcgugaaccacugugccccgccauuguuuucuauuaauaguuugugauuuauauacuuugcccagagucuaauuagccauauuuauaugauaauaauaaacauuuuggcuacaguccuaccuagauuuuuuuuuuuuuagauggagucuugcucugucgcccaggcuagagugcaguggugcgaucuuggcucacugcaacuucugccucccagguucaagcaacucuguugccucagccucccaaguagcugggauuacaagcgcacaugaccacgccuggcuaauuuuuguauuuuuaguggagacaggguuucuccauguugacccagcuggucucgaacuccugagcucaggugauccacccgccucggcuuccuaaggugcugggauuacaggugugagccaccacguccggcccuaccuggaauuuuauaugguaacuuuccugggaaaugcuuauauggacauuguccuuuuuaguucuccuagcauucuuuuauuuguuuauuugagacacacuuucuuccaggcuagacuacaguggugauuguaguucacuguagccuugaacucaagcuuuccuccugcuuuagccucccaaguagcuggauuacagguacaaaccaccacacucagcuucuagcguuuuuguuuuguuucguuuuguuuuugagauggaguuuuacucuuguugcccaggcuggagugcaguggugcuauaucggcucacugcaaccuccuccuccuggguucaagugauucuccugccucagccuccugacuagcugggauuauaggcaugcaccacgaugcccggcacauuuuguacuuuuaguagagacaggguuucuccauauuggucaggcuggucucaaacucccgaccucaggugaucugcccgccucggccucccaaagugcuggcauuauaggcaugagccaccgcgccuggcugaauuuuuuuucuuuuuucuuuuuuuuuuagaauaaggauuuacugaacugaaauucacuucacguaaauuuagccaucuuaaaaugaacaauucaguggcauuuaaguacauucacaauguucugcaaccucuuuaguuucaaaacauuaccaucucugcaaaguaaaaccccuuaccaguuaagcaguuuguccuuauucugcccuuccuccagccccugauaaccaucaaucugcauucugucucuguggauugauuuauucuggauauuucauguaaauggcaucauacaauaugugaucuuuugugucuggcuucuuugacuuagcguaauguuuuggagguuuauuuaucuccauuggaauauuuaucaguacuucauaccuuuucaugacugaauaauauuccauuguguguauacaucacauuuguuuauccauucauccauugaagaacauuugggcuguuucugccuucugcucuugugaauaguguugcuuugaacaugcaugugcauuggcuuauuuucaguuauuuuaggaauauaccuagguaggaauggaauugcagguccuaugauaauauauuaaugaucuucugacauguuagagaucaaagccaacaucugcagcuucuccagaguaugugauuucagaguuguuggcugggcuuagauugggacucagaaucucuuuccuguaugaagaacugaguucuaacauacugguuuuauuauuugcauuuuacugaugggauaauugaagcacagcaucugcaugguuuuaacuuccuaucaucuucagagcaagucagugauggaauuaggaauuuaagacucuuaaucauguucuuugucuaaggugacccauauaaagccauguugcauuuacaugaagcuauuugaaaugggcuuccuauauuuuauaaucucuuggagggauauuguucaggugguguuaagcagauguucucuuuccauagaggacaggacaagagggaauguguuuuaauugcaacauaaaggauguagauuacauguuagaaagaacuuccugacuacaagauacugaaauguuguuaccgagggauauuaugaaguaucuucuccaaagacuaucuuucugggaucauucaggugugagcuuguuuagaaaugagggaggugacagagaugacuugcugaggucccugauaacccugggacauaauuguuugaugguuaaucaaagcaauaugucuggcugggcacagugacucaugcccauaaucccaggacuuugggagucugaggcgggaggaucucuugagcccaggaguucgagaccugccuuggcaacauacggagaccccgucuacaaaacaacagcaacaccaaugucucuggcauuuucaugaguauauuuucacuuuucucacaaagcaguaaucaauagagagcaggugaauugcucaggguuccugguaaaauacuagauuaguauucuaaaucuuuuuggauuucacauccauacucagggaugucuuccuuaucuuaaaugacucuuuucuuagcuguguaaucuacuguuaugauucuuccugaaucauagugaucaaagccaacaucugcagcuuccauagagugugugauuugagaguugacugggcuuagauugggaccggcaaucucuuuccuauaaaaauagcuuuggucccugguuauacaugaagaaaugggaacauguuauuaauaauagaccacggcaauggauucuuaauucuuuaggcaagagccaguuuaaaauugcucaggugagggugcacaugacauagauguauuuuugguuuguggugccuggaaaaauagaagccuggcugggcacggaggcucacgccuauaaucccagcacuuugggaugccguggcaggcagaucacgaggucaggaguucgagaccagccuggccaauauggugaaaccccaucucuacuaaaaauacaaaaauuaguugggcgugguggcgugcacuuguauucccagcugcuugcgaggcugaggcagaagaauugcuugaacccaggaggcggagguugcagugagccgagaucauaccauuguacuccagccugggugacggagugagacucugucucaaaaaaaaaaaaaaaaaaaaaaggaaagaaaaaaacaaauuucuguuguuuauaagcuaccuaguuuuuuuuuuuuuuagacagaguuuugcucuuguugcccaggcuagagugcaauggugcucucucagcucaccacaaccuccaccuuccggguucaagcuaugcuccugccucagacuccugaguaguugggauuacaggcacgugccaccacgcugggauaauuuuguguuuuuaguagagaugggauuacaccauguuggucaggccgaucucgaacuccugaccucaggugauacaccugccucagccucccaaagugccgggauuacaggugugagccaucaugccugagugguuuuugguauuuuguuaaagcagcccaaaaggacuaagagggaguuacugauaccacugguacuuuuaaugaaggauuuauuagguuuguuuaugcuaguugaacuaugggagcauuuacuuguucacuucucugcugccaagaauaucuucagauauauuuauugagcuuucuugaauuggcaacaacuauuaacacuguagauaaagaggaaggaaacuaacuuuugaaugugaaccguguauagggaguuuuacauuuauucuuccauguaauauuuguaacaaaccuguaaaggaugagagaaagugaaacauuguuugaaaaagugaaacauuguuuuuugucaaagguuauacagcuggcaaaugguagagcugagauggagaaagcagagucuucaguuuuaaaccaguauuuuucaaaguauucuuuggaggugcccaagaguuggccaugagaguaaggaugagcuuuaguucucucaaccuugcuuaagccagagcagcucaacuuugaccugcuuuacauuuugguguuuucacauaagauuuccuuuagaaaaaggauucugcaaacuuucgcaaccuacucaucugacaaagggcuaauauccagaaucuacaaugaacucaaacaaauuuacaagaaaaaaacaaacaaccccaucaaaaagugggcgaaggacaugaacagacacuucugaaaagaagacauuuaugcagccaaaaaacacaugaaaaaaugcucaucaucacuggccaucagaggaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuucacccagccauccuauuacuggguauauacccaaaggacuauaaaucaugcugcuauaaagacacaugcacauguauguuuauugcggcacuauucacaauagcaaagacuuggaaccaacccaaauguccaacaaugauagacuggauuaagaaaauguggcacauauacaccacggaauacuaugcagccauaaaaaaugaugaguucauguccuuuguagggacauggaugaaauuggaaaucaucauucucaguaaacuaucgcaagaacaaaaaaccaaacaccgcauauucucacucauaggugggaauugaacaaugagaucacauggacacaggaaggggaauaucacacucuggggacuguggugggguggggggagggggagggauagcauugggagguauaccuaaugcuagaugaugaguuagugggugcagcgcaccagcauggcacauguauacauauguaacuaaccugcacaauaugcacauguacccuaaaacuuaaaguauaauaaaaaaaaaaaaaaagaaaaaggauucugcuucuuuaaaaagagaaacccuggaagaccacucauuugaggaaucauaaaagaaaauuagcuaaaccaaucuaaagauugaaaagauggcuaaauuacauaacugccagucuggaaauuaugucaaaguuugaagugacuugauaacacagccacaugugcagugcaguuauucugcccuuagggagugugguacagcaggaaaaaugcauggacugaguuuuuuuuuuuuuguuuuguuuuucugagacagagucucacucugucgcccaggcuggaguguaguggcuugaucucggcucacugcaaccucugcccuccggguuccagcgauucucugccucagccuccugaguagcugggauuacaggugcgugccaccacaccuggcuaauuuuuguauuuugaguagagacagaguuucaccauguuggcgaggcuggucuugaacuccugaccucaggugaucagcccaccucagucucccaaagugcuaggauuacaggcaugagccaccaugccuggccagaauccuuuuuuuuuuuuuugagacagaguuuugcucuuguugcccaggcuagagugcaauggcgcgaucuuggcucaguccaaccuccaccucccagguucaagcgauucgccugccucagccuccugcagccucccgaguagcugggauuacaggcguccaccaccacacccggcuaauuuuuuuuauuuuuaguagagacggaguuucaccagguugggcaggcuggucuugaacuccugaucucaggugauccacuucagccucccaaagugcugugauuacaggcgugagccaccauacccagcucagaauacuuauuuuuaaaucuggugaccacaaauguacaguggggggaugauaacaccuaccuuucaagaguuguuguaaggaucagaaauaacauguaaagugccugguucagaguaaacaccccaaaauacuagcugauugucaagaugaugaugauaaugcugacaauuuuucaguggguauugacaguucccuccaaugccuaagagcuucugccauaucaaagauaggcaguucuuuaccuacuguaugcaccucauggugggugcuuagugugcucguuuuugaugaaguucguuuuuaaacugcuaugauuauuuacucauggauguaucuaugauugauuaaaugagaaaacuuggacuucauuaaauuuauuguuacuggauuuaaagcagcagcagugcaaagaaacccuauacagugaguuaagagcccuggguuuaugucuagagaugcccuuagugagucuuauaacaauggacaagugaaucuaacuuuuuuuuuuugagauggaaucucgcucuaucaccaggcuggagugcaguugcacgaucucugcucccugcaaccuccgccucccggguuuaagcgauucuccugccuuagccucccgaguagcugggauuacaggcuggcgccaccacgcccagcaaauuuuuguauuuucgguagagacggcauuucaucauguuggccaggauggucucgaucucuugaccuugugauccacccaccucggccucgcaaaguccugggauuauaggcgugagcuaccacgccuggcugugaaucuaacuuuuuaagauauugauugauugggcagggcgcaguggcuuaagccuguaaucucagcacuuugggaggcugaggcaggcggaucacgaggucaggaguucaagaccagccugaccaacauggugaaacccugucucuacuaaaaacacaaaaauuagcugggcgugguggugcgcuccuguagucccagcuacucaggaggcugaggcaggagaaucucuugaaccugggagguggagguugcauugagcugagaucacgccacugcacuccagccuggggcgacagagggacacuuugucucaaaaaaaaaaaaaaaaaaagauugauugauugagacacggacucauucugucaccuaggcuagagugcagugacacaaaccauggcuuacugcagccuugaccuuccaggcuaaaguggucuuccugccucagccuccugaguagcugggacuacagguaugugccaccauggcuggcuaauuuuuguauuuuuuguagagaugggguuuugccagauugcccaggcuggucucggacuuuagggcucaaacacuccuucugcuuugccucccaaaccacugggauuacagaagugaaccacuguaauauggcuacuuuucaagauuuuauguucaaaaugaucccuaagucacuuuuaacucuguauauccaugauuugacaaaaaaguuaaagauacuuuauuuucauugcuagaauuucuaaaaauuacaggguuauuuuuggagaaggagcuuugugcugacuugagcuggcaaacuucugucauacuuacugagugauuuguauagaagaacacuggggaccuuuugcccaggcauaagaauugguauuugucauuuauagaauaucagcggaauugaagccagaaccauuguaaggaggcaaaugugagagauuaucuguugcuuuugggaagauagcuggaguuuucaaaccaugccacuuuguacuuccuugaggguaacacuugccacauuucaguacagugguuaugguuacaguauauugcaguuguagucuccccacaagcucucagagguuagaggccuuuuuuguucauuuauuuuuuuuccaguucucuaucccuuucuuggaguagggcuugcugcaucguguagucuuccaaaaguaugcuaaauggacaaaaauaguugaaccaagaucagcagauguauuuagaaaaugacuugugccuacaugcuuguuaacugucuugaauuuuuucuguugucauguguuaauauagaaaaaccugauaaagggaaaaaacccaguguuguaucauuaaccuacaguuuaucucuuacuggcuuaaaaaaaaauauuaacagcaaucaaauuacuguucaaugggggggcaaguaacaucacguugagcuaggguuuugucuguaaaaugggaguggagugggaggagacuuuagagaugggguauauaaggcauuggcacuuaauaguggucauaccucguauuacaaaugaauguuuuuaaaaugaucagcaauauacuucacauuucuaccugaagaaggaauguaauuuuggagaagcuuauacaugggagaauuaucuccacuugucauuuucugcugaaaagauauaauuucguacuucucccucugggcccacaggauaguuccauggaggagacuuagaguggggaugggcuccuagaguagcugcagaagaccuugcuuuuuuuuuuuuuuuuuuuuuuuuuuugagacauggucucacuguguugcccaggcuggaguucaauggugcgaucucugcucacugcaaccucuggcucccagguucaagcgauucuucugccucagccucccaaguagcugggauuacaggcaugcaccaccaugcccagcuauuuuuuuauauuuuuaguagcgacaggauuucaccauguuggccaggcuggucuugaacuccugaccucaggugauccccugcuuuggccucccaaagugcugggauuacaggcgugagccaccgugccuggccuuuauuauuuauuuauuuugagacgaagucucacucugucacccaggcuggagugcaguggugcgaucuuggcucacugcaaccuccgccuucuggguucaagugauucuccugccucagccuccugaguagcugggauuaccugugcauaccaacacaccuggcuaauuuuguauuuuuaguagagaugggauuucucucaugaccagccauguuggcuggucauuucucaacaugacuagccauguuggccaggcuggucucgaacugcugaccucaagugauacacccaccuuagccucccaaagugccgggauuacaaauauccaugagccacuaugcucaggcagaccuugcauuuuugcagaucucuuuggaaugcuauuucuauaguacacagacucuacucucacugaauauggcuaacucagcuauccuacauuagcaugguaaacaucugcuagguuugccccagucagaaaguauucuguaccugccaucuugcuuggcacuuuauauauauauauauauauauauauuuuuuuuuuuuuaaucucucagugauauagugauaauaggugaaaaagguaggcugcaggguaauguguguuauauaugaucccauuuugguacaggaaacaaaaacuauuauaugcauacauguuuguaugaacuaugaguuuauaagguuaucucaagaggguaggguuggaggguuacuuuuuuuuuuuuuuuuuuugagauucccucuugucgcccaggcuagagugugguauauauaaucccauuuugauucaggaagcaaaaccuauuauaugcauacauguuuguaugaaguaugaguuuauaagguuaucucaagaagguagggucggcugggcaugguggcucacaacuauaauccuagcacuuugggaggccaaggcagguggaucgccugagguuaagaguucaagaccagccuggccaacauggcaaaacccugucucuacuaaaaauacaaaaauuagcuggucuuggucgcacaugccuguagucucagcaacuugggagacugaggcaggagaaucgauugaaccugggaggcggagguugcagugagcugagauggcgccacugcucuccagccugggcaacagaacaagacugucucaaaaaaaaaaaaaaaaaaaaaaagguaggguugaggguuccuuuuuuuuuuuuugagauggaguuuugcucuuguugcccaagcuggagugcaauggugaggucucggcucacugcaaucucugccucccagguugaagcgauucucuugccucagccuccugaguagcugggauuacaggcaugugccaccacgcccggcuuauuuuauaucuuuuuaguagagauggggugucucuguuggucaggcuggucucaaacuccugaccucaggugauccacccaccuuggccucccaaaguggugggauuacaggcaugagcuguugcaccuggccacuuuuuuuuuguuuuuuguuuuuuguuuuuuguuuuugaguuucucucuugucacccaagcuggagugcaauggcaugaucucagcucacugcaaccucugccuccuggguucaagcaauucuucucccucagccuucugaguagcuggaauuacaggcgccugccaccacucccggcuaauuuuuguauuuuuaguagagacgggguuucaccacguuggccaggcuggucuugcacucuugaccucaggagaucuuccugccucggccacccagagugcugggauuacaggugugugccacugcggcauccagcuggauuuuauuuuauuuuauuuuuuuaagacagagucucacucugucucccaggcuggagugcagcggcaggaucucagcuuacugcaaccuccaccuccagggcucaagugauucuugugccucagccugccaaguaucuggaauuacaggcaugugccaccacaccuggguaauuuuuguauuuuuaguagagaugggguuucaccagguuggccaggcugguuucagaccccugaugucaagugauccgccugccucggccucucaaaugcugggauuacaggugugagccaccgcgcccagccccagcuagguuuuucaaguauaguuuggcacacggcaggcuagggaaugggugcugcugauugguuugggguugcaaucauaggcacaugugaaaugguccuuauguacugagucugcuucuggcuaggggcuacagaggaaucgcugguugggguggggucaucuugucaucagaagugcaaaagucugaaaagacaucuuaaaaggcugggcacgguggcucacgccuguaaucccagcacuuugggaggcugaggcgggcgaaucacuugaggccaggaguucgagaccggcuuggccaacauggcgaaaccccaucucuacuaaaaauaugaaaauuaaugugguggugccugcauguacucccagcuauuugaaagguugagccagaggacugcuugaacucgggugguggagaaugcauugagccaagauggcgccacugcacucccaccugggagacagagcaagacucugucucaaaaaauaaauaaggccgugcuugguggcucaugccuguaaucccagcacuuugggaggcugagguggguggaucuccagaggucaggaguucgagaccagucuggccaaaauggugaaaccacguuucuacuaaaaauacaaaaauuaacuggguguuguggugugcaccuguaauuccagcugcucgggaggcugaggcaugagaauagcuugaauccggaaagcggaggcugcaguaagucgagaugggaccacugcacuccagucugggcuacagagcaagacucugucucaaacaaacaaacaaacaaacaaacacuacuuaauaugcuuacauuuuuauuuauuuuaauuuuauuuauuuucuugagacagggcucacucuguugcccaugccagagugcaguggugcgaucucugaucacugcacccuccgccuccuggguucauauucuuacauuuuagcagaguucaggccccucucauaauccuaaacuuggggccuuuuauuaguuuuacaauggcgguuuaguuuuaagaagggcuauuaucauuuaaacuguaaacuaaauuucucccaaaguuagcuuguccuacgcacaggaaugaccaagggcaguuaaaggcaagauggauugguuaggucagaucuuuuucacugucaugcuuuucuuacuguuacaauuuuugcaaagggaguuucacaguggauaaaguugcaaugaagcuuugcccagaagauccagggagaaugccuucagggguuagguagcucaauccucaccccccgggucccgucuguaaucuuucaaccauuaaugucucucuuugucauuuuaagaauguuguauaaauggaauuauauagaauguaaccauuuggauuggccuuuuucacucagcauaauucucuugagauucauccaaguuauauuaucaauagcuccacucuuuuuuuuuuuucuugagauguagucucgcugugucacccaggcuggagugccguggcucaaucucggcucacugcaaccucugccuccuggguucaagcgauucuccugccucagccgccccgguagcugggacuacaggugcccgccaccauggccagcuaguuuuuguauuuuuaguagagacggguuucaccguguugggcagaccagucucgaacuccugaccucaggugauccacccuccucagccucccagagugcugggauuaaaggugugagcuagcgcccugaccaauuccacucuuuuuaauugcuacacaguauuucaugguuuggauguacuguaguuuguuuaauccuuuacccauugaaagacaucuggcugggcaugguggcucacaccuguguucccagcacuuugggaggcugaggcuggcagauugcuuugagaccagccugggcaaucugucuuuacgaaaaauacaaaaaaaauuagccgaugugauggcacacaccugugggcgcagcuacuuggguggcugaggugggaggaucacuugagccugggagguggagggugcagugagcaaagauuggucaugcuacccacuccagccugggcgacagagggagaccccuucugaaaaaaaaaaucugaauuuuuauaaauuuuuuggcuacuaugaauaaaacugcuguuaacauuuuuauacacguuuuuuuuugagacaugaucuggcucugagcccagguuggaguaugguggcgugaucucaguucauugcaaccuccgccucucaggcugaagugauccugccaccucugccuccuaaguaacugggaccgcagguacaugccaccacacccggcuaauuuuuuugguuuauguagagacaggguuuugccauguugcccaggcuggucuugaacucuugggcucaagcaaucugcccaccucaccuucccaaagugcugggauuauaggugugagccacugcacccagcugauaacaaguuuuugucugaacauaaguuaucauuuuucuggauaaaugcccaagcaugcaguugcugauucaugugauguauauugauuuuuuuaauuuaaaaaaaaaggaaaacagaaguaaaaugacaaauuaugugguucuuuuuccuuuucguuuuuuuuuuagagggaauuuuucucugucucccaggcuuggagugcaauggcauaaucucggcucauugcaaccuucgccuccugggcucaagugauuucucccaccucagccuccugaguaacuggaacuacaggcgaaugccaccaugcccagcuaauuuuuauauuuuuuuguagagaugagguuuugccaugaugcccaggcuggucucgaaccuuggacucaagugaucuucaagccuuggccuccuaaaguggugggauuacaggcaugagccuuugcaccuggccaugauuuauuuguagaguacucacacucuacauucuuggugcacauaacuuauuuaccgugauuucuggugcuuugcuguagauaucgaagaaauaauaauguauaguuuuccuugucucaucugaugaucuguguauauauuacaaauacuaauuaauauucauagcccacuaggaggcaaauaauaguuaaccuccagugagguucgcuccuucuuuagauagauagguugaggcauggauauuauagaauuuguccaagguuauagcaugagucacuguguucugacucagauucauucagauuuacuaauucuuucucccucuccucaucucuugaaucagcucuuucuaauuaugacuuucuaggugugaggacaugaagagagcuuuuuuuuuucuuuuucuguauuuuauagaagcaguauuguauaaugguuagagcacuauacaauacugcucauuuggcaacagauuugauuuugaaucucuccuucacuuagguaaaucauuuagccucuuuaugccugguuuucugaucugugaaaugggaauaacaguacccaucuucauaguaucauugugaggaaaaagugagauaaaguguuuagcacuaccaaguguguagcaaauguucaaugaauauuagauaauauguugcuuuaaguguauauauauguguuauauucuaucacuugucuuuaucaguucauauguaauuggauacauacugggauuucucuuuuuuuuuuuuuuaauacugggauuuuucugccauguacuuaagaaggcuuuaagauugcucuuacguuuuuuuuuuuuuuuuuuuugagacggaguuuugcucuuguugcccagaguggagugcaauggcgccaucucggcucacugcaaccucugccuccuggguugaagcgauucuccugccucagccucccaaguaguugggauuacaggcaugcgccaccaugccuggcuaauuuuguauuuuuaguagagacgggguuucuccauguuggucaggcuggucucaaacuccugacuucaggugauccacacaccccagccucccaaagugcugagauuacagaugugagccaccacgccuggccuuuuuuuuuuuuuuuuuuuugagacagucucgcuuuguugccagacuagccuggaguacaguggugugaucuuggcucacugcaacuaccgucuccuagguucaagugaauucuccugucucggccucccgaguugcugggauuacaggugugcaccacuauacccagcuaauuuucauauuuuuaguagagacgggguuucacuacauuggccaggcuggucucaaacuccugacuucaagugaucuggccgccucuguuuccuaaaguucuggaauuacaggcaugagccacugcaccuggcugaugguuucuuuuaaagaaaugagguuucucaucagggugccguguggcucaugccuguaaucccagcacuuugggaggcugaggugggaggauuccuugagcccaggaguuugagaacagccugggcacauagugaaaccuugucucuacaaaaaauaaagaaaauuacuggggcguaguuauauacaccuguagucccagcuucuggggaggccgagaugggaagaucacuuacuccugggaagucaagucugcaguucaguugagauccugccacuacacuucagccugguugacaaaaacaaacaaaaaaaagagaugaggucuauguucucuauguugcaggcuggucuugaacuccuggccucaagcaguucuccuccauuagccuccugaguuagcuggguuacaggugugaucuaccuugcuugacucucaaauguuauguauaauuauuuaagaauaggaagcaggccaggcacgguaguuucagcacauugggauggcaaggcaggcagaucaccugaggucaggaguuugagaccagcuuggcuaacauggugaaacccuguuuccacuaaaaauauaaaaaauuaggugugguggcaugugccuguaaucccagcuacucaggaggcugagguagaagaaucgcuugaaccugggaggcggagauugcagugagucgagaucaugccauugcacuccagcgugggcaacaagagugaaacuccuucucaaaaaaaaaaaaaagaaccaauguugcauuauauuuauuauacuauuaauuuauaggaaaaauuuaaguuucucuugaauucauauuuucucaggcucauauucauagaaaaauagaaagugauccuaaacuauugauuuaucccuuuaaucugcucccccacccgcaaacauaacacauauaguagaacccuucucaauaagugucuccacuauccacuugggacuuaggcccaaaacuuaggaaucacucuucauuucucucucacaccucaaauacaaugcaucuguaauucccuuagcuguuucuccaaaauauauucugaguaugacuauucaucucuuauauugcuauaacccuggcccaaauucccaucaucuugucauuuccuuagcuaaaauccucuaauaguaacccauuacacuuaauaaaauccaaauuuuaucauggucugcuaguaccaaccugucuuuauucucuuccuuguuaguggugcuccagccauguuggccuuauuuccggccuucacaugcgcuaagcuuaccuguuagggaccuuaguacuugguacuccucauccuccuugaaauauuuuuuucaccugccucuuuucucaagguuucuauuucaagaugccagucuuaacucaaaugucaucucagagaggcuuucucuggccaccccagguaaaaggguguguuguuuucuuucaccugccauauuuucuuucuagccuuuuucaguacuugaaaguauuguuaauauuuaauuauauaaaaaucacauaagcuuuuggggggcaagaauguucuucuuuacuauaguauccucagugccuagaacagugccaacauaauaccugcuuaaucaaugcuuguugguuauuuaucagugcuuuuacauccuuccccaucuuuaaguguucuuuauuuggaaaguuggggaaauggaauccagcuucuacucagauuuaaauaacuagguucuuaaaucuaaugccuucuuuugauuggcuaagaaaugugauuggcaugguaggguggcaugucggccuuuuagcauaagaacucuguguuuaauaauuugacuucuuuucuugaagccucgagggaaauuuuuucuuucccuauuuuagucagccaagaaccugaccugggcugacuauaagauuggaaaacacugaacacaguaucuacuaagccaagcaaggacugggaguguagcucugguacuaucugaaggaaaagccugaauucaaauccugcuuuggcuccagacucaucugugaaucuagaugaauuucuuaaccucuuccagguuuuguuuuucuuauuugucugaugaguaaucacaucuguccuaggacuugugaagauuccuggguuaauguucucaaagcuuuuuuuuuuuucugacaauauucuuuccuuuuuuuuuugagauggagucucacuuuguuaccuaggcuggagugcaauggcaugaucucggcucacugcaacuuccaccuccuagguucaagcgauucuccugccucagccuuccgaguagcugggauuacaggcgcgugacaccacgcccagcuaauuuuuguauuuuuaguagagacaggguuucaccguguuggccaggcuagucucgaacuccugaccucaggugauccaccugccuuggccucuuaaagugcugggauuacaggugugagcuacugcgccuggcccaacaauauucuugcuguagcuccagggguuuccaggaagaauugggggcaauguggugcucccaggaaggaguuggauucuuucucaaagacuaugcagagaauagaaagaugugauccuuuaugauuugaaaucggcccuacuccagccuccugauauuguugguggaugaaagguauauuguugccaaagucauuaggucuguuugaggcagcugguuucaguuuccguuucugggguuaagcuguuuugccucugaaauuucuuccaucagaagcuacucuuuuuuuguugcuugcuaauaggaaaucuuuugccauuucuguacauuuaagaguagccuucuuggucuucuugauucuuuugauagcuugaaaccaaaaaauugagcuucaguuucuucuugguuuagugcuuuccuccuuguucuuccuuccguuuuuaggaguucuuguguucucagcacacuguuuucuccagaauaauuugcagauaaaacuuccguuucuuuuuucuucauccuucugagguaagugggaguaaggaaaauugucagucucaaauuugggucuuauugcuuucuauuuccgguuuugaucacacuuuguuuugagcacaagcuuucccguguuucagacauuaggcagcaucauugugaguuacuuuagaaagcucuaguaagcaaaaucuguagcaggaaagcuggugcuucacuucuccccccuuauuauaguuacaguaauuagaauuuacucaguuuuguaucuucaaaacauuuuguaaaauuguuagcccauuugugauauauccuauacagaggucggucuuauuuugaguuuauauauaaaaaacuaaugcugcugccugugugcaguagaggugcagguucugucuguugacaguuuauuucugggauuuuggcuucuuauaaagaaagggacuguguauaauuuuaauugauugaucuuaguucuguugaauuauuuguuuucaauuugucaggugguuaauuagagauaauguaaucuguggcuuuuuauaaucacuguaguuuccuuugcaaucuuucucuuagaacuguaggugcgagacuucuuugugugaacuucuguuuaucacauacucugguuauuguucuaucuugaguuuuacuuugaaaaguaauaaucuugucuugaaauuuuauaacccauuuccccuaagauucuccaaggauuuuauuccuuuaagauagaaggaagguauuauuacuuucaguuuacauauuggaggaaaacuugaaauucagcgaggauaugauuuguccaagauuauauaacaagccagcgauaaaaaucaguuauuaaagcuucuuaccucuuagucuuaucuuuauuuauuaaaucacugauucuuguuauaaacuugacugauacuccuauauccccagauugcaggaucagcuuucuuagggaguaaauuaggaugaagguuuuguauuuaguauucucaagcucgaaagguguaauaucccauauucucaucucugcuaucagaauauccacugucucuguacuuuguucuuaauauucuguguuucaaauaggaggauuaaaaaaauuuuacugccauuuuugagguuauuuuucuuucuucuucccuacuuauaguugagguagugauggauuaguccuuugcuuacucucuugccuggcccucucgugaucaaugacaugugcguaaugaaaugacuggcugaaauuagguugguaauggugcaaagccuugucuuuacuuuucuuuucuuucuuuuuuuuuuugagacagggucucacucugucauccaggcggaguacaguggcgugaucucggcucacugcaaccucugccucccgaguucaagcaauucucccaccucagucucccgaguagcugggauuacaggggcgugccaccacgcccaucuaauuuuugcauuuuuaguagagacgggguuucaccauguuggccaggcuggucucgaacuccugaccucaggugauccacccgacucagccucccaaagugcuggauuacaggagugagccacugcacccggcuuagguuuuucuuuuuaagguauuugacuuguagaaauugaauuuaugacuuugaacucauaaccaccacacuuuuuaaaacucuagauguugcuguuuaugauaguuuuggguucauuugggaucuuuucacaacucugaauauaaguaaauacacauacucaugcucuucuacgcuagacauugugcuagguacugggacuaugacagacauguuuuuugcccucacagaguuuauaaucuacuuaggaagaacgaguccuaagaaaggaucaccagugugauaaaauaaauuuauuuugagauaucuuugguuaccuaaauuuauuaauuuccauauuuucagaaaaacuucuuguuagaguauugagcagauaguggguuuucuguagaaaauucuugauauuugucagcuagauauuaguagauacuagguagguagugguuuuuuuuuuuuuuuuuuuuuuuuuugagagggagucuggcugugucgcccaggcuggauugcaguagugggaucucagcucauugcaaccuccaccucccggguucaagcgauucuccuaccucagccuccugaguagcugggauuacaggcaugugccaccaugcccagcuaauuuugguauuuuuaguagagcugggguuucacuguuuugaucaggcuggucucgcacuccugaccucgugaucugccugccucggccucccaaagugcugggauuacaggugugagcgacugcgcccggugauauuagguuaguaguguuuuaguuaucuauugauguacaaaaaccaccacaaaauugguggcuuaaaacaauaaagauuuauuuugucucauaauuacucagguuaggaauuugggcaggacuugucuggaugguccuucuccccuguguaacaucaguugugcuuugugcgucugcuuucagcuggugguugggcuagguuagaaggucuaagaagguuucacucauuugcuugguaucuugauagucuuccacguggcuucucucucuccacaugguaucuuaucaugcagguccucucugagucuugcucagucgcccaggcuggaguguaguggcacaagcugggcuuacugcaacccccaccuccuggguucaagugauucucuugccucggccucuccaguagcuguuaguacaggcaugcaucaccaugccgggcuauguuuguuuguuuuuugagucagggccuugcucugucacccaggcuggagugugguggcaugaucagggcucacugcagccucgaccuccugggcucaggcuauccucccaccucagccuuccgaguagcuggaaccacaggcacaugccaccaugccuagcuaauuuuaaacaauuuuuguagagacaggggucucacuauguugaccaggcugaucuugaauuccuggacucaaacaauccucccaccucaaccucccagggcagggauuacaggugugagccacugugccuggcugguuuuauuuuuuguuuuuaaaaaggugacagugguaagaucuuuuauaugaaaugguuuggagaccucuacaguggacggucucauuuugccuagaagaauuuguuuuaaauuuaauuugucugacuguuuacagggcuuuguggccuaaacuuuuuauuuuuagaaauuaaauauuguguguucuuauuaccauuuucuuucuuucuuuuuuuuuuuuuuuuugagauggagucucacucucucccccaggcuggagugcaguggcgugaucucggcucacugcaaccucugugucccagguuuaagugauucuccugccucagccuccugaguagcugggacuacaggcacaugucaccaugccuggcuaauuuuuuuuuuuuuuugagauggaguuucgcucuuguugcccaggcuggaguacaauggcacgaucucugcucaccacaacuuccaccucccggguucaagggauucuccugccucagccuccuaaguagcugggauugcaggcaugcaccaccaugccuggcuaauuuuguauuuuuaauagagacaggguuucuccauguuggucaggcuggucuugaacuccugaccucaggugauccacccgccucagccucccaaggugcugggauuacaggcaugagccaccgcaaccagcccuuauuaccauuuucauacuaauucuucauuacagaaugaagcuauuauucuacuauaagcauuuuucauaugguaaauauuuugauccuugugguagcccugugauauacauacuaucaauagucacauuuuauggaugaggaaacuaagguacagucagguuaaguaacuauuccuagaaaucaagauaccaucauauaccaggaaaaggauggagcuggaauucaaucaaccauucugacugcggggcccauauauaugacuauacauauugacuguaauuuggauguuauggauaauaacaauaaaauaaauaucacucaugacuucuccaucuagaguuaaccaguuagcacuuugccauauccuuggauaucuuuugcacacaauagauacacaauucagggaauaguuggaguuuuucugcuucuagguguguuugccuucgggaauguguuguuuacuguucuaaauuuaugauguuuuuccccacauucucuguaccccuguaaauucagucuaguguaagagucacacaagagcuguauggagucaggugugggugcuggcuuguggugcuuacaguuugaacuuugguucuauaugauguuacuugaaguauccugaaauggccguaggaaaguccuauuaauaaaaacaaagcugccagucguagaaaacccuguguauuuccauccauauggaguuuccaaagaguacuggggcaguuuuaggcuucuaauuaaaagccugaaauuuuguaguuaauuuuccauuugggugaacuuuacuuaugcaaguggucuuagaauuaguauuuaaaggauuuuuuaaaaaauaauuauauccuuggguuaaaucaaguuauggaauauaugucaguauuacaugguugguuugacucuuagacuuugcccacaugggcauagugaaguggaagagagaugcaguuacucaaauaaauaaggagauuggacuccauuuuaacagcuucuugcaggucuauagguuucugaaucacacuccuaaaugcaauaggaaggggaagauuugggguaugaauuauuagucagguuuuagauacagcuauaaauuguugguucugguuuuuaauucacuuuacuaaacuauguagagggagcccaaaucacaaugaauuauuuuugccacauaaacauacuuuauuuucucccugagcacuuuuuacuuuguuuucugguaacagccuuugacauaauucuuagaaaucugcuacucuugggaauuguggugucucugggguuucaguuggcccuauuguuuggugagggaaaccauagugaaccucagagaggauucaauaguaauaaaaacaacagaaacaagauucauauuuccacagcuguuuucuuauuuggagucucauaacaacccuaugaagcagacauugugaucauguuuuacagaggaggaaacgaagccucaaagagguuaaguauccccaaagucguauagcuagaagguggaguaaaauuccuggcauaagauaaucagauugcacaaggaaccucuaaaucuaacuucuaauucccacuggguuguggcauacucucuagaugguuuuuaugaguaguuguuaaauauaauugucucuuagaauuaaauagagaaaaucuggaaaggugauugccuucucaccuuuggagaguacucagucauguuauugggagugggaguauguguguguggaaaugggauggaaucuuggcauuugucuuuuuguuuguuuguuuguuuuuuuaagacagggucucacucuauuaccugggcugaagagugcagcggugcaaucauggcucacuguagucuugaccuccuggacucaagcaaccuucccaccuuggccucccaccaugccugaccggcauuugucuuauguacauauccuagccaugucuuuugcuucuacuuggauaagcuuuuggugauugagaauugauuuuggggacugugugacgguaucacaaagacuauuguugguaaccuuugucucagucugcuuuacuuuaagggacagauugggaaacuuguuucuucuuccuuuuuaaaagaggaaugaaaaacacaauugacuggcauuuucuccucaucagcagcccugugugacuucaguuugacuuagcucccuuuguucuuuacagggaacagaguaaaaucucuucucagguggcugguaagagcauaucaggagagaagucccuuauccuuuuaaagcaacagcaaauauuuuucuucagaugaaagagagauuguguaauuguuuuacucccucugacuucuucccaucaguaaagcuuucucuuguuugagcuguuaguguguuuaggucccuggaaauugauagaaauguuguuugguaauccugauccuuugauuuuuuucuugguauugauauuuguagcuacucuuuccccuuucugaauccuguaggaaucugagguugcaucacaguuuucugagucauacaguacuugugaccuguauuuuauuguuccucuugaguaacaggaggucggaaggucgguuuuuuuuauuuuuuauuuuuaggaauuggacugcugcuguuuccaccacaccuuguaagauuauaaaugguuuaaguguauuucuuugaaagugccuuuauauugcacuguuaagacaaaggacucucaagauguuucuucugaacuuuuuuauauuggguaaaagaauugcaguagaggguuaagguaaacuaauaggaacuguauuuuuggcacuuuccugguuaguaauuaaucacuuauguggcaguuugaccgaagggcuacccuggguucaggucuagauuucugauccuaaucuaugaguugucaggguuacuaaggagaugauuuccuuccaguuaguucauccuuagccuauucaggaaguuggccugaaaauguugauauuuucaguacauauuuaugcacuaauaagugaugagagcuguaucaugaggauacaggcuagaauuuguuucuuugucacuccuuagguaacucugugcuguguaggacuaggaacuuggugaguuuuuuuguuuuuguuuuuguguuuuuuuuuugagauggagucucacucugucacccaggcugaaguacaauggcacggucucagcucacugaaaguuccaccuuccagguccaagcgauucucccaacuuagcuucccaaguagcugggacuacaggcaugagcuaccacgccuggcuaauuuuuguauuuuuaguagagacaggguuucacuauguuggccaggcuggucucgaacuucugaccuugugaucugcccgccuuggccucccaaagugcugggauuacaggugugagccacugcaccuggccaaacuugguguuuucuugcugugaaaucuuucugacuuuuacaucuuaguacuccagugagagaacuccuucaacacaggcuguuaauguuuuuuucugucuguauuuggauacaucugguuguguacucuuuagauugcagccuuuugugaaauguaaagagccaauuauuguuuggcuuuuuacaauaaauaguuauuacuuuuuaaaaaagugaaugguggccgggcgugguggcucacgcuuguaaucccagcacuuugggaggcugaggcggguggaucaccugaggucaggaguucgagaccagccugaccaauauggugaaacccuaucucuacuaaaaauacaaaaauuagccgggugugguggcaggcgccuguagucccagcuacucgggaggcugaaacagaauuaccugaacccaggaggcagagguugcagugagccgagaucgccccacugcacugcagccugggugacggagcgagacucugucucaaaaaagaaaaaaagugagugaugagguuugggcuucugguaauaauaauuuuuaaaauuaaaaagugaaaaaaaaauagaaacuugccuauuaaaauuauuaaaucaccaauaaugccacuacugagagacaaccaugguuaguauuuauuguauuucuuuuguauccuuuuucuccuaauauuuuuuaaacaaaguugggauuaauacugcauauagaauuuuguguucuuuuuucacuuaacauguacuuaccgcauaauuuaauuuuuuuuuuuuuuuuuugagacagaaucucgcucuguugcccaggcuggagugcaauggcacggcucacugcaaccuccgccucccggguucaagugauucucccgccucagcccccugaguagcugggauuacaggcgcguaccaucacgccuagcuaacuuuuguauuuuuaguagagacgggguuucaccauguuggccaggauggucucgaucucuugaacuuguuaccacccaccucagccucccaaagugcugggauuacaggugugagcuaccgugccuggccuuuuuuuuuuuuuuuuuuuuuuuuuuuuuuuuuuuuugagauggagucucacucugucacucaagcuggagugcaguggugccaucuuggcucacuacagccucagccuccuggguucaagcaauucucgugccucagccucccaaguagcugggauuacaggugugcaccaccacgcccggcuaauuuuuguauuuucaguagagaugggguuucgccauguuggccaggcuaauaccgaauuccugaccucaagugaucugccugccucggccuuccaaagugcugggauuauaggcgugagccaccaugccuggccucauuuaauauuuaauuuaauuuauuuuuuugauuaauuaauugguuaauuuuuuuuuggagauggaguuucacucugucacccaggccggagugcaguggugcgaucuuggcucacuacaaccuccgccuccuggguucaagcgauucuccagccucagccucccaaguagcugggauuacuggugccugccaccacgccuggcuaauuuuuguauuuuuaguagagaugggguuucaccauguugaccaggcuggucucgaacuccugaccucaggugauccgucugccuuggccucccaaagugcugagauuacaggcaugagccacugcaccuggccuaauuuuugucuuuuuaguagaguaaauuuuguauuuuuaguagaguagguuuugccauguuggccaggcuggucucaaacuccugaccucaggugauccgcccaccuuggccucccaaaguucugggauuacaggcgugagccaucgcgccuggugucguuuaauauuuuaaagaaaauuuuugauaaagauaacagauuuaccuuuuucaaaaacuaaaauuucagcaccuagugcagugguuugcaccagccugggcaacauagcgagaccccaucuuuaaaauaauuuuaaaaguuagcuacucuggaggcugaggcaggaggauugcuugagcccagcacuuugaggcugcagugagccaugauugcaccaucgcacuccagccugggugauagagugauacccuguuucuuuaaaaaauaaaaauaaaguccccacaaacuaacuaaaauuccauuucaaaaacacugacagguauuaauccauuuuuguuuccauuuaucuagucccuccaguccccagcguguuaccauuaguuuuucuucuuauucaaagguagcuuuacucgauauauuguuuuguaccuugcuuuuuuucucucgacaauauauuuuggacaucuauucuuuuuuuuuuuuuuuuuuugaggcggagucucacuccgucgcccaggcuggagugcaguggcgcgaucuuggcucacugcaagcucugccucucggguucaugccauucuccugccucagccuccugaguagcugggacuacagucuccugccaccacgucuggcuauuuuuuuuuuuuuuuuuuguauuuuuaguagagacgcgguuucacuguguuagccaggauggucucgaucuccugaccucgcgauccgcccgucucggccucccaaagugcugggauuacaggcgugagccacugcgccuggccuggacaucuguucuuaucaguagccagagaaucuuccuugccauagauuagucauccaguacccuuuagauggacacuugguuauccucaguuuuugcuauuguaagcaauaagacagaaguaguaacuacucugcaccaauuuuuaagggaaauuuauuauuuguacaagaaagccagcuaauacauguagaaauaaugauagaauuagaaaaugaauauuuucagcaucuccccccauuaaaaaaguacaagagagaaucaucaaugaaugcuaacccauuaaguaaaaaguugagaaguaauaggauauuuacaugaugccaaauaauugccacagauugcuaauuguaaagggggagauauuccuuuauaaagagaggucuggcucuuaacaaccucaaccaaguaaucaucuuucuacaaaugaucacuaaugaugguacagucugaaaauaugugccaccugauguacuccaccuugagguauauaggcacaucaacugugacgcacugucaccaaaaacauuuaaacuaaugaagguuuuagaccuaaccugcuguuuacaggaaauaaagguauagagaggcaagcuaaaugcuacuaugaggaaacaaucaguugagucuaggauguaaggcauucuaacaagucaacucuccugaucuuuuagaaaagcuagugucggcugggugcaguagcucacaccuguaaucccagcacuuugggaggcugaggcggguggaucaccugaggucaggaguucaagaccagccuggccaacauggcaaaaccuggucuuuacuaaaaauacaaaaauuagcugggugugguggcaggugccuguaaucccagcuacuccggaggcugaggcaggagaauugcaugaacccaggaggcagagguugcagugagccgagauugcgcuguugcacuccaacuggggccacagagugagacucugucccccaccccccccaaaaaagaaagaaaagcuagugucacaaauaaaugaaaacauaaacaaaacaaaacauggaggccauucuaggauaaaggagacuaaagagacauaaacguccaaagucguugcuugaguuuugauuagagucuggauuuuuuuuaagucaaccauaaaugaaauuuuuuggacaauggggaaaauucgaaugauaauugaaguauuagaugauaauugguauaguauuguuauugugguuaugaggcagaacauccuucuuccuaggaguugcauaaugaauuaaauaugcaggguuaaagugucuugauaccuacugaaauaauuccaaaauuauacaaaaaaaacaccaaccucaauguaaccauaucucuauccauggagauagaugaggcaaauuuggcaaaauauugacaauucuugagucuagguggagaauaguguauguuuauuguaccauucuuucaacuuuccuauauuuuuuaaaacauucauaguggagcuaaagaaacaaugucacaguggauaacacuguauauauguagauauucuuuugaaauaccauuuuaucaggcuuacauaguccauuguauagaccacaauuuguucuuuaaucauuacacuuguguguauugugcugcuaguugccauuuuaguagaauuuuaauuucugaugaaguuuucuccuuguaagucuugugguagaugagaaaaggagccugauuuuuuuuuuuccuucccuuuccuucucuguccucuacccuggaucuuuaguggagaagagaaagagaaaaugagugagaaagguacuccuaaauaaucuuuuuuuuuuugagauggagucuugcucugucgcccaggcacuggagugcaauggcacuaucucagcucucugcaacuucugcguccuggguucaagcaauucuccugcuucagucugaugaguagcugggauuacaggugccugccaccacacccggcuaauuuuuguauuuuaguagagacgggguuucaccauguuggccaggcugucucaaacuccugaccucaagcaauccaaucuccuuggcuucccaaaguucggggauuacaggcgugagccacugugcuuggccugauccuuucuuuagcuacaagguugagcuauggagaauaugagaguaugaaauauuuuuggaagaaaaauucugggaggaagggucuuuucugagaaagugucauuaaauaggaaaaguauaauuucccuuuugagcuagaauuguauuugcaauuagaagcuucucguugcagaagucguucuuugacauuauucuuuguuccuuaagauuuccaugaggacaacuuacaaggaccuguauggccucauuuuagcugcuucaguguguuggagcuguuacuugcuccuucauuuccugggccuggugugacaguggcuacugagcgccaugaagguugucccagaaaagaaugcuguccggauacucugggggcgagaacggggugcucgggccaugggagcucagcggcuucugcaggagcugguagaagauaaaacccgguggaugaaaugggagggcaagguaaggaaaauggcuauauuucacauaggauuugugcuggugaugguagaaugagaccuuagaauggguuaacagcagagaguugggauauauuuaucuugugugggagaguugacauaucugacuuagggaguuguuuguaaauuugaaagaacuaaugugcuagaaauaucuuuuuccuuuagagcuagacaguuuuccugaagguaauuuagguuuaucucucucaauuuguagcuugaucauugucuccaguuuuuaagccuacacugugaaugcuaaucuagaaugguuaaugugcuuuugagauacggugaaccauggucuacaaaucauguauuuuaacuuuuuuuuuuuuuuugucucccagagaguagaacugccggauaguccacgcucuaccuucuuauuggccuucagcccagacagguacucaguauuuaucuauaacuuaagauuugugauaacagugcuuucuguauauuuggccuggcuugaucuuccaagucagucccuaaagucucucugaaguacuguaugaacagcacuuuggccccgugucggaaagggaaagaaaguagaugagcagugcuaaccugaaaaaucaugagaacaagcaaaggaaacugagaggaucaaaacuuggaaaguuucucaauaacaaucauuugccugugugauacagcucaccagugguaugaugguuuuuccagugggaaaaaauauuuuccgaauguggcaugugucauuuggggacaguguggacaagccaaaagcuuuuaaagaucagaauauuucuguuuguagauauacugccuaacauacaaagcuuaguuucuuucauguugggauuggcagguagcaucaauauucuaugucguccaaaguugauaagauugguuacccuuccacaugcuucugaauucaguucuacucuuugauuuucuaggacucucuuagccuccacccaugugaaccauaauaucuauauuacggaggugaagacuggcaaguguguucauucccugauuggacaccgccguacuccauggugugucacuuuucaucccaccaucucaggccuuauugcuucuggcugccuagauggggagguuaggauuugggauuuacacgugaguauuuccuuaagauacccuuuucuuuugguguucuaauuuuuuuuuuuugagacggagucucgcucuguugcccaguggugugaucuuggcucgcugcaaccuccgucucccagguucaagugauacuucugcuucagccucccaaguagcugggauuacaggcaugugccaucaugccuggcucauuuuuguguuuuuaguagagacggggauucacuauguuggccaggcugaucuugaacuccugaccucaaguggucugccugccucggccucccaaagugcugggauuacaggcaugagccaccaugcccggcuucuuuugguauucuaaaugcagagacuuguuuaccauugguuuuuuaauucuggaagagccuagccagauucuuaggacuacaucugaauauauuguuguagacauugcccacuuaauuaauaggaagucuaauucccugucuuccauuccuuuuuuuuuuuuuugcaauagcuuaagcaugcccugagauugucuuccauucuugcuaagaugaacaucuacuuuugcuuccuucagcccguugugacauaguacaggaggcucuaagauauguucagguuggauuucuguugucuuagggcaucuuugccuaaguacagauauuccuguacuccgaucaugaucaucaaagcaagauccucuuuguccuaguaacuggcuagcggguugucuugcaccauguugugcaccgagcuugaguuuuucucaggcuuugcauggaacugugggcugggcgcgguggcucacgccuguauuccuagcacuucaggagaccaagacaggaggauugcuugaguucaggaguuugagaccagccugggcaggauauuauaccaaaaauauuauacacaaaauuauauaaaauuagcugagcauggugccaugcgccuguggucccagcuacuugggaggcugaggugcgaggauugcuugagccuaggaggcagagguugcagugugcugagauugugccacugcacuccagccugggugacagaaugaaacccccugucaaaaaaaaaaaaaaaaaaaagaaauaggaacuguguauauaugcuuaaugcuuguagauugugacuaauuugaagaacugaacugauuguauaguauuuaucugauaaauuaguggcacuaccagaucgcugaucuucuacaucuuuuuacagaggauguauuuaaaguagucccuagacauagucauuuuaccuuaaauggaccuuucuugaaauugacuucccagugugcugguagcuuguaaccugagaauaucuggaauugguucauucacaggguggcagugaaagcugguucacagauagcaacaaugccauugccucccuggcuuuccacccuacggcucagcuccugcugauugccacugccaaugagauccacuucugggacuggagucgacgggaacccuuugcuguggugaagacagcuagugagauggaacggguccggugagugcgcugccccaucugcauugucuggcacaggacugacgugauagagaacauucuacuggcugucaccuuggaagucagguuguuaucccugcucagggcaaguugucauccucauagcuccuccuauuuuuuuuuugagacagggugucacucugucacccaggguggagugcaguggcgcagucuugucucacugcgaccucugccuccuagguucaagcgauucucgugccucagccuccagaguagcugggauugcaggcacccaccaccaugcccggcucauuuuuuuguauuuuuaauaaagauaggguuucaccauguuguccaggauggucuugaacuccuggccuuaagugauccgcccaccucagccucccaaagugcugugauuacaggcaugagccaccaugcccaccaccacccccccccccccggcuuuuuuuuuuuuuuuaaggagacagggucuugcucuguuacccaggcuggaguacaguugugcagucaugaccucaugggcccaaguuacugcagccuugaccucaugggcccaagcaauccucccaccucagucuuaugaguaucugggacuacaggugugugcagccucucucagcuaauuuuuaaauuuuuucguagagauuuggggggcggggccucacuguguuacccaggcuagucucgaacuacuggccuucagugauccuccugcuuuagccucccaaaguauugggauuauagguaugagccacugcaccuggccgccuccugcuuucuaagcagcugacuaaucagcugggagacauucauuuuguucauuucagcuuucccuuauuggccucaucuucugguuuuuggagaucagggucauuagacucucuuuuaguuucaaagcuaacuguuuuggauaguacuucuuugggaaaaccugaaagaaguuugggugguauuuuagauaccuugguggguugucuguguuuaucaaacuggaagauggagauguaagcacauaauugacauuuauuuaguccucaagaucaaaacauauugucuguauuaaaguugaugcauuguguuucuuugguccucuuggauuuccagucgaauacaggccaauuuucugguuucagcuaugucacuuaaugcugggacuguucauugccaccaagauucaugcuucuugccgguguagcugccauaugagggaagaacugauucuguggcagaguaugagagcauuuuaugcuuuacgguuaggaugaacucuuguauuugagcaaaggugugcuuaagguagcuguuuccugggauggcaacucuagguguuuuucaugugaaaucguuauuuuugugauacauauuccuuuacucuggcaagaaguauugaguguuacuauuuuaaucucuuugaaaguuuuggaagucuugaaugaaguggauaccugagugauaccaguuaucaguaaugauugcuauaaauucaaacacaaguuuccucuucucaguuaacauaaucucucuaugugugucuuugucucuuucuucugugauuuuagucuggugagauuugauccacuuggacacuacuuacucacagcaauuguuaaccccucuaaucaacagguaaguuaguccagcaguuccaauuccagcuaaacugugaguucuuuucuuaacuaguauuccaauucugauuauauuggauuuuaauucucaauacccaagucuuaucuuuccagucaagauuuaaagcuagcuucagacuguauauucaggguuauagccauaaucuugacaggagagucgauucugaaacccuccagugauugccucauuagaaguaacccuuaucaucacuagacaguguuggauagcuugucacucaugugccucuggcugguugacauuuugcuuccccucacugcuuccaugucauggggagaugucuuuuguaagacaauugguuugucagcugcacucauucagauaugcugcuaauugggaguggaaaauuuaauaccaugugauuauuuugaaucugaggccaguugucagugcuucagggguagagaguuguuuccuaccuaugaacauuguuuuccuuggaugauugucagugguuaguuuuucuugauuuacuuggagguucuaccuaacugccuugcucuacccccugccccaugcugguccacguugcagggugaugacgaaccagagauccccauagauggaacagaauuaucccacuaccgucagcgugcccuccugcaaucacagccaguucgccggacgccucuccuccacaauuuccugcacaugcuguccucccgcucuucuggcauccaggugggagagcaaagcacagugcaagauucugcuacccccucacccccaccgccucccccucagcccuccacggagcgccccaggacuuccgcuuacaucaggcuccgacagcgggucaguuaccccacagcugagugcugccagcaccuugggauccugugccuuugcagccgcugcucuggcacucgaguuccuucccucuugccacaccaggacaguguccccccugcuucugccagagcuacuaccccuuccuuuucuuuuguacagaccgagcccuuccaucccccggagcaggccucgucaacgcagcaggaccagggccuccugaaccggccgucugccuucaguacaguccagagcagcacugccggcaacacgcuccgcaaccucagucuggguccuacccgccgcucuuugggagggccucugucuagccacccuucuagguaucaccgagaaauagcuccuggguugacaggaucugaguggacccggacaguacucagucugaacucccgcucugaggcggaauccaugcccccgcccagaaccagugccucuucggugaguuugcugucugugcugagacagcaggaagguggcucucaggcaucuguguacacuucagccacagaagggagggguuuuccggcaucaggguuggcaacugagucagauggagggaauggcuccagccaaaacaacucgggcagcauucgccaugagcuucagugugaccugagacgcuucuuucuggaguaugaccggcuucaggagcuggaucagagccugaguggggaagcuccccagacccaacaggcccaggaaaugcucaacaauaacauugaaucugagaggccaggcccuucccaccagcccaccccacacagcagugagaacaacuccaaccugucccguggccaccugaaucgcugucgugcuugccacaaucuccugaccuucaacaacgauacccugcgcugggaaagaaccacaccuaacuacuccucuggcgaggcuaguuccucuuggcagguccccagcuccuuugagagugugccaucaaguggcagccaguugccaccucucgagcggacugagggccaaacgcccagcuccagcaggcuggaguugagcagcucugcuaguccgcaggaggagaggacuguggggguggccuuuaaccaggagacaggccacugggaaagaauuuacacccaguccagcagaucuggaacugugucacaggaggccuuacaucaggauaugccugaggagagcucugaggaggauucacucaggagguaagcagucgcuuuccuaucuucugcaucccuugcuuuucuccuuguaucauuuccuugaguccuauagauguuguggcuguaucuggagugucugggacccacgcaucugcuucugaucucgccauugcauuuucuuggaaaaucuugcucugguggcagagauaggauagggccuagcaguaugagucaguuggcugcgcuagcucuauuucggcuaagcucaagguucuggcuuuagccuugaaaggagaguguagauuagguuagagaggcaugaggagauggaaccauugacuuucucugccugcuuuuugaccuugucgagacauuguaugugcaggacuacuuauuguaguagucccagagugccuaggaauaaguaaaagagaacccugcaugguagagauuaguauauuggcucuucgcugauuguauugcuuuggacaacugaguucacuuccuaauccuuaucuuuuggaacacugcaguuugacaaagggaaaagaaaaaaaaauacauauauguauauauauguaugucaagaaaaauuccaauuuuuucagagauacuuguuuuugggcagccuauugcucaguugagauucucugaauggaccuuccagguggacuuucaccuugggguggagaagaagaauaauucauggaaggaaagacucuccauacucagauuggcauccuagccaacucuuucaugggagaaacagaguagguguaguugaucgcccaccauauguuccauguauggcuaugugcgcaucuaucuugauuuauuagggacuucuuucuguaauuuuguaaaggucaaagcuagcauaaucaccaacuccaagaauaugccuguuggauccaaacagcauauugcgcugcauuacauccucugucgaagcaacugaaauuucucugacauaagcuucuaacaagggugggaauaugaauuaugcacauaauguacuuguuauuuugggaggaugcuuuagacagucacucagucaauaaguauuaguugaaugguuacaaauuuucuaacacugugcuaggcacugugggaaauacaaaagaaguauaauacauggucuuuacccaccugagucuacaguguuauuguggaggcaagacaacgaaauuuuucaaaaguauagaugagcaaaugcuucauuguaugguaccgagauuggauguagucucagagagagggaaguaucauccaagaaggcuuugcaaaaucaagucuugaaagauggauaggauuuggagagagcaagaccuuuuuauuuuagggaaacagcacauguuaagggaggaaaggguaugguauguguagguucuuaggcaguuacuaagggcccuggguaggaagcagagggagacuugacuagaugugaaagaugaauaaaauagagagguugcuaacucugcccauaugcuugaaaccaguucuggauuaacagcuccucaauuccugguuuuggaauauugugccuggcauacuggucuucaucaggagcccgagccucuguucuuccucuuugccaagaguggugagaaggcagucaacacagggcaugacauguaguaggcacuuuaaaaguuuauuaaagaucucuguaaaaggacugucuucaguuacugcucuaagaaaccaagcaguugcuguuuccguaauaccagugugcucugguuagcuuuuguccauucugcuuuaguaguaccucuucaugugcuauucugagaaauuccugagugguuuaaauaaacucuauuguuugaugauaauuagagauaccaguuacugccgggcacgguggcucacgccugucauccaagaacuuugggaggcugagucgggcagaccacuuaaggucaggaguucgagaccagccuggccaacaugguaaauccccaucucuacuaaaaauacaaaaauuagccgggcuugguggcgcaggccuguagucccaucugcuugggaagcugaggcaggagaaucgcuugaacccaggagauggagguugcggugagccaagaucacgccacugcacuccagccugggugauggagcaagacuccaucucaagaaaaaaggaaaaaaagagauaccaguuacugagggccuacuauguguuagguauuguguucuugcuuugaaauaauuccuucugccuucaacaacgacucuaugcaagucagguauucaauuuuccauuuuauaaaguugaggaaagugaggcucagggaagucaguuucuugugaaagaucauauaauaggucucugagugagaauuugaacucuggucuucaugacuaaagauuugugcaagcugcccuucauggcauuuuccuuaauauaacauuuuuauuuuuuugagauggaguuucgcucuuguugcccaggcuagagugcaauagugugaucucggcucaccacaaccuccaucuccuggguucaagugauucuccuaccucagccucccggguagcugguauuauaggcaugcgccaccacgccuggcuaauuuuguauuuuuaguagagacggauuuucuccauguugaucaggcugcucucaaacucccgaccucaggugaucugcccaccuuggccucccaaagugcugggauuccaggugugagccacugcgccuggccgauaacuucauuuuuaagugaaccacuuuuuuucuuuuaauauuuuauuauggaaaucuucaaacauauauaaaaacgaagagaaaaguauaacugagcuuccauacaccuauaaccugacuucaaagguuaucaaugcuuggcuggcuuucuuuaaucuauauuccgucugcucccggcaccuagauaucagauaauuuugucuguaaccacuagauuuucuagagcaaugcuguccaauaaaacuucuuacacugauggaaauguucucuaucugugcuauguaagaugguagccacuggccacacauggcuauugagcauuugaaaugcugcuacugugaucugagaaaauaaauguaaucuuuaaauuuuuaaguaauuuaaauaaucacaugugacuaauggcuaugauauuauacaucuaaaauauuauuaaucacuuaauaaaguagguuauuuaaaacccagaaacuacuggguaggugcaguggcucacgccuguaaucccagcacuuugagaggccgaagcaggcagauugccugaggucaggaguucgagaccagccuggcuaacaugguaaaaccgcgucucuauuaaaaauacaaaaaaaauuagccaggcaugguggugcaugccuguaguccuagcuacgugggaggcugaggcaggagaaucacuuggacccggggaggcggagguugcagugagccgagauugcaccacugcacucaagccugggcgacagagcaagacuccgucuaaaaaaaaacccagaaacuauuaaggauguaccauaauuuuuuguuuaaguauuuuuuucuuuucuggugccaaaaaauauaugcauugugguuuaaaguucaaccauuuaaaaauguguauuauaaaaaugaagucccuggucaucucacuguaaacaauuuuauauuuaugcucauuuucuuuuaaaauauacaaauaacucaggguucucauuguaagauaguauauuaauacaguaguuacauuauuuauauggaaucacuuuuaaaugagcuaggaugucguauaccauaagggcugacagcugucucaaaaaugagguauguuguaaaauaagugcguacacauuaaagaaggaccaccauuugaauggcugcauucugauguaaaucacuaagacaaacaggugcuggucugccucuuccucugccuucuaaaggggcugaaagucucuaggugaugagccaacccuugcuucuaguucuccagcaggugucacuguugggcugcugcugcuagguuaggaugacugggaagaaaaggugucccugcuguuuguguacgagguugguucuuuuaacaaagccuguuuuuguagaugacuguuguuccugagugaguggaguucauaaaaggugauuguacuugaaaggagaaaguuuuguucauuggccuuauaguagaagauaggcaaaggagagaugucuggauccuuggugcugcugggauauuuaauaguguuugcaaauagugaggguauugauaagcauacaguguguauuucaguguagcugugugcugccaagugguaauaaccaguacacgguuugucuccuuuugccugugggcaguggagggcaaacugucuuuuuauaauagucugacgcuacauugcaacuugaguggugggccuuugcuucacuacaaagaaaugauuucucugugugggagugcaggauccagcagaagaucaggguauuguggcuccuugcgguagggugcccuuggccuuuaaaaacugguacuaggaaaaagaaaaugguuucaauggcaaguuaaaacuggagggaaccuagaacuuuuguagucuagucucucucugaugacaaaacagagagaguaaaugauuucuuaaagagguguuuguaagcaaaagugggguuugaacuccugggcccugaagagggcacccuuuccuccguuucauuugaaauaagugccuucaaacagcaguuuucuuugucaaaaccucuguugcucauguaggucauugccugagggaacuuuucaguuaacucuuauuguaagaaauuggaggucuguuagauaauuuguaauuauuauuuuuggguagaaugguaacuaacacaaugcuucuaggagaaaugcuguuuuaguuauuugcccauagaacuacauugauuaaucccaauaaagugaucccuguuagggauguucacuauuaaaauuccagcaacugagagagauaaaaauuggucucaaucuccuccuagaagcacuaauuguuucuguauucugucucuagguaguuaaagacuugggucuggaguauuuaguaagacugagcgucuucugagaauuuaggucuuuuucucucaugauagaugaagacuggggaaguacauugacggccuuagugugaaauguggccaucaagguuagaguuagaagcccucauuggauugcuaaguuucuuagacuuuuaugggggaauugcuuuggagcuuagaacagucugaagcccuuugaggcuucgugggccaccacacuuauuugaucccucagcuccagucacuuggggauucuccagggaggccucggcccaaacauugauggaggaaaauaaaugggugucugcggggcugauuguagguccacaaaagggggccggcaaccuaaaaaugaggaaaguagcagucuucuuagccugacuacuauagaaagggguccaaauuuaguaguuuuucugugccauugaucuagcugagucuaaagaguuucgauaucuaaucucucccaguuucuuuggauggggaauauacacaauuuauuauucaaaacccagcacagcugucaccgugucccuugggaaaccuucccugacugucccaaguaaucacuuccuuuucuuuguugcauguguacuagauacuucuuugugauauugcacccaugacagaaaauuauuuguuuaccuuuccgucagugagcucccugaaggcagugaucaugucuguauauaucccuugucuaccuagaauacuaccuggccacacaguagaugcucaguaaauguuaguugaauugaauaaguagaauugaaauuauguuccuuaugguuucauaugcaauauaaguccuguuuggccuuuuuaguaaaaaagauuaaaaaaccuauuacuauaucccaucauuuggucuuacagagagucauuggcucaauaaucacuuguuaaauaaaugaaacgguauuacuuagaguuguacaaggaagucacaccuuccaaaacuugagcuccggugaccucugauguuucacugugugcuauguuccuaacuugugaauggguuguccugaagccuguaauaagucuguugcaccuggccaauauguguccuucauauuggcuuuacacugaugacucagggucugcgccuuccucgagagcacuggcaucauaugcagccuucccuuuuuuuaucuuuuugguaccccauuccuauugaauacagcuugcucuugacaccauuuuguuggucuuuggcuuggcaucucaguaauauuauuaggucuuuggcuuggcaccucaguaauauuauuaucucugccagucagugcuguugguauuuuuuuucuccuuaaagauucuucugcaaucucuaugaagguauacuuggucuugauuuaguucaaaaauuacauguggauaauccaauuuaaaugcgaagguucuuuccuacugaugcuuuuucuuuaaguuucuguggaaggcauucauuaaauuugcuuagaaguaggauuuuuaggguuugagaaaaugugugcucucaucuuuuguuuuggagucugagcaucaugagagugaaccuuguuaaguuuugagaugcuuguaggucccuuuuuucuuguggaggucagaauccuuauguuaguuagcagaaaguuuugcuuuaccucuaauuaugcggagugugaauaguucccccugaaaaaaacugguggaauuguugucuuugguauucaagauacuauacaguaaacgcuuucuaacuucugaguucuucuuaguuagaaguucggcauuuaaggacaaauaggaaagaauccucaacugugagaauuucauuugugauacaggcaaauuaugacguguucuuucuaggaagagagaggaacaaguauugggaaauaaaaaggagacaaagccugugguggaauuaacaaacuuauuuuaagagauguaagggaagggaagcuggggaagguaaacucaggcuuuagaauaggguacugagggcugggugugguggcucaugccuguaaucccagcacucugagaagccaaguugggcagaugguuugagcucaggaauuugcgaccagccugggcaacauggugaaacccuaucucuacaaaaagcucaaaaauuagcugggcaucguggcaugugccuguagucccagcuacucguggggcugaggugggaggaucgcuugagcucagaagguugaggcugcagugagccaugauugcgccucugcacugcagccugggcaacagaguggagacccugucucucagaaaaaggaagagggaacugaggaguaugcacaaggacugcuuccuggaugaguuugguucuuccuaauaacgcugagaguugggcuuguaaacugugauugauccaugcauccauccauucacucauuccauuaacagauauuuaccaagcaccugcuggauuucaggugcuauuuauuuuacuuuauuuugagauggaguuucgcucuucuugcccaggcuggagugcaauggugcgaucugggcucacuguaaccuccgccucccggguucaagugauucuuuugccucagccucucaacuagcugggauuacaggcgccugccaccacgccuggcuaacuuuucuguauuuuuaguaaagacgggguuucaccauguuggccggacuggucuugaacuccugaccucuggugcuccgcccgccucggccucccaaaguucugggauuauaggccugagccaccgcaccuggcuggcaccaggugcuauuuaaaugccagcaauaauucucucauucuaaugggagaaagacaauaaaaaaauaagauaucuaguaugccagacagugauaaguucuauggcaaaaaagagaaauguauaaaaaauguaggggaugcugcaauuugaaauaggaucaucaaaaaagguuugauaagguuacacuggagcagaggagaccuuaaagaagugcgaaaacaaaccccgucgacacuaggggaaggacauuuuagacagaggaaagggcgaaugcaaaaucucugagaugcuuggcaccgucagccagugcagcuggagcacagcaagggauggagugauagaagaugaaguuggagaggugacaaggaugagauuaugcagggucuucuaagccauuuaaaagauuuuugccuuuuccuuugagugacuugggaaaccaucagaaguggaguagcaugaucuuauauuuuaaaaagauaacuguggcugcugguugagaauagaccuaggagcuaaguagcguaaauuaaagcuaggccaacucugcacacuuuuagauugauuugugucuugagacuguguugagaaccaaaaaggaggagugacuuguucugucaagauaagagaggccuuaaauguuugggugaagagcugaugaacgguugaacaaaugaaugaaucaaucaucucagcaggcauauuaccugcaacaaagccccuccacucuuccccaaccuccaaacaagaaggcguguuaucgaacugugaggaagggagagcuugaaaaauuaauaguaaacaagagaucauaaauggaaaugaaauuccuguuuuuugcuaauuacaaaacuauugucaauucauuuguaaaaaaucaaacauuacagaaauguacaauuguagaaaguggauauccucuuaaagccacugcucagagaucugcuauuaacaauuuguguguguguuaacuccagaauuuuuucuaugcuaaucaaaacacauuuuuccauuuauuuuaauucuuuuccuuuuuuuuuuuucuuuugagacagagucucgcuuuguagcccaggcuggagugcaguggugcaaucuuggcucacugcauccuccaccucuggggcucaagcgauucucgugccucagccucccgaguagcugggauuacaagugugugccaccaggccuggcuaauuuuuguauuuuuaguagagacaggguuucaccauguuggccauguuuuguuuucuuuuucacaguguugcaggaucuuuguguacuuaaguguuuuuagaagaugaaguucuagaaguggaauugcuagugcccaagaguaugagcguuguuagugguaaaugaaaauuaauuguaugcuacucauuauuacuaauguaagauauauaaaguauuucuuauuuccuguuuuauuuaacugaacauuauuucauagauuucauagauuagaacucuuaaggccgggcacuguggcucacgccuguaaucccagcacuuuggaaggccaaggugggcggaucacaaggucaggaguuugagaccagccuggccaacauggugaaaccccaucucugcuaaaaauacaaaaauuagcugggcaugguggugggugccuguagucccagcuauuugggaggcugaggcaagagaaucgcuugaagccgggaggcagagguugcagugagcugagaucgcaccacugcacuccagccucggcaaaagagagaaacaacaucucaaaagaacucuucaaccuuucuucccccauaagcucuuaagcuuaucaguaguaaauucuccuacuacggguuuucaggagcuuccuccucaaguuuuugagaaaaacuuuuguuuuauucuaauaauugccaccuugagguguuaguguacauuuguucucugacacccuuguaugagaaaaacauagcccuguucuaucucugacaaucacauacauacuggccuucauccacuuagucuucugugucuuauuaagugauuggaaaaauccaggcaucucuugccucuucauaagaaaguaauuuuauauuaauuaauuaauuaauuuauuucugagacauagucuugcucugucacccaggcuagagugcaguggcccgaucucagcucacugcaacuuccgccucccagguucaagugauucuccugccucagccuccugaguagcugggauuacaggcgcccaccaccaugccuggcuaauuuuuuguauuuucaguagagacaggguuucaccauguuggccaggccggucuugaacuccuaaccucaagugauccgcugcccuuggccucccaaaguauugggauuacaggcgugagccaccucucccagcuggcaguaacauuuagauaucgaauguauucgucauugggggugguuaggcaacccauuuucucuuuggcaauaugggaaugaggauagagugaaggagggauaucauucuguuaaucuuuuuuuuuuaagauggagucucgcucugucacccaggcuggagugcaguggcagaucucugcucacuccaaccuccaacucccgaauucaagugauucucuugccucagccucccaaguagcugggauuacaggugcccaccaccaggccuggcuaauuuuuguauuuuuaguagagacaggguuucgccauauuggcugggcuggucuugaacuccugaccucagaugauccgcccaccuuggccucccaaagugcugggauuacaggcgugagccaccgcgcccagccucauucuguuaaucuuucuuaccuuugcugcucaccugcccaagaaggucacucuguuugagccucugaauucuguguguguucccugcccuacccucuauaucaggcauuggcaagcuuuuuguaaaggucaagauaguaaauuauuuuaggauuuggaggcuguacagucucuguugcaauuacucaacuuugcuguuguaguaugaaagcaaucacaaacaauaucuaaaugagugagugugggccuggugugguggcucaugccuguaaucccagcacuuugggaggccgaggcagguggaucacuugaggucaggaguuggagaccagccuggccaacaugucaaaaccacaucuccacuaaaaauacaaaaauuagcugacaugguggcaggcaccuguuuucccaacuacuugggaggcugaggcaggagaguuccuugaaucugggagguggaaguugcagugagcugaaaucaugccacugcacuccagccugggcuacagagcgagaauucgucucaaauaaaugaaugaaucaaugaaugagaguguggcuguguuccaaaaaaacuauuuauggagauaaauuugauuuucauauaauuuucacgagucauaaaaaugcuuuugauguuuuucaaucauuuaaaaauaugaaaaccauucauagcugguuuuggcccgcagguuauaguuugccagcuccugcuuuauaggaaugugauuuggaagagucaggugcuagaguaauagaaggcauuaugacaaugagggccccaaagagguuguuaggggacuccugcacuugcucucucucuaguuuggacuagaugcucuaaguaaguauuggcucuugugggauucuuugaugguuaagagcaggcauaaaugcauaaagaauuuguuucuuguacuaucuggccugaagcaagguucuccagccucacuuucuuucuugggaaucgugugcaaaugaggaggcuugcccugguugggagggcaugagccuccagauccuccaggcaguaugcuuggcaggcagcccuucucccagugcaggucaugcuagcaccuacuaggcugaucuaaauuaucccucaucauuccucucucuggggcugaaugguguagagcgugcugugugcuuuguauacauccugaaacaugaaaagauguaaucgcuucugucagcucugggucuuggagcacuuggggacuacagugacgucuguaugugugcugcaaauacguugggaguaauuucccguguacucauucuucccccuucagauccccuucucuacuguaucuauucagaguagugcucuaaagggugcuuuggaggcuuuuccaagacaguaacaccagguguaugggguucuguuugcauaacauauuuugcuuauuguaauuggucccagcccauuagaacugugcagguagcauccucuccuccuggauuucuuacacauuuauugagugguuggggggugggcccaggauucaguacaucuuauuucugcucuuucuuggaagcauuccugacaacauguuugugugagcaaauuuugcuuucaugggugggccuauuguuacauuaaccaagauauugcaaaauaguccucaaguauguuuguuugccucacaguguuucuaaaaauuuggauguuuuuuuuccauaucaauucggguaucuggauucuguugaaaaaacaggcucacauucccaccuaacagucagcaggaauugaguaggacagcagccccuuucgucaaggcauggacuuucuugaugccuuagucuaugcuaggcugaugucauguuuccuacuuaaauccaauuuuguguacuugaccauugcauuagcucaagcaaaaaguguugaugguuagguguggguaaauauuuccuaagugcccuaccacuuggcuccaccagggggagucacuggucauugcaguacccgcaccaccaccccacccauccugccuaauucacccacaggggcucccccugcuugcuguaggcugacaugcugacagcccccucaccugagaagcugccugauuuuuaaauagcaacaauuaacaaacuccuccucuguuuccaaagggggaaaauggagguuccaagcuuauuugcuggaugaggcucacuagugagcagaucuccauuacgccagauuaugcaguaugagagcaaccuucuuuuggacuauguaaauggacuauguaaaaucuuggagaagaaugccugcaccuuuugcagagcaccuuggacagagugguggguuccaaugaaaagccugcaugacuugggugucacuugccaggaaauuaaaaucaaguuagagcaggaguagaaaauuguaauaauaaaggaaucagaggcugaaaguaugaccuugucauagaaagagaauugcagcuuguuaacauugugcccuuuuccuuugcugcaucagaggguacgugugacucuuuuugccucuucugcuuuuuuccuccccuacacagagguagcccagcuucuacugccuuugucuccuugcuguccccuugggucauuucaccucagcaagguggcguuuaucuuuucuuuguucuguuggcacauguaacccuuuuuaucuucguguacgugugucugugauagaaaacauaacauagauuuacccucuuaauaauuuuaaaaguguacaguacacauuauuguucaauagaucucuagaaccucuucaucuugcgugacugaaacucuguauccuuugaaugacuccuuuucacccucccacaagccccuggcagccaccacucuacuuucuguuucugugaguuugauaacuuuagguaccucuuauuaauggaaucuugcaguauuugucuuuuugugguuggguuauuucacuuagcauaauguccuuaaggaucaucuauuaauaugucacaguggcugggcgcgguggcucacgccuguaaucccagcacuuugggaguccaaggcaggcagagcacuugaggucagguguucgagaccagccuggccaacauggugaaacuccauuuguacuaaaaauacaaaacuuagccgagugcgguggugggcaccuguaacccagcuacucaggaggcugaggcaggagaaucgcuugaaccuggagguggagguugcagcgagccgggaucgugccacugcacuccaaccugggugacaaagcgacacuccaucuccaaaaaauaaauaaauaaauaaaagaaaaaguuguauguauguaucauaauuuccuucuuuucaaaggcugaauaauauuccauucuauguauauaccacauuuucuuuauccauucaucuacugauggacauuuaggcugguuccacauuuuggcuauuuugaaaaaugcugcaaugaacaugggugugcaaauaucucuucaagauccuguuuucauuucuuuuagauacauaaccagaaguggaauugcuggacauaugguaguucuauuuuuaauuguuugaggaaccuccauacuguuuuccauagcagcugaaccauuuuacaauccuaccaacagugcaugaggguuccaacuucauauccuugucagcacuuguuauuuccuguuuuuuuuuucuuuuuauaguggucauccuaacaggugugaggcgauaaauaaaugugguuuugcuuugcauuucccuaaugauuagucauguucagcaucuucuuauaugcuuguugaccauuuguauaucauuauuagagaaaugugcaugcaagucuuuggcccauuguuuaguaugguuauuugugggguuuuuugguuauugaguuguaggaguuccccauauauuauggacauuaaacauuuaucugauauaugguuagcaaauauuuucucccauuccauagguugccuuuuuuuuuuuuuuuuuuuuuuuuuuugagacagucucacuuugucaccuaggcuggaauacaguggcaugaucucggcucacuguaaccuccaccuccuggguucaagcaauucuccugcuucagcuucccaaguaguugggauuacaggugcaugccaccaugccuggcuaauuuuuguauuuuuaguagagauggggucuugcuguguuaccuaggcuggucucgaacuccuggcuuccagugauccucccgccuugacuucccaaaaugcagggauuacaggagugagcaacugcugcuggccuccuacuucuuugauaagggagguagcacaaauagccuuaauuucucaaauucuaggaccauuuucuacauugaaagggagccacccagggcugaaauguguuucagaaagauggagagccuugagauaggagagagugcaagucuuucuaaaugaacauugacccuucugacuaauacaggggccuuaugcuuuacaaacagugagcaaguuuacacuugcuuuauuaugaucuguuuucaaaugccuuuuuuguuuuuaguagccaagguuccuuugagaagagaugugauuuuggcuguaaacuaaccucauggacuuaguucuaauguugcuguugugccuagcuugaaaguuuuacaaagauaaggaacuacuuuguucacauauugguguauaagaaaccauacuccaaaacuuagugacuuaaaaccgauucaguuauuuuucaugguuuuuuuuugugugugugggguguagacugggcucaguuggaaaguucuucugcugaucuuccuuggguuuucucuagagucaucuggaggcccaguuagaauaaacugggucucucucccuugucauguagacucaggggcucuucucuccacauggccucuugagagaguagccaggcuuuuuuuuuuuuuuuuaauuuuaauuuuuuuuuuauauuucuuguuauauagaugacagggauagcagacuucuuacauagcagcuuaagguuuccaaaagugacaguucuaaaaggaaggaaacagaagccugccaguucucuuaaaacgguaggcccagaauuggcacagcuugcugcauucucuugauuaaagcuagugauagagcagucuagauucagugugggaggggaccacacaagggugagaauaccaagaggauauuucuuuggagccaucuuuggagauugacuacucuaagggccauaucuauuuuauuuuauuuuauuuauuauuauuguuuuuuauuuauuuuugagccgauguuucgcucuuguugcccagacuggagugcaaacaaugcgaucucaggucaccacaaccucugccucccagguucaagugauucuccugccucagccucuggaguagcugggauuacaggcauauuccacccugccuggcuaauuuuguauuuuuaguagagaugggguuucuccauguuggucaggcuggucuugaacucccgaccucaggugaucuguccgccuugaccucccaaagugcugaaauuacaggugugagccaccgcaccuagccuauuucuuuuuugagacagagucucgcucugucacccaggcuggagugcaauggcgugaucucugcucacugcaaccuccaucuucuggguucaagcaguucuccugccucagccucacaaguagcugggauuauaggcaccugccaccaugcuggcuaauuuuuuuuuuuuugagacggagucuugcucuguugcccaggcuggagugcaguggcacgaucucgggucacugcaacuuccgccucccggauucaaaugauucuucugccucagccaccagaguagcugggacuacaggcacgugcuaccacucccagcuaauuuuuguauuuuuaauagggacaggguuucaccguguuggucaggcuggucucgaacuccugaccucaagugaucuugaucuaccugccuuggccuuccgaaguacugggauuacaggcaugagccaccgcgcccagacuugacacaucuaaguuuuuguauuuuuaguagagacaggguuuugccacuuuggccauggcuaagcuggucuugaacuccugaccucaggugauccacccgccuugaccucccaaaguguggugugagccaccgcgccuggccuauuuauuuauuuauuuuugaaacaggguuucaaucgguugcccaggcuggaaugcagugguaugaucucagcucacugcagccucaacguccauggcccaaggaauccucuugccucagccucccaaguagcugagacuauaggcaugugccaccaugcccagauaauuuuuaaauuucuuguagagaugaggucucccuaugguugcccgagcuggucucgaacuccugggcucaagguauccucuugccucagccucccaaagugcugggauuacaggcaugagacaucaugcccagcccacaucuguauuuuauauaguacugauauauauaacuaacagaaggcacucaguauuuguuugaaucaccgguuggauggaccaacacauagauugguagauggauaccugacuguucuuguugguuuacguggauggggugcaugugauucucacggcucagguaccccuguuuauaccuuuauaguauucacccuucuucaacaugucuuucuuucugacaaaguaccuuuuuaggcauagugacuugaguggacagagggcaucauauucccugcagauauuuugggagcuguaaucuaaggaagaaaaaaauaguaauggcuguuuauuagacuguacuggcuacugugcuugacacagguucuuaaucauaauaaccaugugaaauaagagauuuccccucaaauguggaagcagaggauaaugaacuugcccaaggucucacagccagugggugacacaagauggaauuuaaacugcagucugucugauucuaaggcucaaacacuaaauugccucauauuuuaguuacucagaguuuucuugguuagucucagaccauuaagauauaucaaaagguuuuauaacagcagcacuauugacauuuggggcuggauaauuccucaccaugggaggcuguccugugcauuguaggauguuuggcaccauuccuggccuucaccugucacauacugguggugcucuggcacccagaagcaaaaaccaaaaaugucagcagacauugccacauuucuggggggcauuccacuccccuugaaaagcacugguaaauuauuucaugauuuguuguccuuugaucuugcugguuuuuaaaaauaugacauuaggccgggugcgguggcucacaccuguaaucccagcacuuugggaggccgaggugggcggaucacccgaggucaggaguucgagaccagccuggccagcauagugaaacccugucucuacuaaaaauacaaaauuagcugggcaugguggugcaucccuguaaucccagcuacgugggacgcugaggcaggagaauugcuugaacccaggaggugaagguugcggugagccuagaucaugccauugcacuccagccugggcaacaagagcgaaacucuaucucaaaauaaauaaauaaaugaauaaaacuaugacaucucacaaggaacugucaguggguucaaaccaucuucuuaugauaguuaauaguacugccugguucugguggucuugugucacgccuuucucucauugcuucucuccucuucugucuuaucuuuugucuuuugucucugauuuuucuaaauaaagcgcaucuggguaaagcgguguuugugggacuuuuuacacagguaucgauuuagcaggcauucagaacucugagauuauagccauuagugcuaauaaaaagaaggcaauuuacaucuucugauuauaguacagggggaaaaugcauaauuuuuagcaagcagggaauugaauggcuuccagacucuacagaguuaauccuccucaggguaguauugauugacaugcuggaggacguuaaugugcgaaucuuuuugggaacgggggaggagaguggaaauugcaguuucucuacuaauuguacuuuaggugucguuuaugacaauuucauguugucuagacagagggaaaugguggagaaauuauuucaguagagucaaauguugaguccaaaaggaaucagggugguugcugaagucaagaucagggugaaagggcaaguaguacauccccagaggcgaaucagugaaaucaaaugucacuaagagaagcaguucagaaugaaccuuggauauaagaaaagugauuguacucugagcuuuguguuagcucaagggcuaacaguggauuguuuggggucccagcuguagucucugcccucauauuucugcagauucuagaaaccucauuccauggacagauaugagcugggaaauuggccuccuugccucugguuaauaaacaccccagcacacugugcuuugcuuuucccucauucucuugaggcuucacguacuaacucgcuuugccuuucugauauucguccuaagauuuuacuuccuauuauauaguguuugcaguauaccagggugaaggaccugucacuucuuaaugaauggccuuggucaaggguuuuuaaaguuucaggucagaaauguggaugugaaaaaauguuuuuuaagaccuucacaggcuuacuaguaucacagcaauaaaugauucuaccaggauauucuucguagacuuaguuggccuggagguagacuuuuaaggauauaucugugcuucugaauaaaauuagcuaagaauucaacauuauggaauucaauaaauuccagggggaaaucagugaauuaggauacacugccucuuaaauucuaaacccuauauaucccaccuguugcauguagggggcaugugugcauguggcaucaaaacuagcuguggaccuuuuuuuuucccauagauuuggucuuacucauccucuggugaaaagccucugaugguaaauucuggguuaaaaaaaaagucuguggucugugagcagaccucccaagucucccagggaaauggauuuggauacuaaguaaagauguccauguagauuggcuugggccuuugaguuuacuugcuaacuaaagugaguuuuuauuauacauucaagucuuacaacuauaguguaauguguugaggguauauaggagcuaagcauagugccaaccagucaucuuacaaauguauuaaaaauaacuacccauguauuaaaaauaacuacccaccagacaguuagcagagggucauauguucccagggggaacuggcugacuucucagacgagacuuuuguaaugcuagauacaugauugcacacuauguauacauucuguuucuagccucuucccuuuugcugucugcgauuauguugugcucucauguuuugccaucuaucgcucacugcccagaggcacugaggaauacauuaauguuuuguaaagauguuuuuaagcguuucuggugaaaagcauuauuuugcacucugugaauuguuuauauuugauaauaguaaaauaaggcugaucuacacuguaggcacuguggugucuuuuuguaguaugucuauuuuuuuccugagguuacuagcauuuuagcagugguaccuugccuuggcccaccucacaucaggggcaggaauugccugccagucucugcuggcaacugcaucacaugcuuuaagugcaccccucaaacuagggggcccugcagcgaucagaugaaugccuaucguuggauaacuuaaacgauaauugcuagugugugaaauggggaggcuuggaugccucugcauuagagcagagaugucaauuuggaaaucauaauagaggugucguuucagaacacacaauuauuuuuuacaaagaauaagggcuugucaucucccagcccaggcaugcgccaaggcagagaucggggaguugcagaguaagauucagaaaugaagaaagccacagugcguucaaguuuauuuggccuccugccccuucauccccuggcaaacauugcccucuuuccccugugggggucucuuuuggcaauuuacaguccaggagcaucagugguaguuucccaggcaaguagccagccucuggcuuuuugauuuaaugagccucccagggaccagacugcacugcauuuaucaggacaacuaugucagcacuuuaaccugagcagcauaagugaccagaggggaugaaggugauguaagcaguuucugaaaaccuuguuccuucaggaguuuuagugugagguuuugggcaucuagcaaccuugucugagagucuugucgccagugaggggcaaccagauaggucuucuugcuuauucuuccaagucugguuaggcugcugauucaucacuuaaauauuuguugguuuccuauuacauguuaauuaggaugugaguuuugauggggauaaaaagaugacuuggauccaguaccuguuuucauguagcaaagacaagacauaaguuacugggugacuugagaaggccucuuaagagagguacaaaaugcuauaggggccgggcgcgguggcucacgccuguaaucccaacacuuugggaggccgaggcgggcggaucacgaggucaggaaaucgagaccauccuggcuaacacagugaaaccccgucucuacuaaaaaaaaaaaaaaauacaaaaaauuagccgggcuugguggugggcgccuguagucccagcuacucgggaggcugaggcaggagaauggcgugaacccgggaggcagagcuugcagugagccgauaccacgccacugcacuccagccuuggugacagagcgagacuccgucucaaaaaaaaaaaaaaagaaaagaaaaacaaaaugcuguggggcacuggggaagagagggugaacuucuggcuggaggagucagguauuugagcuuugaaggcuuuuuacagacaguaauaaggaagaggaacuuuccagaaagaagaaauugccaagauaaauaacguaggugggauagugaggguguguuuaguuuagcuagaacaauggauccccaaagucaaaacuauuuuuauaauaaugcugagacauccuuuguguuuuucacucucauucuuucacaaguauacaguguuugcuagaggcuccaugacauguaaugaggcuaucauccugauggcuaauugaaugugugcuuguguauuaaaauuuuuucaguuuuaauuucaauaaauugaaauuaaauauugauaguggaaacccauacaaaugaaaucucuuuaggagccucguaauuuuuuuuuuuuuuuuuucgaggcggaguuucacucuuguugcccaggcuggagugcaauggcgccaucuugggucacugcaaccucugccuccuggguucaagcgauucuccugccucagccaccugaguagcugggauuacaggcaugcgccaccaugccuggcuaauuuuuuauuuuuaguagagacgggguuucuccauguuggucaggcaggucuugaacucccaaccucaggugauccgcccaccuuggccucccaaagugcugggauuacaggcgugagccaccgggauccucauaauuuuuaagaguguuaaaggaguccugggagcaaaaaguuuguaaaccacuggacuagagcauauaguauauccaaaaggaaugagaaauuuggcugcaaagcuugaauaccaaaugcccugcugaggaaucuggauuuuauuuccuaggcagaaggaagcuguuaauuuggguuuggugcucccggauggaaauagcgguugccauccagacaucaaagcuaggcuguaaaguuauucauuaggcauggggcaccaguggcaccuuaccuucugggagccagcauucccuaacaguagaggccagagaguucuagcaauugauuguuuccagugguuggagaaaguccaaacauguuuguuugcuuuaggauauugauuuuucucugugaucugacaaccaguuaaaagaguaucuucagguuauaauuuuuuaguaaggaggaguuguccacgguuuguuuauuccauauggacuaguacccagacuuucugcaccucaacucugauaucuauugaauuugaagugaaggggccgggcaugguggcgcaugccuguaaucccagcauguugggaggccaaaguggguggauuauaugaggccaggagaucaagaccagccuggacaacauggugaaaucccgucucuacuaaaaauacaaaaauuagccaggcuugguggugcaugccuguagccccagcuacucgggaggcugaggcaagagaauugcuuaagcacaggaagcagaaguugcaguuagccaagaucgcgccacuguacuccagccugggugacagaaacucugucucaaaaaaugaaauaaaauaaaauaaugaagugaagguucuuuucuuucaguugaucugcuccgaccacuuuuuuucuuuuccagagcuuucuuugacuauuuuaaaaauuguauuccuagugaucaagaauacagcugauacagggaacuucuuugcacauaacucagaauauuaaucagggaaagaaaaaauaguuguauucuuuuaaaaauguucaggauuucacaguuugaauuauaugccuauuaugauuuuagcagagcuuaauauucauuuuugauguuuuuuuuccagugcacaauacuuuaauuucaaguucuuuuuuguucugucccuuaguaauuuaaagaauucuauguaagcaaauguuuuagagcagaaaugggcgaacaucuucuguaaagggcuaggcaguagguauuuuaggcuuugucucuaucaggauuccucaguucugccuugccagcuccaaaguagccacuuauuuacaaaagaagacagcugaccuggggccuguaguuuaccaaaccugcuguagagcauuagggcaaguugcuauucuaagaaaucuuuuuacaaagugaguaauucuuuuuuuuuuuuuuuuuuuuuuuuugagacggagucuugcucugucaccuaggcuggaguacagcggcgcuaucuuggcucacugcaagcuccgccucccagguucaugccauucuccugccucagcuucccaaguagcugggacuacgggagcccaccaccacgcccggcuaauuuuugcauuuuuaguagagauggaguuucaccauguuagccaggcuggucucgaacuccugaccucaggugaucugcccaccucggccucccaaagugcugggauuacaggcgugagccaccgcgccuggccgugaguaauucuucugaaaacaaauggcuaucucuuucuuuucaguauuuuacuuuaagauuuuuguguguuguauguuuuuguuuuucauuuugaaauaauuucaaacuugcagaaaacguauagaggauucccauauacccuuuacccacauucccuaaauguuaacauuuugccacauuggcuuuauuaucuucuuuuguucucucucucucuauauauauacgaauauggguauacuuuuauaugcuuauaguuuuuuauauuuaagcuuauccuauucuuuaaguauuuggcauuuuuuuuuuuuuuuuuuugagacagagucugucccuguugcccaggcuggagugcaguggcgcgaucuuggcucacugcaaccucugccucccggguucaagcgauucuccugccucagccucccaaguagcugggacaggcgugugccaccaggcccggcuaauuuuuuguauuuuuaguagagacaugguuucaccauguuagccaggauggucucgaucuccugaccucgugauccaccugccucagccucccaaagugcugggauuacaggcgugagccacugcacccggccuguuuaguauuguuaaaguaauauauaguuugauagagcaguggccuucagacuuaaaaaaaaaaaaaaaaaaaaaaaaaaaccuuauuaauaaaaugcuuucuagccgggcgcgguggcuuacgccuguaauccuagcacuuugggaggccgaggcggguggaucaccugaggucagaagauugagaccagcuccagccaacauggugcaacccuguuuuuacuaaaaauacaaaaaucagcuggguguggugguggacgccuguaaucccagcuacuugggaggcugaggcaagagaaucacuugaacccgggaggcggagguugcagugagccgagauugcaccauugcacuccagccugggcaaaagagggaaacuccaucucaaaaaaaaaaaaaaaaaaagcuuuugaguaauccauguguguuaugauuauauauuauauagcagaaguuguaauauuucccccuugcuguccaauggaucaaauagcacaaccccucguauaccucacuuggacaccagugguguauaaaaugaaccaggcaaguagagaaaacaaggaaguauuuuguuugguuguauuguguuuuuguauuuuuuuuuucuucagcuucagugauagcagcuucgaaccugaacaagcuugucugagcccuuccuaggcccucccugauuucuugugauagauuaagucaagucaaguuugugguggucacagcagaaugugcagaacugccaucgcauucaauuuucuccuaccauuucccguugacagcugucuguaacaggcuaacacugggaaagaaagaucuuuuggccgggcgcagugggucacgccuguaaucccagcacuuugggaggccgaggugggcggaucaugaggucaggagaucaagaccauccuggcuaacacggugaaacccugucucuacuaaaaauacaaaaagaaauuagccaggcaugguggcaggugccuguagucccagcuacuugggaggcugaggcaggagaauggcucgaacccaggaggcggagcuugcagugagccgagaucgugccacugcacuccagccugggcaacagagcgagacaccgucucaaaaaaaaaaaaaaaaaaaaaaaaagaaagaucuuucuuugagguuccuagcaauggugguaaacauuccuaggauguuuacucaucuaguaacucuaguucuuuauuccacaccaauuggagaagccuauuuuuacuccagauaguacucguauuguaacuaugaagaacugauguuucaucaguguauauguguauucauggugauuggcuuuccugcuuuugugcauuagcaguaaagugacauauauauguggcuugccaguuccacuauauugucugggcagcaaauguugccaacacauuccguaguaaguaggcacaggggaugcguguuccaaaagaaccucaucagagacucuccagcaacaaagcuucauauuuugggucuauuccaacuuaaagaagucuuccuaauuaagguaggaaguuaaggugggaaauagacuuuuaggauuguaaaauggagucauuaaggccagcacaguggcucacaccuguaaucccagcacuuugggaggccaaagcgggcggaucagaaggucaggaguuugagaccagccugaccaacauggugaaaccccaucucuacuaaaaguacaaaaauuagccgggugugguggcgcaugccuuuaaucccagcuacucaggaggcugaggcaggagaaucgcuugaacccaggaggcggagguugcagugagccaagauugcgccacugcacuucagccugggugacagagugagacugcgucucaaaaaauaaaaaauaaaaauggagucauuaaaacugaaguuaccuaaugcaaacccuucagaucaggaaucuccuuuacagcauuccuaauaaaucaucucaucucacucaguacugucauugccuuagcagauuggggguaauauuugcuuuuguuaccauaauuaguuucuuuaagaaggauguauuuuuguuuguuuguuuguuuguuuguuuguuuugagaugcagucucacucugucacccagucuggagugcaguagugcgaucucagcucacugcaaccucugccucccagguucaagugauucucgugccucagccuuccaaauagcugggauuauaggcacgcaccaccacgccuggcuacuuuuuuguauuuuaguagagauggagucucaccauguugcccaggcuggucuugaacuccugagcucaggcaguucacccaucuggccucccaaaguguugggauuacaggcgugaggcaccacgcccagccaagaaggauguuuuuuggucacuguggaggaugcugcuugccaaagggccucagcuuacuaaacgaccacuuggaggauaacacaacagguggugacauucaggacuaacuccagagcacuuuaggguggaacaagcuucuagguauucuaggauagucagcugcucccagaccuugcuuccauucuucaacucacacccaguuccugaagaacugguuuguuaaaugauaaauaaguacuauauaagauggcauaaaugaccugaauacucuucucaaaauuuugauuuuccuuuuuucccagacucuguaucucucacuacccuuaccugucccacacauucuguauuuuaaaagacucaaagacaugccguuauuuuauguguuccuaugaaaucaugaaaaaauccugccagugggcaggcacagugacuuauggcuguaauccugggacuuugggaggccgaggcaggaggaucacuugaggcuaggaguuugagaccagccugggcaacauagccagacucugucucuaucaaaaaaaaaaaaauccugccaauuaaacugugucacacaacuguaaaauacaccccaaccucagacacauucaaaggugaaaagugugucuuagaauugaugaaacagcauuucugccacauuugaaccacagugauguuacugaagauuuagucuuucaaccagagagauguauuuuauugcuuuccucucuuccuccuuguuuacauuguguucucucuguucagugguaggauuguuacaagugucuaaguauggggauauaggccuugucuagagagaaaacauuacuugauaguugguuguccugggcaggaaagguugcaagccagguuguuagggccuuugcuaugucucuuccccaggcuguuaggggaaguacugcagugggccaguugcuggaauaaagugaccgcacaggacuauaccuaaagccagaugguuuuaguaacagugaauugaauuaaaucaauuggaaaagauugguagcugcuguccuuauccugcaggucugcuuuaaagaagagucuggcagggagccagggaccuguuccuaggaaaggcaggcaagaugcugcuggagaggaacaauaugcguuccucucugagaccauuuccuuugaaacauguucuggggcaggagcuugauuggcugccaaggcacaugugaguugggaagcaccaugucagacaugcaaaccagggagccccugggccguguuuauuauacguguucugacuggcccuuguuguuuaaaaaaaaaaaaaaaaaguuguagcuaaaauuuaacaaucaggagauuuuauacaaaauuccagauuucuagcuuuccuuaaaaaauaggaaaagccagcaauacugagccuauauucuagcuuaguaacaauuggcuggagcuaaaugaugggccacagaccuuccuguuugucagucuccauugaauacauaugcucuugcuuccugccuggaccguggaaggucuugcaguacaaaauagagauuugaggcauuuuggaguuaagacaggccuucccuggaguccuguuacuaucucuuaauaguuaugugccacagagugauacacuuuaacuucugggcccaguguucucauguauguagucauaccuaccuuucuagguuguggugagguuuaaacaaauacauaugaagugcucaguauuaccuauuaccuggcaucaaaaaaaguguucaauaaaauguacguaucacauaugaucaguugaguuuguuauugggcuagauuauauaaguaaacguugucaguugaaagccuauggaguacucuuauauauauuuauauuuuuaauagauauauuauaguuauauaucugaggaguacucaauucucacaaaaaaaaaaaaaagaaaaaagagcguaggcagagcagaauggauagacaggaaguagauguggaugaugauggcauggaggaaccaaacaacaagauaaauguuagcacuaugugauaaucucugugugugccuaauuuuucacuccuguguugauccgaaccuucuauuugucuacuggagguacugcaaauagaaagaagaucaugucucugaagcacuuguucauuucucauugaagagcaguauucagcagaaugcaguggucauguccagugugggaguuuugcagcucuucauuuauuugugucucuaccuacuuagcuuguagaagggugugaucccagauaacaggcguuagcuggcugcaaaaggggaaaguuauauaucucucccucauuuuuccuuaugaaugaccucugaguugguaauugacagggauuauugccauuuuuuuaaucucugcuaggaggcugcuggaaucuucccucauuucauuaucccguuaugauggagcaggauccagagagcacccaauuuacccagacccagcgagguaaggccaaagugagaaauggcacuagguggggggaggggcggcccuugggguugccacacuguuggaagcuccguucugugccucucugguccuggugcucuuuuauucuucaguuacaguuuugagacaggugguucaggugauggggaaguauugcagguaagugaacaguaccucuggugacagaggguuaugaccaagcucuuguccuuugggacucauuuccgcaaguguggugcuagaggaggaaccuggagaggccacagguagucauaggauacucuuuuucuguuggccagagaggcuguugucauucagauggacagccaacaggggaacaaaauguuuuuaauuuauagggaaauuauguauagauuaaacaaaaaacccaauuugcugucauuugagagggaauuuagaauaucaaaaggcagaagucaagcuccuucagguauugacauuuuuggagacugcccaaaggaagagacgaccgaagaaggaguaaauggauaaaacaaguuggcauuuuauuaaagugcuugccuuacacuuauuagaagacauuugaggcugggcaugguggcucacgccuguaaucccaucacuuugggaggcugaggcgggcaaaucacuugaggucaggaguucaagaccagccuggccaacauggcaaaaccccgucucuacuaaaaauacaaaaaauuagcugggcauguuggcagaugccuguaaucccagcuacuugggaggcugaggcaggagaaucacuugaacuaggaaggcagagguugcagugagcagagaucgcaccacugcacuccagccugggugacagagcaagacucugucucaaaaaaaaaagaagacauuugaaaaguucuaaagagauaaaaaacaaaacagaaguuauuucaaugaguucaaggccugcccuucacugauggugauaacuaaggaccaagggugggauauuaauggauaacauucaucugcagagagcagccccuugggguugucacagccagauuuacggauucuguucgugaucuaaaaaggcacauuauuuaagcaauacuagagcacauuaggaggcuuugccaaaagaaaaggguaauuuacaguugugggguuggcagguuagcaguguagguuagguaaagcaaaaugaacuuugcucuagauuaggacuuucaggucugccuggaaaaaccuuuagaccaaguugauuccaggaauauuaagugcuuuuauuguugccacaguuaugucaugacacugagcauucuuucugagauacuggugcaaagauucuucauuauccucuuaguuccuuuuccacacccuagaaaugacaaacuuaaggaucagggaacauaaggauugaugacuuuaaaacaggcaggcaccauagaugaugagugaaacaaggaaguuuaugugagucucuaaugauguuugaggauuauacacccuaaauauaagggaaaggaauuuuucauaugaaucaauuacuuugaagcacugagauagagaaguucuugcaauaaagacagcaauaggcaucucauccccagaacuuuuaaccuggcaguguucuacaaggauacuuaacgaccaugauuuauccuccuuuuauauaauaaaucuguuauuuauccuacugugaucuuuaucacggaaagugucauacuucgugguguugguauuuuuacacuuugaauacaaaauagguuuuuuuggaaaaggaaguauuuuuccuugaagaaaacuuaaggauuuauuuaaacauuuaaaauguucacuuggaagacuaggguuguuugaugauuuuccagcucuuuguuaggaggaugauuguuacuaccucauugcugguuguuuaguuucuuuuuccucuuaggcuucacccuauacacuauguauaggucagagccuuagugagacaccucagcauucagauccuuagcuucccucugcauaucuaaaaggacaaggcuaggauauacuuguauuuaauaauuguggcaggaaugcuuuuuaaaccauuaaucuacaguuucauagcuuggggaauuccuaugucccuacauaaaaaggcagucuucuuauuaucauuagcaucaacauuaugucuaccucuaucaccaauaauauuauguuuuuuccauuacuuaggguagccuauaaaguaaguguacuuaucacuuuucagaaucgguuccaaauaaaagggucuucuuucuccucuugagauuuuucuccuuguauauucuuuucuagucugauugacuugagaauuuaaccaaugaugcuugauuucugcuagaagaguucuauauauugggcagauauaagaacagugcacgaacaucgacuucuguugguugaaaauuuaggauucugugguucauccuugcaaaaugcaugggaacaggggcccaaacagauaaugaaaguuccuccaguugaggcuuuuaggaacuagcucuuguacucugauucucuuggccaaggcaucugugccuccuaugccuacuugcuauacacagauauuauaauauugacucguugguguucacugcaguguauuauucuguaaaacagacuuuugaguuuaaaagauuguuagcuguucugcuugggaauuccauuugcugguuggccagaaggauaccaccuuugaugacaggcauuucagaggcagccuauguuccucuagcaguugacugcaguugacugugaccuggguugguagacuuacugaggaccucuuugcaagauaguugccaauacuuuuuguaccauuuggauauaacuauuccuguuucuguucuuaaucaauuuuuuucugauuuccauuaaaaaaccgaaaaucuaugcccuuuuccuuuuauauucaaacauuauggaaguauauaaaauacaaaagucccaggaauccucauuaggauugcuguguuguucccuuauaguuuuuuuugccuaguaacagcaacauauuuuaguauauguauuaguguauacagaccauucuucaauuuuucucccacuuaagauuuuauuuuagaggacuuuccuugugaguauauaggaauaguuuauucucuuuaauugcuacaugguguuucuuuguauggauauauuaauaauuuauuuaauuuguugcugggcauuuggguugcuucccaguuuuucacuaaugcugacaauguugcaaaugaacuuucuuauauauaucuuuguaaccuuauguauuucuguaggauaaaguuucuaguagaauuauugagucaagugugccuggggcagguuuuuagucuugaaauuuuuuaguaauccauuuaauauuaucauagaaaacauuuuucuguuauuguuccucucauguuuucaguccauagcgucaaauuauauaauacuguugugagagauggaggaaaacuugagaaggcaauguggagaauuguauauaacacuaggaguuuucauggaguagcaagauauuaaagccguaguuugaagaauguagaucuggacuaauuauuuacaggaauagccaucauaaaggagaagaaagaggaacaacucucaccuuccauauugcccagugcccacgcagccucugaugcucugauuguaagaaauagaaaaaaaucucuuuuauuuuuuucuguuagauuuucuguucucccaaguauauuuuacugucagucucaguucugaauuuuuuccccauguuacaaauaucuaugacuaauucuuaagggagagaaaaagagguuccaagagaucaugcuaaggagguaggacaaaucuggagcuguguauacuuguuggagaagacagaaguccuggugaagauaccuguggauaccuucuuuaaucaucugaggcuuaccaucuccuggcaucuuuucucaucuguaaaacaugaugguagauaauugcucaggucccuuucaugucuuccauuuugcguauggauggugaucaaggaaaagcuaugaaugagcacagcucuguguaaagagcacccugaggagcuaaaaguguaccuucagaagcuagaaggaaaggcccaguguuucucuuggggaggggcagcuuuuccucagaagaugucugguuaagcugccuguuugccuuaucucagaacagaaacacuggugauagucugauaaguauauucugcagugcaaaccuccuggugaguugaguuaaaugcccuuuaauuuucaugucuccagaguucaccucagcagggagaugccaugggagagcuggauuaacugccuuucauaguauuccccacauuagugcuaguuuguguuuguccaucucugucucucucagauuaucuccugcugcauacuacgcccagaggaugauccaguaucucucacggagagacaguauucgccagcgcuccaugcgcuaccaacagaaccgucuccguucuuccaccuccuccucuuccucagacaaccaggguccaucaguagagggaaccgacuuggaauuugaggacuuugaguaaguacauacucagcuugcuuucuucccucuccucucaagcuuggagugcuuccaaguuggccacuguuggagcuacaaugguggauguucuugcucccaacuccucaauuauuauuuaugaguagcaggauggggugagggacagaggguuaagaugcccagagcacucccaccucuggcaguugcuuugcugauucacuggcgcgcgaggacagagaccucccauugggccccaggccagauugcgagaggaugguggcuguugcuccucgggcaacauuuuuauuucccuuuugcauguccagugaccguggaaagcuucucauggacugucuuuaccacaucagggaggcuggaggguugguguuuuuucuccuaagcagaguagcuguggagauguugucuucguucugaaauacuuggauuucccuaagaggcggauuuucuaucuuagugcccugaucagacugacucuuuaagauccuacuccauugccuaaacuuuuuuggucucccuacucuuaccccccauucaggaaccuuaaaaaguugucugucaaauuaaugugguggguugagaaaugauuucuugcuucuuugggcuuuuuugaguggucagcggggagagccaugggaggaugcgcuaaaggagcagggucagccccaggcucuagaauuuaagcuagccaaucuuuuuuuuuuuuuuuuuugagacggagucucgcucuuucgcucaggcuggagugcaguggcgcuaucucggcucacugcaagcuccgccucccgaguucacgccauucuccugccucagccuccugaguagcugggacuacaggcgcccgccaccgcgccuggcuaauuuuuuguauuuuuaguagagaugggguuucaccauguuagccaggguggucuugaucuccugaccucgugaucugcccgccuuggccucccaaagugcugggauuacaggcgugacccaccgugccaagccuuuuuuuuuuuuuuuuuuuuugagacggagucuugcuguguugccuaggcugcagugcaguggcacaaucucggcucacugcaagcuccgccucccagguucaugccauucucuugccucagccuccggaguagcugggacuacaggcgccugccaccacgcccggcuaauuuuuuuuuuuuuuuuuuguauuuuuaguagagaugggguuucacuuuguuagccaggauggucuccaucucuugaccuugugauccgccugccuuggccucccaaagugcugggauaauaggugugagcaaccacgcccagccuaagcuagccaaucuuauugcuggguuuugcauucucucaucugcugcuucugaccuuucuagccauucauuguguuucuuuccauccugaaacugagcuuuuauggccuguaucaaauugaacauuuggcucauuuugauuccuuauauuuugguauugucaaacauaaaagcaagagagagagaagggcgguuaagcauuauuucuuccuccuucuucacuggcauuugugaaagaggacagccugucagucauuuccuccccaccuuccaucuugacauagccgggucaggucuggggccuuaagaguucucaucucccccucagcuuucuuccuuaacugaauggcuaguuccucacaagucaucuugcaacaaagcuuuuuaguguguuuaagaaaucucuuugccagaaaggacuaggaaagugagaacaaccuuuguaccaauuugccuuccugaugcugucauuaaacacacuacuagcauuugugcucuuagaagcaaaaggaaaacuaagugggagguuuauuugucugagaaagauguaaaugugaaagaaaugcagggauggccugaaguagcagugguguggcaaauggagcagaggucaugguucucucuugucaacugcaggagaagagcagagcuaccuucugacugucagcuuguuccuucucccuucuguccacucuagggugagguggaugcguauaucagcagugaaggaaauggaguguuuguucccuuagccaggcagauacuuacagugaaauauguucuccuguagauacgguuuuuccagcaccagggucuauucagggaagcaguugaaacauacaugccaaggcugcuggcacuuagugcugcugaaaagccugggugacuuucucucacuaaugcuguggagcccugggagucaguguuguggauugccuagcccucuuuccaugcacgccugggagacugcguuaucuuuuugcaguggugaaauguggggcucaugccuucaagcuguaucuugccucgugacuuguccuucacaagggaguucuggguuaguuuaaaauguucuguucuugucuuaccuucccuuucuccugcuaccaccuccucucucucuccccuuccuucccccucgauuuuccugugucagacugccuccuccuuaugcuccccccagcccaccugugcgcucucccccacccccuccccuggcuuuagcaugaccugaauuuacauuuccuucuucaccuuucaugcacugacuuacuguuuuuucucagggggucuuauauugcucccugguuaguaacaauggacugauuucucucauacuccuuggaaagucccuucugggguguuugccuuucuuuuugggcugauguagacuagaaucuuguuuuuaauagcagcuguggauuagucaccucaacauuaguaguccaggucuucuaguaaaggauguuacuggcugguugaaacugacuguuuauucuuucucugucuccuucccugcccaccucccucuacaguaaacugaaugcugcuugugguugcuccuguccucugaguguccacgugcucugugaggagggagaauaacaaagaaggaauguaccagcacauuuuaauuuuucugccccaaucuuuugccuuagcuuugguaacuagaaggaaagucagaggcaugugcagucacgauuuauauuuuuuucagguacagagagacauguaagguagauauggcgaguaauccuccuaacaauuagguuaccauuaagacaguuguuccuuuguuugguauccucaccuucucagcacuucaugcucuugccuuugcuaccucacuuugaugaccucucccucuguuugcuaagucauagaucauuuugccauuuuugggcuugucacauccaguuguauaguguucucagaaaaccaagggagccauuacucagagcccaucuuuugugguucucuuccauuugaccaaaucagauaugucuaagguuagaggacaggagcaagcauauuuagugucugaguuuuauuguccugcugauuuaaaaaccuuugaaaaugauguaccaccauuuuugagccuuuccaagagcuugcuguggagcaagaccauugagauuuaucucuugggaggguggcuuuggagguuggucagcaucagguuaaauuuucuguucuuuugugaucuagaugaaugaccaucuuccugggcaggcuuccucuccugccauucaucucugucuacagcaaggauugagacugcaggguccuuguguuuaucaaacugcacaaacaggacauccagaaaccugcugucagcaggucucuccugaagcucucagcagcugccuuugcauaaagauguucauaagcaggguaaagguguggcugcccaugacauugcugucugucugcuuucaagcccagaccaccuacuagaauggagauggcaaauaagcguaaggcagacuuccauuuucauguuugccaucccuuuggaaagagggagggggcuuuuauaaagcccagguuaagugcuauggcccguaguugcuaaggccuacaaaagaggugguguguaugcuuuaugacaauuauuccagcuaugcuugcccccuuacucauuuuaucuguuaaucuaaauguaauuauaauuccagaauccucccuagcccauauuccugcccuuccugccucuuuuuauagcugcuuugcuuucugaggcaaagggauacuguagcaaaggcuuugcuaaugacagucagacuagagaagcuucagauuagaucagucgcaaauaucugcaucguauauacuagccacuggauaauuacauucagcuucuugaaaacuguugcuagagccggguguggcagcucacaccuguaaucucagcacuuugggagguugaagcaagaggauugcuugagcccaggaguucgagaccagccugggcaacauagugagauccccauauguauuaaacaaauaaaagacuguugcuggcacagaagucucuuauucacaauuuugacacacgggcuguacuuuggauuucugccuggaaaaaacaucucaaugagaauucuagucuuuuagccuuaagaugaauucucuuuaggucuguuaauuuauuuucuuaacuauucuaauuaauuugcuuauauuuggguccucuuuucccagaaguccacauugugaccaaauacaggcacacuuuguuuuauugugcuuggcuuuuuuugcgcuuugcagguauuguguuuuucacaaauugaagguuuguggcaacccgacauugagcaguuggcaccauuuuuccaacagcaugugcucauuuugugucugucugucacacugguaauucuugcaguauuucagauguuuucauuauuauuagaucuguuauggugaccugugaucaauuguaauuguuuuggggcacugugaaccacaaucauauaagacaauaagcuuaauuguaaauguuguauauauuuugacugcuccacucacuggcgauucccccaucucucuuccucuucuugggccuuccuauucccugauacacagcaauauugaaauuaggccauuuaauaucccuauagugaccucuguauguucaagaaaaaggaagaguugcacaucucucacuuuaugucaaaagcuacaaaugauuagugagcaagacauguugaaacuugagauaggccagaagcuaguccucuucugcuauaaacagccaaguugugaacacaaagcaaaaauucauuuuuuuuuuuuuuuuuuuuuuuuuuuugagacagagucucgcucugucacccaggcuggagugcagcggcacaaucucggcucacugcaugcuccgccucccagguucaugccauucuccugccucagccuccugaguagcugagacuacaggugccugccaccacgcccagcuaauuuuuuuguauuuuagguagagaugggguuucaccguguuagccaggauggucuugaacuccugaccucgugaucugcccacuucggccucccaaagugcugggauuacaggcgugagccaccacaucuggcccacaauuuaauauucuucaucugccccuuugauauaacuuaaaaagccuaguugagucauggcaaagaagauauguuagaaacuagagaauaccauucuuaucaggugauagaccugaugacucauguauuucaaguucuccugacuagaauucuagccaccuguccuugacaguacuuguuccugcucucuucugagccgggaauuucuaggacuucuguaggaaucagugacuacucucuaauaacaaauauauaacuuguacccaaggaagaggggguaacuuuuggcaaguaaaaucgucagagagggauaagguauuaucuacuucauuuugaaauagaguucccuuugucuuuuccuuugucuuaugagccacagacucuaauauuaggagugcaagagaaaugcugaggaaacacacuguaaaguuacucucuuuauagguuggaaccugcuuaaagcaguuaggaaucagccagccaucuacauuuauugaguggugguauuauacaaaauuaguucuuaauguggaacgagacaaaaacuucuccaccuauagucccagcuacucaagaggcugagguaggagaauugcuugaaccuaggaggcggagauugcagugagccgagauuaugccacugcucuccagccugugcaguuuuuuauuuucauaaaaaauuaaaacaaaaaaaaagaaagaaaaugaccuggagagagacaaaaaccucucuuauuuuccagauaauuuuuguaguggucgaaugucuuuacaaaauggcuuagaaaagagcuguaagucuuaaaauagggucuuuauuuagguauacuuaggagaaaggcaaguacaguaauuccucuuuggaaacuguaacuuaagcgaaacuacuauaaugaaacuaauuuuaccauagacuaauugauaugaacaagaguuaaguuccugugacauauuucuggcuacaaaaacgucaccaagcaucuaaaacacccaaaacacuucuuauauuaaacauugaaauaaaugugagcuguuuguacaucuaaaagauuaauaaaaauauaauuauuugauuuuuggugaaucagugagugacaguggucaauguggggugagguaaaucaaggaauagauguuugcaaagugaaaauugugaggaacuacuauguaguuaaaacauaaacaggaacaaauauggucagugcccugagacuuaguacugcaucauuauuguugugcaucuguaugauuauuguaugcuuuacauauuuuuacauuauuuuguauucauuuauuuuccaaccugcuuauucccauucuggcucacagguggcuggagccuauccuggcagcucagggugcacagggagaaccugcccuggacaggaugccauuccgucacagggugcacucaugcacacacccacacucacucagacuaagguagucuaggcaugccaguucauccaaugugcacaucuuugggaugugagaggaaacuggaaugcccagagaaaacccacacagacauggggaagugugcaaacucagacaguggccauggccaggaauugauuuuuuucccucaucaacauuauacaaaacaacauugaaugaaacaacauuauuugaguaccagcuguaaaugcauggucauagaaacaugaaacagcauggaauauuuggggaauugcuuuguugauagguguggcuagacuguaaaguuaaagauguguggcagaugagccccuagaauggagcuagaucuuugucuugcgugccuugcaaaggagaugaacuuuaucccauaggcaagagggaaucauugaagcauuuuaaguuauggaauagcaucaaguuuuacauaaguaucuaaaaagauagacuguaauaaguuaccacuaaaauacuaggagagcauuguauaaagggagagaguauuuggggagaggugagaaagcuucauggauuugagcuggguauugaagacugcauagaacugugagagaggaauugauauuggugauggguauagcgaggagauucuagauaaagggaguagcuuaagcaaaagcguagagacaggagauuuacagggcuuauucagggacccugaauagaucuguggcuagagcuauggaguguuugugauaugagagagauaucagaaagccccgaacucuggauggccuggaaugccuggcugagaaguuuggacuuugucucaggccagccaucauccaauauauauuuuaggcagcuaacucugauagcauugguuaaggugaccuaaagugacaaguguacugaugcagaaguaccaguuagaaagcagugggcauaguacaggugaggauaucugaggguugcauuguaaguauugauugucugagggcuugauguuuucuaaguguggagccuguuugugaauguuuuaggggaacgagcuuccugaaagcacagccaucuuacuuuucuugucuaaaaaaaaaaugcuaaguccuuuuuuacucuuacuggauccaguuuugaacuaaauuuauaaauuagcaaucacugcuucuuagaacagcagugacuggcauugagaucacuugucaaugccugcuggccccacagccugacagcuauugucuacggaauaguccuggguucuagucuuggcugaggcugugauuuauuaucugaucuugagccggccccuuucccauccuaggccucagugucugauguguaaaaugagauuagauaaccucagauucuuguagcuuuaagcuucuuggaucuuuguuggaguuaacuaucuuagaaaaauuuccccugucagccgggggcgguggcucaugccuguaaucccaguacuuuggaggccgaggcagauggaucacaaggucaggaguucaagacuagccuggccaagauggugaaaccccaucugucuaaaaauauaaaaauuagcugggcgugguggcgggcgccuguaaacccagcuacucaggaggcugaggcagagaauugcuugaacacaggaggcggagguugcagugaacugagauugcaccacuacacuccagccugggugacaaagugagacuccaucucaaaaaaaagaaaaaaaagaaaaauuuccccuguaguaggcagagguacaauaaugaaaagucucagaaaaguaaggggccuuccugaggauuaagaauaggcuauaugguaccugucgagccucaauguauuuguaaaauacauacuuuaccugaauucuagcucuuacugaggacuuugauuuauugcuuaaaaacguguaauauugcuuagcaacuuuagaauuaauacuuuaggauucuagaauuagaauuacugggcaaguaaaauacauaugaauauuuguuaagaggaaugcagaagaagagaaagaaaauggaacacgucuggauugugcuugggcuuagaaugggaaaauacagcaggaaagaauuacgcaguggggguuugggggaggaagacauaacccuuagauuuauaugcuuauuuuuuaacauaaaaugcacaauaggaauguggauuugcauaauguaggcagaugaaauuaaaagguaacauaagggaggagaggaauuuguaaaugguaauuaucucuuguauuaccauuccuuggagaaaaaugaaggcucuguaguuccaggagaccuaugcuauuagcuauucccuaugaaugauaucagcuggggcugugccuuccuuccagaaaucaaagcccuugcauaugugcacagucauugaaaguagagacuggggccucaguuucuaaccagcagcacuccaguaaggaaaugaguugaccaagaucacugugcucuccagggacaggaauaccagcuaggccuucuguugucuggagauugaguagaaacagagcagcauagggaaacaaaaauuuuuuaauagucuaauugucagcaaagucaacuguauacugucaagaggacaguggccuuuugagcuuuuugcugcaagagcuucauuuauaaaggcccaagucagagccauuugucacugaggagcaaugacaaccugacugucuggucaggacucagacagcagucuguaggugcauuuuucauuccuucaaauuacagccucucuccgaggcaauuaauccuagacauuuagcaaaagagcugcugcuguguuucucccuuguucuggaaauacaucuucuuguauucagcacuuauuuuggauacuugauuguuugaaggguguuuuuuuucugguaaaaucuuugauaagaaaguauuuuucccccuacuccuucccaaauaccccucugagaguuaaucagagaugcacagaguucagcaacugggaaagccauuaauaacccagccagcuucuauccugcuggcucaaagucagcuucaggcuguuggaauugaugaggguuucucugguguuucccugaaaaguauuccuccuauguuggaggagcaauaccaacauauuuguguacucuguucuucacacuuuuaagucauuacccuuggaaaggguguuggcuauguuguuagagcccgguauuuagcacccuucacuguuccuaaacugucugggucugccuuucucucacuuuucaucuggcaaauaucuuccaauucacucauauucagccucugccugccugaccaaauuugucuccuucuaucucauagagccuuggcuugaugucgaccuuguaucagcacggaagugaguggcagauuucuguguaguuuucuaaguauaucauuauuuuaaguacuuuuaauuccugugcucuucuauuggaacuuaucccucucccuucaguucuuccacuaaauaucccaugcauugaaauuucuuuucccaccccaacccauuaucucugaaucuuccccucuuucuaaacuauagaaucuagagagucaucaguuacuguuucugccuuuaguuauuuggaacugugccuuugguccaggauuucuguguaccaguacuaaaacugauggccuuuuccccucuuccugucgaacucguccuuuuguaguauauuuugaccuuugccaccuuacccauuccgguauucaagguuuuaccugcucaguaaauguuugagcugguuugguuauaggcuauuuuauccuagaggucuguggguucuuuucucccauaggcagcaucucauauuguguuuauuauguuucacauuuuccuggucgugcuggguccucuccugucauuucuccuucagaguucucaacacuuggaauuugaaaucugcucugccuuguauugagaugacauuuagcuccuauuucuccauucuuagccaagauguuaaauaaacugaggaccagcaugagcaccuccccuuacuuaacauguugccucuuuuauagugccucguguaaccuucagucugagacugcguguauuugagccagcugaucucauucuuguuuuccuuuauauaucccccacuaaucucuaaacacuauaaagccauuaucucugaccauauuuugcacccucucuuuuccaucaguuuuuaaaaauguugguaaaauacacauaacauaaaauuuaucaucuuaaccccuucccuuuauuuuuuuauuuuauuuuauuuuauuuauuuauuuauuuuugagacagagucuugcccugucacccaggcuggaaugcaguggugcacucuuggcucacugcaaccuccgccuccugguucaagcgauucuugugucuuaaccucccaaguagcugagauuacaggcgcucgccaucacgucuggcuaauuuuuguauuuuuaguagagaugagguuucaccauguugaccaggcuggucucgaacuucuaacuucaagugaucugcccgccucagccucccaaagugccgggauuacaggcaugaggcaccacacccagcccccuucccuuuuuuuuuuuuuuuuaaaugaagggauaaacugaaucagaaagaaauuauauuuagguuuuaauagcaacaaaaagaugcuugugaccuacguuguacgggcccacauuuuccccagcccugggguuugccccuuuuucucuguugucuucuuguguucuuucaccaagcucuguguuaccuuugggcacuggcaacugcucaguacuguccagugcacuggcuucuccuucccugcucuucagcccuucuaacgagagauagauucguguuuguuguccagaaggaggugaaucuuuggaucuugcaggagcaaauugucagcucuguaaugugauucugggaaggccagcucucucucauggguguggaauaauuagauuugacccaugaugcuucuuuucuagcuuuauuuucuauuuuuuauuuuauuuuauuugagacagaguuuuacucuugucgcccaggcuggagugcaaaggcgcaauuucagcucacugcaaccuccaucuccuggguucaagggauucuccugccucagccucugaacagcugagauuacaagaugcaacaccaugccuggcuaauuuuuuguauuuuuuuuuuucuuaguagagacaggguuucaccacguuggccaggcuggucucgaacuccugacccuaggugauccuccugccucagccucccagaguguugggauuacaggugugagccacugugcccggccuguuuucuaucuuucuuuaaagagaugagagucucuuguugcccaggcugaccuugaacuccuggacucaagcaguccucccagguaacugagacuacagaugcacaccacugugcccagauaguuuuuuaucuuuuugaggcuuagaggccuccacccuuucccccgcuuaggauccuuuuuaacuucaaaauauuuucuaacuccucuuaugauaauuaguuguacuuuguucaguacuaauugauaagugaaauauacgauaaugaaaagcuaucaugaauucaauuguacuuuuaaaugaauuaguaauuuaucacaacaguaguauauuugaaaaauaauaguaugcuuaauuuggaaacugucuuauuuguuugauauucagcuacucuguguacauguauaauuugugggcuccccaguaacugcagucugcuggucaggaacuccugauuccauuguucucuuuaaccccccuuuuacauuccauauagucuuaucucuuucuccuugccccuccuuucaucugcacaauuucaggucaaaggaauaagauauguuaaggaacacaguguacgcuuucucuuuugggaaaauaaaaaccaaauacuuucaauggaucagcuuccaauaucccugguauugauuugucauuuaaugcucggcagccaauucuaccaagauauaaaaaccaucauagacuuuuguuucuggcuugugaaguucccagugguccacuuaaaagccaaguguugccuuaacuucgguuucagggccaguuugaagauuaucucauugauuugaagauaauccaaagggagaauucagaaaauaucccaaaucaagcucucaaagguucauuuauuuuguggaguugguuaagccgcucauuaacugcucuguccagccagugcccuuuggcuuauuauucuuuugauguacuggaaacuaaaacaugugaagcuccuuuccucuucucuuguaggaagcagugaaauguaguggaaagaucuaggacuucaaaguccaaucuuccuugaauccugccuuaaccacuuacuaguuaugugaccaugguauuuaccucucuggucuuucguccgcuucucuguaaaauaguaauaauacuucguggccuagccagaagaauuaaaugggauaacauaucaauaaccuuuguauuggaaccuagcagauacuuaauaaauggcaguuacuacuauugcauggacuguuaacaguccauaaagaaaacacccagacuuuguauucaaaugaccuaacauaggauuacguuuucuaauauucuucaccauugacagucuguaaaagaagguacugucuuuuucuugugcauuuuuuuuucuuuuaccugucacugauuuuuccacauggaagaccuaaacagauuucauuugaagauaaccauuugccaaaugaaauuggugggggaauuuuucuuccuuuaagaccuccucccacagcaggcgucuggauaacaaguaaaaugauaaauaauguaagacaaccccccaagacacauuuuucuugcaucuuucaauauagaaaaaguuuauauauauccauuccaaauccuaagaucuaaauguggcuucaguuugagacgcuaagggaccacauuaacucaagaaaaauccuccucuuuccugagcuguugguaaaugcucauaaaucucuuaguugagguucuccagaaauauguuuuauuaaugugcugccuaauuagugagcagccagaugacuaauuuaugugggguccucuccuaaguguaagaaugucauuuuggggauguuuccuuuuugggcugguggaugauucuuccuuagugacucucuuauguguaguguuuuuauuuuuuucagggacaauggugacagauccaggcaccgagcuccacgcaaugcccggaugucugcaccuucgcuuggacgcuuugucccaagguaagaaccgaguugcuagcaacagagggagccuucguuagagccuaggauuuaguuuuaaaccuacuuucuggucuuugaauuguccacaucuggcauuguuuccuagugggcccauagcccagcccugcugucuaaacucuugacggaugaugguuagccacauucaaaagagaugaaaaaguggugcugggagaauccuguuuaagaacagaaguguugggggaacuuuagaaggaagggcagaaaaagauagauacaaaucugcggaaggaccaaucuugggagauuuuauuucuuucugggcaucuguggauucagugggucccuuagcccagauuuuucaguguagguaguuaguaucuguuucgugguagucuuuagucagcuuuucacaugugauuccuucuuguaggcguuucuugcugccugaguacuugccuuaugcugggauuuuucaugaacguggacagccuggcuuggcuacucacucuucuguuaacaggguccuggcagguaaggaaauguuucuuuggcuuuugaaaaugugaagggccaaggagccagauaaagcuucucccuccuuuaccuauguugaugugauggugucuuggcaucugucugaaaauucuauuuugggguccugguuugauauucaguuccuuacuugaaggcaggaaauggcaggguugaagaaaaauguuucucuuacccuauucccacuuucccuagaccuuuuuuuuucuuuuaaauuauuuguuuaaaccauuuguuucuuaauccagcaauuaaauucuagcuaugcuuuuaauugaaugauaaaggugccguguuuauguuuugguuggugagauacucaugagccagauccugugauuuaauuaggagcuuagugcacaccucuccacuccuuugguacugccagcauguggaauuuccaggcaguguggaaucuucugaggaaggaaaagagggagacgcccuuggagcuggcucagaaaucuccacagaacagaaaaugggcuaggcaagccccacugaagcaguuuuauuguuuauuuacuuauuuauuuuugagacagagucucgcccugucacccaggcuggagugcaguggcacgaucuuggcucacugcaaucuccaccucccggguucaagcaauucuccugccucagccucccgaguagcuaggacuacaggugcccgccaccacgcccagcuaauuuuuuguauuuuuaguagagaggggguuucaacguguuagccaggaugaucucaaucuccucacuucgugaucugccugccucagccucccgaagugccgggauuacaggcgugagccacugugccuggccagcaguuuuaugaugguugaauagcuuagugacagauguuuuucggcugugaggcaugacgugacuguguucugagacguugugugugcuauugcuucuggucagucucuagagaaggaaguaaagcagaauuccauuuuuauauguggcaaagguuguuucccugucacagucuuucccuaccucccucccaccuccacugccgacuuauaaauuuaugaaugcaaaugcauaaaagguauaaaaaucaagccacauuuagagguaucuuuaauaagcaucuuuauuaaaaguuuuaaaaugacauucuguuuuggagaaucugggccaugugaugguuaaagguggggagggaucuacugaggcaguggcacugucugacugugagaauguuacaagcuuuaucuuaugauuucuaaccaagcugcugugacagcaucaaggccaugggaucuggccuuuccuaaauaguauguuugauccaacaucaaugcuuagaaauuccagaaaccucagugguuucucugucagacaccaggacuucauaggcucuggccuggcaggagagcagacuauaccacaaucuccugacagccucaucugaggaggcucuggcccuaguuguaaaacagaugcugugguccgugccucuccuugccuggcacuucuguguggcuuaaccgaaggcacguuaaagcuuuuuucacuggcagauaauaacuugcugccagacaauacucuagagcucuucuccacccuucuuuguuccagacaucugccuccaccaccccauacagcaccuccugcuucucuacugccggcagaucucuguuuccuuggcauuuagcuuugggggaacagcuguauguuguuuuuuucugccuugccuccaagaccuccuuacuucaauuuccuguuuccuacuuuaugccuuguggucugaccccaaauggccuaauuacacuuauggaugccuuugaauauaggggcuguguugcagugggcagcuguuuacagaugugaaaucugagaaaaucuaucaaaggaugcagaaugccauuaggagaaggaacucuagacucccuagaaccucacucuugaguuagauuagcagaugguuuucauucaccauuaaacuaguuucuaccaauuuuucaaaauacauauuacagaguauuuauuuaucauucguugauauuuugaugucccuccagauucuauuggcaguuguaucauuuguuuucuucucuugagaaaauuccaauaauaauaauauagcaacaaaagccuaacauuuauugagcacuugcuauauacuagggaguguuuuacgugcuuuacacauauuucguuucugucuugcaguaaucauaugagauaggugcgauuaccuaauuaacaguggaggaaacugaaucccagagggcuaacuugcccagaguaaugcagcuaagaaguagaagaauggagccaguagucucuaaaccaccuucccgauccgccuccucguaguuguuuuaaaggacaaaacauuaaaaugucauucuuuuucuuaggacuuuauaagagggagagagcucccagggaacuucaguguuuuucuuguuuguuuuaauuauucuauuuaaaugguuccuagacauagguuuuuaugauccaguggugcuugcugaggaaaaucuuauuauguaaccgcccuuuuccugagccuucuugcccuccuggauacagauguuuugcuuuuuauuaaacuuacuugugaucauguaauugagcugcuauaauaauagcuuucagagugaaagagcaauugaccuuuuagcaguaagcacucccaauuuuccuggaaaggcacuuugucauguaugauuggaaugagauuguaauggucccagaacaauuacauuuagcagacauuuguucuacagcugucauaugccaggcaguguucuagguuaccagagugaauaagacagacuaugaucccugccuuccuguagcuccaagucuaggugguuagccaugacucagucuuacuccagacauaaguggaacuuuugcauggugaauggcuuuuugcagggaugaagcuuggaaauuuggcagaccuggagggacaaagcagacacacaccugcaguuuuagggggugugaccaguacuguagugccaaaugagucuucaguggacccuaagcaaagccauucagaaucaucaacaaaaauggguuugcggaaaaucaagauccguucuacuuccucccacaagagacugaaagcaauaauagaaaacagaagcuacuauagaaaaguguuauaaggugaagaguaaguuauugcaaaaagaauuuuuaaaauauuaaaaaauaaagagaaaaguguuuugauagucuauuauucaucucuucucccuuaucuuggugccuucaccugcaauucuguagguuucugguagccuccaauuggucaucaacccaggccuuuccccaucaucaucagcaacacaaauucuagacccauacuuaaagagcuguaaguacauuuaaagcuauugcagcucuaccagguaaaauugugggagaacauacaaaagucugaggagcucccccugcugacauuguagcagaccacuagcucuguguagucacagcaacugaaaugauggaaaugaagcugagugccuaccguggaccagguacugucuuucccacguuaucucuuuucaucuuugcaacaacccugugagguaggugguagcauuuccauucuguagggaagaaaacugaggcucagaaaguuaugucacuugcccaauaucacugugagaggcugaccuggaauuuuaaaccgggucuuccugacucuuagaagaguucuguucugucgucugugccauguuuuguuugaguucaaguagggaauaucugccaaaagguucuuaagcuuauaauauuuuucugcauguuugaggccucauaaaagugaaauaagaagcuuggcauuugacagcuuccugguaauuacuggaagaacaaaaaacuucugaggaauaggggccuggguaaugugggguauuagcugucuguccugcauaaucuuuuugacuuucauccuaaugagcaucugcuccuagcagauguggaccugauauacuuaauuuacuguuuugauuaaaaucaaugggaagugucaggguuuucuugcuccuagccacaggucauuacggccugguccagugucuugagcaagagauggcuuugugcccaguuauccuaauuucucuuaugacuccuucuucuucuuuuuaaauauaaaaaagaaaaacuggccaggugcgguggcucacgccuguaaucccagcacuuugggaggccgaggcagguggaucaugaggucaggagauugagaccauccuggcuaacguggugaaaccucaucucuacuaaaaauacaaaaaauuagccaggcauguaggugagaauugaacaaugagaacacguggacacaggaaggggaacaucacacaccggggccuguugugggguggggagagcgggggagggauagcauuaggagguauaccuaauguuaaaugaugaguuaaugggugcagcacaccagcauggcacauguauacauauguaacaaaccugcacguugugcacauguacccuaaaacuuaaaguguaauaaaaaaaaaaauuaaccgggcgguugcgggcgccuguagucccagcuacucuggaggcugaggcaggagaauggcguuaaccugggaggcggagcuugcagugagccaagaucucgcccccgcacuugggcgacagagcaagacuccgucucaaaaaacacaaaaaaacaaaaaaaccuuuuuacugaacggugucacuucucaguacgacuucuuugaccuauuacuuuuuugggaguguguuguugaauuuucccauauuuugaauuucccaaauuuccuucuguuguucucuuauuuaauuugaucauggucugagaacauacuuugugugauuuuauucauuuuaauuuuauuggaacuuguuuuauggcuuaguauauaggcucuucuagagaguguuacccaugugcuugaggagaauguguauucugcaguuauuuaguggaguguccuguagaugucgguuaaaucuacuuggucaauauuauuguuccagcuuuguauauccuugcugauuuucuaucuaguuugucaguuauugagaguggguauugaaaucucuauuauuauugaauuguguauuuuucccuucaauuuugucaguuuuuuuuuuuguuuuguuuuguuuuuuugagacagagccucgcucuguugcccagugaugcaaucucagcucacugcaacuuccgccucuuggguucaagcgauucuccugccucagccuccugaguagcugagauuacaggcgugugcccccaggccuggcuaauuuuuguauuuuuaguagagaugggguuucaccauauuggccaggcuggucuuaagcuccugaugucaagggaucuaccugccccagcuucccaaagugcuggaguuacaggcgugagccacugcaucuggcccaauuuugucaauuuuugauuaauguauuuugugacuuugucauuaggugcacauaugucuacgacugauauguguuccugaugaauuaacuauuuuaccauugucccucucugucuaguaauauuuuuugucuuaaagucaauuuuuucuuauauuaauauagcuacugcaguucuuuuaugguuguugauuacaugagauaucauuuuccauccuuuuacuuucagccuguuuagcucuuugaaucugaaauguguaucugguagaaagcauaugauuggagcuuguuuuuuaucuagucugacaaucucugcuuuuugauuguuuaguccauucacauuuaauauuaucauugauauaguuggguuuuugucugccauuuuacuguuuguuuuuuguauuucugauguuuuuauuccucuguuccuucuuuacugacuucauuuguauuaaauggguaucaucuaaugugucuuuuaaauuccuuuuuugauuuuugaauguauuuuaucaggaucaguuuccaauuuauucagacuuaauucugguaagauauagaaacauuuuucacuaucuguuguuccccuguggcuccauucccuucuaccucuuuugugcuguuauauauauauuaauauuacaucuauauguauuacaaacccaacaaugugguguuaacuuauugauuaauacaaucuuuucucaggcauccuucuguuuguugccuggugugggaaagacagagcuauacuuuucauaaaauuuacuuuuauuuucaucuaacuuuauuaacuuguuaauaaaauuguuauuaacuuuauuuuugguuaacaacaauuuacuuguuauuauuguuaacuuuauuuuugguuguccucugccccucucaucucuuuuauuuuuauuuuauuuuuagagauggggucucgcucuguugcccaggcuggagugcagugacccagucacgacucacugcacccucaaccugcuggucucaagcuauucuccuaccucagccuccugaguagcuggaacuguaggcacacaacaccauguccaucuaauuuuuguacuuuucguagagaugggguuuugccauguugcccaggcuagucucuaacuccuaggcucaagugaucugccccacucagccccacaaagugcugggauuacagguguuagccauggugccuggccccucucaucucuuuuauuuguauuuauuuauuuauuuauuuauuuauuuauuuauuuauuuauuuauguugagauggagucuuguucugucacccaggcuggagugcaguggcacgaucuuggcucacuguaaccuccaucuccuggguucaagccauucuccugccucagccucccaaguggcugggauuauaggugcccacgaccaugcccagcuaauuuuuauauuuuuaguagagacgguguuucacuauguuggccaggcugaucucgaacuccugaccucaggucauccgcccaccuuggccucccaaagugcuaggauuacaggugugagccacugcaccuagccuccucuugucucuuuuaaaaacaccaguacucuggucuuagauguuccccacuucccugguuccuuagggaauuacuuucaggaggacuuuuuagucucacuuagucaacuggggugggcaucuagagccucaggcuugcuaacuuuuaggaauuagccuuauuucaccaucugauagcauagcugucuaauacaacaaauugcuuaaucacuauauagcagaucuucacuugaacuggcaaaucugguauagauuaauaauagagacugcaguuaagggccaucgugauauuacuuagaugaaagugaacagaaaugaauaauauuucugguguuggguccuuuaucucuuugaucucccuuuaucuuucugccguguacccaucugguacccaguagccaggcagauaacaugaguggcacauuccaacucaacaucaauuaagauggcuguuuauaaaccccagauaaauggacaauuagugguggugguacugguagugcugcuuuaauaauuaacccaauuacauuucauucugcuccagugaugaaagugaagggaauaagaggcuggcuuuguugccugggaaacagagaaguaaaugcaguacuccucccagagaacucagccuucccaguugccuuauagcacccggggccuuuuaccuauuugguguccaccagucacuggagcauucgaguccuuucuaccccagcccuuuaccuuaucuuauaccacuagugagaagugugcuuauugagaacauggggcccaguuucuaagcugaauugccugugcuucuucaggcuuuucuagggaaaaauacugggccuugucaaugaacuuuucuguuccuuuuauauguguaaguuuuucugugcuuuugucucucuuuuccccaggaaauuuccucuugaucuuuccccacuuaugcuuuacccgugugcccuuucuguauugucaccuuaaaauguacacagcacuuucuaaaugcuuaguauuuuccagaacacuuuggguauuacaaaauaauuaaaugauucugcccucagggaguuuacugucuagccagggaguagcccaauaucuauguuuuguuuuagcccugccacuaaaaauuuacuaauuccccugagacuuuaacuaccagucuugauagauuagcuaagggaggugggguguaagccugggcuuggaucaaggacuuucaguccaguuugucuuucguacaguuugaagaagcucugcaaauguguccccguucaucuuuugagugggacuauaagcgugaguaaguggggcacuggaaggacagcugucauuuauaugguauacucugucugagagacaguauagugaaauguuuaagaguuugggcuucuugaggccgggcauaggggcucacgccuguaaucccagcauguugggaggccaaggcgggcggaucaccugaggucaggaguucgagaccagccuggccaacauggugaaacccugucucuacuaaaaauacaaaaauuagccgggcgugguggcaggugccuguaaucccagcuauucgggaggccaaggcaggagaaucgcuugaacccgggaggcaaagguugcagugagcugagaucgcgccauugcacuccagccugggggacaagagugagauuuugucuuaaaaaaaaaagccugggcacaguggcucacaccuguaaucccagcacuuucagaggccgaggcagguggaucaugaggucaggagaucgagaucauccuggcuaacacggugaaaccccaucucuacuaaaaaauacaaaaaauuagccuggugugguggcaggugccuguagucccagcuacucgggaggcugagggagaaugaugugaauccgggaggcggagcuugcagugagccagagaucgcaccacugcacuccagccugggcgacagagugagacuccaucucagaaaaaaaaaaagccaaagaaguauaggugguggcagggaugcaguggaaagggaaugcguauacacugucagugggaauguaaguuaguacaaaguagaaaucuuaauguccauaugucuggauugaggcgccacuauuuauuuguacuuuaaguucucuguacucuggggcuucccuagaccuaaaaugaucucaaagauuauuaaaucccaugguugugugcuccuuggaauuacugcucauuuugaaggugccagcugaagauucucucuaaucuauaaugacucaguauaaugccagaauucuuuuacuucucucuucuuagguuaugauuaguaugugcuuugacauguuuugcaaccccucagaacaaaugcaaugaucuagaaaucugcagaggacaugugaggaaagagaaggccaaaugugaggucaaaacccauauuuuccaguggaagcagcagcuuucuuuguuauauuucuuuacauuucaaacuuucuuuaggauuagauauccccuaccuugggccccuugugcauggcacaaagcugcagugagcugagccuaugauaaacccagggacucaccucaauagcccuauaacaugagagacugucuuuacagggugaguaaagagacuuggaacaauccucuuuacugucccaucuacuucaguaguuuuuaccaaagugagcaguaugaaugcuggaaguuaauaacccaugcuaacuaacccccuaccuccuucuuuuuaccuuuuuuuuucuuuucgagacagagucucacuuuguugcccaggcuggagugcaguggcacacuccugcaaccuccaccucccagauucaagcaauucuccugucucagccucccgaagcugggacuauaggcguacaccaccacgcccagcuaauuuuuguauuuguaguagagaugggguuucaccauauuggucaggcuggucuucaacuccugacuucaggugauccacccaccuuggucucccaaagugcugcgauuacaggcaugagccaccaugccugccagccuccuccuuuuuaaaacccugggcucacaucagcuuuucuuucucguuuccuuuuccuaucuccaagcagccucguuuauuccaaccuggcuggaaaugccaugggagcuggcagacaucaccucuuaccuuuucuaccaaaguggagccaaccugugguuguuaauuuccuuucuuuaaaacuugcugaucaacaaaggccagcucuuccccuggguccucaugccacucagguugaagagcaagcauggauaucuuuguaugagccaugauggggaaagaaacuccugcaaauaggugacuggggcccuuugggaguguuaagacucccuuggguauuucuuuuggguagcuguugagugucaccccagagccagagagucaucuuguaaccacauacucacccugugaagauagucucucauguuauagggcuauugaggggagucccuggguuuaucauaggcccaguucacugcagcuuugugccaugaagaaggagcccagcaucacuucuacugucuugagcuguggggcuacauucuuuagggaugccugguaagcagauucaugguuuuuacucuuuuuuuuuuuucuuuuuuuuuuugagacagagucucacucuuucacccaggcuggagugcaauggcauggucucggcucacugcaaccuccgccucccagguucaaaugauucuccugccucagcguccugaguagcuggaacuacaggcgcaugccaccacgccuggcuaauuuuuguauuuuuaguagagaugggguuucacuguguuggccaggcugguuucaaacuccugaccuuaugaucugccugccucggcaccccaaagugcugggauuacaggcgugagccacuacgccuggcugguuuuuacucuuguggcucauagcugguaaaguagaagccaaaaagauuccuuccuaaugcagggaaguuaacugguccaggguacaaaggaacaagggaaagcuagacaggagguaaaggguagaaguccccauugggaacaaggguuucuccuuguuccugugaaguggggugcacaguaaacaugugagggacauuuauuuucacaaaugaagcuggcuagaaaggugaguugucuccagaaucuaccauauugauauaguuagugccaguggcugcuuuuuguaauauuugcugacucccaacagcaaguguucacaacagucuuuuacgguuuccguuggacugguaacauaaaggaaugacauggaaauauccgcagucacuccugcucauuagagugaaguuucacccagacaaauagcucugagauugugacaguucuauaacagcauuuacaauuauccaaaacauugcccaucaugcugaacugcagagggguagugaaaagacagaauuuaguaacucaagcuuagauuuggccaugaaguaguauuauagagaaaaacaauccuaaaauucauagggagccagaaaagagccugaauagccaaagcaauccuaagcaaaaacaacaacaacaaaacaaaacacaaagcuggaaacaucacaucacauuaccugacuucgaauuauacuacaaggauguaguaaccaaaacuugcaaaacgugaggacuuuggaauaugauauuucaaauuugguaaacaaaaccccuaagaacauuuguucuauaccaaguacuguuccaagcacuucucacauauuaaucaccagcagcauugcuaugauacacugucauuuuuacagaugaggaaacugaggcuaaaagagaugaaguauuuuacccaaaaccacagcuaguacuugacagagugggaguuggaccucaggcaguccugcucuuuuccaacagaaccaccauggggugugaucugauucuuuguugguagaaaaacaggcuaaaaucuaaucucaggcuuuaccuucagagaacaaaaauaggccgggcgcgguagaucaugccuguaaucccagcacuuugggaggccgaggcaggccgaucaccugaagucgggaguucgagaccagccugaccaacauggagaaacccuaucucugcuaaaaauauaaaauuagccaggcauggugacgcaugccuguaaucccagcuacucaggaggcugaggcaggagaaucacuugaacccgggaggcagaguuugcagugugcugagcucaacaagagcaaaacuccaucacaaaaacaaaaacaaaaauaguguguucagcucagaagacugcuacuggggagggggcuacuaugcucuuauauccuugucgcagauccuuuccccuagaaagagggcccuguagaagaauuauauucccaaacaaugaauuguguagugguaauuacacuguugccaucccuuugggaagaaggcuggggcggugauuacauuccaaaacagagcuguuuggguguaauugcaccgugcugcucuuaucagucuggggacggcaggccucuggucuccauccucauuuguuuuugagauggaaucugaacagcauucaauuaauagucaagacccaggcacagggaagucagccaaaagagccaagaggacauuaaguugcuauuggcauuuuccuucuacugaaguuuuccagaccuuuaaguaucagcaaauuugagggggagccuaguugagaaaauuuauuuggcuagugaaggguuagagaucccucuuuaagaggcugugccccaaaccccucauuggucucuauacguaaaggagagauaguuggauggcagugaaauuuuccucuucuaucagcagcuuuagcucugucaaaagguaguccuuccuugaaaucauucccugggacuugcaguauguauauauuuuuuucauguauguagcuuccaaaguuguagagcaaagagccucucucugguuguuuugagauaauaaggcugacuuugguuaaacuucagcaauaaucucuagaucuggacuagaagaaaaaauaaaaugaauuauuuuguuuuaugacucagagaacaaaaaacugccaguugcuuuuaagguacacauguugaucuagagcaaagaaggaaaagacgcauguauugggaugaggguugcacaacccugggaagugguauagcuuuggccauuaugucauuuagcuuuugcugcugaacaaaccacccccaaauuuaguggcauaagacauuucuuguuucucacaauucugcgaguccaauugcaguuugccuggucugcaucauuggcucuucucuguggucaauuaauagcuuggcuggauguggaugaucuuagaugguuuaguagguaaaauaaugaucugccuaagagguccuuccacaucuuaauccccagaaccugugaauauguuacuuuacauggcagaaaggacuuugcaguuaugauuaagauuauagaucuugaggugggaagauuauccugauuuaucugggugggccucaucugauuacaugagcuauuaaaaguggaagaggaaggcagaagggucagucaaggugcugcaaugaucaaagaugggaauggccucugcuaacagcuagcagcgagugggaaccucaguucugcaucugcaaggaacugaauucugccagcaaccgaaauggacaaggagacagacccgaacacaggccagccaacaccuuucuucuagcccaaugaguccuuuguuugacuucaggccuauagaacugagagauaauaaauuugucuuguuuaagccacuaaguuucugcuuguuguuauggcaguuauagaaaacugauaacagauaguuucacacauguaucuggcauuuggcaggcuauuuggcuucagcugggaugacuugucuccuuucuauucaccaguaaacuaaccugugcuucuucacauagugucucaggguugugugugugacggaaucucgcucugucgcccaggcuggagugccgugguguagucucagcucacugcaaccuccgccuccuggguucaagugauucuccugccucagccucccuaguagcugggauuacaggcgccugccacuacaccuggcuaauuuuuguauuuuuaguagagacaggguuucaccauguuggccaggcuggucucaaacuccugaccucagaguucugaaaagaagcaggagaggucaaguccuacugcauaagcacuuuuugaaucucuccuuaugucauguuugcuuuuguccauuccaucagcuaaagcaagcuguuuggguaagccccaaaccaggaagaagacucucuaaggccauggauacagaagggccuaaaucauuuggggccauuacuguaacaugcugccacaacuaaguaggcuuugaaaucugagguagccugcuagcacacucugaacacauugcuuuuuuuuucuuuucuuucuuuugagauagggucucacucuguugcccaggcuggaaugcagugguuugauuacagcucacugcaaccucugccuccugggcucaagugauuccccggccucagccucccagguaaccgagacuacugcacaugccaccaugccuggcuaauuuugguauuuuuuguagagacaggguuucacuguguugcccagacuggucuuaaacucuugggcucaagcgauccuaccaccuuggccucccaaaguguuaggauuacuggcgugagccacugcguccagcacaaauugcuuuuuuuaaaaguguccuuacauauacugaggaaagcuucagcauaccaaaggauauaaagguacagauuuagaacuuucaagaaauaucuucgggcaugguggugcaugccuguaaucccagcuacucgggaggcugaggcaggagaaucgcuugaacccgggagguggagguugcagugagccgagauugcgccauugcacuccagccugggcaacaagagcgaaacuccaucuccaaaaaaaaaaaaaaaaaaaaaagagaaaaaagaaaaaaacaagaaauaucuugccuuagguaauuauuuggguuauucagagaaaugaauuuaggaacaacauucaaauaaaaagcuggacccugguuuccuagacauaggauaucagggaaacuaccuuuucucuuucucuggguauuuucuaggauauagcccuguauuucugugcuggaggguaaaaagaugugcaaaagagcucugugggugguugggccccuuggggccaaauguauuucuguguaggaguaagacugacagaauuaacugugcaagcacuuacuaauuugcuguaagugaaccuguacccguggcaucauuuauaauccagagcuccuugaacagaagcaacucagaagaaaaguuccuaaaaacuaaggcaaggaauuuuugugugcccaauuacuguggcauauuaugcuuucuuauagcagugguugggagaagcaagaauucagcuauucucaagcauaggacuuagcuuuuacuuggcauuauugagauugguuaaaaacuauuuuauggggaccaaaugugaauugcauagauugggccucaggucacauagagacaaauucaguauauucaccagucauucuuuuuuuuuuucauucaccaguaaacuaaccugugcuucuucacauagugucucaggguucuuuucaaaguagagaguucuuuuaaaauacaaaaauuagcucuggcuaauuuuuguauuuuuaguagagaugggguuucgccauguugaccaggcuggucucgaacuccugaccucaagcgaucugcccgucucagccucccaaagugcugggauuacaggcgugagccacuaugccuggccucaccaaucaaucuuuuaggacuuccuugauguacuuuuagaaccaccucagucgcugaugggcugggggcucugcuguugauaaacccuggauauuauccuaggcaugugcauucaaaaugguauagccuauguacaauaaagacguguccucaaagaggcugggcacaguggcucaagccuguaaucccagcacaguaggccaaggugggaggauugcuugcacccaggaaagcccagccugggcaacauagugagagcucaucucuacaaaaaguuuuuuuuuuuuuuuuuccagaaauuagcugagcuugguagcaugugcauguaguuccacaguuccagcuacucaggaggcugaggugggaggaucauuagagccugggaggcagaggcugcauugagcagagaucacaucacugcacuccagucugagugacagagcaagauccugucucaaaaaaaaaaaaaagaaguaucuuuaaagagacaaagacucucccuaaugaaaacucggccuuauccuuuuuugucugauaagaguuagagguuguggugaugagauugagcuaguguccuucuauucugccuuuacuuuuacuccugggucccuuuccccucccacccuuccaccuuucucccuuuaucuguugugggucucaguauuuaagcagauuuuuuuuuuuuuuuuuugagacagucuugcccaggcuggagugcaguggcgcaaucucggcucacugcaaccucugucucccagguucaagugauucucaugccucagccuaccuaguagcugggggguuacaggcgugcgccaccaugcccaacuaauuuuuuuguauuuuuaguagagacaagguuuuaccaucuugaccaggcugguuucgaacuccuggcugauccacccaccuuggccucccaaagugcuggaauuacaggcgugaggcaccacacccagccuuaagcagaauuugaacuugauuuucuuuaaggcagaacuaauagagcuaacacaggagcuaacugagagcuuauaaaagccacaaaguguuucuuggucuaaauauuuuucuggauucugcugaugugaagcaacuggggaaaagugguaaaauguuguauagcuuauuuugcaaacuaauuaaaacugaaaauaucagugcaaagcuggaguaaauuguuuaaaaugcccaguuucuucacucccauguucuagguggagaggccacagggacaguuuaggagcacaugcugugaauaaguuucuggcuauucuaaucuaugucuuaccugggaagaaugugaagguccuaugggauagaagcaguaccagcaccacggguuggcuugggacucuuuacguaucuccccaccacuauuaucuaaccacaagccaccccuaaaaauacaccaucuaagugaaaaacagugugcuugcucugccggcagcuucaagacaagucaccuaacuugugcacacccuacucguucaccugccaacccugagacucauuuauagaauuucuugagcugccacuggauggaacuaacagagaaauuggccaugggauuuggagguaauagugcugaaggaaacacugacuggcugauuuccccucucaacuucauggacacuuuuuccucuucucuguuauuauuucuggguacuguguguuggagguuugguuuguguggacucaucagucauuguuuucaggcacugagugcagcucuccaccuuuuccuuugugauauuagugucuccccuauauggaagagugaccauuuucugaaaggcuaaugcagcuauggaggggaacaguguucuuuuccgacaccuggagaauagcuguuaggguuuagaauuccugaaaaaaaucauuuuagucuugauauuuuaguauauccuuuauuugaagcugccugcuuucuuugccuucuuucuugugaaugccacaguuuccuguuccaccuuucuccgaaucugagaccuuacaguaaaaaagaaguaugcgacaagaaauuacgggauucucguauccagagcaaagugaugaugguugcaaguugacuauuugacauuuuacaguuuuauaugacucauaacuuuuguguggggagcauaacugaaacaaauuaucaaacugggaauggccucaggggcucugucucugaaggaaaggguuggaauuuugaguccuugggccuucugaauuugacaaauugaauuauccuaggauuccucugucucucauuuucauuuuucauuggauagucugugaugggaggggauuuuuguauacagagaaauagacucaaucaaagaauacagcaaacuaauacauguggaauuaagguccagucuacccccucaaagaaauguaugcuugucuguuccuuuuccaaccuggaaccuggacauuaaacuguugaauauuuugucuaucuucccuuuuggcuuugauguucuuaaacguugaacguuagcaaaugucauggagacacacccauaacuacuuucuuguaaggaaaccaaggacuugaauucuucucuuauucauaauuaauacuuugcauuccaaguuauagguagcacugggcgcuggaggcugccugccagauaggcugacuaggguuugaaguuaguuggguugcuauucuacuuugcagaagaaccuaaaauacuuuaauuuuuuuucuauugauaagacuguuuuucaguuuaagauauauucaauucaccucacucauuuucuccucucaucuccucuccaaguacucagguugauccuaugggaacauaaugucauccuccucauguuauacauauaugcggacuuugucaggcugagccuuaaaauguccauuucucaagcgcacacuguguucuuucucuuucgacuaucuugcuuuuuguuuuuuuucacuguucuggcucugauauggguuagcugcccucagugaaccaguacuguauuucuuuccuugaacuuaacuuuaccugcuagccauagggaaaauccagaaugaguacuaauccuuucuggauuucccccucuguccaacagacaguauaguauagaugcuuaagaacaaggguagaggccaggugccguggcuuacgcuuguaaucccagcacuuugggaggccgagguggguggaucaccugaggucuggaguucaagaccagccuggccaacauugugaaaccccgacucuacuaaaaauacgaagucagccaggcguggugucacgugccuguagucccagcuacucgggaggcugaggcaggagaaucgcuugaaccugggagguggagguugcagugagccgagauuguaccacugcacuccagccugggcgacagagcaagacucugucucaaaaaauagaacaagguuagaaauugggccucuguuuauguugagaaguauaugaauagaccuguucguauugaucauauaccugauaauaauuaauuuauuuauucccuuauucauuugaaaguauuuuccuccggugguucuaauauuuacuaacuuaauaaugaaauuaaucaaccaggaaaaauaucaaacugacugauuuuaccaccacauuuauugcuacucuuuuuuuuuuuucuuccuaaaucagggcagcacccugaaccaguaaaaguucagggaucuccucauugcuauucuaaggaguaauauaguccuauuuucaaguuuguguguauucauuggaauauacuucuugagugcuacuaugugcuagguagguccuacacuaaguguugggaauuuuuaacaggaaaaauuaaguuaccuucuuuaagaauccuuaaaggauccuguccgggugcgguggcucacgccuguaaucccagcacuuugggaagcugaggcgggccgaucacaaggucaggagaucgagaccaucguggcuaacacggugaaacaccgucuccacuaaaaauacaaaaaguuagccgggcguggugguggguguccguagugccagcuacuugggaggcugaggcaggagaauggugugaacccgcgaggcggagcuugcagugagcugagaucacaccacugcacucagccugggcgacagugcgagacuccgucucaaaaacaaacaaacaaaaaaagaauccuuaaaggauccauuauuuuucugccuuuucaauacuuauuauugcuauucuaccuccagaaauccuggauuuuuucugauucuuuaucacugaucauuauaucacucugugacaguuucccccacaaguaacaggaagaauuaacuuuguuuuauguuagggcuuuauccaaagaugucaauacaauacucauccuaucagagaaauguguuacaaaaaugcaaguuaucacccucucuacuuuucucugugucacuuaaacacaccuaaaguuccuggcacucaaaccagauguacacaggcuucuuuuccucagaaagcuuuuuugggguauugcagugucuuuccagcuuuagcuuccuuugaugaggucaguugucucuuccuggcuaucacagaggcugucaugcugacaugauacaggaggauguagucuuuaaugagugccuuuggcacuacuugucaauugcuuauuuuccagugacguugcauuaaaguauuaauuaaccacuaaauucaaguugaccucuuaauugaggaggcuuugcuuuccugaaggcaggcagacugacuuuccuaacaugaucuagcacucuuguaugccaauaaguuuugaucaguguguaaaauauaccuuuacuaaaacuguuacuguaauaucagguugauuugagguugaggaagucacacuguguucuagagugggauuuauaaguugguaugagcaagagguaagggacugguaccaaagagcaagccuguguuuccuggagcauguguggaguuugccuggugagcaggugacagggcagggagaacagcucugcucagugacucagugacauaguuccgaaggccaccagauaaggacuaggagacauugucuuacuguaagugauuuguguuuuuauuauugcugacuuuacuguucucugagucuuuugauuccuucaaauugcuaagaaaucuaguauucaaauguauguugugaacacaaaaagauugagaacuacugaucuuguguuuuagaaaauaaacuagaaguugacagguuguucuccugacuccuucaguaauucucuauacaauuugagugagucauuuaaccucuguccacuugacaggugagggugugguacuuaccgcuauguuccuuccagaauuuaaguaggaaaaauugguaaagugcucuaacuucauuugaaaaagauauuaucuguaguccaaaggaagaaaauuaaauauauguccuagcacccagguuauuugcgguagcugaacuacuugagacaagcugggacugccaacuuuagauguuccagugacaagaacaccucaaugcuaagagacaggcucagguggcugaaaaggauccaucucaguuuaauaaaaggaguugccaaagaacaucugaguugugcuaggcacccuugggacauaaaauaaauacuucuuguugaacuaaauagaagcggucacagcagcaguaaggaggagguaagacuuguccaggauuugcacagaaucuuuucauaggcugaauguugcuccacaauguguccuuugacuaucucuggcuaauuauuauuuuaaucucuucucagcuuuuccaagaacauaacguuaaccaaagaucuuaggccauucacaacucuuuuguaaaaauuaauguggaugugaaacgaggcaacaaauccugaaguagaaaguuauuccuggccaggcacgguggcucacgccuguaauccuggcacuuugggaggccgagguggguggaucaugaggacaggagaucgagaccauccuggccaacaugaugaaaccccaucucuacuaaaauacaaaaaauuagcugggcauggugacgcgugccuguagucccaguuacucaggaggcugaggcaggggaauugcuugaaccucggagguggagguugcagugugccgagaucacgcuacugcacuccagccuggcaacagagcaagacuccaucuaaaaaaaaaacaaaacaaaacagaaagaaaguuauuucuuaacccuuuugggggaaaugccaaaauacucuuaaaggaauauuacucuguugcccaggcuggagugcaguggggcgaucucggcucacugcaaccuccaucucccagguuuaccccauucuccugcuucagccucucgaguagcugggacugcaggcgcccgccaccaugcccagcuaauuuuuuguauuuuuaguagagaugggguuucaccguguuagcuaggguggucucgaucuccugaccuugugauccuccugccucggccucccaaagugcugggauuacagguaugagccaccgugcccagacgaauuuuuauauuuuuuagcagaggugggguuuugccauguuggccaggcuggucuuaaacuccugauuucaagugauccgcccgcccgagccucccaaagugcugggauuacaggcaugagccacugcaucuggcgugaauucaaauuucgucuaaacucuugguaaccuggagaccaugggcaaaugguuuaucuugaucugagccucaauuuccuccucaucuauuagauagggauucaguaaauucuuucagcaacuacccuaucagaaaucgccaugcaacauuuuccaugccucuucccuguuuuauauuucuccauggaucuuaccauaauuuaacauacuauauggugaacuuauuaguucuuucuccuccucccucuagaauguaauuuccaugaaggugggaauuuuugucuguuuuauucauugucuggcauguaguagauacucaaauauuugucugaugaguaaacaaacuuccuuuagggugguugugaagauagaaugggagcuuuuuauuuuauuuuuuugagacagucucaccuugucacccaggcuggaguaugguggugcagacauggcucacugcaagcacccaacuccugggcucaagcaauccucucacuuuagccuucugaguagcuaggaccgcaggcccauggugccacaccuggcuaauuuuuuuuuuuuuuuuuuuuuuuugagacggagucucacucugucgcccaggcuggagugcaguggcgccaucucggcucacugcaagcucugccucccggguucacgccauucuccugccucagccuccucaguagcugggacuacaggcacccaccaccacgcccggcuaauuuuuuguauuuuuaguagagauaggguuucaccguguuagccaggauuggucucgaucuccugaccucgugauccgcccgucucggacucccaaagugcugggauuauaggcgugagccaccgcgcccggccaaccuggcugauuuuuuaaaaaauuuuuuguagauauggggucucccuauguugcucaggcuggucuugaacuccuggcucaagugauccucccagcuuggccuccaaagugcucggguuauaggcaugagccaugguguccagucuugaaugaaagcuuuuagagcacuuauuuuggcacuuggcauguuuucuuuagcucuaaggaagauaauacaagucuuauuuauauaacugauuaauguauaaaguaucuugcuacacaaugcuuaguuauaucagaaugcaaguauggauauuagauuauuguaaauuuuuaaaaugaaauaggcugggcacaguggcucauuccuguaaugccagcacuuggggaagccaaguuaggaggauugcccgaggccaggaguucgagaccagucugggcaacauagugagaccauaucucuaccaaaaaaaaaaaaaaaaaaaguuuaaguuagcugggcaugguaguuugggccuguaauccuagcuacucagaagguugagacaggaggauugcuugagcccaggaguucgaggcugcagugagcaaugaucguaccacugcacuccacccuggggcaacagagugagauccuaucucuaaaaaaagagaaaaagaaagaaauauauguugcuaagucuuauucuuagauucauuuuacucugaagauaacauauuuaaauugugccuaguuuauaguauuuucauuguacauauuuucauauaauguacauauuuucauacaguuuucauauauauuacacauauaauagguguacauauuuucugucuccuucaagauugucaguucucucaaguuaggaaccauaccuuuuuuucauaguugcuguccccaauguuucuuuuacagucuguuguaaucuaaggauucuauuucuuuuuuuuaacuccuuacuaucauucccaagguacucuguuucuaaaacauucagagaaauaaaaaauucuguuauaaaaacaaugauuucauuuuggaggaagggaagauuaggagcuggagaguucagcauaaaacacauuuuaccauauucaaugaaaauacguuagauauagauauaacuguaaagccuaaacuaacuaaaucuaauauuuuauuacaucuucuuuuucuuuuuuugagguggaguuucccuguugucacgcaggcuggaguucaguggcgugauuucggcucacugcaaccuccgccucccagguucaagugauucuccugccucagccucuugaggagcugggauuacaggcauagaccaccacacccagcuaauuuuguauguuuaguagagacgggguuuugccauguuggucaggcuggucucgaauuccugacuucaggugauccaccugccuuggccuccugaagugcugggauuacaggcuugagccacugugucuggccuuccuccuuuucuuucucucuuuuucuuuuuucuuuuuuuuuuuuuugagacggagccucacucuguugccgcccaggcuggagugcaguggugugaucucggcucacugcaagcuccgccucccagguucacgccauucuccugccucagccuccugaguaacggggacuacaggcgcccgccaccacacccggcuauuuuuuuuuuuguauuuuuuuguauuuuuaguagagacgggguuucacgguguuagcuaggauggucucgaucuccugaccuugugaugcacccaccucagccucccaaagugcugggauuacaggcgugagucacugcgccuggcccuggccuuccuuuucuuuaagagugaugcuugugcuacuaggaggcugaggugggaggauuccauaagcccaggaguucagaguuacauugagccaaggguaaugcuugggccuccuuccucuucuuuuuucuuuuuuuucaagagaugaggucucacuauauugcccaggcuguucucaaacuccuggacucaagccauccuccugccuuggcaccuccuaaggugcuugggacuaccagugugagccaccaugcugcccgccaccccuccccacuuuuuuuuguauuagugauuggucccaccacgcacugcuugcugcauauucuuuaucaucuauuguucuuauaauucacagaaccacucaaagaaggcagcuguuguuuggccauuucuucauucaacaaaugugugaggguuuccaauauaccugucaccauccuaugcccuggaagaauagcaaccauguuuuccuaaguaaacugaagauuccaggaucucuucucacuauucuagcccugauugaggccauuaugcuuucguagcaguuuccugccugguuguucccugcuuauaaucuucccaugccagaaauacuugccaguauguggcccuagacuucugguaaacaugaaagaaugaacauguguguuuaucuccacucucucccagaucucuucuaaauuaacaguaaaagggccaggugcaguggcucacaccuauaaucccagcacuuugggaggaucacgugaggucaggaguuugagaccagccuagcugacauggugaaaucccaucucuacuaaaacuacaaaaauuagccggguaugguggugugcuacucgggaugcugaggcaggagaaucgcuugaacccaggaggcagagguugcagugagcugagaucgugccagugcacucuagccugggcaacagagugagacuccaucccaaaaaaaaaaaaaaaaagaguaacauagaguaacaguaaaggaauuagacaaaaguauauauucauuguaaaaagagaaugggaaaaagcgagugaugauuaguaagugaugacaagaacauuucucuucuagaagaaacaaaauugcaugugaaaggaaauacgaauuuauuauacuauuccuguauuugugaauauuuauauaguuauaauacuguaaauaauuuacauuaacccaaacaugggauguaacuauuuuggaaggaugggggagaaaagaagguaggaacaaaucaucucccaucauaggaaaucaguagauaauagcggaaauugaaaaaucaguuauaggccuagugcaguggcucacaccuguaaucccaguacuuugggaggcugaggugggcagaucccuugagaucaggaguuugagaccagccuugccaacacggugaaaccccuucucuacuaaaaauacaaaaauuagccaggugugguggcgugcaccuuagucccagcuauucaggaggcugagacaggagaaucgccuggauccgggaggugaagguuucagugagccaagaucgugccacugcacuccagccuggcaacagagcgagacuccaucucaaaaaaaaaaaaaagaaaaaagaaaagaaaaaaagaaacauuaguaauuuuagaaauaugaugguuaauuaucagaagaaaaaaaagguuugaaaagugauugccucuggagaacagaaaucaaggagggugggucauggggcuggaggcugccauuuaacuuuauuagccuugaauacuuucuaacuuuaaaaauuauggguagguaguacuuugauaaaaauaaaaauuugaaagcuauccacuguguaauuuacuuacucaaaaaugucaaaagauuucucuuuccugccacacagaugacaaguuccuuaucuuuuuucaaccugaucucuauuauuauuuauauaagccuuugcuucccacugaacugguauuagcucuugaccccugaauccacuuugagcaguaaccucuuucuauccugaaccauucuccuuuccacaugcuucaagcccuaguuccucuguacucuguaaauuuccugcuccuucucagguagccauuggugcccaguggccccuuccuaaauggcuguggcugugguuggucuccucguuagauacucacauugcccuuuuuuuuuuuuuuagacagagucuugcucuguugcccaggcuagagugcaguggcacgaucucggcucacugcaaccuccgccuccuggguucaagugauucuccugccuuagccucccaaguagcugggacuacaggcgugugccagcacgccuggccucauuuauaaugcuuuugauggaaguccuaucuucccaacuggauuguaggcuccaaacaagcaagaaguacaucuuacuaccauuuuauguacaucuuccacagugcuauuugauaaauaccuguuuaauauucaguucucacucagccaucaaaaagcuuucuguuuugagaucacuauucuuuauucuaggcaugucucaagacucuguacuuuagucuagaucccaaaucuguguaucuuugucagccuuagugagguugaaggccaaggcuuuaucuguuugcugcugauacugucgcugguuggcacagcaugcuaguuguuuuuuauagaauauagcauggacaguugcacaauuucugugaauguuuaagcaagauuguauguauacauuucagaaguucuguguuacuuaugagaagugcuaauuuaucaugagcaucacuauuuuggggauggaugaaccuuuuuccuuucuaccuccuuacacugaugaucccuuacacugcaaagagccaggaaaaaccaaaaguaaauaaagcccuaugcagucuccacuuuuucucuuugcacucucuaaccaccuggcuuugcauguucccuagagaggcuuccucugugauauaucuuagccuguugagccccaaaguuaccugaaauauuuaggucacuaguuuuuaaucuuuagagaacagugaacucucugagaaaauaugguaaaaacuuagacccuacacuaagaaaaaaacaccuacacauaacuguaguaacgugugcccaggauuuuguuuuuauuccaauaugguaaggacaaaagaugaagagaugauugccguugaaaggauaguuuguuccuuacaguucccaagagaugagcgugugccaugccacacaacacaaggccacauggggaaguaccagggagucaggaggcagaaggagggcagggaggagcaugagccuuuauugggguuucuaggggaagggaugggugaggcuaaguaaguuuaggauuggaucgguuugaauaauuuuggcagggucugggcuguaggugugggcacuaguuguccauacuuggcccuggggugauuuagggcuggggaauauugucuugguguuuauuuuuuuuuauuuuuuauuuuuauuuuuugagagggaaucucacugugucgccaggcuggagugcgguggcgcgaucgcagcucacugcaaccuccaccucccgguucaagugauucuccugccucagacuccugaguagcugggauuacaggcacccaccaccaugccuggcuaauuuuuguauuuuuaguagagacgggguuucacccuguuggccaggauggucucaaacucuugaccucgugauccgacugccuuggccucgcaaagugcuuggauuacaggugugagccacugcgcccggccuugucucgguguuuaauaaaggagguaguuaggguauggacucuggauugguugguuugcauaucaaaggcaaguuguuugcaaucuccaggaaguaacuaacccugggagguacaguugcuuaucugcaaagccccuaagaugucaaagcaucauaaaauauagaaaauuaaaaauauuaauguaauaacacacucaugaacacaugcacaauuuuauuugcuauuucagggguuucuugaaccaccugaagccuaucuguagacccaagguacaaaacccaaauuggguccugggagcucugugccuuugaauacaguauuugaguuuaguuuagaccaucucaggaaggugcauagugaauuauuaaauccagggaaaugcagcaacugcucaacuuuuuugguaaagcuuuucuuucuacuuuguuuugacuuuuauacuaggagcuuauuuguggguauuuugugccaagagggauaagccugcauucucuaauugcugcaucaagucugcucacagggcguccugaugacauuuuaaauacauggaaauuuuugaaugcaugaaaacaucuagugcugauucucuggcaccugcucuucucuucuuggaguuuaucccauugccuaauucuguauauuguuuccaaaccuuucauuaaccauuguuggaauuuuugcuuuuuaaccucagcauccccacuuaucuuuugaacagaaacaaaaacugucucugacuacuaggcauuuccuagagugaaaagcucccuaucucuccuuuucugacuuuucagagcaugaaauggcugugcuaauccuguuggccccaaggcaagagccuugcagaggcuaacaaaggagaaggccugcacccacuuggaucuuccacaggccagagcaggaauuuuuuuguuacguuuuaccaacuugcagagggaagcccgcccaccccggcuuuguuuuggcugcaguuauauuuccccugcaugaaaccaucaauuucuuagggccccgaguacugugcuauguagacuuccagaaguugggugcuuuccuggaguugcagaaaucagacaaaagauuuuuaggaauuuuggaagugccauucugacgauugaguggguaucuucucaaagccaaagauacuuugaguccuaguuaacaaauugaguuguaauucugugcuuuugugcaagguacucuuuaguuaagugcaaggauucggagguacuuaagucucucagagggauuuaagguagucccuacucuuaaggagcugacagucgaauaguccaagucagauauauucaaguggcccuuuguuucuuuaauuaauauggaguuacugcauaccuucuacagcagagcaucuauauauuuuauauaaagaugaagaaacuguguguguucuugcuaucagaggcaccuacuaauaauguacuauggggauucagauucagggaaaguguugagugggaauagaacagguauacuuggcuuguagauuuugaguuggccccuggugggcugaauuuuaaacucauccucaaguggagugaauaaugguagagcauccugcagagggcaggaaauugagcagaagaacuguaacagaauaagagagaaacaaagugccauggggcuucugaagaggagaucauaaucagguuagugagauuagaaaagacuucuuagaaaaggggauuauuggccagacgugguggcucacgccuguaaucccagcacuuugaaaggccaagguagguggaucacuugaggccaggaguuugagaccagccuggccaauauggugaaaccccgucucuacuaaaaauacaaaaauuagccagacaugguggugcacgccuguaaucccagcuacuugggaguuuugaagcaaggagaaucgcuugaaccugggaggcggagguugcagugagcugggaucgcaccacugcacuuuagccugggugacagagugauacccugucucaaaaaaaaaaggaggggggugaauuauuugagaaaguacuugaauggggagaugagggaugaaggggauuuuaguaaacauugacuagggcagggaggagggagucuagauagugggggcaguaugagcagaagguuuaaauguagggauguguuuaaaacacauguacaaagugaugggucuggagagcagugggagacaagcccagagggguagaugacagacagguccagaucgaggagggccuugaagaccaacgagucuaccucaguguagucagugaggagccacuaaagcuuuagagcagguaagugacaaucaaaaaucugcuuuaaaaacaaucuggcauugaagacagacgugaggagaguaaagaggaagauagaugguuuuguaugggacaagggcccggcgcuuaguguugacugcaagauuauuuccugguuucccauaccccaaggggcauauagagaagcuugcagguuuuuguguauucuuuaugaugaccagcaacggaguuggucuuaaaaaggugugugcuuacaccgccgugcucacuuguuuacgcgcaucccuaacuugugauagcagguccaggguuuucugggagaugcaugcagcucugacagaaaaggaaacaccaaaauacauuuuaaucucgucagauaucucuuguaaaagcuagaaauuugccacaggccuuucucagacauuuaucuaaccugacauuaaaauuaugaaggaugaaggggauuuuaguaaacauugacuagggcagggaggaaggagucuagauaguggggggcaguaugagacuuaaaauuaagucuuucuucuuuucaggguaagacguuauauggcaucaagauggcauugaagagaaaugcuugggccugggcauguguuugcaugcuucaucugugcagacagauuguuccuaguuugaacucaggaauuccauggcuuuagagucucugccuuugugggguacaaaguuuaugugaccauaugucacucaauagcugccugcagaauaguuucaccagugcaguagcucaggcuuuacaugguaugaacuugauucaucaagacucaggacauguuucugugggcauaaucuuuuaugucagcaauuccaaauaaacagaauguagacuuucugccugccucuggaauuuagugggacuccacauccccaaguauuuaacuuuagccaauuaugaccucccccauacuauguuggucaaggcuuaagauugugggaaagcacauaaauguucuuuccuuuguauucccaguuguuugcuuucguuugcuuccuuccuuccuauugugagaaauuuuaaaaauacuugcaaacauaugcccagaaauuuuagaguaguaucuauacaggcauauauaugacaugcauuugugcuuccacaaccaaaauuuaauaguuauugacauuuugcccuauuugccucaacaaauugaguuguuuugccccauuugucucaacaaguuuauuauauuuuauuuuuccagucagggucuuccucugucacccaggcuggagugcaauagcaggaucacagcucacugcagccuugacuuuccagguucaagagauccuuccaccucagccuccuaaauagcugggacuauaggcguguaccaucgugcuuggcuaauuuuuuaauuuuuuguagcaauaaagucucauuagauugcugaggcuggucucgagcuccugagcucaagggguccucccgccucagccucccaaagugcugggauuauaagugugcaccaccacuccuggcccuaauuguuuuuuauuuaauuaauucauuuauuuauuuuugagauguggucucacuauguugcccagacaggccuugcauuccuggccuccagugaucuucccacccuggccucucaaaguguugggauuacagaugugagccaccgugccuggccucccaacagauuuuugaaaaugaaacauuucaaauaaaguugaaguuccuuugaccccuuugauuaucuuuaccacuucacaggcaucugcucuuaugacuuugguuuauaugguuguacuuuaucuuuuauagcuuaauauauuaguaaaauauuguuuuguauuuuaagaguuguguuuaugcuggacgcgguggcucacgccuguaaugccagcacuuugggaggcugaggugggcggaucacgaggucaggagaucaagaccaucuuggcugacacggugaaacccugucucuacuaaaaauacaaaaaaaauuagccgggcaugguggcgggcaccuguagucccagcuacuugggagacugaggcaggagaauggugggaacccgggaggcggagcuugcagugagccaagauugcgccacugugcuccagccugggcaacagagcgagacuccgucucaaaaaaaaaaaaaaagaguuguguuuauauaaauggggucguaugcauauggaucaucauauaacuuuuaaaauucaguauuauaaguccauguugauauaguuugauugauuuauuucuguuguuacauaguauucuaauagucauucguaugucuuguugucuguucccgauugaugaacauuuaacuuucuagauuuuucacucuuauaaugugcccugaaauucuguacacauguggugucuucucuaagauguuuacacagagaugaaauuguucuggcucaucuucaguuauauagcacagauuuuuuggcuacuaaagcuauaacacucuuacuucuuaaacaugugaaaggcaucucaggguauuauucugaccggcacucagugaaaagagggaaccugaggcuccugaacuucauugguaaauccaagaccaaggaguuuuucugaaguccuucaacucuuuagcuucauggaauaaguaaauguauaugucaaauacaauggagauuaaauaguaaaauguauauauuuuuuacuucucugugguauuccaggguguguguguguguguguguguguguguguguguguauguguauuuuuuuuuucuuuuugggagggagauggagucuugcucuguugcccaggcuggagugcaguggugugaucucagcucauugcaaccuccaccucccagguccgagcaauucuccugccucagccucccaaguagcugggauuacaggcaccugccaccaugcccagcuacuuuuuguauuuuuaguagagacgggguuucaccauguuggccaggcuggucucgaacuccugaccucaggugauccacuugcgucgguuucccaaucuaggauauaaauuuuuuauuaaguuguuauaaauauaaguaucagugucucugacccccuuuuaaaauuuauaaaguaauauaguuucacuguaaauaauucaaguaauaccaaaauauauaaaguaaaauguucaaauuucucuucccacucuuccaaccccauucuccaaaguuugauugguuuguaacaugucuuuccaaguuuuuuucuauguguaauaaaaaacauacguauauuuauacaucuguauaguuuucaucauuuuauuuuguaguggggauggaaucauacagaauauccaggauuucugucuguccguguaucuagaucugcuuuauucuuaguaguggcugcgugguguuccaugguguaguuggacauaauuuggucaccuauuuucuucccgauggauguuuaaauuuauuuauaaugaaagacaaacucuuuuugcaaaauauaguugcuuuguccuguuccuggauguauaugccauacuaaaaacuccuuuaaauuaugauuugguucuguauaauucagccagucccucuaauacgcauagguaguaaaagccgucuaggaccuguuaucucacuugcagaaggagcaguuucuaaggccaauggugacauuccuuguguauuucauguuuauggaugggaauauucuaaucccauggcuggacaguaucuaaaaugugagguucuggucauggugacucaagcuuuuagucccagcuacucagguggcugaagugggaggaucacuugaggccaugaauucaaggcuguagugagcaaugaucaugccacagcacuccagccugggcgacagagcaagaucuugucucuuaaaaaauuaaaaacuuaaaaaauauuauaugaaggaaaaguugaucccuucucucaaggaguucaccaucucaagaagaaggaaaaaucacacaguaccaauggaaaaucgauggcucaguguacacagaggcaaaaacacuugaauucggaggaaacuuuauguacuuguagucagguaaccuaacagaugacaaaguuuuguguuaugaaaaacagcuaauaguguguaggcagggauuucucucuaauucaggaaagcuucugggaggaggugggguuuuaaacaggcuucaagacugaaaaggcucaucuggauggcuguguuccaggugcguccuuuuagcagcgucucaauauauggcuugcuaauauugcuuuuccacuguguuccugguguuaauguuugaacacuggauuuuaauuagaagcuauuucaaauuagcuaucuuuuuaugacaagugcuguucuccucagauuccacagcauaugccugguucuggggacuucucaaguuucagagcaguuuaugcugugaaacagacccauucaccaugcucucucucacuuauuuuugcuccugauuuuccauuaguggguuccugcacuucagaacaagggucugaaaucuuuuuuccauuuuagaaucuaaaggaaaacagcauggcugggccaguaggguggaaugucuuuuuuuuuuuuuuuuugcaacggagucuugcccugucacgcaggcuggagugcaguggcgcaaucucgacucacugcaaccuccaccucccuccuuggcucaagugauuuucaugccucagccuucuaaguaguugggauuauagacaugcaccaccacaccugguucauuuuuuguauuuuuaguagagacgggguuuuacuauguugauuaggcuggucuugaacuccugaccucaggugaucugccugccuuggccuuccaaagugcugggauuauaggcgugagccacugcgccuggcccagcccaucuuauaagcaaccgucaccaccaaauccauuaagaaucacuaauauuuugaccuuacucaaaaaagccucaguuccauuacaguaaccaagucagccagaugcuuuaucuugaugccacaaaucucaaaauuaacauuuuccuugaaccuaguuguggaacacccucaagauugucaaccguuaaauuuuuccccccuuccaaggugaaugugaaguuggacugaguguuguauuuaggaguccauuuuccgaucuaaccucaccuuugaccaccaaguucugugggauuuguuagcccuuggagcuuagccugucugucgcuggguaaugguaauguggcagugauugcaguggacugacaccaugcuguccuuagccugaaugaagcaggcuuugaauuagaggguucagcaggcuugggagcucuucaccuuucuucgcugggagcaggccuguccucuuucuugcauguuggccccaacugacucagcuguaaugcuguacccugaaauguacaggugcugauuugacaggagcuuuucacccuuuagaagcugggcccccuaaugugaauguaggcucauagagcaauaauucacguguagguggccuguaaggaaaguuuuaacaaaagaguugguuaagaagcugauuuauuuucuugcuuuaacucucuugucaugugcugagugggggcggaagaggaggggaggguggggacuggugcugcugaaagcauuuaucuucauuucugccaucucccaguguuuauuacccugugaucgacagaugaggaaagcugccagucaaacccacguucagcacauuuccauuucccuucauugcagauuuuaggcuuuugaaaucugcauccucuuugcagcaauaaaggucguuucccuccugcugcugacgagccaaagacccucugguccaauuccacucgcuugugcuuccaccaaacaauaaaagcugcgggagucucagcaauuuaagacaagugauuggugagagccauuuaguguuugagucagucgcucucuuuuucuuucucucucaccuuuuucucccucaguccuuuucccuaccuucaccccucucuuugcccauucuuaugcugcugaggcacccccuuaagcagcugcauugcauaaugaugagaggcugacaguuuuccuggcuucaccuagggacccaccuaagccaguguccucuguugcugggauuaaguauuggcagugucagguuguggggaauguauuaguggagguagaguaauucuuaauacucuuauccaccugcaagucuuuugucagagguagaggcuuugaggaaaucccugccuggugggagcgaaugcuagauguuuguguuugggguuuuuuuuucccccauuuuuccuuaacacuacguuuuuuggaauacuguuccuaguaaucuuucaguagcauguguucuugugagcuuauuuguuuuugucuuaaauaauguuuguggguggaauaaagguaaugauacucauuucuuugaaaauggauguucugcuuucauaauuacuugucccaauuacaucauuaguguaagugcagguaauugcuucauuaggacauauguauugaaggagggagggcaagucuauagcauggugauaaaaacaggccucacccucuuucucuacccacacaggagcaucucagcuugacuucagggauccaggagccaccagccacccuguaaacagcccagauuaauccuggguuucagugucaugggaggaaggaaggaugaccuaguaaagagcaacuuacuuacuuucuuuggggugguaacucauugcugaacucuggauggcacuggugcguucaaggcaaugugauugaaucauuggggauuauuacugaauuagggagcaaaguauucuuauggaagcuguaugcuuucugaggcucaccaggccggauggcaugagcccuauccucuguuugaguuauuugacuggcuuuuuaagggagucuccauuuucauucuggccaugacagaucaagagguuauauucucccaucagaccuuacuacuuuccuguagaguugaauauuauucugauuuuaugccaugucugugaaugucuuugugugcacgcuaccuaguuaugcaucuccucuuucaaagcauguuaaaagauaccaauaguaaaugauucugcuuauaugaggcuaacuaaaguagucaaauucauagaaaguagaaugguggugaccagggacuggggagagagggaaagaggaauuguuuaaugaguagagcuugagauuuguuacauacauacaguucuacugaacuguacacuuaaauaugguuaagaugguaaacuuuuauguuguauucuuuuuagcacaauuaaaaaaaaagaaaaagaaaaccuaugcugggugcaguggcuuaugcccauaaucccagcaauuugggaggccaaggcaggagaaucauuugaggccagaaguuuaagaccagccuggguaaauacugagaucccauaucuacaaaaacaaauuuuuuuuuaauuagcugggugugggguggcguacaccuguggucccagcuacuugggaggcucaguuaggagaaucacuugagcccagaagguugaggcugcaguaagauguggucaugccacugcacuccaaccugggcaucacagcaagaacccaucuccaucucaaaaaaaaaaaaaaaaaagcuaauaccagauuccuuguucacuuacuacuuauuccagauaagaaggcucuaucuacugcugugucuuuaaugaauaucagguuaauuucucuuucuuucuuuuuuuauuuuuauuuuuuugagauggagucucgcucugucacccaggcuggagugcaguggcgugaucucggcucgcugcaagcuccgccuuccgggcucacaccauucuccugccucagccucccaaguagcugggacugcaggcgcccgccaccucgcccggagaauuuuuuuuuuuuuuuuuuuuuuguauuuuuaguggagaugggguuucaccguguuagccaggauggucucgaucuccugaccucgugauccaccugccuuggccucccaaagugcugggauuacaggcgugagccaccgcaccuggccaauuucucuuucuuuuuugaccuguuauaaaccuuacugugcuguggccauguaauccugguuugaauuguuguuuugagaaaauuuuuuuaugaagcugugauacauaggaauauuucacaguuugccaggcaugauggcucacgccuguaaucucagcacuuugagaggccaagguaggaggaucacuugagcccaggaguuugagaucagcuagggcaacacagcaagaccccgucucuaaaaauuaaaaauuaaaaaaaaauuucauagcuauuucuuuuccuuuccucauacacuguauuccaggccuugcuacuuuucuuguugaacucucagacuaucauugcuauauuggccugauccagugccuuuggccucaguagagucuuucucaggucugccccuaaaguucaugauuugcauguggacuaauauuauccuucuuuggagccuuuaggaguuuauuggacaauaaaauuauguuuauuugggggccuaauuccuacaaauaagacacguaaccauugaagucuguauuuagaaaauauuuacccuuuaauucauguuaaauauauugcaaacuuguuuaaugauuaaucucagcaucagauuaaaugacugguagaguaguuauuaaacugccuaaacaugauagaccaagugccuuacucagaacauuuccuaugccagaauuauagacagccacguggugcuuuuuugggauuuuauuuuugugguuugcagaaaaugacguucccuaauacucuucauaucuuuuagccucaggaaacagugaagacucuauuucagcuauagauaauacacucagaauuagucuuugaagcccuacuuuuucuuuacaauggaaauaauucuauuuaucuuaaguccuuuuaugauugcugguuuuccacacaguauauuuucuauaaaauaaaaacuacuauuuaauucucauaugaaccuaugguucaguuauaaacauaugauagaauauuauucagucauaaaaaggaaugaagccaggcagaguggcucgugccuguaaucccagcuacuagggaugcugagguggguggauugcuugagcccaguaguucaaggcugcagugagcugugauugcaccacuacauuccagccugggugauagaaugagaccuugucucuuuggggaagaaaaaaaaaaaagugaaguacugaaacaugcaauaagcguggauaaacuuugaaaauguuaugcugagugaaagaagccagacacagaaggccaccuaccauaugauuucauuacaugaaauguccaggagaagcaauuagugauugccuagggcuagggcaggagugggacagaguaaaagggagugacuguuaauggguacgguauuuaggggagaugaaaaugccugaaauuagacaguaaugauggugguuguaaaauuuauuugcugaugguuacauaacugugcggauaugcuaauaaccuugaauuguauacuuuaaaauaggugaauuguaaguuauaucucaguaaagcuauaauuuuaaacagacagacacacauauauauuugggcauuuuucucaaugucagaaucauaaaugagaacucagagaaacuugggacacuucuaagcauggaagaagucuucuuauuugucaucagggacuuuuuccagguaccaggcuauaggauacauugacugugauuucagauuagauuaaaugaugauuagagugagugugacugaguacuuaguuauaccccuuucuuaggacagauuuuaagacugcauuugaaugaagcuuucuggaaagaagauuaaguguucuuccuaggaugccaugcagauauacucagaaagggaagaugguucccuugcucugagaauuauuuuuuguaaacagaagccaguguauuuauuuacagagagcucagauaauccauaagagaaaaguuaaaguaaccaaagcuagguaggguagcaugugccuguuguccuaguuacugggaagucugaggcaggaggaucacuuaagggccaggaguucaaggcaagccgggcaacauagugaggccccaucuaaaaaacaaacaacaacaacaacaacaacaaaaaaccuuaaaauaacaaagguuuuuaaaauguacauaagacacuaguagaccaucuaaaagauacacagugagcugguaaacaaaugaaaagauguucaccaauacucuuaauuauuaaggaaaugaaauggauccaaaaaauaggauuaccauuuuuuacuucacaaauugauagacauuuauuugaauaguguuuucuuaauaacagcauuauugagauaugauucaccuaccauacaggccaccuauuuaaaguauacauuucaauggcuuuuaguauauagaguugugcagucaucaccucuaucuagauauuucauaucaucuuuaucaccuccuaaaaaaccccauacacaucagcagucacuuccccuuucccucucucacaucccuccagcccaaagcaacugucaaucuguuugaaaaguugauaaguuuuucaguuggaccugcccugggcuuucuagucucagcucuccuccagcucagcuggucaggagagcugagacuagaaagcccagggcagguucauauaacagccaagcagaaagauaguaauugugucuccaggaugaugaguguuuacauccccaaccccauucuuauuucaucuucccagcagcacacagucagagauggccauucugaauuagaaagucucaaguuaaacagauuuuucaggacugaaauguaauuuaaucauuuccuucuuugcaacuugcccuuuuuuaccuuccccgaauuagcuuuucugauagauuugcuaaugauucccauuguucaguaucuucacugaacuguugaaucauacuuuucauuucccuucuccuagaacaaaucuuagagagaagcugugaagcuguuuugaaaaaagauuccuaauucuuuccaagcaacagaagagaagaguuucugagagaagcaaagguagagagaugcacagaggcuauuaggcuuggcagagcucaccuaucaugugacugugaugauuauuaugauuuuaucccuagacacauucugggagcucuggccuacaaguugaagaccugacucuggaaugagacuuggcagcuuaguuuuugccauuguuguuggcugauaguuagccaggaucacuggauuuaagcuucuuuuccuccuuguuuugucugucaucagaauaaucuuuauuucuucuuuugcucuaagccucaaugaaaggaauuucugugguuauaugauagauaugaacuaccaugacuaguauuguccuuaugaacagcugcuguucccacugucuccuagaaugugaaugaaagucguggccccucccucuuuuuuagguuuauuaaaaguugaguggaaaauacagacaguucccauauacucccuccccuuacacccacaggcuuccccacuguccacaccagugugguacauuugcugcagcugaugaaccaacguagacacaucauuaucacucaaaguaugcguuuacauuaggguucaugcuugguguuguaaauuucacugguuuuggcaaauguaugugccauguauccaacauuguaguaacauagaaaauaacuuuacugcuuaaaaaaucuccuuguggcuguacaugguggcucaugccuauaaucccaacacuuugggaggccaaggcagguggaucucuugaguucaggaguuggagacaaggcugggcaacauggugaaaccccaucucuacaaaaaauacaaaaaaaaucagcuggucaugguggcacacaccuguagccccagcuacucgggaggcugaggugggaggaucaucugagcccagaaaauugaggcuuccgugagccgugauugcaccacugcacuccagccugggcaauggagugagacccucucucaagaaaagaaaaaaaaaaaaaaucuugugcucaccuguucgucucugccucccugcaaaccaaccccuaccaacuacccaucauuuuucugucucuauaacuuuuccuuuuccagaaucucauacaguuggaauccuauaguauguagccuuugacuucuuucauuuaguaacaugcacuuaagguuccuccaugucuuuuuguggauugauagcucauuucuuuuagcaugaauaauauuccauuguauggaugugccacaguuuauccauucaucucuuaaaugaagaacaucuugguugcuuccaaguuuugacaauuaugaauaaauaaauaaagcugcuauaaauauccauguguagguguuuguguggacauuaguuguuuuuuuuuuuuuuuuugagacagucucgcucuguugcccaggcuggagugcaguggcgugaucucgacucacugcaagcuccaccuacuguguucaagcgauucuccugcuucagccuccugaauagcugggauuacagauaugcgccaccacgccccgcuaauuuuuguauuuuuaguagagaugggauuucacuauguuggucaggcuggucuuaaacuccugaccucaugauccaccugccuuggccucccaaagugcugggauuacaggcgugagccacugcgcccggccuauauuaagucuugaaguuggguugugucaauccuccaauuuuguguuuuccuuccauauuguguuggcuauucugggucuuuugcccuuucauauaaacuuuagaaucagauuguuaauauucacaaaauaauucaggauuuugauugggauuguguugaaucuguagauccagcugagaagaauugacauuguaacaguacugagccuuccuauucaugaacauggaauaucucgcuaauuuaguuuuauccuuugugaugucuuucaucaguuuuguagcuuuccuccuauagaccuuguacauauuuuguuagauuuauaccuaaguuuauuuuuuugaugcuaauguaaguggugguguauuuuuaauuucaaguuccagucauucauuuguucauugcugcaauauaggaaagcaguugaccuuguaucuugaaaccuugcuauaauuauuuaauaguuacuggaguuuuuuuguugauucuuugggauuagacagugaugucaucuggcaacaaacagauuucuuccaaucuguauaccuuuuauuuacuuuguuuugcgguggggggugguuucugauugcauuagcuaggacuuccaauaugauguugaaaaguauugguaagaaggggcuuccuugccuuguuccuggucuuagggggaaaguaucuaguuccucaccauugaguaugauguuaguugcagguauuucauauuucuauuuucuggaagagacguuagagaacugguacaauuucuuccuuaaauguuugguagaauuuagugaaaccaucugggcccaguucuuucuguuuuaggagauuauuaaugauugcuucaauuuaauagauauaggccuauuuagauuauuugucucuuguguaaauuguaauauacugugucuuucaaggaaaguuaguccauugcauguagguuuucaaauuuguaggcauacgguuguucauaguauucccuuauuguccuuuugguguccaugggaucaguagugauggccccccuuucuuuucugguauuaguaauuuguaucuucucucuuuuuucguaguuggccuaccuagauguuuauuguuuauugaucuuucaaaguuuuugguuuuauugauuuuucucuauaggugauuuccuguuuucaguuucauugguuucugcucauguuuuucuucugcuuacuuuggguuuaauuugcucuuuuucuucuuucuuaugguaggugcuuaaauuacagauuuuagaucuuucgucuuuucuuauacaugcauucaaugcuauaaauuucccucuaagcacugcuuucacuacauuucacgaauuuugagaagucauguuuucauuuucauuuacauuuaauccaaaauauuuuuaaaucucucuugagacauauucuuugagccauguguuguucagaaauguauuguuuaaucugucaguuuuauaggauuuuccaguuaucuuuuuauuacggauuucuaguuuaguucucuuguagucugcaaguguaauauguauuauuccuuuucuuuuguauuuguuacauuguguuuuguggcccagaagguggucugucuuggccugggcuguuuucaaggagaaaguugccaaauaguauagggccuagacaguuuauuuuaaucuucagauuaaacacuucucucucuuggcccuggcacacuauuugggccagucucuuacacaaggacaucucucuauaagcugucuguugaugcugauguaaguaguaguguaacuguagaugaaauacacacagagauuggaguagaugacagauauaacuuuaaaggccauuuauuagacacuuaguauuugccaucacuauuuauuuauguauuuauuuacaagauggucuggcugugucacccaggcuguaacuguagaugcaauacacacagagaguggaguagaugacagacauaauuuuaaaggccauuuauuaugcacuuaguauuugccaucacuaucuaucuaucuaucuaucuaucuaucuaucuaucuaucuaucuaucuaucuaucuaucuaucuaucuacaagauggucuggcucuguaacccaggcuguagugcaguggugcagucucagcucaccgcaaccuccaccuuccagacucaagcuaucccaccucagucuccuggguagcugggacuacagguacacgccaccacaccuggcuaauuuuuguguuuuguguuuuuggguuuuuugagacagaaucuugcucuguugcccaggcugcagugugguggugcgaucucaucucauugcaaccuccuccuccuggguucaagcaauucucaugccucagcaucccaaguaacugagacuacaggcacacaccacuaugccuggcuaauuuuuguauuuuuaguagagguaggguuucaccauguuggucacgcuggucucgaacuccugaccucaagugauccuccugccuuggccucacaaagugcugggauuacaggugugagcuacugcgcguggccuuuuuuuuuuuugcgauaagagucucacucuguccaggcugguuacaaauuccugggcucaagugaucugcccaccuuggccucccaaagugcugggguuaugggcgugagccaccaugcccgaccacuuuguauuuauugucuuaguaaguucuuccaacaauccuguaaguuguagguacuauuauacccuuuucuacagauaaggaaacugagguucagagagauuaauuuauacaaagucacacuauaguagauaaugacaggaagugucaaaaucugguccaguugauucugaaaccuguauucucaaaacaaacaaaaaacaagccguaagaucccauuggcagauauggaaaauugaaguuguaaugcugugccuuggauuaguuucuuuccaugacuauaacagcaucacuuguuagcagcagacauucuaguaguggugcuaagagcaccuacccuggaguuaaaauguaggauauguuuaucuagcuuagcauuucucaacuaggaaugauuuuuauccccagaggacauucggcagugucuggagacauuuuugguugucucaacuauguggaguggggugcuacuggcaucuaguggguagaggccagggaugcuaaauguucugcgaugcacaagacucuucacacaaauaauuaucuguccuaaaauuucaguagugcagagguugagaaacucugagucuagcuuguuccauucugucauuacuacaugggagaaccuugaaaccuuagaaaucccuuagcagucucucaggauuugguuucugaggcuaagugccucguauguaaauacuuucuagcucaguccauuaacccccucuggcacauuuccugccuucaucuuaguggccagaggccuacuaaaugguugggguuguuuuaauaacaucaggcuuuuuccuccuguuguuuccaagagacaggcucaguuggccuacaguucuugaagaaaagaaccugguaacaguacucuaaucuguugcuggcaucuuuagcucccuaaucuguguuuauaugacacaaaaaaaaugacucuccuuggugccaggcuucauuccuccucagcacccuggcaccauuggcagagagcaccuccccagucucuuccacacaguggcaacccuacauguugauuuuauggcacagcuguucuccagaagauguuucuugagacauggacaguacaggaugccucuggagccgggauuugggagucuuaaucauuuguguucccauuugcagauccacaguacucaaaaagcaucugguauuauuccuuaacuguuuuccuguuuguaguucuuaucccuucccccagaauaagcucuuaaaauaugaaguuuguuuuuucaauuuauuuucuacccucucuuagcaacuagcauuuuguucaucauguacugagaaaaucaacuuaccuucuaucauuugggguuguuaaaagcuggagaaaaugauaaggagcuaaauuaauuugagagacuaguggucaaaggagggugucaaccaucuugauaagcaagcccaggaaacaauucggaaacucaguggaacugagccuggaucagaaugaaauggaauaauuccuuccagggaagugguagaccuuguaacuaaagaaugauuuucauuaucaaagaggcauagaaaaaucaagaaaguuccuuuuaauaaagucguucagguaucuuacccuccucaugacccagagguucagcaaaagucagauauaauuauuaaaggggaauuuucugugaagguuaaagcaaggguauauauuuaccucaucuuaugauacgccacagggaccucaaauagagauuugaggucaguggacucacugacagcacacccccaaaugcugucauucucaggucucagggagagcaugacugggcuuaugucuuugaauuugcaagauuuuaaaggaugucuuguuuuguggguauucauuuaucuagaacgguuuguuuuagccuuuauuccauuauuguccuccugaggaaccuuuuuagacauuuuuucccuacuugucucuccucccaugaaauuuuaauaucacagauacaauguguaucuauuuauauacucugaugcuuuggaggggaacaaaugauuacacuaaguuuuuuuuuguuuuuuuuuuuuuguuuuucuuuuuuuugccccuuugaaccaauuuuuacccccauggggaugauauuucccauguugagaaugcaugaucuagaaguaucaucauuuuggaaaugaacuguuauuuguacuuuuccuuacaaauugaaaaugagacaaagacaagacugucaauaaauuaaugcugaaaaacagucuucugacacaguggccagcagcaaccggaagagugcagagaguacuuuucucauauuucuuggcuucuaugaagguuuucucuuugaaccaucucuugaucauuuggggaaagaaagggacaccaggaguagcagugcaauaaaugccgcucucuaaaagaaaaaaacuacaguucacaagaugcuuuugcagugaugugcagaggaggaagacuaggugauacugaagaaucuggguaugaaauuguccauuuuuccaaggcugguaaacucuaacaaguucaguuuuucacaguagccuuugauuuacagcugagaauaccauuuagguuagcuagcauacaagaauguucuauucuuccaacaggguuugacucugucugaucagaaggagggugguuguguaugaaaugcaccucagaaggaggaggaggaaaugacauguucauguaaaugaaauacaacugcaaauuaaagugucacccuguuaaaaaaauccauuuuuuauuuaauugguuaccaaggaaaaaaaugucauacagaagaauauaucucagagaaaguuaaaccuggagauguuacaagcaaauguggauucaaggagguucuuaggggguagguauuauaaaagauggccuuaauaaaaauauucugaugcuacaaagugaggcucauaaauuuuuauuguguuacgugccagggguccagaagagaugaaugaauauuaccuuauuuguuuuuuacugucuguuucuauccaaucagcuguauaguagcugccucuucccuggaggaagccuguuuuugagauguccuauuaggaagaaagugauaaaggaggagauacuuugucugaaagagugcugcuuacuaucaggauguccagggacugaaaugcugcuggcuuuucuguguuaauggugucuucccauuuuucauuuuucuuuucucacauuuuugugaaaauucaccugucucuuuuagauguugagccuaccagaccauguauguacaguaccugccacguuguuggcacuaaguaaauguuaaguaacaaugggaaggacugaugaaugggauuauauuuccacauugaauuguucccuggcaaacaugccugguuuuucuuugagacaaagacuugccagaugggacucauuagcuuucuucagccauagucuaguuuuuccucuucucuccccacuacuaaucccaguauuguuuuauguuuugcaguggaaacguggauaaauaauauaaugugcugucuuugacuucuuccucauaaggggcagugaucggugauggacagucugcuguggccaguaacauugccaauacuaccuaccggcuccaguggugggacuucacuaaguuugaccucccugaaaucaguaaugguaagucaaugucaaauggggguaucaguggaaggguuauauuugcuggugagccagaacucaaaaauucauggagcacuggguuuuucaucauccuauugagcaguuguuaucuacaugccauuucugcaccucuucuguaacuuucuuuucagguccauuaaccagauaucaaccauaccauacacuuaagucuauuaagaucuggauuaaucgaguuuaauuaacaucacuguagucuuuccuaaaagggucacaagguuuagcucuuggauccuacacucccuucucuuucucuucuuuucaguuccaccuaaacuuuagguuuugaccagugaacuacuaguccacaaacucuucagagcagagaaaucuuuguuuuugugucuacuucaguaccuuacauuguuugcugcugagggugggugcaagacauguuugcugaauugcuuaauugagaguuacaggcugggugcgguggcucacgccuguaaucccagcacuuugggaggccaaggcaggcggaucacuugaggucaggaguucaagaccagccuggccaacaugguaaaacccugucucuacuaaaaauacaaaaacuagcuaggcaugauggcaugcaccuauaaucccauagggcuuaguuguucauaucugaagcugaaauuuuucuaucuugucugugugauauuauaagacuuugccaguugccuuaaaauaauuaagauauucuaugucuguggcauuuccugauaugccaguuuucguaucuuuauucaucucaaugguaugguugauaucugauuuacaaacaugacuguuucaguuuccuugcuucuagugaagucugcaguccacaucccaguuguucuauuggaaucacaacauuuuaaaccucucauuucacuuucuaccucgugaagggcucucucuugcacauuucugagagggaugguccagccucugcuugacugcuucugaugauagaccacacugacaagguggccugaccaucacugcuagauuuguguuaaaauauucuuucagccagguguagcagcucacaccuguaaucucagcacuuuaggaggcugaguugggaggaucacgugaucccaggaguucaagaccagccuggccaacaugaugaaaccucgucucuacuaaaaauacaaaaauuagcugagugugguggugcaugccuguuuucccagcuacucggguggcugaggcacaagaauugcucgaaccuguguggcagagguugcagugagccaagaucacaucccuacacuccagucugggugacagagugacacccuaucuccaaaaaaaaacaaaaacacacaauuaauugagcaugguggcguacaucuguagucccagcuacuuggaaggcugaggugggaggaucaucugagcccaggaggucgaggcugcugugagccaagaucacaccacugcacuccagccuuggcaacaaagcaagacccugucucaaaaaaaaaaaaaaaaaaguuuuuuuuuuuuuugcacugagccaccauuucccuugucacuuucucccauugguccuaguucugucucugaaccuccauaguauaaaucucguaaugcuucuuucaagugacaguacucugacuauuuaaacuaagcugccauuuuccauuaaaucuuuguugaaaggucaaaccuccuuagauuccuuucacugauuuccaaauccuugacaguucugcuccucuuuccuuuuaacuuucaguggaggagggcagaaaagaauagaaaacucuagaugugagcugucgaauacauaguacaguggugcuucagacacuauuagcuuacccuaugguuucagcaguuuuuucagaagccacucuugaauuuuuagucacuuaaaauuucuugauaauuguuaauaaaccaagacucaaccuuccuguacuuguacagcuugaucuuuuuuuuucugaaacagagucuugcucugucaccaggcuggggugcagucgcaugaucucgguguacugcaaucuccgcacccccagguucaugcgauucucccgccucagccucccgaguagcugggacuacaggugcacgccaccacacccagcuaauuuuuguauuuuuagcagagacgggguuuugccauauuggccaggcuggucucgaacuccugaccucaggugauccacccaccucggccucccaaagugcugggauuacaggcgugagccaccgugcccggcccagcuuaucuuuuaauaacgaaaacagauuuguauuuguuucuauucaauuuuuucugucaacuguaguuucuuuuuccugccucucaucaucuauuugaacuuuguuuuaguccuucuuucucaguauuccauugucuacuaauucaauaaacaugcuuuucugucuucugucagauuguuagcaaaaaguagugaaucaggcagggcauugcaccaaaccuuguaguacauuacuguggacuuccucuguguugauuuugguuuaugaauuaccacucugggcuugguuguucauaucugaggacgacauuuuucuaucuugucuguaugauauuauaagacuuugccaguugccuuaaaauaauuaagauauucucugucuguggcauuuccugaugccagucuugguaucuuuauuggacaaggaaaaucaguuuaauuuuucauguccugucucaaugaaacuucagcagcaaccaucuauuucuaagugcuuauaggccacauguccaguaauucauucuuuaacucugcuggaaauuaaccacaauccacauuuucccuuauugaaaaugaaguuugcuucuucauuucuagcuuucuguuccauaauuuauuuaaaguuggccauaauuuauuuaaaauuauuuuguuuuguuauuuugucacuuucuuucuuuaauugucaucugaaauugauauuacuguucaaaaauuuaaaaaauauaaaagauuaauacaguaagaagcccccaaauccuaccacuccuccucacauguaaccacuguuagcaguuccuuauauaucuuuucagaaauauuauauguauauacaagcaaaugcaaauuuauguuuuucugccuuuuauuuaacccaaaugguagcaugcuguauguacucgucuguacuuccugcccuuuuucuuuacaguauagcucaguguucuuuucaugucaguauauaaagagcuuauuuguucuuuuuuaugacugccuacuauuccauuguaugaauguaccauaacuagucuacuauuaaaggaccuuuaggucauuuucaaucuuuuacucuacaaacugugcugcaguuuaucauuuugcacauaugcagguauaucucuaggauacauuucuagaaauggaauugcaggggggaagaguguguaguuauugccauaccacacucuauacagcucgugccaaauuauuauuccacuuggaguucaugagagugccugauuucauaaacucuugcugauagaauguacuaucaaauuuuuggauauuugcaaaucugauauguuaaaaaaaaaaaguaguaugugggcauuuuaaauuuguauuuuuuguguuacaaacaagauugcaugccucuucauauacacagccauuuguguucccuucucuugaccuguccaugugcuuuaccaauuuuucuguuguguuacuggucuuuuccuuagcaauuuuacaggaauucuuuauaaaucagaaaauuaacuuauaauaggagcuuccuacuugucauucgaguuuugacuuugcugaagguuauuuuugucauagaacuuauuuuaaggagucaaaauuauacaacuuuccuuuuaugguuccuugguuuugugucaucauuagggagaucauuuauaacuuuuauauuuuaguuuuuuaauaguuaagucuuugauucacuaggaaauuuagucccaaauaaucaaaguaugauccaauuucccccccauauggcuacucacuugucccaacuaauuaauaauccauuuaucuccauuuauuugggaugucaucuucaucauacuauuaauuucuuuucuguauuuagauauauuucuggacucucuguucuguucuagugaucugucugauuauucauuugaaaguuccacgugaguuuaaucuuugagguuuuauguuuuauuuuacuuauuauuauuuuuagacacagggucucgcucuguugcccaggcuggaguacaguggcgugaucauaucucacuauaaccucaaacuccugagcucaaaugauccuccugccucggccuuccaaguaacucggccuacaggcacaugccaccauaucuggcugauuuuuaaauuuuuuuuuauagagaugagaucucgcuguguugcccaggcuggucucgagcuccugaccucaagugauuacccugccuuggccucccguaguacugggauuacaggugugagcccagccugauucuguguuuuacugaugaguucagcaaccaccaaguugauuuaugugaauugcauuuaaccuuuuccuggaguuaggcuaaagaucuugccaccugcuucucucacuugagauuugagauuaguguuuagaaguuuaugaauaaggccucaugcauaaauaauuuugaaauugcuuuccugaaaaaaguggcacauuagauucacuaugauuuuuaagagugaacucuuacugggugaauggaauuggucacuaggcuguccugucagaauaggccuuaagaaacccggcggaugagugguguggggcaggcgauaccacaggggauauagugccuucagggaguguuuaugggucaucuggagcucuguacaggccuuauucugaaauccagggggcucagagauagccaggaggaaauuuuucugcugauuuaaccccccuuggguuuuccaaaucgguaucuaaugcauuugcaaaggcacugcaacugcuaauugcucccguggccucaucuggccagccagcaacaggcuacaaaucgaucuuuguacaagguguuuguuuauaauuuauggagcugauaggaaggcagagccaucugcuccuccaggcaucaguauuucuaaccccucccauucccugcuagggcauuuucacuuggaaaucauuucuaauugggaggagauuacauugcagagucuggaacauggcuuccugcugucuccugcauuguuuuuucucccuccggagcugcccccugaaguucuagagcaguuuugauuugaaaauccuuucuuuccuaaucuuuauuuccauucuucacugcccagcuaaauaccccaucauuuuuuuccaauauguuuuuugccuuuaagugaaagccaguugcuggagaugcaucucccagacuaaggauuauuugacaaggucgcauuucucagguguagucccaguccggcaacaucagagacaccugggaauuuguuagaaaugcaaauucucaggccccgucccagcauucuguguuuuaauaugcccuccuggugaguuugauacguguuaaaguuugugugcugcuggggucacacaagguauggagcaccacaaagacuucuaaugguguguaagcuauagccggugucuucggcuauauuuuacuucucccuuuucucucuaccuuauauuauuguugaauccaaaaaggaugaguuaguuguucuuugucauuaguacauuacuuuccuguggccuaaauaaacaaguaauugagauccaagaaaucucuuccuguaugaauuaacucaucaaaauuucagccuuacgagaggaagcugcacaagugaauggaagcagugacacuuauuguaacugaacauuuccuuuuccacaugugaaauuaauagacaacaaacagcaaaugugagaaugaaauuguaaacagaacccagugcaauggagcuaccaaaucacucuaugccaccacaucccauuaggguagaagugaaaccccagaucaugagcugcaaaauuucugaaacugaauaugcuaccggagaagcuguuacaauuuucagcauucucuuuucguuuguccuuugcauaucucugugagcucauugcaguagccaggaagaguuaugaaguuggguggagucaggggagagggcagaauuugggagauagcuauugacuuggaaucgucaucauauaauacaaaugcaagcacaguggccuggauuugaggcugacgaaaugcuuuuuguccauaugcccaguuuuuaagggguuuuagagccaagcuuuccagaagaaggaaaaucuuacuuguacucuccucugcacaccuugucuccguaagcaguuaaaugcuuuuuuguguguuggugaugaguuuugaggguuacuauagccuucuagguguuugaccaaaauaaacguuaacacacacgagcuggaucuauguaacagcaagauaggaaagucuacuuuaauaacauacccaacagacauuuucgagacauuaaauguagauaaaaugguaacuguucaaagcugucuuaaagcccauagagucucaucuccuuuccuauuuagguucauguacuacuuaacauuuaugauuucuuuauuuucuuucucucccugcuuuuggugguuagaguguaaauuguuaguuucuguuuauuuuucugagcauugucagccucagaguuagaaaaccaagauggucucacuucugaaacuucucccaguuccuuugguucuauauccccagcuggauucauguguugauccagaaaaggagagggauauugccguguuuuguuuuuguuuuuguuuuuguuuuuguuuuggcaaagggcuugggacccugaguaguaaguagcagacggucccagugcuaauuagauaaaucuagccuuacaggcuagaccagaugguggguugggaguugagcaguagaaaggccuaauggugauagcagugaguauuuggauaucauuauuuuauuaguuagcaaacagaaccauccuuguggucccucuucgguuuuauguguaauggugcuguaggugucagcccccgaguuggcacaauagccuaaucaauguauucuaaugccuuuuuugauauacacugucaucucauuagcaacacacagggaaaggagaacaaauagaguuuuacaaaucacucuuaaguaucagaucacauaagccugggggccucugaaagagcaauuccuuguuuuguuuuccuugagguaauuuccuagggaaacuugcccuugacuuuuuuuggauuacugcaguagaucaccuggacucuggcgagggcagcugagcuuggcuuuuaaaaaauuaccacaaugccucugacaguggacaucuccuucaaauaagagaaacagugaaaaguuuuuuugcuugagguauaucuacaugagacaaagcccugaugagcuuggucuguuugaauguguugugcuguucugcccgggcccaugaugugggcacucuuguucuaugcucacaucaaggguaagccacuucuuccuggcagggaaucacacggugggacucagagggauucaaaugaaaaccgaaacaaggccuauaggcacagugccaguuaacaucucauuggugcuguuguguggaguggaugcuccucaccaacagacauuccuccacccucagaucuugccaccuuaccaggcugagccugcugccugccugacccugcaguuuguucucaggagcugcaaagugcagacuagggcugucauggacauuggcauagagcauagugggaaaugaaaagagcccuggccauccagccgcagcugggcuuuguucuguuuccucucuugguagaguuagagauuaguauuagcaaggagcuguuccagaaaacuggucucuagauguuccaguucucuuucucuuaaaugagaaaguaagauacaaauuuaugaaaugacuuucuucuccaaggucacauaacagguguugaauaggauuccugccccaagaaagcucuaccuguaucaucuuuuucuuggaaccaguggguuugcauuuucauuuaucuugguuuugaucucugggacaauaacagcuguuaaauggcucucuaggaauaauuuuuaauaacuuuuuccuuaucuaaucucucaagcgguauuuccuaaaugugaacuaagacucagcaggugguuguggugguguugacuauccuauaguuuccugcuaaggugggagaagagacauacuuuucuugccuccuguguuuuguucauuugacauuuuaguuugaaugagaagguauucuuuagcauuucuagacaagguucaggcccuuaggaagucccuaaaguuucuuggccccagaauuuuuacaguaucaacuccaaaguuucuuauccucuuuucuuucuuugucugaugcagcuuccgugaaugugcuggugcagaacugcaagaucuacaaugaugccagcugugacauuucugcagauggccagcuccuggcagcuuucauccccagcagccagaggggcuuuccugaugaaggcauccuggcaguguacucccuggccccccauaaccugggcgaaaugcucuacaccaagcgauuugguaagggauaggaagcccaaccuaaugacagagggacgcuggugccuuggcauggucauugcuaggugaggcacagcuugggugggaguaauggucacauacugccccuaccuucacuggggcacaggccagagaaagauugcuuugcaggagugcuggcuaguaacauugcagaagcaucugagcauuagaguccuaccgcaugccccuguuacgacggucaggaauaagggaggaggugguuguagcacacacaugcacugcaagacaguuuggcauuguguauuuaaaaccucccaaaaugugucagcucuuuggcaauccagcuuuuaaggaaauaaucagaaaacuauacaaagauuuacauacaaggguguucacagcaguguuaccauacagaaaaaugccaaauuguugccuugagacuuuuuuguuuguuuguuuguuuguuuugcgggagggugggguggguguuuuguuggugucaccuugaguugaauuuaaguguuuuuuguuuuuuuuuuaagaguugacuaaacaaaugauggugcagugauagaacugcuccauuggcccuuaaaaugcucuuacagaacaguguucauaauguauuaaaugaaaaagguggguuucaaaauaguaauuacaggauguuaacaauuuuuuaaaauguugauaacaacgguuagcauuuauuaaguacuuucuuucuuuuuuuuuuuuuuuuuuuuuugagacggaguuucacucuuguuggccaggcuggaauguaauggcgugaucucagcuuaccgcaaccucuaccucccggguucaagcgauucuccugccucagccucccgaguagcuaguauuacaggcaugcgcaaccacgccugacuaacuuuguauuuuuaguagagaugggguuucuccauguuggucaggcuggucucaaacucccuaccucaggugaucccccgaccucggccucccaaagugcugggauuacaggcaugagccaccgcguucagccuuauuaugugcuuucuauaugucaaacacuacacucaguauguauaugccuucucaucauacuccucacuacaguccuaugagauaacaccaggaugagcaagugaauaugaagauuagagaaaaagacaagaguaagagugaaaguuguuuccuuggaauggccagaagccuaggaaauauuucucuguuuuguuggcccucaggucccaaugccauuucggugagccuguccccaaugggcagauauguaauggugggcuuggccucacgaaggauccugcugcaccccuccacagagcacaugguggcccaggucuucaggcugcaacaggcccaugguggagagaccuccaugagggugagugccauugcuugugccuucacuguauggcagcuccccuaggcuuggaaggguaaugaggggacaguggugugaccucccagccaggaccagagcuaucacacagucauaaggaguaaggaagggcuguagucaagcccauccaugaccagcaggcuucauuuguggaagcucuggacuaucaaaggccuuuccucacacccuagaauaugugcugcauuccccagaggccugcaaguaucuucagauaaacugaauacuuccuuacuucuacgugaaacuuuuaaucuggagaugcauaaaggacccaaugaaaugcuuauuuuuaaagcuuuuugugugugugugugagggaacaagcuguaaaaaguaauaguaugccaugaaauguuuuuuuucuguggguuauaauuaugauggaagaugaagacuuuaggcaguugcuguauucuuaaucaucccauucauuucaccaguggagaaaagguccugucuaggacccugucuugucuaaggcacgucucucuuauauugccauaaaagccuucugggcauccugugguucguggccuuuuggccucagccagacuaacgugccugagugaacgucccacaucccauaggugcucauuuagccaggguuuugucaaggggauucaagcauuugaacaguucucuaauuagauaguauucaagcuuugucagaauccaagaaccugugaauuuccuuaguacuuugugcaaucuguaccauuuauaguuggauguacuuguugguccauuuuuugucuucuuuagcuguguagcguauguguuuaauccacccaauucgguucaguguaagcuccuuagagggauaucccucaggucccucauuuagugcugugcauguagauggcuguugaauaucuggaaugggaagcauuuguuuuaaauaaaaaaacuagagauagcacccauuauauacaaagugauagaaaguggguggccuggugugguccuuuccucuccagccucuucucccuccugucuccuacagauauccucuguccaacuacacugagccacuuuucaagcuucuugaauuugucaaagugccuucuugccaggguaccuuuacuuggaaugcccuccuguccccuaucuccagcuaccugcaagcuuuuuacuuucuguggcauccaucuuaauagaauugaucacucguuccuugugcuaucauuguaccucuuacacauucucaugucaguacuugucacaccaaacugcaguuauuuguuuccaugucacucucuucuccugggcugugagcuccuugagaauagagacugugucuguuuuaucuuuaugaaguccaagaacuucaugcggaaccugacacuuaguagaaagugaaugaaugaaugaaagagaaucucaaaaaaaaauaaauaaauaaaaauaaagcauccucuuuaucauuucuaggugguaacuagcagaaccaaugauggguaacauaacaucaugucccaccaagcuucugaaaggaaaacaagucauucuguccucuugauaucacaaugacaagaaaguucugaucuugaauuccauauggcuggaaauauuugacauugggugaauaggagaugucauugugggauguucaucaagucuauuuucuuaucuagauauuugaggauggaaguugaguuuucauuuaaauauucuucuuuugcuucucuuaagcagaagcuggucucugcuuuucaccaccuggaaucccagucccaacagcugcucuucuaacccuuccggccuaauuguggaauaaucguuuaaaucauuaagagacagaaucugauguugguagcucugacagaccucucuagcuucuuucauaagccagggcucuugcccagcuccugcacacagccugccaguucuccaucuuagcacaguuccacuuuuccauaguagccagaaacaucuggcugaagacaaacaguuacaaagcagaagccaaggugaugggaucuguugucacauauggggcuggcagcucaaggaaugugguucucugcugaggagaugugguaauccagucagccccuggcuguccugccaagggucucaaggcagcuagccagcagcugcaugcuuggugacuggagcuacuacuacugccaggcugccuggugaaccuuuuuugauucucaguagguaccaucugccaccaagcacuaagaaagggagcugaaguaccuagaaaguucccauuugggaaguguuccugucacccaagagacaggaucaaggcaucucaacaagguuuaggucaaccaaguguccacccagucugacuuuaaacccccaugcuacagaaagguuucugguuuuccaggucuugguugccccuuacguccaaaggcaccagaucacucagcaaaugucccugaauucagugauugguggaagggaagacaccagcuuuuuuggauagcugugcuguaucaccguuuaaggcaagaagugaauuuuugucugagaacagggagcaaggguuuaaugggacaguacagcaucucccucuuugcacagguaaguauaggugggugucuccaucucuaaugucaagcucugaccauaaaggaaugcuuuaguggguaaugggccuguccuagagcuuugcuacccagaauuccccuucugucugguguuaccucuuggaauucacugugguaauguucagagaggcaaauguguugggccaacagacauucccaggagaacauccuccagagcauugauuuauuuuaagauggcacuaagugacaucucuccccaagagaugaucucugacacaaucccauaugaaaacucuucugaaaaugaauugcuaauugcuauuagccuugaugcacuuacucuaagcaguucuucagacuucuggaucagugcuucucaaacugugguucuuggacaacuuacaguagaacuacauggguccuuauuaaaauacagauccauuucagaccuaaaaucagaauaagaaugggagucagagggacccaggauuaguauuuuuaaaacaagauuucuucauuuuaggugucugcccucagccuccucagcaaggcagagucagucucaggucuacuugccauugugguuuugugcauggugcuuugauucuuugcuaauuauguugcaggcacagugguguuugucuucuguuuccuaccaaacucagcuuuuuuggcugucugcgccucaccucccaucuuuucuaggcuguugcugcuuuccagguuucucccuugaauagcuguaugugcuggagucuuuucuuuauguugaaucauuuuaauuuuuguccuuauuucuaggaucuaggguccuuuugaucuuucccuucucuguuuaucgugcuaguccucccaguuuuaaugauggguaagucaggaaaguaagacugggcacauauuuucucucucccuucccacuguccauuugcgauuccuccagacuggauaugcuacucucuaugacucagaaucuuauuuucugucugauucccuucugcuugagccagagagggcuuuuuguuaauuuuuguuuuguuuuuagguuaagcuuuuagagacugcugagcugaaguuuugcugaauucucaaaacacuaaacugccuguguucccucucggcuuucauuuucuaauuggaaccaggcacaguauuguaacagagaacugcaauuaauuuucuaaaauaguggcaacuugcacaguauaauaacuuugguuguaaccaagugaaagcauaauaacaaaaauacaaaauuacugaugaaaccagaaagagucauauaccacauucuuccuuuaguuuguaucucaguaagugcuguguuacuuaggaauaggggcagaagccugcaacugggcagggagguucagggacaugaggacgaagcuagggcauuuugagcuagaaagcaagaauaaggauuagugcuuucaacacuggaauuaacauggaccacccccccaccucccaauaaguggggauuguaggcacauaagugguuuaguaagaaguggaaaagguuuuucuguggaguucgaguuccaucggcucccauccgggcuauccugccaccuuagcggcugcuccuccccaggaugcgggcagggggccucucucccacuccccacacaccgauuucugaguagcgauaggggcuggaggcuuauuuuaugggguagggggccgcugguaggcgaagauuguccgagggagagggggaggaugaagccagugcguggcggagaccugccagauguugaugccuaagaagaaccggauugccauuuaugaacuccuuuuuaaggagggagucaugguggccaagaaggauguccacaugccuaagcacccggagcuggcagacaagaaugugcccaaccuucaugucaugaaggccaugcagucucucaagucccgaggcuacgugaaggaacaguuugccuggagacauuucuacugguaccuuaccaaugaggguauccaguaucuccgugauuaccuucaucugcccccagagauugugccugccauccuacgccguagccguccagagacuggcaggccucggccuaaaggucuggagggugagcgaccugcgagacucacaagaggggaagcugacagagauaccuacagacggagugcugugccaccuggugccgacaagaaagccgaggcuggggcugggucagcaaccgaauuccaguuuagaggcggauuuggucguggacguggucagccaccucaguaaaauuggagaggauucuuuugcauugaauaaacuuauagccaaaaaaccuuaaaaaaaaaagaagaagaagaagaagaaguggaaaagauccucauugccuaaucgcugcagauccuagaggcacuaggaacuugaaucucaccaggcguaguuugcuuuucucucgggucauuuuauuggcagaagggaugacuaaggacaccuucauuugacuuggguugaggaggaagcucugggauagaaugcaguuuugcucccccuucuccauggaacaguauuguggucuuuaagggaaagccuccaauaccuaagggucaauuuuauugaaagcuuuuucuuuguggccaugugguaaaaccguagccaagaguugagugaguguuacccagacaaaucaauaguucguaggacacauugaaaagaaaguauccaucucucucccucuccucuucuuccccuccccauuccccuucuucuuucuuccuuucuugaccuaagaguuuugcuggucaguaguggucuaucccuuuauaccccuucucccucuagagcgcuagcaauaugccucccccucacccuaaacaggucccaggcagcagggaaggaaagcauauuuguuacuuuuuuuuuuuuuuuuuuuuuuugacauggagucucccucugucgcccaggcaggagugcaguggcacaaccuuggcucacugcaaccuccgccaccuggguucaagugauucuccugccucagccuccugauuagcugggucuacaggcacucgccaccacucccggcuaauuuuuguauuuuuaguagagacaggguuucacuauguugaccaggcuggucucgaacuccugaccucaggugauccgcccaccucugccucccaaagugcugggauuacaggcaugagccagcgcucccggccuguuaccauuuuuuauagaccuacaucccacccaaaucugauugcacagcaguucucaaugugugcccccaggggaccacaucagcaucucuagggaacuuauuagaaaugcagauucucagccccacuuaagaucugcugagucagaaacucugggggcgaggcccagccauguguguuuuaacaagccuuccugaugacucugcgcgcuaaguuaagaacgaaccaugggcuguagggcgauuccaucuagaccuugccugucaauguaucuugauccuuuccgcuuuuguucuugcucugucucuuacuaucucugaaaauaaacauuagauugcuugcuuucuuuuauaccguuggguauccauccuuacagagacuaaugauggcugcugcugcugcugcugcugaucaaguucauuaaaaugaaccauagaaaaaacuugggauccagacuucucaaauuagugguaacuauaguuguggcuuagauccugggucaggaugagugcccagugcugucagcacugaccagaauuuauauaacuucacaaauauaggcucuuuugacuugucccagcuuuauucuucaaucuacaaacuucauuaugacucucuccuucccugcccuugaauugaacuuauaauauaguccuaaucaucugugcuucccuauauucugcaaauuugauuuccaaaagugaccuagaauucuaguucaauccagaguauucucuagaaaucuaaggaaacugagccuuuucuuaaucuugucuggacuuggggguggcaaauaccaaaaauaaugauauuuuauuuuuguauccuggaaggguacuauuucuucaaggggagauugggauaaaagacagauggcuuuguugucagaaaugauuuacuccuuccuaaaauuuuguccucauuaauuuucuuaaagcugccugucaguugauuaaaagcugcuuccgcugcaauuaucuuaaaguugacuucugagauguggcacaaagcaucuauccucaaaaaguucuuuucuucagaacauuguaggaaaagggggaagaaguauaggagaaguaagaggugucucuggugugauuugucagagaagggaggggggcaagauaaaaauuaaaaauaacacuagaacugcagucagagccauucauuuaggaaauuuuuccaugacagauucaccaacucugacagugucuuuccucuguggccucuuaguagagugcagucuaugcugcauuuuauucucuucacucaaaaaaacuuuauugagccccugucauuggucuaggaaugcagcagugaacaaaauggaccuagucccuuccucuguagugcguccaugugcaaugccuggcuucuucuggucuuuucacugccaucuccccagcccucacugugcuuaguuagcugcgggaggcaugcaacguuugcuuccuaaguguguguuacuuugaaaucucaugugcccuggguuucucugcauguccacgcaugugcacccugcucaccaccacuaucacuguaacagcccauuacucaguacgcccuaauugaaucaagguaguaaugagauaauccugaaaauagggagcaucuuacucauuuccacaauguuuucuuucuuuuuuuuuuuuuuuuauuuugagauggagucucgccucagccucccgaguagcugggacuacaggagcccgccaccacgcccagcuaauuuuuuuguauuuuuaguagagacgggguuucaccguguuagccagaauggucuugaucuccuggccuugugaucugcccaccgcagccucccaaagugcugggauuacaggcgugagacaccacgcccagcccgcuguuuucuuuuuuuuuguuuuugagacggaguuucgcucuuguugcacaggcuggagugcaguggcacgaucucggcucacugcaaccucugccuucugcguucaagugauuuuccugccucagccucccgaguagcugggauuacaggugcaugccaccaccccggcuaauuucuguauuuuuaguagagacagggauucaccauguuggucaggcuggucucgaacuccugaccucgugauccaccugccucagccucccaaagugcugggauuacaggcgugagcuaccgcgcccagccucauuuccacaguucuaaccgauaucagugaguuucuccagguucuaguuccagcacugagacaugaugagagguucccaguagauaguuuaaaaagugaaaggcaaaacauccuuuuuuucaagaauuggaaaaucaauucauauauuuguaaaaacugaaaguauuuaauauaaucccuguccugaacagagaaauacuacuucuuacacacacacacacacacacacacacacacacacacacacaaauggaucaagcaaaagauacagaagcauugucuuauccaaggugaaucucuagaacucauuagaccauuuccuuugagauguagaaagacacagaaguucaagaacuuguguugugcucugugcccagagauguggaaaccagaguaauugcuuucuuucuauuuauuuauuuuuugagauagaguuucacucuguugcccaggcuggagugcaguggcgugaucucggcuaacugcaaccucugccgcccggguucaagcaauucuccugccucagccucccagguagcugggauuacaggcaccugccaccagccuggcuaauuuuuguauuuuuaguagagaugggguuucaccaucuuggucaggcuggucuugaacuccugaccucgugauucacccaccucggccucccaaagugcugggauuacaggcaugagccacuacaccuggccuauuuguuuaaaauuuuuuuuaagacacaggaucucacccacgguggaguacaguggcacuaucauagcccacuguaaauuuuaauaacugggcucaagcaauccucccaccucagccucccaaguagcuaggauuagagguaugugccaccaugccuggcuguuuauuuggagacacacagauccugcuaugucagcuagguuggucuugaacuccuggugccaggugaucuuccuaucucggccacccaaagugcugggacuacaggcaggagccaucacgcccagcgaguauaauuucugggaauuccagaagccgugagugccucaguauuucuuuuagcacagaaguagauuccucagcugaaguaaucucugugcuuugauccuaauggccagggguggccuuuggaaagcagcgggccaauugaaaaauaaaaagcuuguccucugacugucuuuggggucuccuucaggaacaaaugaauaagacaaaguuuguaggaaucagcaaaucauaggagguugccuagaaaugccuugaaggcagcacauugucaauaguaacaaagggcaacaaauuugaacaaauuaaaaaaaaaaaaaggcuguuugcuguuugcccuuuuuuucugcugggagagagcuuugguuuggauaugugcaaucuagggauuuguuccugcuucaaagggggagaguuaggugacuuguuauuuugauuuuuuaaaaauuuccaaacaaagcugugauuuggguuuuuaaauaaucacuuuaaaaauugggugcacuggcugggcacgguggcucaugccuguaaucccaacacuuugggaggcugaggcggguggaucaccugagauuaggaguucgagaccagccuggccaacuuggagauaccccaucucuacuaaaaauacaaaauuaaccaggcgugguggcccaugccuguaaucccagcuacucgggaggcugagucaggagaaucgcuugaacccaggaggcagagauuguggugagcugauaucgugccacugcacucuagccugggcagcaagagcggaacuccaucucaaaaaaaaaaaaaaaaaaaaaaaugggugcacugccugugaguuaguccugcucugucagaacaguaaaaauuuaaaaauaauaaaaauuggccgggcacgguggcucacgccuguaaucccagcacuuugggaggccgaggcaggcagaucacaaggucaggagaucaagaccauccuggcuaauacggugaaaccccgucucuacuaaaaauacaaaaaacuagccgggcgugguggcaggcgccuguagucccagcuacucaggaggcugaggcaggagaauggcaugaacccaggagguggagcuugcagugaaccaagaucgcaccacugcacuccagccugggugacagagcgagacuccaugucaaaaaagaaaaaaaauaaaauaauaaaaauuauaaaaauuacaucaacauuuugugaauucugaauuccaacauagaauauaaagguuuggagacaguaaaagaaauuaaaguuuuuaaaaagcaaucaggcuuuccuagggucgaagaaacucaauaauucauugaucuaagcagaucaacagcuggaaaagaagaaaagauggccaagguauuucucccacugccacucuaggauaugugcauuucucagccugugacaagauauguagccauccauuuccaauggaaaggucagcugucucuuagcaucugcuuucuauugauuuuucccucuucucaguugauucucuucuaguagcccucacuaaaaccuuaagccuuccuuaauucccaucauuacccagaaggcaucuuuccuccucacaguuccuuucuuccucaaagcccccuugcuuugcaccuugcaccuuuuuccacagcucuucuagccucaguuuccaguuguccgcuuccuccagccagcuuccauugucuuaaagaagaucugccaacugcacuugaccucuggccaccacugcgagguuuuagcuuuacagaugaugagauucccaaauguaaacaaaauaaccauaaaguuuuucuuuuagcuucuuauccgggcugaucugaacagugccguuugcugcuugaacuacucgucugaguuuuauuggcaugcaguaggggaaaaaaaauacgaccaucuuguugagggcugcaauaccuuuuuccucuucauuuuaaaaggauggagaagaagguuucccgcugaccuccuggcucccucucauucuuuuccugucuaucuuugaacaagaaacaagacacuuuuaguuuugaucugagaacuguuuucuuuugcucucacuuccuauuagaguuugagggguagagaggcaagcgguacaagagauugucuuggacaccagaaguggagcaaucauugucuucuacucucuuagaaccacaaagaucuuggcaaccagacucauucccuauuaacaugcugagacugcacuaacucuaagaaauuucuucuuucuagcauauugauucuauuucccuucauagauguuagacagaaaugagaacaaucuacuuugggaagagggguugcugucagcauucgucauauaccagggaagagcugcaguggagacaggugaaaccaggacucgucaaucaugaaucagcagcuggguuuuguauucagccccacagaggguccccuguucugauaauacguccgguguaauagaauuuggugguguagcugcacggcaugucucuugugucagagagaagagugggggacaggguggguguucagcaggccacccaagcuuuguucugaacaucccauggggagcuucagggcacaugacuaguauuaaagaaaccuuuacuugagauguuuuuagggugucuguacaugaagaccagagccaucucuuauacugucuuugucaguacugaugaccuuuggguuuacagagccaguccccguggaaaucuaaaaggggacucacaacucacccagucucuggguuagaaagacugaugaccaaaaccguaaaugguuugggauuagcagagcuacguaaccaucugucaguacugagaaacuuguccagauagucucucaucuguagggcuaauugugagagguauuucccuucagugagguggacugagagcuguucagcuuuggcccgggaaagggguagacacuacaucucugggugcuuuucaaaaugggccagauucucauuguucaaguguccauugguuucaggcaugugugaaaucaggaugauuggaccagaugaccucucagccuauggaucagugauuaaccucccauucugcacccuccaugcccucaucucccuccuucccacaccgcacuagagugugcuaagcaagcaagugcuuaucaggauccaggaggcugcugaucuuugugcggcauuuucuggcuuccugccacaaagcaggauuuagccuaauacccaaacaugggaagagaugugcacuugagaacugcccuuucggcacuguuuaaggacucgagcaugagggagugccauagcuggaggacagauugaugcccccaugacucuugccacugcagaaguugggaaguggcuagcaacaacccgggggucucaacauuucauuacuucucuccaaucccucugugaccuugucucaccuaagcuggguucaucuaucauauuggcgucuugaggguuuuguccccaaaggaaguuccuauacuaagaagcaaauagauaauauuugccuguuaaucccuguacagcaacaaaugauaaaagguaaauuugugacagaggcuuguuuuguuacuuucuggucuggaacauuucuaggaaagaggucuuuuauucuuuuguuucagacccccauuuaaaaaacgcagcacagcaacuuaagcaucugauuacuaaagucuuauuauucuccucguaaggcuacuuucucuggcccuuuugccccauucccuacaauuauaaaucauuguaguuucaggggagacuuuguugugaggcccauguagagcuaccacaggcucaaaaccaaggugcuccccucaugcacccauugagguuaacccucaucccuccuuaacucugggugugcucugcucacaccaucugaccuuuggagaaggaaaacuaaacagauuaagugaucccagccacaauugucucaucacacccacauuguccuuuuaguguuaaaaguuaaauggcaaguuguguuuaaccauaaagucuauagguuggacagaaaccauugguuaucuucugagaaggugaaaaccuccaugagaaagaauaaaggugccacaccucauugcuugauuuaaaggcaaaauauugauuaggugcaaaggagaaagagugguauuaccauaucugugcccguucagacagugaggcugagugagaauagcagccaugaauuuguuugagacuccugccagccaggaggagaugauccaaaggccaagcagccagacuccagauaacuacgagagaaauucauuaacuucaucgguuucuuuuuuaauagucuccucaguuagagcaaagauuuaaggagccuuaacgaguuccuuacauuuggaguugaguccuacaggaaggguguaggagguuccuaaugcagcugccacagggcagucagugccgugccucaaaccugaaccaguuccaugucuguaaaaggcccauuugaccucaggaccauagcuaggccauucuggaagaguaccauuuagcuaccugggcacauuucucagcaccacaacaccuggaagaguguguguguguguguguguguguguauugaggacacgugcugcugucuuuuccauucuggaggcuguccugucagaggccuuucagauacguacccaaggcacaugaacauguguucucagauccagggcugcuuaucacuugguuugcauaaauggaguggacccuuaguucagacucaaucaucccucccugccuuccucccuccccaccuucaucccucaucaggauagucagaaaaauaauuauaauuguaccacucuaaguucauuuuaugaauauuacugucuaaaccacaugcucauuuguuuucucuuuuuuuccccuucuaucaacccugggggcagguaaaggcagaugaaaugaaguucauauuugauaaauuaaaaacuggggaagcaagaagggaaauaaacuccaguuuauagaguuucagcuuccugucguuuucauaggcccugaugaucauuugugaagagacugagauacagguuccugguugcaauaauagcaguuacuauuuaggagcuugcaccauggcaggcauuuuauacaucaucucuuuuaaucucccaaauuauuugaauguauguguuuguucuaaguugagaucuagagauauuguuuuguaguggcaucaggacucgaacccaagucuuauuaacucuaaagcccaugucuuuuauucuuccacugaccugccccuaucucugauuaaguugcuucuaaaacauaucagagaguggugaaagagacugugaggccauaguuuaccuucagcccaaacccuacauacuuagaaaauaugccgcucagaaaauauuagcuuggaaaaagagaaacaaucaauuuaacggugauuuauauaagcuagaaacaaguugugugccugaauguucacgauuccccucugcuccgcucccuccaucuuaaugcaccuuuuagguuuccuuaacaauagcaguuuuaacauugcuuuuaauuagaugaauuaagaauguucucugauguuaucacccccucccgccccccuaucaccuccaauuccccauugcugugagagcacugugguuaccaugguaacaggacuaccagccaaggcugaugcucacugguuggccuggucagaggaaaguuaugggcaguccguccugguauggugggcuuuauggggcuuuccagggaguuaauuuaaaagcaaugaaguuaguuagcuaaaaggcucuaaggagagcgcauuauuagagccauagaguccccuaguauuucuuaaaagagaccuagcucuccccaaaacuaagagaaucccaucucuccugcugccccaaguucucaggcaugaguuaagagucauccuguucgaaaaccaaacaccgcauguucucacucauaggugggaacugaacaaugagaacacuuggacacaggaaggagaacaucacacaccggggccuguugugggguagggggaguggggagggauagcauuagaagauauaccuaaugugacugacgaguuaaugggugcagcacaccaacguggcacguguauacauauguaacaaaccugcacguugugcacauguacccuagaacuuaaaguauaauaauaaaauauauauaauauauaauaaauauauauauuuauauauaaauaauaaaauauauauuuauauaaauaauaaaauacauauuuauauauaaauaauaaaauauauauuauauauuuauauauaaauaauaaaacauauuauauauaaauaauaaaauauauauuauauauauuuauauauaaauaauaaaauagauagauagauauagaaaaaaaagaaaaaaaaagagucauccuguucccagccuaaccaccuccuuuccuccuucuaauuuguuucucccuggauuuuguuauucuugguaacaaauuguuucuccucccauucucuuuuuuucccucuuuuccucuaccuagagaguuuucaacguccuuuaucccaugccugccgaccagcggagacaugucaguaucaacucugcccguuggcugccugagccagggcuuggcuuggccuaugguacuaacaaaggagaccuggugaucugccgaccagaguaaguggcuuaaaguguggggguugagggaucacuggggccgaggacugggguaaucaguauucaccaacuggggucuuuuagaagggaaaugucaauccaucuagagccugccucauucucagcgccacuccuuaaagggcccucuucccacaggggcugguaggauuagcuccccauuucacauuucauccagagacugauuuagugaucauguuuucuugaaucuaaaggcaguauuuuuuuuucuuuguuuucccuuguucucugguuuccuagugauacuaaaguuucccugcagucaaaagcauagauaucaaagauucuuuuuuaaacccugcuagaaaaauucaacagguggucuuggguuugaguaaauaccguagacuuuaacuuaaaaagaauuggaaauagguauuguugaaacccuaauuuguuaagccacugaucucuaauagccgaucucuaacugaucucuaacaacaauucugucuugcuuguuuuccuuucugcuuggagcucuagcuuauacuagugaaagcagauugaaaagcucaauuuggggcugggcacaguggcucaugccuguaaucccagcacuuugagaagcugaggcaggcggaucacgaggucaggagauugagaccauccuggucaacgugguaaaaccccgucucuacuaaaauacaaaaaauuagccgggcauaguggcacgugccuguagucccagcuacucaggaggcugaggcaggggaaucgcuugaaccugagaggcagagguugcagugagcugacaucaugccauugcacgccaaccuagcgacagagugagacucugucucaaaaaaaaaaaaagaaaagcucaauuuacagucaaagcaauuauuaucuggucuugaaguagggaguaggaggggauuugugucugaaguccugaugacaccccuuccccuuccucuggcuuuauggaggucagaguuucuccaggcauccauucauuagagacgcugggagucagccaggucugucaucaguuuccagccucagccagguggagagugugaagcucugccucacugccgaucagguugauugcugcgugggacgcugcaagguuccagccgacuaaaugccacuucugccuccaggcuguccucauguugaccuccacuuggugcagagucuuuucccagaguguucugcagaucacagaguguggugugacaguuccaacagggucucugguuaucggaaguguccguguugccuuuugaugggauccuugauaguuucuccuaaaggauguauuugggucagcucauguggccugguagggaagugcugauugaguccuuaucggcugaauuaggucaguggccuaggagaaaggaaaacugguucuuagggcagcucuugcauuccauuuugaauuuuuugagcuccucccaaagacagacuacugucuaagccuagccugcucaggcugcucuuggagcugcaagaauguuuuguguugcaagccacuugcuccagagaccaucuuucaccaucucuggagcauccagagagcauuuucauuaucuccuugggucucucaguuucugcccuucuucuggccugucccuagucccaggaucuguccugaaauacuccuuuuccccaaagcacaugaugcugauugucuuaucucuuuucuuaacaguucauaagagaaaucuaauaagcaucuuuuccaaaacuggcacagaauucuggacuaugauucuacucuuacuuacacuucaguuacaggccuuucuuucccuguuucuccaagaccucuuuccucagcaguguuguuuugucuauggcuuccaccacuaacuuuugucccagccaaauuucuaguccucucccuugcaaaaauaaucuacacccaguuuguuguggccucauaaagguuuuuaugucugaaaccccagccugccuacuuugugucagucacagucaccucagccaaacaugaaacugacuuuggcuucuguuuucucuuuucuccccauauguugcuccagcaucccagagucucagcuggccuaagccaucuugggcugccuggggaacucucuuacccaccaggaacucaagccucuucccugaguaagauggcauuagcacuggacacauugaacaguguccugucacagaccaaguuguguuggacuaagaaaacuaguuuagcccaucuuuuuugguugcuguuucuccugacuucuugggucagguuggcaaaugccucaagccuuagggcccaaaauguaaggguaccauauaaauuggacauggacaugacuuaaguucuucaaagcuuaggcaaggaagacugugugugagcaauauacaccuaaggaaguuaagacuccucugaggccuccuaacagaugacagaacuagaauuccucacuuuacuauccagagcgcuuuucacucaaaaaccccuuuaaaauucugacgaaagcaauguacagucuuccacagaaaaauaugccacaauaacacacacauacuuuuguaacucuuuaagaccucagguaaagaaugcagcuuuagauuguguugagacauuucagcaggucaggcauggaugcagguggaaaugagagaggaucagugagcgcauucaugucuuuugagcggucuacagaugaguggucuccagucucaaaugaggagaacaaauagggaaguaggagcucaggguucuugugugucucauaggcagcugccuaucccugggugauacagcucccuggcacacccauucccaagggcacaggauccagccagccagcugggccaagauugcagcccucccuccgaaacagguggcugucugccuuugucccaggcacaggcagcugcaccccauuuugugcucucaauacugcucuugauuucuccuccauugucuuugccucagcagucucuccaagcacaaagacagaggaacaagcuccuugggcaucucuuggugguacuaaaacccacuuggcaguagacuaaggccuucaaaaauccuccaucucuccaggggaaggaauucuuaggacaggcaagaagacaaacaacuggccagucagccccucuacaaagccaucccaggggcugauagcgcagucaucccgcccuuccuggcacugaggcgcucccuccuccucugcucccccaccugcacucugcccaagcugcugcugugccucuggcugccugccagccagccagcacccccacugauaaccauggggggugugaagugccagguugauaugagggggugcuugcuuacuuccggccucauaaaccagcccuacaaaugugauagggggaggugcuggcgggaagcccacugccucucagagucagcucaaaggacagaaucaggggacucauggcagaagagaggugggcugagacuauggggcaucuggcccauuggccaacuguggggcuccugacaaggccccagcucugucccuucuguaaucaugguaauuauagucaaguaucaucacccagggaggggaaagcaugccuccgaaucaaaagggagccaaaauugccacggaaaccacaucuuucaggcgaggcucuaagagccaggugcuggcucuuucccgcgcugcagagacaccaggcaucuuuggucugauccucucccgucgugucacugauaaaugaaagaagaauguuauccaagggaauggucccaagaaguugggaaguucagagccagaaguucugugaagagagcaucgugacacugagggagcucaggucuguucagggagcccuuggaaggucucagcauggggaaguuguugagccaggcccagaagcacagcuuccagaugcuguggaggaagccaggugugagguggaagcccacuggaaaaggcuggcccugauuggaccuccuagccuuccuccucccuugguguauuuguguaguucccaggaagaacccagagcaaacagugacucauucacccucacugagacccaagaagacaccaggacauguugggaucauucuuuagcucacagacagucagugacacuggguauugaaagcuaagaguuucaggccgggcaugguggcucaugccuguaaucccagcacuuugggaggcugaggcaggcagaucaccugaggucaggaguucgagaccagccuggccaacauggcgaaacacugucucuacugaaaauacaaaaauuagccaggcaugguggcacacaccuguaaucccagcuacucgggaggcugaggcaggaaaaucacucgaaucugggaggcugagguugcagugagccgagaucacaccauugcacuccagccugggcaacaagaaugaaacuccaucucagaaaaaaauagagaaagaaagaaagaaagcuaagaguuucaguagccagagagggugucuucaacucuauuccuugguacagugucuggaauugaaaccaaauccaugagcucauuguaguccagcucucugaccacagaaaguaaagcaaauccaggcuuagaauuagaccuguuuguggggagcagaaaggauugggauggggaggcauaguggagcaacacaucugagacaggaaguacggccccuguucuguuggcaguggaccucuucagucaguagccaaggucacagcccugagccgaugaugcuccaugcugcugccuggauggaaagcauucgaggggaccuuuuggccaccagcauuaugcugacagucccagcucagacagaaggccuucuuguggccucuuuucugagguaggaaggaagguuccgggucaggaaguacaugguuuguuguaggucugaugugaacaguuuguugucacuaaccagcccuggcuagcaagaauuccagaagagggauuuggcagggacccaugugguauugcaaccugucaauacaucuugacaaguuuguaaaucagucuuccuggcagccagcuucacauaguaucuaacacagacaggauuugcucaccaaaaacagagaugaguuuguuuuuggaggccucugcuguuacuucuggccauuuaccucuugcauaauguaagguagccuuuucucaucuuugcccuccaaugcccaucugguucucagacaauccccaaaccccacaaaaauggcuguuuagaagaggaaggauaaacaguuggcccuugguaucugcagguuccacauucauggagucaacaaaccauaaaucaaaaacauuuuggggaaaaaaaaacagugaaaauuaacaauacaauuagucugggaacggugguucacaccuauaaucccaguacuuugggaggcugagguaggcagauuuuuuagcccagaaauuugagaccagcuuaggcaacauggugaaacccugucucuacaaaacaaaaaacaaaaaaaauuagccaggcguggugaggcacgccuguaguaccagcuacucgggaggcugagguaggagaaucaccugagcccagggaagucagggcuguagugagccgugaucacaccacugcacuucagacugggcaacagagugagaugcaauacaguauaauaacuauuugcauaauuuacauuguauuagugcaaguaaucuagagaugauuuuaaguauacaaaaggauauggauaguuuguguauuagggacuugagcaaccauagauuuugguauccacagggggucuuggaaccaauuccccaaagauaccaagggacaacuguacugcuuuuuaaagagguggccuuuggaauuacaccaacuccacagccugacaggccccuuaaaaggagcugggagagguuuacuacagcgcagugaaaagaagagcacuuuuguuuggcuguggcucuuucccuucaaagaagcaaguaguauucccucaggugaagccuaaucauaguuacccucuaaaagacagauuugggccgggcaugguggcucacgccuguaaucccaacacuuugggaggccgaggugggaagaucauuugagcccaggaguucaagaccagucugggcaacauagugagaccccaccucaaacaauaaaaaauaaaaaaaaaauuaaaaagacagauuugggcugggcgcagugguucaugccuguaauccuagcacuuugggaggccaaggugggcagaucacuugaggucaggaguucgagaccagccuggccaacauggugaaaccccaucucuacuaaaaauacaaaaauuagccgggcgugguggcacacaucugcaaucucagcugcucaggaggcugaggcaggagaauugcuugaacccaggaggcagagguugcaaugagcugagaucaugccacugcacuccagccugggcaucagagugagacuccaucucagaaaaaaaggcagauuuggaggcucagugccugguuuuguugccuuuuaccugaggcagcacagccuccugggaccuccugggaccuccugggacacagucccucgucuuccaggcccugccuggucucuguccuagccaacacccauguuuaggaaggaagcaccucccagcauccuauaauacacucacuuggggauguuugcucuuuauggagguaacuucuguuguuaaaggagggugaccuaggccucuagguuaaauagcugacuuuuggugaaguuugucuuccuccgcucaggccgccccaggggcgagagccugcacugucuuuguuuucugaggccucugcuuuucuuuuuuuuuuuuuucuuuuuuuuuuuuuuugagacagagucuugcacugucacccaggcuggaguacaguggcgcgaucucagcucacugcaaccucugucuccugguucaagugauucuccugccucagucuccugaguagcugggacuacaggcaugugccaccacggccagcuaauuuuuguauuuuuaguagagacaggguuucacaauguuggccaggauggucuugaucuugugaccuugugaucugcccgccucggccucccaaagugcugggauuacaggcgugagccacuggcgccuggccaaggccucugcuuuucaagacuaggcaugcccauugggcagggcuguccauggcucuguaucucuccagugggccucacuccagccucacauuugccaucuuaguuccuuucucugugucugaagaauacucaggacccacugccuguaucuguuguugcuauuuuuuuagcugucucuuagcuccgaggaggagccgguuaggcuugucagggggaagggagaagcuaaacccaccauuccaggcauuuaggcuauuagagauuugucugaauugauccagcacugagcauccugaugaggcagcagcucuggucuugguuucagcucagccccaggagagagaaaggaugggcagccacaguccacaaagccaggaguuucaggagcucuuauccuucccucucuaaugccuuucaccuucuucuuuacccuucccaacugauuuuuagggccuuaaacucugguguugaguacuacugggaccagcugaacgagacggucuucacuguccauuccaacagcaggagcagcgagcggccuggguauguuugggaaguaggcagggagcagcuggcuggaggcccaucccuuccuccugcuuuugaugggcucuuaagcagcgcccucuagggcucugggucccuccucaaccagagcagcaccuccuugaucuuuuguguacaguuucauuugagaaaaguguuguguggcuaagaaagagaacaaaagcucugcucucagagucuugcuguagaaccacccccuggcccucucccauccuggccauggugccugggcacacuuggggugaggagagaagauagggccuggagaaggaugccgccccaugaagucugcuccauggcccaggcucuuccagaugaccaggaccucagggaccaagcugcccagggcuguagcccagggacaaauccucuugaggcacccauuaguagaaaucugguacugauccuuucaucacuuaauucacuaaugaagacuggaacaaagcgcuggguuguugauaaacccaaagcaauugcuacuuccccuaggaauugcugagcauagcuggaggaauagucccagaagcagcuagaaaugugagugucuggugauagucucaaaaggccugggcugccucugcugccagcuccagcuauuccaaggcagugccugggagaugcccaaggaagggggaugcuagcauuggccagaaccuuccuuguaggacagccugugcucccuaccugcaagggucuguuuucagaaggcccuggaaagaggaucccagaacagccucauaagaguuccaguccuggaugggcgcgguggcucaugccuguaaucccagcacuuugggaggcugaggcgggcggaucacgaggucaggagauggagaccauccuggccaacauggugaaaccccucucuacuaaaaauacaaaaauuagccgagcauggugguguaugccuguaaucccagcuacucgggaggcugaggcaggagaaucgcuugaauccuggaggcagagguugcagugagcugagauugcgccacuacagccugggugacagggcgagacugucucaccaaaaaaaaaaaaagaguuccaguucuuuccuuccaaaguggaguucucaguucacuugcaaauucaagaauucaaaguggaaucuuaugagcauacaguuggaaggaagguaaagcuaaagagagaaaggaccuucuucuagugcucacucuuuaucccaugaucucagcuacuggccuccugaauuucauuagucuuuucagaucagccaucucuacagcuccuccccacuccccgacaggggccuguuguugaagggcaugacugagugagccaggguugcaagauuggauguuucuguggccuuucauuguucuaggguauagacuaaccuugggggagaauggacacagacaaguuaaccaccaucaagauguaguugcaggagcacagggcuucucuuagccugcagggccuggcccacacugcccugaggauuggcacagagccagcagagugcugugaggggugcugucccaagccccaucugacuuuagucugccuuucucucccuagaaccagcagagccacauggaggacagacagagacauggggcugaugaaugccauugggcuucagccccggaacccugccaccucagugacaucucagggcacccagacucuggcccuucagcugcagaaugccgaaacacagacugagagggaggugccggagccagggacagccgccucagguccuggugaagguaggagccauguggcgcuggagggggugggagagggacccuaagaccgagugagugccacuucccacucaggaugcauacccccucccaugucugggugaugcccaccugguggcauuaagagccuccucagcagcgacaugguuucccugagcugggucacucuugcagcucgccucaacucccaccaaguacacugaugucccucuccucuaaaaugugaggacccugucucuuuuuccaaagagagagcacagaaagccuggauugaaagggcuaaagggagacucccuccugcaagcugccauuccagagaaguacaccccaggccuuagcuucuggggccaaaccacagccuagcuugucgucccccuaccaguguggcagauuugggacugccccaugggaggaccucucacaauccugucacaccuggggcucguugacauuuuggcugcagccuggccuaucaucagccccuuccucucaccuauuucagguguggcucugccacacucggcccugacucucugugccagccucacacuuuuaaaaaccaauuagcacuucccagcagcagaguucgagccacuuaggaguccgucagcagcuguguuaaacaggcuguucucacucaguugcuauccucacccccuaccuccagcccccuugcugauccuagcuccaaacaaagcagccuccaaacagacacauuuucuaagucuguguugagccauuugcccagaagagaccaugggaggaaaagccacggugcacgucaggcaaagaauaacaaacgugccuaucaccccagggaauggcuuucuacaccgcaguccccaacaggguauugcguggucgcuugcgaugccaugaacugagaauuuucaaagugaagucccucuuuggucuguagcacagcccaccuccugcauuugugcuugguggaagccccucgcuggggccaugaccauaagguggugcuggcuggagcagccaaccuccgcugugagccucugggaggaggugguggaaggcuccuucugccaucuucaggcccuuuuuugcagguuucuguggacucugagcugcucuggaguccauuaggccuuuuccaggaagccugagggccaggcaaaagggaaccaccacgggcuucucaauggagccagcaggccagcccucucaguaggaggcaaaccucucagagcucccaguaaccccugacagcgagagggauuuggagaagugggccauucucuuaggcagccccuucuuuuuauuuuuauuuauuuauuuauuuauuuuugagacagagucucacucugucaccuaagcuggagugcaguggcaugaucucggcucacuucagccucugcgaucucagcucacugcaaccaccgcuucccgaguucaagugauucuccugccucagccucccaaguagcugggauuacaggcaugugccaccacucccggcuaauuucuguauuuuuaguagagacaggguuucaccauguuguccaggcuggucucgaacuccugaccucgugauccgccuaccucggacucccaaagugcugggauuaaaggcgugagccaccgugccuggccuguuuuuuuauuuuuugagauggagucucacucugucgcagaggcuggagugcaguggugcaaucucagcuuacugcaaccucugccucccagguucaagugauucugucugccucagccucccgaguagcugggauuacaggcuccugccaccacucccaacuaauuuuuguauuuuuuaguagagacgggguuucgccauguuggccaggcuggucuugaacuccugaccucaagugauaugcccaccucagccucccaaagugcugggauuacaggcgugagccaccauaccuagccagccccuuauguguguuuguaguauguauauauguaugugcaaauagcagucacuggaagagaguguuguuuguuuuguuuuguuuuugagauggggucucacuauguugcccuugcuggccuugaacuccugggaucaagugauccucccaccuuggccucccaaagugcuggaguuacaggugugagccaccacacccggaccuuuuuuuuuuuuuuuuuuuuuaauuuaaagauagagucucagcugggugugguggcucacgccuguaauucuagcaacuuugggaggccgaggugggcagaucacuugagaucaggaguucaagaccagcuggccaacauggugaaacgcugucucuacuaaaaacacaaaaauuagccgggcaugguggugggcaccuguaaucccagcuacugagguggcugaggcaggagaaucacuugaaccugggaggcagagguugcaaugagccaaaaucacaccacugcacuccagccugggcaacaaagcaagacucugucucaaaaauaauaauacaauaaauaaauaaagacagaaucucagcugggcaugguagcucacaccuguagucccagcacuuuaggaggccaaggcaggaggaucuguugaguccuggaguucaagaccagccugggcaacacagcaaaaccuugucucuacuaaauauacaaaaaauuagccgagcaugguggcacgcaucuguagucccagcuacucuggaggcuggaggcaggaagauugcuugagccuggaagguggcgacugcagugagcugugauaugccacugcacuccagccuggaagacagagugagacccugucucaaauauaaauaaauaaaugaaauaaagauagagucucacucugucacucaggcuggaguacaguggcaccaucauggcucacugcaguccugaacuccuaggcucaagcgaucuuccugccucagccuacugacuagcugggacuacaggugugugccaccaugccuggcuauuuuuuuaaucauuauuuuuuuuuagagauagggucucaccguguugccugggcuggucuugaacuccuagcuucaagcaagccucccuucuuggccucccaaagugcuggaauuacaggcaugaagcacugcacccggcugggcagcccuuucugauuugauuucacugagcuuuuaccaugugucagccacuugguaaaagcggugaagacaaguaggccucucuguccuuccaugaggagcucgcagucuagagagggagaugggcaccuaaacugauaauuguuuuagugugaugaggaccucuggagcauagaggaggaggggcuuugcccagccugugggguuuaggggagacuccuggaggagguggcccugagccuagucuucaaggaugaauaggagucaggugaaguagggugguggggaagcauuccuggagacaugucucagcacaugaaauggcaccaaguucaaagacauguuacugcauaaaggaccacuaauuuguguucauggcaugucuggugcauguggagaacugacacuggaugaguggggaaggcaaguuacugggacugggcugggagugaggccuucagccugaaggugacaugcuggggcucugggagcaggagcugccaccuucagaaguaugucugcugguguuucaccucccagagaauucucugcuguuuucuugguuagcaugcagcccauuucuggcuucuagucaauuauaaguuccuuucauucuuuuggggggauggggacagaggguggggcagagggaaggagcucuuuucccugguuuuaggaggcaagaccugguuccucgccccacuauccccuccuccuguaaaguagaguaggcgguagaggauggccccagcuaagcugaggcucuggucagcgggagcagcaggcagagugagaccgggcagcuggcugcuucugccugccugcaucccugcaugcucugcguauacccuguacccacagcuguuccacacaccauaccccuuucagaaaccagucagggcaggggaggugugggucagaggguaugggcacuugauggaugggugucauucuccagccuugucccuccuagggcaaggagccuugcucugaggcacucacaccacuauugugcugucagacucuucaggggagcccagggaucagggcucucuuugagcccagauuuccccaugcagaggcagcuggcagguuuuguauugacaaaaccagagcugcaagagcauggauagugaaacccucuggucagggaguucagcucuucugggcugggcuagaagggagaucccaccuguacucacaccugcuacaggcaccaagauuuauuuauuuuguuuuuauuuuuugagacaagaucucgcucuuccauccaggcuggaguacagugacacgaacacggcucacugcagccucgaccuccugggcucaagggauccucccaccucagccuccuggcacacgccaccacgccuggcuaauuuuguuuauuuuguuuguuguagagacaggguuucaccauguugcccaggcuggucucgaacuccugggcuccagugauccucccaccuuggccucccaaaguacugggauuauaggcgugagccgccacaugcagccacacagauuuauuaaugugggaagccugcucugcuugugguaauugcuguucugugcccugccccuccccacuccccuuggcccuuuucugucaguuagcaccaaagggcuccuaggcuacuucucauuuucuuguucuauaaaaaugugguugaaauccauucagcucuuuccaggccuuccaggaggagcccuccacagggguauuugcacgcgucagcuuuuuugcauguucaacuuuaacaagaguuugacuucucccagaauuugacucuacagcaagcuuuccuacccugcuggccaagagcauagcucgaaaagggagggaagcauuuccugggcucaccguuggcuuccagcacugaugacagugccucccuagcuugcagugggcauucagggcaagcauggaauuaaugaguuuagcugagcugaggcaaggcccugccucugagcauggcugugccccacuauuuggagagcaccauggcugugccccugacccguagcaaaggucaucugagccucuguuuugucuggugaagauggucgguagaccagcagcaguagccugggcccugggccaggaaaaagcaaaugugaagagggaggggcuggaagaccaguacucccagaggucaggaagggcagcuccuccugugacucucugagccucaguucccucuuuggcucuucuggcaaugaaaucucuagaauuaaauaugguuguagggcauggugggaacuuguugauccuacccuggccucugcuucuagaguguaccuuaggacuugccaaggaagagaccucaugugaacucuaaaucaauuuccuauuuucaaagacaaaaacagaugcuuuugcuacagaggaggagacugcagaauuaacccccugucugccacugugccuggaucccugacuguaacugccauuucccucuagcccugguauuuuuucucuugaagaaugugccagcucuccucaguugcucuuagccuuggcuuagaguucccaggagggaagcauagcucauaguucuguaggcugaagcuguccacaccgagcccugggggagccauuuguuuguacauuuuaaaaucuuccauucauucuuuuuugagcacuuacuuugugucugguauuguguucggcaccaugaauucaagggcacuguggagggaauuacauugagaugaauccauugugucucuucccucaaagagcaaguccagagagaacuagacauguaagugcuucuccaguggcucaugccuguaaucccagcacuuugggaggcugaggcaggcagaucacaaggucaggaguucgagaccagccuggccaauguggugaaaccccaucucuacuaaaaauacaaaaaaaaauuagcuaagugugguggugcacacauguaaucccagcuacucgggaggcugaggcaggagaauugcuugaaccugggaggcggagguuguagugagcugagaucucgccaccgcacuccagccugggcaacagagcaagacuccgucucaaaaaaauaaaauaaaauaaaugcuucucccacaaugggcaguuacaagaccgguuuuccaagcauccuuaagucuggagccccugugaggagccugggagcccuuuuauuaauacauacauguauuugacaaauacacgcccaguguaaacccacguguuagacuuggcugaaaagagaauacagcugaguccaagaccuucaggaacuuauaggccagaagagagaugccacagcuacggggaguugugaagcacugugaggucccagagaaggagcauccccuucuagcugggggaccagagagaaguggguggcagaggagaugggacgagagcauggcacagugugcacaguguaugcccaucugugcaggcagggagcagggcugccggguaccugcaggaaugugggggacagggcaggaaggucugcagcaugauaagggucuggccagagagcccucaaaugucaagcuaaggaguuuugacuacugugagggcuuuugcagcugcuggguuuugaacagggugcagacuuaaccagagcucaagucagcagagcugaauuaggaugguaauaggaacaguguggagacuagacggaaggggaggagacuggaagcaagaagcccaguuaggacacagucauagccauagagagggguggccaggccuggagccauaggcaagcaagcagugggcucagacuugagugccagcagcagggccucccgcagagccugggaaagcccauccggggcucucugggggcuuggcugcagcagcacccauagggccccaaggcagccuguucugccccugguaaucuacuugagaagagcugagcugggugcgguggcucaugccucccagaacuuugggagguccaaguggguggaucacaaggucaggagucugauaccagccuggccagcaugaugaaacacugucucuacuaaaaauacaaaaauuagcuggguaugguggcacaugccuguagucccagcuacucgggaggcugaggcaggagaauugcaugaacccgggaaguggagguugcagugagcugagaucaugucacugcacuccagucugggcgacagagcgagacucugucucgaaaagagcugagaauucacuaggcacagcgccuggcacagugcacuccaaugccagcaggccucaggccagccacagcacgccccagaccaugcugcgagggcuucagugcacagaguucugagaaagcauuggggcuacagugagcacagggagggccccaggggaccuccccaggcagcccuuggcucccaggguagaaucucugugggcaccaaggccguagguugacuuuuuucuucuuaccuucugccccacuguuagaaggcuuuaaaaccugaagaugggguugacccaguacucugagagcccuucagguuuucucuccuucugcccugggagcuggagccgggugucccaggaggaaguggggaagggcagccaccuugagggauggagggcagugcuuuaucagggguuguccagaaaagcaagagaggacauaaugcugaggaagaucgucuaagacuggggcugggcgcagugacucacccauguaaucccagcauuuugggaggccaaggcaggaggauugcuugagcccaggaguucaagaccagccugggcaacacggcgaaaccgucucugcaaaaaguacaaaaaauuagccaggaguggugcuugccuguacucccuacuacucaggaggcugagguggguggaucacuugcacccaagaggcuaagcuacagugagccauguuuguaccauugcacuccaguuuaggugacauagcgagaccuggucucaaaaaaaaaaaaaaaaaaaaaaaaaaaaaaaaaaaacuauagaaagaacuagaagcaugaggcugccaaguaccaacaagaagggugagagaucucuuggggccuuagaugccaccaagcugugaaacuggcuggccuggaaauccaacucuaaugaggcaggcagagagaaggggauggaugggguuaggggagcaaagaaagucucauaaaaauagcugcuggcaaguaccccaaaaggaaagaaaacucaccaucaaaacccccaaaacugcaaaauuccaaacaguagcugauggagacaaaucagcaguucaguggagccaucccucgcagccucagagccuugaucauaguugcccacggucuuggccugguucucacccuaccaagagcugagcagaaagcuggaagggaggucccacagcaauagagcuccacugcugcagaccccaaguuaaucacaacaggcaccguugaccaagugccugggcugugcguuagcuccuuuucucucuccagcaccgugcaagguagauguuagggauuuuuuucaaggucacccagcaagcaagugacagcugagauuugagccgaagucuuuucuguucccacacaagggaaugcucaggcauuucugcagagggaguggcggacagauccuucucucccucccuagaccuggguccugugcuggucaguugacucuuuuccgggaaauauggcaucaggcauugagccccaggagaacaauaacuggggaauagcuugugaagacugggggguaaagggaaagaagagaaggaaacagcccuuccaaggaacaguuaaaacucucagcuucugaccaggcacgguggcucacgccuguaaucccaacacuuugggaggccuaggugggcggaucgccugaagucaggaggucgagagcagccuggccaacaugguggaaccccaucucuacuaaaaauacaaaaaauuagccagguguggugggagccuguaaucccagcuacucaggaggcugaggcaggagaaucgcuugaaccugggagguggagguugcagugagccaagauugugccacugcacuucagccugagugacaagagcaaaacuccaucucaaaaaacaaaggcugggcacgguggcucaugccuauaaucccagccuuuugggaggcugaggcaggcagauuaccugaggucaggaguucgagacuggccuggcuaacauggugaaaccccgucucuacuaaaaauacaaaaauuagcugggugugguggcgggcaccuguaaucccagcuacucggaggcugaggcggaagaauggcuugaacccaggaaguggagguugcagugagcugagaucgcaucauugcacuccagccugggcgacuagaacaaaacuccauuucaaaaaaauaaauaaauauggccaggcgugguggcucacgccuguaauccuagcacuuugggaggccgaggaggguggaucaccugaggucaggagcucgaaaccagccuggccaacauggggaaacaccaucucuacuaaaaauacaaaaaugagccagguaugauggugcaugccuguaaucccagcuacuugggaggcugaggcaggauaauugcuugaacccgggaggcggagguugcagugagccaagaucacaccacugcacuccagcuugggugacagagcaagacucugucucaaaaauaaauaaaauaggccaggcgcaguggcucacaccuguaaucccaacacuuugggaggcugaggugggcagaucacgagaucaggagaucaagaacauccugguuaacauggugaaacccugucucuacuaaaaauauaaaauuagcugggugugguggcgggcaccuguaguuacucaggaggccgaggcaggagaauggugugaacccaggagguagagcuugcagugagcugagaucgcaccacugcacuccagccugggugaaagagugagacuccaucaaucaaucaaucaauauaaaaauaacucucagcuuccucaggggcuuugaggagguaacacaaaacuacgcugaaggaagacagcauuguaaugaagcagagcagacuguuucccuuugggccacacccauaggguaccuacucucuuugcagagaaaggguggcauaccccagcucagcccuaggucugcugaguuuccacaacagggagcaggcagacaaaaccagcugucugaaccugccuucucgcaugcuaagcugccacuggugcugagagaacucauugaggccaaccugcugccuucugggccagugcugccucuuaacuggccauccuaggccucaguuuccccaccaguaaaacagaaguauggauugugaacauuuuggggguuuugucuagcuuucaagacucggauugguuuucacagugauggagcgagucuuucucuauccugcguuuagucaagaaucccccagcugcuaccgguggcugcccaccugccucagaggcccaggccagcagccaauucgcucucucuucugcuuuguaucugccaggugaggguucagaguauggugccaguggagaagaugcgcucagcaggauccagaggcugauggcggagggcggcaugacagccguggugcagcgggagcagagcaccaccauggccuccaugggcggcuucggcaacaacaucaucgucagccaccgcauucaccgcagcucucagacgggcacugaaccuggugccgcccacaccuccucaccccagcccuccaccucucggggacugcucccagaggccgggcaacuggcagagcgaggccuaagcccccggacagcuuccugggaccagccugguaccccugggcgggagccaacccagccaacccugcccucuuccuccccuguccccauuccuguuucccuucccagcgcugagggaccaacccuccacugcgaguugaccaauaacaaccaccuucuggaugguggcagcagcaggggggacgcugcaggcccuaggggagaaccacggaacagguagagacaaacguugcacuggugccuccccucgaaccgccaagcagaaaccggaccucacagcugacugggaacuggacauguggaagagcugcuggcugcaucagggaacaggaggaggaagagggucaggguggagaggaagaucagucagugggcacaagacagucaaaugggcaaggccugccucggggaacuagaaccuuccaggaucuggagcccgggagagccacacugugggcuuaaugugaauagaggaacaaguggguaucucugccaggcaccccacuuucuccuaguaacaugggcucaggggacucagcccuggacagagagccuccagagagugaacagucuuccagaucugggccaaucauccuggacagaggcccgcgaggcagcuuugcccuguccaccuguugggugggcagagccaccaggaacccagacaccaccuccaacucugagccuuccagagcuucagccucucuucgucgucuuaccccacugaaaccaacagggaucgggccaggcucccagauucuugaggacagggacuucggcauuuacuaaugggggacuacugugggguaagggggcgccugcuugccugauacaggauggggucaagggacagugggcagguccucacucaggagugggggguguaggcuggccagcccccagggcuuguccaccagucuucuccccgcaaggcccucagagcagcgccugugggugucaguauuaccugagccuaggccaaagcuagcccaaggcuggggaaggggaggagacuccaggucagaaugugaggucucagucugugauuuaagguguugcauguggacucuuaacuguacguguaguuucuaguggagaaaucaaggcucugaucauuuuguuuuuaguaugaaaaugugauuuccuuucuguuuguaacucaucauagaaacauuguggugggaggagaggggauagucuacagcuaaugagggaaacaccaaagaucacaucauuaaaaugaugacaugccccuc

SEQ ID NO: 191211 - RNA, 8945 nt, Homo sapiens
ucuuauggauucuuuauugaaucacaaacaacucagggcaucaggccccagcagcugcauuagaacccaucugggauugugaggggacuggagagggaggggggagaagacccgcucucccuagcuuuucacuauauagaguaaaaacaucagaaaucaccccaagagaaaggacauaccaaaugcccaccagaagggccagggacugcaagccacccugagcgcaggaggguguggugaagggugguauggccccgaaauuugugugugucccccacucccccugcaaauucacauuggaauucucacccccaaggugacaguauuaggagguggggccuuuggagcugauugggucaugggggcggaacccucaugaacaggguuggaguccuuauaaaagaggcaggaaggagcuugcuuguuugugcuucuaccauugaggauacagcgagaaggcaccaucuauggaucgggaaacagcccucagcggaguccgaaucugcuggccucuugaucuugggcgucccagccccccaggacugugagcaauacguuucuguuguuuguaagccacccggccuacggcauuuugauauaggagcucgcuggacuaacaguggggccaagcaggcucugucagccacaaccucagggaagaauguaaagguuggugucuuaccaucacaaggcaagcggcucagaaccagcuguaacaccucccuugcagagaucuaggggcgccagacacagcugggguggaaggcuccuagucuggacccuugcuccaucagccccaccuggggaggaaggcuucuggggagguagaacugggagaagagagaagcagcuccuuggcucugcuuucagaaggcuguuaccugggccaggugcugggagaccagagggacaggugccacucagggccagaggagccacgcaggacaaugugauguuagggacugggggaggauguuaaugacccugcuuaaccucuaagagaagcaugguucccuuguguucaaaagcuggacauacaggguguauagauggugagcacuuucucacaauccaccccauucccaggccacugcccagcagccccuggggaucugcuggugucagagggaacucgcucauuuccucccucaguccaggccacacuuuccuccaaaggaaggccggucugugggcccagggugaggcugccugcccaccgcagacggaaggcuucccaacccucuccagguggcugugguagggccaucuccccugaguacagugaagccuuuguggcuuugccauugcugucccuucaagguuguugccugucccuguccucagagugauguggaggcagacaggcccuggaggcagaaggaagggguucaacucucacuagggugcucccucgggaaggacaaaaacucagaaauacgagaggauagagaaggguuuggcaacuuucugguauuacuuguaaacacugguuccuucaacuuucugauauuacuuguaaacacugguuccuucucaaccaccguauucugauugggucuauaaguagcacccaguccacaccacagcacgcuucugggguccaggagaccgccuucacuacugugcuggccccgccuguguacgggccccggggccgggccauccagggugccuguggugcucacacccccauggcgcucuucucgcugucuuuggggcugggcuccuccggagucuucuucaucucccagccccugacccagguguaggcggaggagccgcccagcaccaucauguugcucguccaccagaggaagcucuuggucuccucguaguagagcacggccagcacugucugggcacaggccuuggccgugcccgacacauugugggucagcggacuggugaacuugaucugcaguccugucacguagccgauggcaaagccaaacaggccgcccagcgucaucaucccccagaagugggcacugcccagcugggcaaagucacgcagggccugaagcuccccgagcagcaggagcaggggcaggaagaggaugcaggcguugacguuguuguagaaagucaggcgccagaugcugccguccaccgccgggagcaccuucgugguguagauggcguugagcgagacacagaggcuagccagcacgccgaagacggugcccagccacgacagggugccuucugcccccuccugguccacaccaagccagaagcccccugcaguggggagaggaggaguggggaagggugaggaagagggaugaggacgaggaggaagaaggacagaggaucagacaccaaauuucacagacugaguauugcggcccuccccguuccuccccaggccucccuccaauaagcacagccagagucuccacugcaggcaaagcacuccacaugaacuaugggagccgcccagggcaagaaaaccuccucuggcagcuuaucugcuagcagaggagaaagacauuaaaacaaaucuucccaguuacuucuuuaauuacaauuguaagaauuguaaugagguccauaaaguaguacaaggugcugugagagccuguaagugggcgacugugcuggccuggggcaucugaaaauaacaguugaacugaguucugaagaaugagugccacuuagugguuaaugugauuuaaggugacccugcguaaaugacuuccagugucuaagccuuggcugcuucuugcauggaaugggagccuaugaugucaucauggggcacauuaaguuagaaucucuugugucauuuggggcagugacucugagacucucaucuugugucacuuccugcucaaagagcuuccguggcuccccacuucugccaugaggacuacacuccuuggcguggcaggcgggggugcaggcccuuccucuguccuauggucgccccagcuucccugcucgucucccugcuucucacccugggccucaguguccuuguucauguccugugccagaaacacccuccuccuuucugggggauucuacucaucugucaaggucaaaguuggcuucuccuggggaauccuuuccugauaaucccagaaccuggacucuuacugccucgcuuuccugcaaagccccuugccugcucugggcugcugggccccugcccauggugacagucuggucuuuuuagccagaucccaugcucccagaagccaggggcugaacaaugcauguuauacuuccugccacagcaucuggcaacacggggcaguggggaaaguuuuggggucagagggauuuagccuccaaucaggcucugcaauuuagaagcugaguggccugggagaaguuacuuaaccacucugagcucucugggucaccucccuguccuccacuccagccaaucuacucuccaccuugcaacugauaugaucauccugaaguccagaucgguccaggcugugcccuggugugaagccucucuguggcucuccacugccuucaggagaaauuccacucacucaccacagcucuuaggaccugcaccacguggagucggccugacugggcagccuugugucuggugagucuugcuguggcccagccaugaagaagugcacgugcucuuccuucuaucuagaauguucugucccuacuucuuccucuaaacccaguuucuaaacuuccuccagaaggccugcuuagacugcccuguccccggguccccucccuugcccagagcucccacagccccuuuuaugcaugccccaucacagcccuuacuaugcuagcguaacugucaccaccaugcccuccaggaguguaggagcugagguuaccuuuuccaaacuuguauccccaaagccuggcauggugccuggcauguguuuagccaccaauuacuagucguggaaugaaugaaugaaaguuguuauggaggugguuguauuaaaggagacaggauacuuccuacaucauaggcacucaacacacagcacucuucucuuuuucucuuuguuuuuugagacggagucucgcugugucacccuggcuggaguacaguggugcgaucuuggcucacugcaaccuucgccuccuggguucaagcgauucucgugccucagccucuugaguagcugggauuacagggaugcgccaccaugccuggcuaauuuuuguauuuucaguagagagggggcuucaccauguuggccaagcuggucuugaacucuugaccucaggugaucugcccgccucagccuccccaagugcugggauuacaggcaugagccaccaugcccagcccaaccacagagcccgacccuccucuuucuugacagaaccuuugcacaagggguacccacagaccugcuggggguagggugaggggggcagagggcugcaccacccacucaccugcuuggcuacagcaccccuagcccuccuggugguuaccuucugaguccagaagcaacugcaacaucaauguucuagagcgacucuugcccagaaagaacuuuuuuuugagacugugucuugcucugucgcccaggcuggaaugcaguggcgcgaucuuggcucaaugcaacuucugccucccggguucaagcaauuauccugccucagccucccgaguagcugggauuacaggcacaugccaccacgcccggcuaauuuuuuguauuuuuaguagagacaggguuucaccauguuggccaggcuggucucgaacuacugaucucaggugauccaccugccucagccucccaaagugcugggauuacaggcaugagccacugugccuggcccagaaggagcuuugaaaguuacugugugacauggggggcuaggaggggaggccuagaauaguugccugagacucgucuuccccuacaaggaggaagaaagaggaaacauugcagauagggagccagguccugggcuggcagagagcguccaccucccuggccccugucccagucaggcacgcccgugaaugcaccauucucagaaccucaccacugguuacuuggauuaccuuugggauuugggcccaguuacccuagugucuucaccuuccugcaagcaaauucuccaacuaggagccucuaccccugaggccacuccuggcagggucagcaggaaugaaguagagagcccuggggcaucugaggaggacagggaggaggggagguacaccuguucccuggagagggaaauggaagcaggcugggagaguucuggcagggggggucuugcagcuuccccuacucuaacugugaccuucucccuucuccccucuuggacuuagacccagcagcccuagauccagcagcugcucaacaaggggaaacauuuucuaggacagguggcaugggaugggucccuucccccaccaaccggugcaucuagccugggacccugagccaucagcaaagaauaugauauguaggccaaauaagauaaacuuuauagcaccaggaaaaaccagcauagguucaaaugaagaccccauuccuagaugacgcagcccugggaagacucggagggaaugggaugcuggaggcucucuaacgcagcauggggcccaguaaaauaugggcccaucuaaccugugcugucccauaccauagcccucagccacauuuggcuacugagcccuugaaauguggcuagaaaaucagguuguaacaucugcaaaugaggaagugaauguuuaacauuuugcuuaauuuuaacuaauuuaaauaaguggccaauggcuacugcauugaauacugcaguucuaaccuccaagacgagcagaggggauagaagcacaggccugggagucuggccaaucuggguuugcaucccagccuggcugcuugcuagcuguguggccgugggcaaguaauguaacaucucugagccucaguuuccuuguuuguauagagaugaccgcugguagugaugccacaacccaggggaucucugggagaacaaaggagaugcuauaugugaaauaauuagcauaauuuccccaucaauaauuauuauuuucugagggucaaguccaggaagacagcugaggccucucaaagcauauugcuugcuacugucucaggcgcuauccugagcuggcagagagugaugguauauuuauuaaaagacguauuguccucuacuaagagcacuggcugggaaaucaggacaccugagcucuugagaaacaauaaaguacaguggucgggcaugugaacugugaagccagauugcuugaguucagaucccagcucugccacuuauuagcugggugaucuuggacaaguuaguuaacuucucugugccuugguuuuucccucuguaaaauguggauuauaaucccaucuuguuaugaagauuagcugaguuaauauggcuaagauccaugugccuggcacauuuuaaucacucaacaaaugucaguugcuuuugcugcuguuguuacuauuauuauuacuauuguucuugccccggcugggcuccuaacuugcugggugaccuuuaguaaguuacuugcucucucugugcccccaggcucuuucuccuaugacugcugcaccaaaggagcugggacagaugaaguccuaggaugccuagaagaguuguucuucacugcuucaguccccaugaccacucuaucccccguggccccagcugccacucaccgaugaugauaccgcaggugagcagggcauagaaggagguggucugcuugagcagcagguaggagagcagcacguugaagacgguggugagugagcggcccacauuguagaaggccacaccgacguacuugaggcagagguuauugaaggugaucaugccgaugaagaccaccgacaggggcaggacgcugcgggccacccugagguccaggcgcaagcuggggaaguccacggcaccagggcagcaggcggccagagcgcugaggccuuugcacagcagcguggucaccaggcacugguagaaggugacgaagauggggguguccagccgcagggaggggcuguccagcagguacuuauuaaggaacaccauggagauggaggugacccaguagagggagaccaccagcgcgaucugcaaugcccgcagcagaaagggcuucuccccguuggccucugccucugcagaggggucugaggccccggucagcgccaugugcaggauccuggaccgcuucagaggggcccuauucaugguagcagaggagcugggucaccccgcggccagaacucugauucccuggaguccagggcagugagcucacuugugcucuccgcaaggaagccgcagcccuccauugucacaugugggcuggccuaaaggccuccccauuguccucauggauugagaaguucugcuuuggggugagcccaguugugcugcuccacaaccuacucccaccccgagggggcucugagacaagacacagggcaagggagaggaauaggauaaggcggugaggccaggacagagaagaccugugaggggagaagaggcuggggccuaacagggaggggucgcagagagaagggaggggagaggaauggcagggcggggcaggaguagguacgcggggcgaaggugcaggaaaaggacgcguggcagagugggaagaggugccgagagggcgucaugggcggcugugggagggaggggcgggcagggggagggaggcguacagggagcugccggaggccgggcgcggcuggagggagggcugcggaagggucagaggggcucggggcuuggggcugaaggacgcgggagggggcugggccggcgcccacgucucgcugccuucccgggcucugucgccggcucagcccaggagccuccggacauccgaggccgacuccccgggaggcgggcccuggacucacuuccugacacgcccccacguggccuuaaagggcccgcacgccccgccuugcccuuaaagcgacagccccagagaggcggaguucgccaguccccagccccgccccugcgcuccgcugcccgcugcuggcgggggaccucggcagccacagguuuuucugggugcuugagccucgcccugcuuccuggaagggcuccaucaaccucgccugcccacccucagcuccguccgccccggagccuccgucccccgacuuggcuaggcuuggcucgcagguccacuucccggaaccccgacccaggacccgggcggcgcuacaucagccuggaccccuccaccuccggagacucgcguugcagccccgcgucccucugccaauccgagcucacucuuccauaacaauguugugguccccuccuuuccccccauuuucaccgcccccaggcccucucccaagcccgagacccccggcagcgcuccccgaggccggaggccacgccgccucucucggacuucaguuuguccucccugugcuccugucgagguccucugggcggcccggauccgagauuccaaaggcucaagacagcaucucuuaccccuuccagaaaauacuguuuccccggccgguccagccgcaucagcucccgcgucccugccuguguccccgggccgcgaaggcgaccuggcgcucaccuccuccggugcacugggcgcccgccccgcgaccccgugcugcaucugcagcgccgcacccugggccgcgcccgcgggaucgacuuccugcuuuccgccccgggcccgggcaccuugccagccucgccggccuguucgcggcaugggccccgggggugccggcggagaggcggugauccggacggucgugggaggaggcccucuccucuuuccaaggcuacuccugucccugguacccccgcccgcccgggacccggcuucaguuaccgcagcuggcacgucccgggacuuggcuguaucccuggcccgccgcgcuaccggcuugcacuuccagaagugcgugcgggga

SEQ ID NO: 191212 - RNA, 20061 nt, Homo sapiens
gcagccauuuuaauucauauuugagugggcgguggcgauugguguuggcggucuggcucagcugggcaggggguaacuuuacugauuugggggugguuuuuaguuuaauuuuucuuuucuagcuucccaucgacggucagugcgcacguuguaaucagcugaggccaugucaggagacggagccacggagcaggugaggaaggagagugguggggccucguggcgaccucuucuccacgucuguuccuccgacugcuccagacauguucggcugaggaaggaauugggucuagugaacccgggggacaggguauauagaagaguggugggaauggggagcaagaucuaagauuuaauuuuuuuuuuuuuacuucucucucuuaggcaugaauacgaguaaauacuugauuuagacaauagcgguaggcugcuucguccuauuuagauucaugggacuacuccagaugggaugcuuuccuuugauaucguuuugguauuagaguggauaggaauuauuuuaacgugcacccgacguuuuagaaaaacuugacaguguuucuuuuaccccgccaaauauacuguacccagaaauagguuacuaguuugagaaauauuugagacaaagcuaaucuggagaauuaagacuuaaugagagcgagugaagaaagaagcaaguuaugcugagguuuugggaauuuuguggcuuucuuucguuuucuuuucuuuuagccacauuucguuuucauuuuuccagcuacauaaacauugcagguauaaguugaaaaugagaagucuguuuuggccacuguaaauaaaagcaucuguuuuaauaguaaauaugagugacaacuaaauauuuuaaaauucacacuuuuagguuagaucagugugauuuguuucuuuugcucuuuguauucagaauuuuguaggauaguauuuaccuuuuagugugaaagaggaagcuaaauaguuaugaaaaaugccauuaaauguguuuuucgaucuaaguccugguguguuuagauaaauacaguuucuaaaauggaggcuagguagccugcagucucaauuuccugaaauuucccauugccauagcaacgacaugcacuuagguuuucguuuuucagguucccuagcuuauaacguggaagauguuauuggagguuggcagagaugaggcaaaauaggagcguucuauugcauagucuguaagacuguagauuucauuaugucggcaguuugauuaaauuguuuuguguuugcccgaggacugguuucaguccagaaaucuucgcacuauuuacauuuuacauaguguuagcaugcccaagcaugcaaagucuuaaaauuacuguaucaaaacuguuuaccccuuuucugaucuaguauuuguuaucugaaagugaaggacuaaugaacugagguuucauugaaaguuuucgaaauucauuguuaauucuuagaauuuaucuaaaauuacaaagacacggaaauguuaccaugaccucuugaauguuuuagaacugugguguuucagugggacagaugguggugaaaauuuauagaaaaauaauuucucccaaagguuuuauugugcaaaguuuagaacauagagaaaaguugaaagaaaagugcagugaacaccuguaggacaacucuucgccuggaaucaacagcugaaagccuugccauauuugcuuuaucuccccaugcugauagauugagaacagagucuuugucacucacacuagagugcugugacgccaucacagcucaccauagcuucgaccucccugcgcucugugauccugccaccucagccuccuccguagcugggaguacaggcgcgcgccaccaugcccagcuaauuuuuuuuuuuuuuuuuuuuuuuuuuuugagauggagccuugcucugucgcccagacuggagugcaguggcgcgauuucgccuuacugcagccuccgccucccgguucaagcgauucuccugccucagccaccccaguagcugggauuacaggcgcccaccaccaugccccgcuaauuuuuguauuuuaaguagagacggggauuuugccacguugcccaggcuggucucgaacuccugaccucaagugauccgccuaccucugccuuccaaagugcuggauuuacaggcgugagccaccguaccuggccuaauuuuuguauuuuuuuuguagagacaggaauucaccauguugcccagccuggucuggaacuccugggcucaagcgauucacccaccucaguguccccaaguguugggauuacagacaggcacgagccaccacgccugguccacgcauguuuauuugaaaguauuuugacacauugcagccccaaguauuucagcauucucuuauaaauaagagcaaaauguuguuacauaaccaccauaccauuuccccacccaagaaaauaguauuucuaaaaucuaguucuuuaaauuuccccauuugucccaagaaugugauuuuuuuuuuaaccagaaucaaucuagauuuacauauugaaucauuuacuucugucucuuaaguagucucaccauucuucuccccuggggcuguugucuauucgaagugucaaggacacuuaacacugcuuuucuggguguauuuguuuuuuguuguuuguuugcuugcuugcuuuugguuuggggguugaugaugucauuuaacuugucccuucaucuguauuuccugaaaacuuuacaguuaggucuauacucagccuugauauuuggguuaaguauuuuuggauagaauacuuaacauuauaucauuacauuagcagguacuucugcuggguucuguuaggaugguuaaguuugaucacuugguuuagggugaucucauuguuaagggucauguuccccuuugcaguuaauaaucugugaguugauaaccguuuucuuuaaaaucaccuuauaccuaguuaucaauugauaaaucuugacuaaaucagcucuuacauuggaaguagcaaauggugguuuuguuuuguuuuuaaaacccacaauucuguuggucugugucuguuuacuggcucauacuuucugcaaaaaagacuuuuuuucuuccuaaagauuaaguaucgcuauggauucauggauuucucuuaguguguuaguaucagugauagccauuuuucuuuugcacacucaacuuguccaaaccuuuuuggugguucuuauaucuuuuccuuaagucugaaaggcaauuuagacaucugauuaucaacaaggaagucaucuucauauagccuuuucuuuaacuuuuuaauaauacauuucaaacauguaagaaaaacaguauaauauaugaaguaccugucauagagcuucaauuuauggcuaaucuuguuuccuccaugacuucauuugcuucucucacccccauuacuucgaagcaaauccuagauacuguauucagcuucaacuaaaauaaccauuaaauaacaccuuaaggauggaaaauaugaaugagcuguaccuugcuugauauuuaagacaauauugaaaaucuggaggaaaagagaguauccaaaauaaccugaaaucauggaugagaaaaauaaacucaaugagacuaaagaauaauaagaaaaaaauuaaaaccauugaaucauggauuugcuuuggaaaaaugccaagggaugggguggacaaagaguccuacaagaugcagguguagauuuagccuuuuaguagcauugaaguucaaguuuguagaauaaaccugauacuaucuuaaauuuauuacuaaaauauauggauagucauuuuucucuuggugcuaagauuugugauuugugcccccuaacagagggaaauuauugcagacaagcaaaaucacugcuaaagguuuauugcugugauuuuuuuuucaacucuaguagggaaguucaauuuugcauguagagagcuauuggaauuaccuuauaguguucaaggaucucuucugaagcuccuugcuuauuguuuuugccaguuuaauggugaaaaaacuauuugcauauagguuuaccccccuaacaaacauaugauuucuguguggaauuauggcuguauuauuuauuucaugguuuuguuuuuuuguguuuguuuuuuguuuuuuugagauggagucuugcucuguugcccaggcuggagugcaguggcacggucucggcucacugcaaccuccgccucccagguucaagcaauucuccugccucagccucuugaguagcugggauuacaagcacacgccacaaugcccggcuaauuuuuuuguauuuuuaguagaaaugguguuucaccauguugaccaggcuggucuugaacuccugaccucaagugaucugccugccucagccucccaaagugcugggauuacaggcgugagccacugcgcccagccugugguguuuguuuuuuuuaaugccugauucaacuuuugaucucauucuuaggucuauuuaaccuugugcacuacucuuaaggcauuuaauaugcuguuauuuagacauuuuccauuggguuuugaacuucuuuaguugaagagaugauguuauucaucuuuaugucuuaaagaccuaagaaauaauauuuugaugcuuaaagguauucaguaaaugaauggauuaaguuugcaucuuuuaaaaaaaauuauuuauuuacuauuuagguagagacgaggucucacuguguuucccaggcuggucuugaacuccuggacuuaagugauccuccugccucagccuuccaaacuguuggauuacaggugugaguccagccauauuucaccuuuuaaauaauguauaacuuauccuagaauuuggaaggccuaaaauacaagccaaaugauccucagcuuggaaaagcuacaugauucuaagaagcgcaaauuaauugcugguaguucuuaacaaaggagcauuuaggcucauaaauacguguuuuuagugaaaaauaauuuugggaagauuuagaaaauaaugaagaguauguguccuauuauauacuuauuauuaauaaggaaagaaaaaguugaaacacccacagcauugaaaccugaaaccugguuuauuucguuagguaaacauuaguacuuaagcuguuuagaaguaacaguaucgccaauuuuagucaaggugcauauauguguagggguuagaagaggcagagaaagagccaacuauguguguuggacaauguguuuuuuuggauuuauuuuuuccaaaaucuuucuguaacagcccuuccuaguuuucugccuccuauuuuuagugaugcuuguuugguguaacaguuuugggcaggcaaauugauuugaucuuuauuguugauauuucuuaggaaacuggagcauuaucaaauauucuguuuggggacaguuguuccuaagagaaguugcucugugcuuaaagaaugagaauuggguuuuucuuagagauacagcagaaagguacuguguuaggugauacugcauuccuucaacauuauuucagggaauguaggcauuuacaucccagauagaccuucagaagggcaaaaucuguauuuggguguuuuuaccuauuggacaauuacccauaccaauucaugauuuuaagcuuuuuuuuuuaaaucuucgauuuggugacggugauuuuaagcuuuucuaccaugucucugaaucuuucucuuuagauaggaccuaccugugaauuugagucuuuuuguuuuguuuuguuggacaguugguaauggugugagaauugggcuaaaaaagggauuugaguuggcaguuguuuaaacuaucuuuagauuaauggacaacuuaggauacauaguaaauauugaauaaaaucagaagggcaaagcuucuguguguccuaauuaauguuuuucuaauguuugacuuaguuuauuuaguguauuaaaucuggauuauucauauuugaaagaagucucaucuuuuaaguuccaaacgguuaagauuuuaauuuauauuuuguagcuauuuguuuccuaggggaugaauaugcaaguuuacuaagcagauaaugguaaauauaauuauuugaacuaauauguuaagccaagaucuuuuuuuuuuuuuuaauuuuuuuauuuuuauuuuuucgagacagagucuugcacuuucgcccaggcuggagcacaguggcgcaaucacggcucgcugcaagcuccgcuuccuggguucacgcuauucuccuaccucagccucccuaguagcggggacuauaggugcccgccaccacgcccucacgcccagcuaauuuuuuauauuuuuaauagagaugggguuucacuguguuagccaggauggucuugaucuccugaccucaugauccgcccgccuuggccuuccaaagcgcugggauuacaggugugagccaccaugcccggcccaagaucuuuuuuuuuuuaaguuuuugaguuguuuguauguuuagauuuuuaaucuauggaugauuuggagggauuaguuuuguauuguaggauacauguucaguuucauucacaacaaacaugaaguaggguuugguugcauugguaaaggaacacagaacuaagcugacaucugguccuaauauccggucucauugugacaccugucacauauaguucuuuauuaucugggcauaugaauggaaucaguuagguuacuccucuaugaaagucucagcacggcaccguggcucacgccugucuguaaucccagcacuucgggaggcugaggcuggcggaucacuuggucaggaguuugagaccagccuggcuaguauggugaaacuccgucucuacuaaaaauacaaaaauuagcugagugugguggugcauaccuguaaucccagcuacuugggaggcugaggcaggauaaucacuugaacccgggagucggagguugcagugagccaagguacagccacugcacuccagccuaggugacagagugagacuucaucucaaaaaaaaaaaaaaaaaaaaaaagaaagucuuacggagugcuacuccggucuacuuuuaauuuugaaaaaaaguuaaccacagagagagacuuaagacuucaaauauauaguauauucaguuuucuuaauauuuuagcaaaaaauucacuuggaaugacagguuuguugccaccuuauuuuuaaugaaacgugacauuuggaaaacauuuguggaacagauagaugaggugguacauauuucuuaaaguggagcccauggcccauuuaugucauaauuaggugcguuauaaaaguauagauacguagacucugauuucaaaccuaacuguucaguggggcugagaaucuucguuugaaacagguaccacagugguuuuuaugucaauaaaagcuugcagaccacagaguuagaugauagcugguuguuuuaaaauauauucuugauaaauaaguggaugaaaaaauggcagauauuugaggaugguauuuuacugauuuuuccugcccaccugcuccccacccccauauauuuaguuauuacccugaauagcgagaaauacucauuauaaaaccaggguugaggcucaacucugcuuuuucuguuggucauaguaaaaagcuuacaucgucuuaaaucuuucagucuaccaucuuucucccccucuauucauacuuuuguguuaucacuuuaacugaucccuacuuuaacuuaauuucaguauggcuccuaauauaacacccuucuaauuuaucaugaaaguagcuauuuggagaaagagaauuaucuuuuuuuuuuuuuuugucuguuuuaccugcauggucgaaauggaagaaauuagauuauuauuauuauuguuauuauuacuauuuuuuuuagagaugagaucuugcucuguugcccaggcugcagugcauuggcguggucauagcucaccacagccucaacguccuggccucaaggacuccucccaccucagccucccaaagugcugagauuacaguugugacccacugugcccagccuuaaauuauauuauuucagucauuaacaugauagugucugucaccucuucacaucccaccuucccauuaacaaccuccuaauaaaaguuaugagcucauauagaaagaaagugguuaggaguuucaauaaagcauaacucauagggcuuuccagaggcuacaucaccuauccacaauuguauguaaaggcuguuaaaaauggucuuuccucccuuuuccaacuacguaacugugaggcuaaaauuuuuucauauuuuucaucuaaaacaauauauuguaacagauugaaagaagcagauaaugucuucuauucagccagacauuuaaaagaucaugaaaauguaaaauggugccauucuuuugacuuuuuuuuuuauuuuggaaaauuuccuucaguaaaauauuuauauucauauuuaaggaauuuauuauuuuuaagugaauuaaauacuuuaauuuuuuguuuuaauuucuuaugugaguaaugauagaaucccucugggcuccucaauuauuauuguuauuuuuuuuuuuggaggcggagucucacucuugcucaggcuggagugcaguggugcgaucccagcucacugcaaccuccaccucccggguucaagcgauucuccugccucaccuucccaaguagcuaggacuacaggcaugugcccacacccagcuaauuuuuuguauuuuuaguagagacaggguuucaccaaauuggccaggcuggucucgaacuccugaccuugugauccgcccaccucggccucccaaagugcugagauuacaggcgugagucaccgcgcccggcccaagcuccucaguuuuuaagaaugugaagcaauccuuuacaaaauguuugagaauaguuggaauaguacaucaugucugugaagccaagauuguaaguucuauuucucugaguuaguuagcuucacauaacagacgguuaaacauggaaaguggcaaggcaucccacagaauaggauacaguuuuuguaaaucaugucugauaagggauuuguaacuccaacauguaaaaauucauuaaugaaaaaacccagccaggugcgguggugcacgccuguagucccagcuauuugggaggcugaggcaggaggauugaucgaacccaggaguucaaguccaaccugagcaacauagcaaaacuauaccucuaaaaaguaauaauaauacguccaguuuuuauuuuauuuauuucuauuuuuucaagacauagucucgcucugucgcccaggcuggagugcagcggcacaaucuuggcucaguggaaccucugccccuccccgccggcucaagggauccucccaccuuagccuccugaguaggugggauuacaggugccugucaccaugccuggcuaauuuuuuguauuuuuaguagagacaagguuucaccauguuggccaggcuggucucaaacuccugauaaguccaguuuuuaaaugggcaaaauauuugaacagacauuucuccaaagaagauguacaaauggccaauaagaaaaugaaaagacgcucuacuuugauagccaucagagaaauguaaaucaaaaccacaaugagauaucacuucagacccacaaggauggcuguaauaaaaaagauaauaucaaauguugguaaggauauggagaaauuagaaccccuuauacuggaaauguaaaauaguacagccccuuuaaagucugguaguuuuucagaagguaaaacauaagaguuaccacauuacuuagccauuccauuucuagguauauauccaagaaaaaggaaaacacacaaaaugaacuccacaaagaaaucuuacacacuaauguucauaguaacauuauucauaauagccaaaacuggaaacaauccaaaguccaucggcugauacauaaacaaauguaggauaugcacauaauggaauauugucaaaaguaaaguacuuaguauaugcaaaaacaugaacuuugaaaacacgcuaacugaaagccaaaacaacgccagucaugguggcucacggugguaaucccaacacuuugagaggccgaggcagguggauugcuugagcccaggaguucaagaccagccuggacaauauggcaaaaccccaucucuauaaauuauaaaauuuagcugggcaugguggcacaugccuguaguccauuaucgggaggucuaggugggaggauugauugagcccaggagguugaggcugcagugggccaugauugugccacugcauucgagccugggugacagagugagauccugucucaaagaaaaaagaaaacuagaaacaaaaagaacacauauuguaugauuacauuaaauaugggcacaucccuagagacaaaauagauuaguaguugcccagggcuuagggauuggagggaaaugggagugacugcuaacagguacagauuucucuuuggggugauaaaauguuuuaaaugugugaugguucuguaaacuugaauauauucauaaauaaaaacuauugaguuauacacuucagaugggugaauuguauguaugugaaucaugucucaagccaguacuaaaaaagaaauuauaaaagcuuaaauacauaauaugcuuauucuacuuucaaaccuuuuuuuuuuuuuugagacagggucuggcccuguugcccaggcuggaaugcaguggugugaucuugguucacugcaaccaacaccuccugggcucaagccauccucccaccucauccucccaaguagcugggauuacagauaccugccaccacacccagcuaauuuuugcguuuuuuguagagaugggguuucgcaauguugccaggcuggucuccaacuccugagcucaagugauccaccugccucagccucccaaagugcugggauuauaggcgugagccacugugccuggccccccuaccuucuuucuuuuagccaguuguacaugguuguguuauucacagagaagauaaaauuaagucauugguaauauguaugucuugauaacuaguccaguuuuugcucuacuccuuugauuuggggucccugccuguuccccauuaacaucgccugaaaaaugauauuaggauuauagauuauuauuucagaagcaaaacuggauuuugauaguuuuugauaguaauaaguuuuugggaugcauaagcaugggacagcuguucuugcuacacuaagcaguuuguuacagaagggcauuggaaacuugcccuguuuucuuuucuuuucuuuucuuuuuuuuuuuuuuuuuuuuaguuugagacagagucuccaucuguugcccaggcuggacugcagugguaugaucuuggcucacugcaaccuccgccucccggguucaagcaauucuccggucucagccucccaaguagcugggauuacaggggccugccaccacgccccgcuaauuuuuguuuuguuguuguuguuguuguuguuuguuuguuuuguuuucaagacggagucuggcucugucgcccaggcugcagugcaauggcaugaucucggcucacugcaaccuuugccuccuggauucaagcaauucuccugccucagccucccacguagcugggauuacaggcguguaccaccaugcccagcuaauuuuuguauuuuuaguagagacaggguuuuaccauguuggccaggcuggucuugaacuccugaccucaggugauccaccugccucggccucccaaagugcugugauuacaggcguaagccaccaugccuggccaauuuuuguauuuuuaguagagaugggguuucaccauuuuggccagacuggucuugaacuccugaccucgagugaucugcccgucucggccuuccaaaguacugggagccacucugcccagccuguuuucuuaaaaugaccuguucuggcaacagauucagguaauaauacaacuucauuccuuauggaggcccagucucucuuuuggguacuacaaaacuguucaguuuuucuuugcccaguagcauuaugguaaccaggccagaaaacaaaaaugcuucacucucagcguuggcuacccaagugguucauagcuguuauguuaaaaggcuuuuuauugugagaauuaaaugugaccauaaccagcaggauaugcucuugagcauucugguuaacuuccauuguuaauuaaugcgguugauugagaauuacauguauagauuguguuacgaacauuugacuacugaggagcuaggccagaaaaaaacauuuagugaugcaacugauacuucugcuaauuccccagguaucuggauagcauuuuagggauucugugaaauuggaugggggaaaagacuuucacuaaucgcuaacugaaauugagcauucccuuuuauuauuaauguaggccagaauuuacagagguaauaguguuagcagcagcacucaucacucauguagugaauuggccccuaaagcuuguuauuugauguauuaaguauauauuacuauaaaaaaccucuggagcaaggagcggugguacacgccuguagucccagcuacgugggaggcugagacaggaggaucacuggagcccaggaucucuagaucagcaauguagagagagccugucucuuuaaaaaaaaaaaaaaaaaacacagcaacaguacacacacacaugcuuuuuccuuggaaaucccucagaauuuauguauuuaagaauauuauucugagaaaaggcucauagguuucacuagacugcagaaagauucuguggcaccaaaggagcaaccaacuagagagcauaguuuuuuuuuuuuuugagauggagucuccucugucacccagguuggagugcuguggcguaaucucggcucacugcaaccucugcuucccagguucaagcguuucucccaccucagccuccugagugugugagacuacaggcacauaccaccacgccugcuaauuuuuguauuuuuaguagagacggggugucacuguguuggucaggcuggucuugaacuccugaccugaagugauccaccugccuuggccucccaaaaugcugggauuacaggcgugagccacugcacccgaugagccaugguuuucaacuaggacugcuauacguuagaauuacuugaaaaguuuuuaaaaaauauugauaguauguacauuccuagagauucagguuuaguugauugagggcgaggcuuggacaucuuuuaaaaucuccuucccuuaggugauucuaaugcagagccaggauugagaaucacuaaagggcuggcucauuugauguauuaaggagacauguauacgucuuauugugauuaugcuugguuggauaucagauucuaugcucuucaguuggucucuuuuacagauuauaugguauaccuuaccugauuugguagguuaauuugagcaagugggucuugagcuccagaauaucuaugaacacuaaaguaauuuaaauagcucucuaaaugcaaaauugaccuuguaucaagaguaaaaacaauuauagcaguaaaccuuggcagugauucugcuugucuacaauccuuucccucuuucagagggcaaaaaucacaaaucuuaauaccaagagaaaaacgaccauauguuuuaguaacaaauuugagauuauaucagguuuauucuucagugauacugaaaggcuaaaagaaaucgacaacucauaccuuguaggauucuuugucuaucccauccccuggcauuuuuccaaagcaaauccaugauucagagugguuuuggguguuuguuaucacugauuaccuaaagcaguucaaguauagaugaacuguuuuuugguucccauaucaguuuuauuucuuaguuaaucguuaucauuuuauagucgguaucucaagacugaaauucuaguuuacguaaaauuucuuuuuuuuuuuugagacuaagucucacucuguugcccaggcuggaggcucacugcagccucugccuccuggucucaagcgauucucuugccucagccucccaaguaucugugacuacaggcacgcaccaccaugccuggcuaauuuuuguauuuuuaauagagaugggguuuuacuauguuggccaggcuggucucgaacuccugaccucgugaucugcccaccucgggcucccaaagugcugggauuacaggugugagccaccaagccuggccucuuucuuucuuuuuuuuuagagacagugucucacugucacccaggcuggagugcaguggcgcagccuuagcucacugcaaccuugaacuccugggcucaagagaucuuccugccucagugucccagguagcuaggacugcaggugccugccaccacgccuggcuaaguuguuuuuguuuuguuuugguagagacagagucucacuguguugcccaggcuggucuugaacuucuggccucaagcaguccgccugccuaguagcuagggcugcaggcacacaccaccaugccuggcuaauuuuuauauuuuuuguagagaccagugucucacuauguugcucagcugcucuugaacuucuggccucaagcgguccucaugccuuggccucucaaagugcugggauuacaggcaugagcuaccaugccuggccuaaaauuucuuuuaauuuuuuuuuuuuucaagaaguaaacccauugaaagaauucuuuauuuuguuauguaucccaagggccacuacaaugucugacacauacuaggcacugagugaauauuucucagacgaauaagaaaaauucaaacaaaccagaaggguauauggcagaguaaguguauguguuguuugcaugucucccugcucaccaucacuuuuuauuuuccauguggcuaccugccaugccuuuuuuuuuuuuuaagugacuacaaauuccauaauuuauuuaauugguccuuuuuuauauguauuuauuuaauuuuaacaaauagagacaggguuuuguucucuuacucgggguagagugcaguggugugauuauagcucaccgcauccuugaacuccuggggucaagcgaucuuuccaccuuagccucuugaguagcugggacuauaggcaugcaccaccacaucuggcuauacauaguuauuuaauuuauuuucagucuuauguaacuauagucuaguagcugacucauuauauaucuuuguguacaugugcaguaggguguuaauagaaguggaauucagaaucggacauuuauauuaaacguugaucaguuucuuuuuuucuuuuuuuuugagacggagucuugcucuauuacccaggcuggaguggagugcaguggugugaucuuggcuuacugcaaccucugcugccuggguucaagcaguucuccugucucagccucccgaguagcugggacuacaggugugcaccaccacucccagcuaauuuuuguauuuuuaguagagacggggguuucaccauauugguugggcuggucucgaacuccugaccucaggugauccacucgccucagccucccaaagugcugggauuacaggccugagccaucgccccuggccacauugaucaguuucuacuugcccuugcuaacaauaugagaauaucuuuuucugcuuacccucaccagugcaauuuaauuauaaaauguuggaucuuuguuuucugguuuauauuugcauuucuuuuuuuuguuuguuuuugagacggagucuugcucugucaugcaggcuggagugcaguggcgccaucucugcucacugcaagcucugccucccagguucacgcuauucucuugccucagccuccugaguagcugggacuacaggugcccaccaccacgcccagcuaauuuuuuguguuuuuuaguggagaugggguuucacccuguuagccaggaugguuucuguucuccugaccuagugagcugccugcuuuggccucccaaagugcugggauuauuacaggcaugagccaccgugcccggccaauauuugcauuucuuuugagucuuuaaaaaguuaauuauaaacuguucauaugcuuugcccuuuuuuuuauuuuuaaauuuuuauuaaaaaauguuuuuuugacacagagucuugcccugucacccaguuuggagugcaguggugcgaucauggcucaaccuccugggcucaggugauccugccaccucagcuucccaaguaggugggaccauaggugcaugccaccaugccccacuaauucuuuguauuuuuuguagagacgggguuucgccauauugcugagguuagucucagacuccugggcucaagcaauccuccugcccacccaccaaccccaaagugcugagauugcagguugagccucugcauccggcugcauuuucuuuuugaaccacuggugguuuauugauuguacuuuaauaaauuuaguauuuuugucauguguuggagguuuuuuuuacguuugucuuuuuuuauuuugguacuuuucucaugcgcaaauuuuaacuuaccauguaaguuuacucuuuaaaggcuuuuuuuuuuuuaaagacagggucuggcucugucacccaggcccgagugcaguggcggcaaucucaguucccugcaacuucucccucccgggcucaagcgaucccaccgcagcuucccaaguacgugagacuacagguguguggcacacaccuggcuaauuuuuguauuuggguagagacgggauucugccguguugcccaggcugguccagaagaacgccugagcucaaggaauccucccgucucggccucccaaaaggcuucugaagagcuuuuccaaugcagaaauacauuuaaccguauucugcucuaguucugucuuguguuuuguuuuuaacauuuaaaucuuugaucucucuuaaguuuauuugggcagaaagaguaaaguaggaauucaacuuuauuuugauaaaauugacuucacaguuauucuaacagaugauuauauaguuauucugaaaccauuuauugaaaaauucaccauucugauuugaacaugccaccuuuauuauuugcugauuuuccauuugcuguucuuucugagccuguaguuucauauaugggaagagccaauagucccuuauaaacuuuacagcuuuaguuccuugagcaagcuauucauaaaguucuuauauguuaggaaagcauccuaauuuuaauuuugaauuacaguagucaacaugucuuuuuuucuaaauaaguaaaugcuuaccaguggugcaagcuaauuuauuccaaagaaaagaguuuauuucuccuagguaauuaaaaaaaucugaacagauacuuuuuuuaaacuuuuccaaacugguguuuugacugaauuguuccaugaaauacuaauuccacuaaaaaaaagggggaguggugggggagaaaagugauaggggcagugcuucccucuuuaugcucggauauuaucaauauauauugccauuuauagaugucaggauguccuagaaaaaaggcaaaacaaaacuucauauaaauuaacuuuuuuuuuugagacguagucucugucacccaggcuggagugcaguggugcuaucucggcuaacuguaagcuccgccuccuggguucacgccauucuccugcuuuagccucccgaguagcugggacuacaggcgcccaccaccaugcccggcuaauuuuuuguguuuuuaguagagaugggguuucaccauguuagccaggauggucccaaucuccugaccuuguaaucugccugucucagccucccaaagugcuguguggcuuugucacccaggcuggagugcaguggcgcaaucucacucacaguaaccucugccuccuggauucaagcaauucuugugccucagccuuccagguagcagggauuacaggcacacaccaccacgcccagcuaauuuuucuguuuuuaguagagacuggguuucaacauguuagccuggcuggucuugaacuccuggccgcaaguaaucugccugccucggccucccaaagugcugggauuguagaugugagccaccacaccuggccuguauaaauuaacauuuaucuggcuuauuugaccaucccuuuuugugguacacaguaguauucugaacaacaauuugagaauuaauacuuuuauuuuugcuucaagugcuggcuacuauuuuaggcauuuuuuucaaaaauuaaauuucuauaauaaaaguaaaacuaccuuaccaaaggauuuggggaauauugaaagaaaaggggaaaaaaaaucagccucuaauucuacugcuuaucuuccaaggaugaccagucuaagcauuugaauauauuuuaaaaaucucuuuaauugcagauuucuuuuauaguuuucauuguauuguacauacaauugugaauuguguuuuuaaaauuucuuuacaucgaaauaagauuuccaugucauuucaugcauuuucuuuguggcgcaggaugaaugcuuuaacagcaguguuucucaaaguugguccaggaaccccaaggguuccuaaggacuuucagaggaucugugacuucaaccucucucauaauaaaucuaagacauuauuugcccuuuuucacuccuaaucucucacgggcauacaguggaauuuuucagcaucuguaugaucugauagggcagcagauugaauacagaagcagaugugaaaauucagcugccuuuuaaaaagucaaacauugaauggauuuauaaauacguaaaaagcgacauucuuauuacugaauuuuaaguuauuuuuuauaaagaaaaaacauguaaaaaguuuuauuuguaaaucaaucaauauuuaaauuuguuuuaauuucuaauaugguaaauauugauaaaacccacauaaaagcucuuugugguucuuaaauuuuaagagcguagagggguccugagaccauaaaguuugagagcugcuguuuuauaguauuuaauacaaaaguaaguuuauuugaauaaaaaauacuugaucacuugguuuuauuaucuuuaugcaaguuacuucugauuacaaauacaaucgucccucaguaucugugggggauuguugccaggacacccccuuagauaccagaguccaugugugcucgugucucuuauauaaaaauaauguauuugcauauagcuuacauauguccucccaaauacuuaacucauaucuagauuauaauaacgucauauaauacagaugccauguaaauaguuguuauacuguguuguuuaggaaauaaugauaaauaaaaaggcuguacguguuuagugcugucuuuuuuuuuucucucugaguauuuucaauccacccuugguugaguauaaggaugcggagcccacagauaaggaaggacgauuguacacaucgguucuaggaaacacacuucucuuuuauaagaggauauuuuuaugcuuuguaaugugacauugcaucugaggacuuuauuguucaugaauuaaguuaggcaugagauuuuuaaaacaguaacuuuaguucacuguuguuuuuuuuccccaggcagcugaguaugucccagagaaggugaagaaagcggaaaagaaauuagaagagaauccauaugaccuugaugcuuggagcauucucauucgagaggcacagguuuagugauauaggauuacauuuccuucucuauggguccaaucacacuacuugguucugcagugaauaauauuuucauaauccuaacauuguaaaugcuguuuauugguuuucaauuuuagaaucaaccuauagacaaagcacggaagacuuaugaacgccuuguugcccaguuccccaguucuggcagauucuggaaacuguacauugaagcagagguuacuauuuuauuuuauuuuuucuuauaucaguauugcagcauucacuguagugauagaaaacaaguuaggaacauagccaauuaggacaaggaggauuuaaaugugucuuaccuuuauuuuguaaaauagguauaaaggaguaauuaaaaugaauuuuugaaauuugggucuuuuacaagcugaugauuguugcauuuuggaguugcaacaacauuaaaacaguuucaauggua

SEQ ID NO: 191213 - RNA, 77221 nt, Homo sapiens
gaaaagugcgcccuacgaaaggacggucgacuucggcggggcccaggugagaaaggcccaccuguguccugguugagggucuccaggguucuuuggggcccgagguagguaauaucacguaacguucuucuccuuuugagugccuucauucacauugaguuaaagaaaagguuggugaaacaauaaacccuuagggcuuaucaagcaauugcuagcaccuuucuccgcugugugugaggauagacuuuuuuccugcucauuuaucuucugauuucugauagaaaauucacuccgccuuccccacgaugucuuuuucuuaauuuuguguuauauggaaaggaugggaucucuuaccuuaaugaguugguugcugagcgucugggcuuaguucguuagugccuagugguaggugguuuggaauuaaaccuuagagcgaaaacucuugaacuuugaggcuaucugguuuuccugugucugacaaacuauagcucucugacaaguuccgauaagaagcuuuuguuaauuuuaauuaguguuucuggaagucuuggaugucuuuccuaagcgguguaaaugacaaguguuacucugacaaccuuguucacacauuuaauugucguuugcuguuaaagcagcugcaaauaacagaaaauacuuaggguuucuuucccccaaaaaacugcuaggaagaauuagaaguauaccuacuuuauuuuaugaacccugaaucgagaguuuauuacuaaaauaccaauuuuauguguggaaaaaacauguauuuugaguuguauuuuuguauuuaauuuuuuuuucaaaacugagcagggacaguggguaacugauguuuaaaggcaaucaugauugacaaaugucuaaauugaaaaggacucccaaaucauuaccgcacuacugaguuauugacuuugacagugaucugugauaccuuuuaauuagagccaaaccucauugaaauucuugccaucgaauuguuuuaaaucucacugaccuguugaaauuuuugggcugauucuguuugauaaauugaaauuaguauugcuaaauagugacuggaguuuuucauuuggggaggauuuuuguuuguuugcuuguuuuuuagaaucauguuuaggaaaaaacccuguuucacaauauaucaacuggaaagcuuugaucaagguugcuuucauauugaaucuuuaaguuacucaauaaauagcuguugagugauuacugucuguuuggacuuaaucuugucauuuuagaccuaugguaauaaaaauggucucaccuggaggagauaaaauuaacacauagaaaacaacauaguacuuaaaaugaacacauuaaauagcaugugcuaauuuuauccuguaguaaauaagcacuaggaagaccaaaagaaaaagugacaaagcaguccaauaucagauagaaacgucuugaauuuuuuuuuucuucaacuuuuguuuuagguucugggcuucaugugcagguuuguuacauagguaaacgugugcuguggugguuugcugcacagaucaacccaccaccucgguauuaagcccagcauccauuagcuauucuuccugaugcucucuguccccccaccccuacaaauauuuuugaugcugugaacuuuuugaaaugcuacauauaauuauuauuuuuugacagauggcauuguuuuguguaccucaugaugcuaugaaguguauguacauuccggaaucguuaaaucuagcuaauuagcaaugcauuaccucacauaguuaucauuuuugugguaagaguacauaacaucuacacuguuuacauuuuuuuaaagaauacaauauaugauuauuaacuauagucagcuugcuauaaauucauguuauauaauagauuucuugaaauuuauuccuccuaucuaacugauauuauguaucuuugaccaaauucuccccauccccccugccaaccauccuggccucugguaaacaccauuguacucucugugcgaugaacuauuagauuccaccuaugaguaagaucaugugauauuugucuuucugugucugacuuauuucacuuaacauaaugguauaauucguuuuuauaggcuucuguauuacauauucccuuguuuccuacuguauuuacuuaacccuuuagauuucccaagaugaugauaguggugcuuuguuugccucauuacuagaacugaagaauuauuuuccaacuuugacuuggacuauaauucuggaaagaugaucuauauacacaccagaguauucaugaaauuaggauauauaucugguauaacacuaucguaggauaaauaugcuuuuguuuuuuuuuucugagacggagucuagguguguuccccgggcuggagugcaguggcgcgaucucggcucacugcaagcugugccuuccuggguucacaccauucuccugccucagccucccgaguagcugggacuacaggcgcccgucaccacgcccugcugauuuuuuguauuuuuaguagagaugggguuucaccguguuagccaggauggucucagucuccugaccucgugauccgcccaccucggccucccaaagugcuggaauuacaggugugagccagcgcgucagccaaauauggguuuuuuguuuguuuguuuuuuguuuucuuuuuagacggagucucgcucuguugccaggcuggagugcaguggcaugaucucggcuuacugcaaccuccgccuccuggguucaaaugauccuccugccucagccuccugaguaguugggacuacaggcaugcaccaccaugcccagcuaauuuauguauuuugaguagagacaggcuuucaccauguuggccaggauggucucaaucucuugaccuugugauccacccgccucggcuucccaaaguguugagauuacaggugugagccaccgcgcccagccgccuuuuuuuuuuuuuuuuuuaacaaagauaaaaucuuugcucccaaauaauuucaaauucuugaacuuaccagcaaguagcagaguugaauauaaaacacgagaauaaauaaaguauucauggaaaggaagaguuaaaaguuauauguuggcugggcacagugacucaugcguguaauuccagcacuaugggaggacgaggcgugcagaucacaaggucagaagaucgagaccuuccuggcuaacauggugaaaccccgucucuacuaaaaaauacaaaaaaauuagcugggcaugguggcgggcuucuguggucccagcugcucaggaggcugaggcaggagaauggggugaacccgggaggcagagcuugcagugagccgagauugcgccacugcacuccaggccugggcgacacagcgagacugugucucaaaaaaaaaaaaaaaaaaaguuauauguuuaggugcguucuuaauuaauucuuuaugaaggacauacuaaauucuaggaagugcaccagagcucagguuacaggagaaaaaaauacugugucaguacucuuugaguucacaguuggggaagauacgugggcaaauaggucaauaaaguacaguugauccuugaacagugugcggaucaggggugucgacccccacacccguguaguugaaaacacgcauauaacuuuugaccccucccaaacuuaacugcuaauagucuacuuuugacuacuggaugcuguaccaaugacaucuguggauuaacacauaauuuguauauguauuauguacugcauucuuuccauaaaguaagcuagagaaaauguuaaucaaaucauaggaagaaaauauauuugccaugcauuaagugcagguggaucauuauacaggucuucguucugacauuuuucauguugaguagucugagcagaaggaggaagaggagggguuggucuuguagucucaagggugccagagacagagaaggugggaggggaggaaggagagguagacgcagucaauauagcuuuauggaaauacauacuaauuugucuguuuugcuuuuucagcucucuaaaaauguuuuuguacaguaccauuucuuccacuguuugcuuuaguuuuaguaucuguguuauaauagggguccaugucagaagaagucacagcagucuugaauaacuggaagacuucugccagauugccuaaugucaguuuguuuucuggcacugcuucuucuacuucuuucucaucaucuggcacuuguuuggaagcauucaucuccaucaagucaucuucuguuaaugccucugguguggugucuguuaacucuugaauuucuccaaggugccuaucuuaaacaacuauucccucccgacguuuuuuauuuuuuauuuuuuccauguccacaauguuucccauaacuuccuugauugacuguuguaaauccugcaggaaaccacuuugagauacaccagaaaacauauaaugaacaugguaggcaaccagcaccuucugauacaaguggacaccucuucaguuguuuuuucaguggcuucacuagcccuggaguccauaucacuguugugucugugcagguaaagcauauagcagagauacugugaagguucacuacggggccugcugguauucuggcagcaugauugaaggaaugaauacuaaggucaugucuacacagagggaguuccucaaccuccgguaauuccuuuuuugccuccuuccugucauuauacucacaaagagaaacuauaguccugaguuguagcaccacagauuucuuuuaccuguuuuucuacuucucuacuuuuauuauacucucuacuucugugagaucaacuauuagauuccauuagauccacuauuagauuccauguuugacuucuuuugcuuaacauuauuuuugugaaaugauccuuguuaaugugugucguuguggcugaucuauucuuauugcuguauaguauuauauaaauguauuauaauuuauuauguguucuacuguuagaagggauuuggauaguuucccauuuguggccauuucuucaaugcaauuguaccaguuuauacucuuaccaguaguauuugggaaugguuguuacuucucauccuuaucaacacaauguuuuucuucuuucauuucagcuauucucagaggguugugguauggcauugucauuuggauuugaacugacgaaguugagcacccguuuauaugcuuauuggccauuuggguaaccucuuuugugaaagggucuauccauguuuuuuaauuuuacaaauuuggauugucugccucugucccauggauuuguaggaguucuuuuauauuuuggauaagaguucguuuccaaauaaauucauuacaaauaucuucuaucauucuguagcuugccuuuucauuuucuuaucuuuugauuucagucaaaacauauucugacuuaacaauuuuuucuuaguggcuggugcuuuauggcuauguuugccuacuccaaaauuucgaagaugaucuccauguuuuuuuuccuaaaaccauugauguuuuacuuuuaaauauuuaugucuguacuuuauuggaauugacuuuuuuguguuuggugugaggcagcgguaaagauguguuuauuuuuccuguauugguauccuauugaccuagcaccauuuauugaaaaaaugauucuuuccuugcuauaucgcaucaucacuuuuuuaauaaauaaagucacacauaaauuaggcagauuucuuucuggacuuuccauugguuagugugugucuucagguucuucagaaggcuggcuuucuuucucucagaauuugagccacacuguacuguggggaccucaaguuaaaucaguaaaaaugggaaacucacccuguggcaauuccuucucaccuaaguugacuacccagcaaaaucuguuugcuucuauuaaaucuguagagccuucacauaauugauuuuuguguauuguucagaguuuauaguuguugucuaugguaggauuggucugucauaagcuuacuuugccauacuggaaugagcucuuccuauccuuuugugacuguagugauuucuucuuuuauuuauugcugauaaauaaauaucagcaauugagaaugaguuucuuuuccuuuuuuucuucauuguuaauuuugcuagggauuuuucacguaaucuuuaaaaauacucaaauuuggcuuuauugguuuuucucagucuuuacuuucuacuuucuguuuaaucgauuacuauuuauuuaucauuuauuuccuucuacauuccuucauuuugauuugcuaaggcuuuguuuguuccgccuucuuauacuaaaagcuuaauuauugauuuucugccuuuucuaauauaccguauguaguuaagagcgugcacuagcugcuccuauaacuuauggcauuuuauguuuucaucauuuauuucaaaauauuuacuacuuuuuguuuugauuuucucuuugaucuguagauuauuuaggacacuuuugaaaguacugaaauacugaauuauauuggaugcuaggaaagcaggaguaagcugggacugaccagggcaaaugaguacuuauauucauuauaauuuuaguggauuuuaaaguauaaauggaaaacugggguauuuaaauuaaaacuuaaaaagccauuguauagucauguguuagaaugugcaguguaauaggguaaauguguccaaggguuuuaguucaaggagauuugucaaguaaaucugucuacaagaaaaaauaaaggcaaacaaaguguuuuuaauggucaacacaaaaacauuaaaauuuuuagcaaaaaaagaaaagaaauuucagagacuggcccaacauuuguaugucauucagucugggacuuuucuccauauuugcauguagccaacaugaggaauuaaauaacggcugacugguguuccuuucacgugucaaccagagucucauagacauaaagcuacuguguuaaagcaugugugauguucuaauuaucguggacauuucugcugagaugugaucaauuucccuucgguuugaauaauuauggaagccugggaguaggccaaauauuuaaaacuauuucauaugaaaaaaucacaucuacugauuuugcccgaagggucccacaggcuccugaagcuccucucuaaagaaauaaauaaauccuggaccaauggguaguguuagagugaaauuuauuauuuugacuacuguuucuuaguuuaagagucuggauaugaaguauguuuugaugaauuucuugcaggauaaaaugaaaguuggauauccuagcaaacauuauuuucauuaacucagaaccaaauuggauccauuuauuacauaauuuaaaaaauuacuaauggcucuuguucuauauaauuauucuaccucuuuuugaauucuguuuucguaggaaacuuuauuauuacuuucaaaugugauagcauucauuacauucucaaccuugaauuauaaucucuuccacaucuauguucaaauuuaguuucucauuuguaguacuauaucuuugaauuuucucucaguucggauuuuuucucucugacuuugaaggacuuuaaaaauaucuauuucggugauauuuucauacaacaaggucuuugauguaugcauuaauuauuuucauuucuuuuucuuuuucuuuuuuuuuugagacagucuuacucuguugcccaggcuggagugcaguggcaugaucuuggcucacuguaaccuccaccucccagguucaaguaauucucaugcuucagccuuccaaguagcugggguuacaagcauguguuaccaugcccagcuauuuauuuauuuauuuauuuauuuauuuauuuauuuauuuguagagaugggguuucacuguuuuggccaggcugggcucaaacuccuggccucaagugauccaccugccucggccucccaaagugcugggauuacaggcaugagccaccaugcucggccauuauuuucauuucuaaaaccccuaauuucugucuuuuucuaaauguauuucuucuuccugcuucugagugucuuauucuauucuguguugcuguaacagaauaccugagacuggguaauguauaaugaacagaaauauauuggcucacaauucaggaaacugggaaguccaagauugaggggcugguauccagcgaggguguccuugcuguguuaucacauaguggaguggcccaagagagagcaagagagaacaagagucaacucucagccucaaucucauuuauaauuuucauuaauccauucaugaggguggagcccucagaccuaaacaccucccauuuagccucaccucucaacacuauugcacugggaauuaaauuuucaacacaugcuuuuugggggacacauucagacuguagcacuuagguauguuuuuucaguguagcaauuguuaaagcaguaauuaaaaugcaguuacaauaaucuauuguaauacccagaugaacccuguccaguagaaccuccuauguugauggaaauguucuguaucugcacuguccaguacaauagucauuaaacacguaugguuauagaguacuuaaaaugugacugauaugacagaggaacugaauuuuaaucuuauuuaauuuuaguuauuuuaaguuauuuauuuaaacagcugcauguggcuaguuuguacuauauuaaaucacacagcuuuagaucaagcuuuggcaaccuuuuucuauaaaagaccaaauaguaaauauuuuaggccuuguaguccauauggucucuguuacaacuuuucaacucgcugugagagcacaaaagcagucacagauaacauguauaugaaugagcaugacuuugucccaguaaaacuuuauuggcuaaaacagagucugcugaauuugacucaugggcccuaguuuggcaaccucugcucuagguugaaaaaaaaaagugucuacagcuuuauguauuuuuauuucauuugcccuguguuccgaguccuuucaacacccucucuuuggggaguguguguguguguguuugugugugugugugugugcauauguggaacagauuuuuggaggggagagaggagugucuuuuccugaaaguuuaggaagauuaacuccuuuggauuguuccucuucaacuuuuucuccaccuuuucuauuuuuucugaaugggagaaggugguggcagacaggcauauauuuuauguuuaaacucuguucuuuuaauucuauaucucuuguuuuacagagacauagaauuuuuuuuccucccugaauuaccucugauuucuccaggguugcuuauucagacuaauuauuuucauuauggaccuucuuucucaugcucguguuuuccuuaaauguuggcucuuuauucauguugauaagugaaggaccaguggaauaauauaguaacuggaguggguuuucucuuucuuuguuuucccaucaaaucuuuagccuaaauggaaaaaaaaagacugaccaauuuucuuguggguugguaggacuuaauuuauugguguacuuugcuuuaaugugcauaaucaaggagcaaguacacagaccagucguucucuaauagccagaugaggaggccccuaaccuagcucuccaaccuccauacuuggagaccaaauucuucucaggcagauuacacuuuauuuauuuauuuauuuauuuauuuauuuauuuauuuauuuaagaaguuagccuccagaacugcugauuuuagcucagaaccccuuuggagucacaggaagaagcgucucaucuuccugaagcauucucauguuugugcuuggcuaggggugggcauacauuuucugggaccagaugguaaauauuuuagguuuugcggguaauaugaccucuuaacucuuccaugggaaaguagccagaaauaacauuaacaaaugaguauggcuguguuuuaauaacacuuuguggacacugaaauuugaauuucauguaguuuucacauguuauaaaaaauaugcugcugcuuuagucuuucagcccuuuaaaaaaugcaaaagcaugugaugggcugggagauuuacccugugaacuauaauuugcuaaccauaucuggacugucauucgcuccauccaaaccuaucacuaugauuuuauaugccuggucuuccagaaauucuucaaaaucucuagugugccuuucacuccuuuucucagcauuuauuucuauuuauuuuuuaaaacguacugucguuucaguguaguguuuuuuguuuuguuuuguuuuguuuuguuuuuugauacggagucucacucugucgcccaggcuggagugcaaugacgugaucucagcucacugcaagcuccgcgucccggguucacgccauuuuccugccucagccucuugaguagcugggacuacaggugcccgccaccacgcccagcuaauuuuuuuguauuuuuaguagagaccggguuucaccauuuuagccaggauggucuugaucuccugaccucgugauccgugcaccuuggccuuccaaagugcugggauuacaguguaagccaccucgcccggcccuccguguaguuuuugaagagaguagcaguaaauuuaucugcaguuuugaaccagaaucccauuuaggcaugauauuugaaucaaaagacacaugguaaaacugaaauguaaaguaucuucuuuaguaucuucuucaguaucuccacuccucucuccauggauguauuggugauuaauuauauuaaguaauguuuuuguugaaugccuauuguagucccuguaauguugugaaugcuuuauauauuauuuaauccucacacauuuuauagaugaguguguucagaaguuaauggagucacauaaaggauaaguaacuuguucuaucuaggucagaaagcucguaaguggaagaucuaggauucacaauagagcuagccugucugacuacagaauucauacucuuauccacuauuuuccacuucaguccaaauacaggcuuaguuuccuccucaggguagcuuuuuauguagccaguuuauggauauuagcauaaaacaugaagcauauuugcucugcuaaaauagguauauauucagagugauuaauauggugagaaaaagugaugggaaagcaauugagguaguaacuggaauauagguagcugggaggugaaagauuuugaguuucauaagacuuguuuuaauccugucaaaaaaaaauuagaccucuuuguuucuccagggcauagaaauuucaguuucaacccagauuaaagaacuuuauaacaguguuguccaguggugaaacagaauccuuuguaauuuaaaaauauuuccuucuuaaaaccuuuagaauuuuaauuuuauaguucugcuuauuauauuuuuuauuucccaaagugaaagguucaaagaauaacauuaaaggucauuugguauuacaauuuuuccauuagucaaaauuaaagauuugaaaauaauuuuauaguccauuugguauucuaagguuggauuuuuuaagaauauaaagcaaauuauguuuuuucuauuaacauuuccuaaaucaacucacaugaaaauuaauagauuaucaucauacaugacgaucguuuuucucucacugagcauuggaauauguucacuuuacuacuuaucaguagcccaguuuugauuuucuaacugaaguauuugugucugcccucugaacuggcucaagguuuugagcccuuuaaaaaaauuuguguaugugugauaaaaauauacguaacauaaaauucacuacuuucaucauuuuuaaguauaagugaagucacauuaagaguacuuacaauguuguguaaucauugccacuauuucuaaaacuuuuucaucauucaagaagaaauauuguaccccgccgggugcaguggcucacgccuguaaucccaacacuuuggcaggcggaucacgaggucaagagaucgagaccauacuggcuaacaugcugaaaccccgucucuacuaaaaauagaaaaauuagcugggcgugguagcgcgugccucuagucccagcuacuugggaggcugaggcaggagaauugcuugaacccaggaggcggagguugcggugagcggagaucgcaccacugcacuccagucuggcgacagagcgagacucccaucucaaaaaaaaaaaaaaaaaaagaaaagaaauauuguacccaagaagcaguaacuuguuauucucucuuguuucaaccacuaauaaccuguauucuacucucagugaauuugccaacuuauuauaagcaccucauauaaguggaaucauacuauauucuuguuaauauuugcauaauauuuuucacuuagcauaauguuuuucaaaguucauguauuuuguaucauauauuaaaacuucauuuuuuuauggcugaauaaucuauugcagaugcucuuugacuuaugauggaguuauguccugauaaacccaauuuaaguugaaaauaccauaaguugaaaauguauuuaauacccugauaaacccauuauaagguugaaaaucauaagugaaaccauugcuaagucagggaccaucuguguguguauauauauauaauauguaauacauauauguaacaugugcaaucuuauauaagauuauaguauaugauauaagauuaucauauauaauagaugauauauaugauauacguaauagaugauauaucauuguauauaauauauaagauuguauuauauaugauauaagaucauauauaucagauauauauaagauuauauaauauacucuuagauauauaaaauuauagauuauauaauguauaauauauguuauauauaggauuaucuauuauaauauaugauuauccuauaucagauuacauauguaaauuauaacauauuaacaucauuuagcauuaggauguacccuaaaauuuaaaguauaauaauaauaaaauuuuaaaaaguuauaacauauauauaagauaacauauuuauaauauacacacacacacacacacacauauaucacaguuuguuuauccauucaucuguugauagacucuuggguuguuucuaccuuuggcuauuguaaauagugcuacagugaacauuggcauagaaguaucuguuugaaucucuguuuucauuuccuuuggguauauaccauacaauggaauugcuggauuauaugaaaauucuaugauuaacuuuuuaagguaucaccaaacuguuuuccacauuggcuguaccauuuugcauucccaccaggagugcggaaggguuacaauuucaccacauccuuagcaacauuuguuauuuucuguuuuuuugauaauagucauccuaaugcauaugaugugauaucuuauugugguuuugauaugcauuucccuaaugacuagggauguuuaacaucuuuucaugugcuuauuggccauuuguauaccuugucuggagagaugucuuuugaaaaccuuugccgguuuugaauugaguaauggcuuuguuuuuuuuuuuuuugcggguuuuugaguuauaggaguucuuuauauauucuggaccgugacccuuaauuagauguaugauaugcaaauacuuucuccuugugauaguauuuuuuguugcucaaaaguuuuuaauuugagaaagucuaguuuauauauuuuuauuucuuuugugaccuuuguuuuuguugccauauucaaugaaucauggccaaucaagaguuguguaguuuuagcucuuccauuuagguuuuugaucuauuuugaguuaauuuuauaugguguaagacaaaaguccaacuucauucuuuuuuauguugauaucuaguuuucucaauaccauguguugaaaagacugccuuuuccccauugaauggucuuggcacccuugucaaaaaucauuugaccauuuaugucaaugcuauuucugugcucuuuauucuauuccauuggucuauagaucugucauuaugccaguaccacguuuuugcuuacuauaacuuuguacuaaauuuugacucagggcuuaaaauaauaauaucaacauuugaaaucagcguguaaguccuuucgccaugaguguaaguuucccgaggccuucccagcccugcagaacugugagucaacuaaaccucuuuucuuuauaaauuauccagucucaggcaguucuuugugcaugccugaggcuagcaugagaauggacuaauacaguaaauugguacugagggagaggggcacugcuauaaggauaccugaaaauguggaauugacuuuggaacaggguaacaggcagagguuggaacaguuuggagggcucagaagaagacaggaaaauguaggaaaguuuggaacuuccuagagacuuggaaggcucagaagacacgaagaugugggaaaguuuggaacuucuuggagacuuguugaauggcuuugaccaaaaugcugauagugauauggacaaugaaguccaggcugagguggucucagauggagaugagcaacuuacuaggaacuggagcaaagguaacucugcuaugcuuuagcaaagagacugguggcauuuugccacugcccuggagauccguggaacuuugaacuugaaagaaaugauuuaggguaucugguggaagaaauuucuaagcagugaaguauucaagaggaaacagagcauaaaaguuuggaaaauuugggcuggucgcgguggcucacgccuguaaucccagcacuuugggaggccaaggugggcggaucacgaggucaggagauugagaccauccuggcuaacacagugaaaccuguuucuacuaaaaauacaaaaaauuagcugggcgugguggcgggcaccuguagucccagcuacuugggaggcuuaggcaggagaauggcguaaguaaauccgggagguggagcuugcagugagccuagaucacaccacugcucuccagccugggugacagagugagacuacuuuucaaaaaaaaaaaaguuuggaaaauuugcagccugacuaugugauauaaaagaaaaacccauuuucuggggagaaauucaagacagcuacagaaauuugcaugaguaacaaggagcccaguguuaaucaccaagacaauggggaaaaugccucuaggacaugucacggcagcccuuucaucacaggccucuagaagggaaaaaugguuuccugggcagggcccaggguugccccuguucugugcaguccuggggcaugguguccugcaucccagcugugucagcuccagccauggcuuaaagggucaaaaguacggcuugggccauugcuucagagggugcaagccccaagccuuggugacuuccaugugguguugggccugugggugcacguaagucaguaauugaggugugggaaccuccuccuagauuucagaggauauauggaaaugccuggaugaccaggcagaagucugcugcagggguggagcacuuguggagaaccucugcuagagcaaugaggaagggaaauguggaguugaagcccccacacagaguccccacuggggcauggccugguggagcugugagaagagggccaugguccuccagaccccggaaugguagauccacugacagcuugcaccgugcaccuggaaaagcugcagacacucaaagccagcccaugaaagcagccaggaggggagcuguacccugcaaagccguagaggcggaguugcccaaggccaugggugcccaccucuugcaucagugugaccuggauaugagacauggagucaaaggagaucauuuuggaacauuaagguuugaagacuucucuauuggauuuuggacuuguauggggcccacagccccuuuguuuuggccaauuucuaccauuuggaauggguguaguuacccaacgcuuguacccuuguuguaucuaggaaguaacuaacuuacuuuugauuuuguaggcucauagguggaaaggauuugccuugucucagaugagacuuuggacuuggacuuuuggguuaauucuggaaugagcuaagauuuuagggaacuguuggaaaggcaugauuguguuuugaaaugugaggacaugaaauuugggcggggcugggguggaaugauaugguuugauuacgcccccacccaaaugucaucuugaauuacaguuuccauaauccccacauacugugcaagggaacugguaggagguaacugaaucauggcggggguggguuacccccauacuguucuagugauagugagugaguucuccugagaucugaugguuucauaaggggcuuuccccucuuugcuuggcacuucuccuucccgccaccaugugaagaaggauguguuugcuucuccuuccaccaugauuguaaguuuccugaggccuccccagcccugcaaaacugugagucaaauaaaccucuguucuuuauaaauuacccagucuugggcaguucuuuauagcagcaugaaaauggaguaauacaguuguuuuggcuuuucagggucccuuaacauuuuuuguagaaaaacuacaggcaugcaucaucuuauuugugcuucccuguaucgagcuuugaagaacugcauuuuuuacaacuugaagauuugugacaacccugcaauuagcaagucuauuggugccauuuuuccaacaguacaugcucacuuugugucccugugucacauuuugguaauucuugcaauauuucaaaccuucuuaucauuauuauaucugugaugguuaucugugaucaggaucuuugguguugcuauuguaauuguuuugaggcaccagaaaccgugcccauguaagaauguuaacuuaaucaguaaauguaugugugcuaacuguucuaucaaccagcuguccccccagcucuccuucgcuggccucccuauucacucccuauucacuucauugugucacugagacauaacaauauugaaauuaggaaaauuaaccauacaguggucuuuaaaguggucuuuaaguguucaagugaaagaaagcauggcauauuugucacuuuaaaucaaaagcuagaaaugauuaagcuuaccaaggaaggcuuguugaaagcugagacaggccaagagguaggccucuugccaaacaguuaagcugugaaugcaaugggaaaaguucauaaacucaugaauguuaagaaagagaaaugaccuuauuacucauauggagaaaguuuuaguugucuggauagaucaaaccagccacaauguuccuucaagucaaagucuaauccagaguaagauccuguuuuuuucaauucuaugaaggcugagagaggugaggaagcugcagaagaacauuugaaagauagcagagguuguauuaaugagguuuaaggagagaagccauaacauaaaaguguauggcaagcugcagcaaguuaccucuaucuagcaaagauaguugauauagguggguacaugaagugacaaauuuucaauguagauuaaacagccuucuguuggaagaagaugcuaucuaggacuuuucauagcuggagagaagucaaugccuggcuuugaugcuucucaggacaggcucacucuccuaaggggauaauggcaacuggugucuuuaaguugaagccagugcucauuuaccauuaugaaaaucccaaggcccuuaggaauuauacuaaagcuacucugccuguucuuuauagacagaacaacaaagccugggugacagcacauguguuuauagcaugguuuacugaauauuuuaaaaugugugggucucccauguaugucuagaggaucucugccaucauaagagaauucuucaaagaucuuuccuggauaaucucaucucuguuucuagcuucugcugaaaagguugauuuggacccauuagucacauaccuaaucucuucagaaaagguuuuucagccacauccuuggcccuucuccagagcauguuuuagcaucuuuuacaauuuagauagguuaagaaaucuccaaaucauagguuuuucuuugcuuaacaauuucuuccucaauuuaucucuucucucacauuuuacuguaagcagcccggagaaaacagucuacgccuuuaacacuuugcuuggaaaucuccucagcuacauauucaaguuaauugcuuaccaaguucuacguuuugccacauaguagaacccauuucagccaaguuuucugccacuuuacaacaaggacugcuauuucuuuacuuuccaauaccauguucuucauuuccuucuugagaguucaucagaaaccuuuuuaauguuccuauuucugucaacauucuguucaugauaauguauguauucuuuaaggugauagcuuucuuuaccucuucucuuccuucugagccauuagcagaguucucuuaagauuucuuuuucuaccaaaaauuucuucaaggcaaccuaggcuuuuucuguuuuucuauuuuuagguaucacagcaacacuccaguuuuugguaugaaaaucuauguuaguucucuaaaauuaccauaacaaaugaacaaaaacuuggugacuuaacacacagagaucaauuuucuaacaauuuuggaggucaaaaauacgaagucaaguugucagcuauguuuauuaugaaaacucuaggggggcauccuucuuugcuucugcagcuuauggugucauguuauuccuugcccugagacaguguaacuccaggcugacuucauuuucacauuguucuuuucucugugucuuccuguguccuuuucugucucuaaugaggacguucccguuggauuuaggacccuuuguaaucuacuaugaucucacauugguccuuaccuuaauuacaucugcaaagacccuuuuuccaaauaaggucauguucugagguuccagaugaacaugaauuuggguaggggaggcaggaagggggaccauuucucaacucacuauagucucuuuuuagguaauuauauuauaaaugguguuguauaaucuauauacaaauuuuaaaaaauuucaaggcuugugaauaauuauuaugacauuauguuacaacguacuaauaccuuuaauguuuauauuagagagugcugaacaggaaaaucacuuuucuucucagacuuuauaauauauauagaaguaggggguuauuuaaugaacugcuuuuuuuuuuuuuuuagauggagucucgcuuugucaccaggcuggagugcaaugaugcuaucucagcucacugcaaccucugccuccuggguucaagugauucuccuaccucagcuucucgaguagcugggauuacaggcgcgcgccacgaugcccggcuaauuuuuguauucuuagcagaggcgcguuuucaccauguuggccgggauggucucgaucucuugaccucgugauccacccaccuuggccucccaaagugcugggauuacaggcaugaaccuuugcuuuuuaauguggauagugcacauuacauacacacacauaugugaauaaauagcgcuaaaguucuguugauuuagagaaguugguuacucaauauuuacucacaucaauguaguaagauccuaaauuaccucuuuauuagaauagugguugucucuaguuuuuuggaaugauuagagauuagaugugagauuagauuuccucgaaauuuuugcguguuucaagaucgaauuuaaaaacauuuagcaaguucuuaaauaacucaggagaauuuuuuaugaauaacaaauacaauuuaaguauauuuagaugugucuuccaauuaugugagauuguuaagauuuuugagaucaaacauggugcuuguaaguggaugaaacgauauauuuaaacagacuauuguuacaggagaaaacucauuuuuaaagguaccagguuaaaagaaaaaaaaagugguagugucauaaagagagaagauugaauuaaaaauuugaauugauacagaaaugcauuacaaaagaggaggaagagagauuggcagaaaugaagaauuaucagaaaagugaaauguguaaaagcaaaggcaagagauaagauaagaagacuaaggagagcaaaagaugauaaguaaugcaacuaaugguuuacugcuaaaggguagaagauuaauauaucagaguuucucucagcuucagucaaauugaugguaauuauuagagugaaaccguauucuuuauaucauucgccaaaguuaaacugcuugugucauuuugucagaaaauaggaaucauuuuacguauuaaauuucaaguaaauguuauguauuaauaacauugauaugugauauuguauauuauauagauauaugcaauuaugcauauuuaaaagugaauaugcauauauuguuuuaaaggcaaaaguuuguuuuuuguggcagacacugaaaagucacacgcaaacucacacaaagcaaacuuuaacauuucaaauaaaaauaaaacuuuuuggccgggugcggugacucaugccuguaaucccagcacuuugggaggcugaggcaggcggaucacaaggucaggaaaucaagagcauccuggcuaacacggugaaaccccgucucuacuaaaaauacaaaaaaauuagcugggcaugguggcggguaccuguagucccagcuacucgggaggcugaggcgggagaauggcgugaacccgggagguggagcuugcagugagccgagauugcaccacugcacuccagccugggcaacagagcgagacuccgccucaaaaauuaauaaauaaauaaauauauauaaaaaauaaaaaauaaaacuuauuuucuuaaucauaagaacugagauagaauuauuauaauugacuaugaggcagguuuugacauucaagucagugucaaacguauugcuuugccuuugucauauuauaacuggucacaagguuuuuuuuacaguaucacacacauuccuuauauucaguacauaucuaauuuagucuuauaucacuaguauuguauucugcuuuucuaccgcuuuuuuauucuuaaaauuaaccucagguauucaugcugaccugcagaaguuaauguuuguauccuuucuaugucucagucuagaacaguuuaaugaacuguugaugguugcccugucaacucauuuaacucuuggaacauaguucuuucuagguugaucucauauaaucuauuagcuauuacuuucuucucugaccugaauucucugauggauaaaggacuuuaauauugucuguuuuuuuaagucauuuuuuccaaagcgucauaaaauuccugaauucaagaucucauggacccauuaagaggaagacgcaccguuacaacugucauucagucauaguauagacuacuaauucaacucaauaugguugaaaauagccuucaacuaauguaauuuugauuuccugcuuuaggauuccugaaauuguggaucacccaccuaugcuuuaagacaugcuuuauuuuuuuuuuuucuggaagcccugcaacuucccuaaaaauugaaugaauuguagaacagaccuaugguaagugggcuuuuuccuccuuuuucuucugucgguuucauguucaacuuaacucuuaugacuguuguaaugcugcucccugcuggacacaauguaauuuuguaaaguuggcacuuaauagaugggcaaauaacugguuaguuggacccacuaaggaggggaaucuuuggcuacauucacaaaaaccaauaguaugcaacaaaagcaacuauuauaaaggugcuauaucauugccaucauguugguaccuggagccugaugaaaguacugauagucuuguuucaaaauuucauugucugcuuccuguugagcagcaucuaaaaguuggaauaacuguacacacugaaggaugcuucuagguggugaaccuuugaggauuuuguaaauuguguaggguuuuuuuguaauguaaguuaguuuacuguuaaauguucuguaauaauuuccauucccuguacuuuuguuuuuccaaagaaaauaucuaaaacugccccaguauaauuuacauuagacauuguauaacuaugcuauaauccagcuaucauguuuucuaguacucacaguguggauuucaucuguagugucugugacuugccuaucauggaccuucauguuguaugcauagacaagugcucccaaaauuauuuuaaaaugugugaaagucagaaguguguuucuuccuaccuuagggcuaagcuauuguauuuuuugaaaugcagcaugccucaaauuauuaccugaauaucauuuggaauuaaugagcaugcauuuucuugaaaagaagacugacagacagaaacaacauggagcugcuaagccaagaucuagcaggauaacugaucuuauauuauuuaaaggcugaaaucuacuuuuaauuaggauuguggagaauuaggcauaguaacuuauuucuuccuuauuaaaauauugcauuaaaaauuagaaauguagaucaaggaaauuguugauagcagaaaggaauccuuccuuuuuauaaaaauauauuaguauuauuuuagaaaguauauaauuauaacuuuuuguuguaaaauauagugauacaggaacauaaauauauaauacaaugaauaauuauaaauuaaauauuuagcauacaucuuuguaaccuuagaguauuacuggcaucccagaaacucuugauaugcuuucuuuucuuuagagguaaccaguaucaugacuuuaaugguaauuauuuauacaauuuuuaauauaacuuugucacuuuacguguauuccuaagcaguauguuuacuuuuuucgccucauuuuaaucuuuaugaaucguguauucuuucuuccuuugcucagcauuauguuuugaagaguuauccauguaguuauguguaguuuuauuucauucauuuuuguuauuauguauuaucccuuugaauuaaaugugccagaauuuauucauccauucugcuguugguagaucauugaguuguuucuaguauuugaugacauugcugagaauguguuuuaaaaaauauccugguuacauaucauguguacauuuguuuauauccugacaguaacaauauuaaauguuggggaacauucuaaaaugauuaucauuucuuuuauuguaggccuuacauauauaguaaagugacauauaguuugagauaguuuaaauauagaguacauauaaauagaucuaguuauaguauugauguagauacaggaccuaaugcaguaacucuguuucacuuuguuagcacacuuauucuauuuaguaacauaucaugccuucuauaacuccuucacuuuacugaugaagaaacuaaggacuagagagauugagucacuugaacaaggccauuuagcaaauuggagcuagaagccagacuaaccuaucuacuuuggcaguuacaacuuaaaguaaaaugaaaucaggacauuuucuugaguguuccagucauuuaagugaaaauaugccuaaauagcuugcagaaaaaaucagauauuccuucggcuauuaacuaacaacuggcuuagcauagaaaguugcaugucuaucguaaggagaggucauuacaaaaaaaaaaagggaaaaaaaaguuucacaucuaaagcccccauaguuauugcacuuuaucacaguucaucuucuaaagggcaaccacuguauauucugauuuuaaccgagaaguuuuacuuugaguacuucaucagaaaaacgugugucuuuguucucuuaaacagaauacauuuuaaguuuuuuuauaauggcucugaguuguuacugugaacaucagucauuuuacagaauuaaagugauuuccucggaauucuaugcuguguuggacuguuuucuucuaaauuauccuagccugauaagcuuuuuuguccucagagcuacugugauguguuuucucauuuguuuuguuuucuuuuacauuuguuagguaauucuugcuuuuuguugucagugccuuccguuugacucauauuuaaaaucaacgcauuugccuaacauuauguauuacuuaggugagagcuuaaguaugguucugucacaucugcugacuauaagaguagagaaugugugcuagcauuuuaaaauucauuuugguaucagcaacuagucuagccacuuuguuuuuacaggauauugagauaaccucagaccgauuucugucugaccgacugauuucugucuaauauauaugcaacauagguugcguauccuuauuuggggaauaaauaugaucauuuacauguuuuccagcuaaacaguuguaggauuauugaaagugauuuacuuaaguaugacuucaaauaggaaguccaguggacuugguguuuguuuucuaauuauuaaauauuugauaggauagacauugaaauaaaaauaauacauuagaugauacuaccuguuaaaaauggcaguuacaaagguuaaaucaccuuugaaauuacggcuuuaaaaaauauagaaguaacacagauuugacuucaugaaaacauuuaagugguuuaggaaaacauucauuuagaagugaaaugcauuugacuucguauccauuuauaaacuauugaaugugaauuuuuuaaaaaacuggaauagggaguauauuuguuuuuggagcacaggagauauuagaaagacaaacaguugcuaucccagcacauuuaggcauuaauaugcugauuuacugaguuuauaugagguuuguuuuuuaauuugaaaauuuauuugcuuuuaaccuuucuaagucaacaaauuuuacauuugcaucugggaaaaaaauaagccaagagcuuuauguaguuuauugcagugagcacaucguuggaaauugccuuauaaacaaaguauuuuagaggcccggagagaggaauagcuuuuuuucaggauaaaucagagaugcauagguuguggaagugcaaaaugaugcaacuccuguggaaugcaaauuggcaauuucuagaaaaagaccaaugcauuuaccucaucucaguaccaauuuugggaauuuauuacagaaauucuuguguguacuuacaaaauaacauauguauaggaguuuucauuguagcuuugugugugguagcaaaagauuggaaauuccuuagugucuauaggcaacguguucguuaaaugaacuaugacaacuacacaaugaaauacucuacagcuguuaaaaaaaguggauuuuuuuuucuauaugaacauuuggaaaguuuuucacauaccauuguuauuuggaaaaagcagaauucaaaacaauguacaguaagguacuuuuuguguaaauugggaggggaauaaaaccauauauucauauuugcuuauauuuacauaacaaaaucuggaaguuuauacaacaucuaagucuuuguggggaugaagaagaaaacagggaagaugggacuuuuacuguauauaucuuuuagauuaguuuuaacuuuugaauauguuaauauguuaguaguugaaaauaguuuuauuuguaaaucaaaugagagugaaagggguaagccugcuauauuuacuguaaaauuagcuauuuuuauucuauuuucccuagagccugacagauaguaagcagugaauaaauaaauauuuguuauacaaauuaaacaaacuauaauaaucuuuggaugaucuuuccuagcuuaucucuuaaagcaucuuuucaauauaagaaaaaaaguauuauaaaucauauugauucuaguauggaaacaagggaaauauuuaauugggagauaugagauguauaguuuauuaucagauuaucaugaagcuuuauuuaauguguaugguauuguuauuaaagaguaaauuauauuuuaauuucauugaaaaaaugauaguuuucaaggaaugcuauuaaauuaaguaauacacauucaugauuaacaaacuaacgcuuaugaaauuugggaggaagagugaaaacggcaaucauauauucuguauacugcauucuguaccacuuuaguuucccacauauaaaggcaaaucuucaguccggagacuauuuuaaaagcuguguuauaauagcaguaucaguuacuuccaacacgaagacuggauaucucugaauacaugauugggaucaagggaagauaauagggugaauguuauaaaugucuuccauuuauaagcauccaggaaguuaacuaaguaguugaaaauuugguuauucaaauagauacgguaacaacccucaguuuucucccuuggauuauauacaugucaguuccuaaauuucuuaugacaaggauuuagacuaucuuuauacaucuguguauuuuuauguaaaagugccuucuuuaaagaaagcuacacauacaggaaagugcacacuuugugaguggauagccuaaugauuuuuuugcaaaccaaauacacccauauaaccagcacccagauaaaguaaaagaacauugucagcacuccagaagacaccuucaugcacccuuccagucacugugcccccucccccaacaaggauaaucacugccuugaauuuuaauagcagauucauuuuucuuguuuuuguauuauauauagaaaauuauacaguaucauuuuuugugugucugauuuccuuuguucaacauagugucuuaagauuuaucuauauaguuguaguuuguuuuuauugcugcauguaguugugaauauauaacuauuauuuauccauucuacuguuaguggacauuugcguaguuucuauauaaugcuauuaugaacauucuaauauguauuucuugaguuauguaucuacacauuucuuuuggugauauaucugggagcaaaauuacuggucagcaacauauauauguucagcuuuaagcaacaauggcaaacaguuuucuaaaauguuuguaucaggcuauauuuauaguaugcgagagaguucuaguugcuccacauguuuccaacacucguuuuuuuccccccaucuuuuucauuuuuccaauucugguggguacaaaguaguguaccguaaugauuuuacuuuauauuuccccaauuaaugaaguugaguacuuuuucauauguauauuggcuguuugguuauuuucuucugugaaguuccgguucacuucuuuggcccacuuuucuguuagccugucauuuccuuugauuugugggaguucuuuauauauucaaaauaugaguucuucauugaugauggguauugcaacuauuucuucuucuaugagguuugucuuuuuacucucuuaauagugcuuuuaaugaacagaaguuuaagucuuuaaaguagucuaguucaucauuuauguuuagugcuuuuuaauucuuguuuaagaaauauuuaucuacuucaagaauguuuuaucuucuuaguuuuucuucaaaagcauuuuugcuuuaccuuuagauuuaaaauuucagucuguauuuacauauuauggaguuuugcagugcuuuuggacucaguuuguaucuggagacagaaaaaaugagguggacuuaggccgaugaccguaauuauguacuuucuauaaaauacucccuuaagaaaacaguguguuuauucauguucaccuuaugugcaguuuuaauguacuacuuuaguuguuuguuaguuugccuuuaaggagagucuacuagaguauuaagggaggaauuuggggaugaagagauaaauguuaugauuuuuaauauuuuaagcaauaguauucauaaauaaguuuauucaugaaauacacaauuuuguauucacagacacaaucccuguuacuucauugggcaucaucuuuaaagcuuaggauuuuaaauauaccuuuuuuuuuaaauugagggaaaaauuagguuuuaacuuuugucaccaaaucaaaauaaaaugcuagcuauuugaaaauuauuuuuauaaacuucuuuuaaauuuuaaguaagauuucuugugcaaguuaugaacauuuaugaggucuucaguuauucuuuuuauuguucaaaaaugcauucacuauauguucugauuaugggcuaugauguuguagaaaaguguuuuuucaugcccugauauuuuaguuuuuaucuuguccauaauguauauuauuaacuucaugauuauuauauuacuuaauuuuauauuuauauuuccuaaugaaaguaauugccuauuuaaaaguguuuuuuugucucccguuacagugcugaaauuaaagaaaggugauuguaauaacucuucacuaagcauuuagauauuuuucacuugccaauugcauuuuuuaguuuaaagcaucaaauuaaguauuauuuuauccuggcuuuuauuuuaauucaugcauuuaaaaacugaaauucagauaagagauaguuugaaaauaaauucaguauauuauuuaugaguggagcaacacauuagcauuggguucacaauagaucauaucgcuuuauuccaucuuacaagcuuagcagcacaaacagaauaaucaacauauuauuuggcugucaucugcugaacagaaaccagagaucacaaggagguuuucccuagcuguggugauggccuuuuuguuccaagcccccaucugggagggccaugguguguuaucauauggaacgcgggguuuucuguaaucugcuuagcugcacugcaguuugaaucuucauuccauguuuguguaauuuauaauuuuaaugagaccauggcucuugugggcuuugaaauauauuaaaagcucuuuugugcauaugcuuuuguucuugcuuaauaggcucaguguauuuaaaacugaugaauuuuuauucaugaauuuggaugucuggagauuaacucagacugaauaucauugcacucaucuauugaugguuagaaaguuuuuuuguuauuauuauuauuuugcuuuuguguguguguauguguaaugucuaugugauacuuguaaccagaaaaggaauaaaccuacauaauuguaaaaggcuaaaaauaaguagcaugacuaggucauaaaaaauugauuuaaauuuuauucaucuuauuuauugauacucauaucucaauuucaucuuuagccucaguauuacagauagauauuauaaaggaaugauuaugaaaaagcaacuuuuaaaaugaguuaguaccuuaagaacauguuuauauuaaaaucauauuccagugugugacaaagauagacuuuguuuuaguuguauaguaucaguugucuagucauucuaaaugaauaauuacauuuccugaauuacauuauuuucaguuuuacuuauuucuauaaaugcuuuuuauuaaaggauuuuuuaaaagaauuucauugaugauaugaucaaaagacuaauagaaaagcagccuacuaauaauuuauaauguugaccuuuuuauuuugugaauauucugaaguauacuaaaugucucaaaucucuguaguuauuacuuaaauguacuuuaaaaauuugaauguaaccaauuacaauaacaccauagaaaaaaguucaucccuuucuagauccaaacauguuuuuugaaguugcuaucuuuugagcucaaugagggaguaacacagaccucacuagucuuuuaugaaauugcucaagagacaauuuuuuuaaaaaccuguauuuacuggacuaaagcauuuuguaacuacaucacaucauucuuuuuuuauacaucgauggucagcaauuuggcaggucuucuuucaccaccauccuuaaacugaaaauaugaaguagaagcuaaaaugacaggauuuuauacuuucuuuacuaagcuuaucuaccagauuugacacuggaauguuuguucuuccauaauuaacccucugcuucaguauuuuuauuaguugcaccauuucauuuggcuuaggaacauaggaaaauauaagaccugcuaaaguggugcuuuccauuagaaacauaauaugaaucacauaaucagcuauaaccaaaauauuuucaauacguaaucaauauaaacauuaacaaaauacuuucccucuuuuguauuaagucuucagaguccaauguguguuuaauacuuauaguacaucucaauuuggacuagucaucuuuuaaguggccucauaaggcuaguggccaccuuauugaacaguauaguucuaaaguauuacacaguuuuaacaaaauaucauaacaaaaauauguacuuuuuacauuucugauuuuucuaguaauauccuagucaagguaaccaaagaauauucaugugcuauguaguugaaauuacauaaaguuuuuuauagcacuaauaccauugguuuauaucuuucugugugauacauaaaauccaauugugucaccugacuuuugaguacuuaucagacauuguacagauauguuuaaagagauugugaugaugacgugauaaugacuaauguaauaaauguggaguguuccucaaaaauugucggcaaaucaaacuugucaaguaagccauauugcaaguauacuuaggaguuuaguuuuacaagaauuccaucgcaaaucuuaguacuuuuuuuuuauauaaaacuuacaacgucuucacauccuuagauuuauucuggacagauguuuguguaaauguauaugaaucagucuuuucauauaaauuugcuuagauaagcugguauagcuguuaugucauggguggaagaagcugauuauaaaauaucauuuuccuaauuucucuagaauucuauacauuuaaaauguucuguacauauuuaaaugugaggagagauuucuucacugauaacuauuuuaaaaacauauaguuaagaauuauaaaaccuugaauuacaauuuauuugacuugauucaaauauuuuaaaguauaguuauaaaaugaucaaggaaauuuauauaaaauacuguaggcauacauauuuuauuuaaaauggucauacauaauugacuuugcacaaguaugaguuagagaaaaccauauuuaugaaaucucugaguuuuucacauuuucuaaauuucgagggcuaugaccuaauuuuauguaauaucauuuuuaguuauuagccaaugccugcuguauucuuggacucacauuuuuauugacuacucccugugacuccugcauuuaaaguguuggcacaaaauguuaaacuauucuuuaaacaauaccucuaguuucuuggagaugauaaauccguccauugauuuccuaauuuuauuauguacacagucaauuguaauccaagauuacagcaaacaagauguuaauuucuagacauaaucuauguacauuucaauuacagagcaugauuguuauagaagcacagaauaaaaaagaauaacauuugugcuauccucacaggagcugucaauaaaagauguaauaggggauuuagaaaucuggaaauggccaacuaauuuaugugaaucuauuuuauuucagcuagaaagaccaagcucuuuuucgucugcacugcauauugcagagcacaggcugucuauacaaaaccaggcggcugcauauggauaguccccugauaucauucacuugcuguguaaucuuauuaugcaaaguucuaaucuucaccuagaaugaaugccucugggucagaauauagucauaucaggguuuuugaggucauguuuugugauccuuagcuuauucuucuaaguagggcugggauuuaaaggguauuccccagauacuagcagagauagacagcagaaucugcugccuuuuuggaagacaagaccaacaugaggucccugguaggauuaaacuugauuuguagcuguaggauuuuuuaacagauguauuauuggacagggaauagggggccaaccagcacagcaaaacugaaucacgacugacauucucagggaguuugcugccggcuaaaacagcagcugcauguggauuugacuucuuucaggugaagcgacuuccagucauuuggaaaggaugggaugaaaaggaaccuuggugauaauuuugaugucugcaagauuuaguaccaguguaaugggauuaucgguaacaccuucacugcagaaaaagccaccuggcgcuauaacuggcagcaacugagaacuaauccuuucccaucucuuggaugucauucaugaagcucaaagcuauuucugcccugcuaacugugauuaauuuuauaaacaacaacaacaaaaaaucaggucaucaaggcaaagaauaugcucuuuauuauuuauaauauguaaccuuauguuaagcuauaugacuuaaaauuaugcaagacauauacaaacuaagcuauaugauucaaaauuuauuaagcuauugaaauagaaaaguugaucaaugaugucuugguuuuuuuaauugaauggcaaauuauuuacuauugguaacaauucauauuucagaucaaauauuaauuuaaauacuuuuauauucuuuuggcuauagagccacuaugaaauuaaucaaaaugucuagcuguaaggaauugaaauaauauguuucgucauauguuuuaccuguuuuugacugcuucaguugcuacugaugaaauguuuuuggugaauaaaacauaauuugaaauauauagacaccuauauuuuuuguaaugaagguaaugcuagcugaaacugcugaugaaagggcuuuuggugaaauauaugauuuuaauauauaaaaguauagaguaaauaggaauacugaaugacuuauuuuuaaaaaucagugauucuuaguaacuuuuccuuuagauggagguuuaguugugugcuuaaaaaucagugaguuaguuaauugauuuuguuagcuuuuauuucaacuaaaaacuuuaucaaguacuuuggcuggagguguuaauuauuuuaauauuuuuuucuaacacgauccaauauaaacugagagaaaaugaagugaaauuaucccaucagucacccaaacaguaugcaacguaacugccaagacuagaaaagauaauuaguguugucaguguuaugaucuuagaguacuuaauuuuaaaauauuuauucauagaacuuggauuuuaucucauagcucuuuuguuuaguagcuguaucuuuuaaaaaauaaauuauacagccucagucuaaauguuuuuaaacuuuaacauuuuaacuaaauauaggugacuaaaguauuuucuugaaauuauaaaaauaauuaaaauauaaucaauuuuauaccugaugcacaccauuaauguacuaccaccucuguuuauguguaguaucuuuuauucuuuuccauauaaagucuuuacuagaaaagucagcaaauauaauaaauuuauacagaguucccggguuugguuuaacugguuccaagcuacuguauuucaaauuguauuuccaaacuuuuaccacauuuugaaugaauaaaugagaaagcuugccaauauuuccaguaaacugcauuguguuacuuuuauaaaggacgacuuuugccuucuauuuguauguuugcuguuuggaaaaauuuuuauuuuauuaugaugaaaaaagcuauccaugaaguaaauaaguggacuaaaaucuuuuucuuacccucauaauaaaauuacuuauuuuaaaucuaaaauauuugguuuauguguaauuucacauuauuuugccagguaggcuauuaucucagcauaacuuucuaugguagcuuguaguauuauauauuuauuuuuaaaaguaguuuugcauucaaaacagaauuugucuggaagguuuuacuaaaccuggucaguauuuacuuuuuuacuuuuuauucagguauuuacugaacagcucuugagaguuaguauuuuuuccuucuccguucuaggggucacucuuauuuguuuagagaugguuauuuucuuuagaacgucucaaauaaacucaucugaaguaaauucaacauaaaacauaagaucuucucaaugguauacauucuuuucauaaaaauacagguuauuugaauuuuaauaucuguugauaacuuauaagaaauuuggcuuaucuuaagcuagauacuaauuugcagcacaggcaacucaugaugucaguaagacuuaagggaauuauuuuuggagauaagagagugggauauacgaugaaaugagaagaaauuuuuuagaaagaaugauaagucagguauaacaaaagaauaggauggggcugggcaugguggcacccgucccuggucccagacacuugggaggcuguagugggaggauucuuugagcccaggaguuggaggcugaucucucuaaaagccguucaugaacuguggcacagugaggguuagccuaugauaaugcuaaaugauauuucuuuuugaauuaauauucuuccacuguuacucauacaacugcuauauuuugaaauagaucauuuaauaguuguauuauuggugaaugaauguggauguuuugguauuuuacuuuuuggaaggugaugcuuucuuauauuaaaaugaucaacugcuuauucuuuauaaacauaaggugaguuucaauuuugguuauaugugaaaauguaaaauucagaaaauaccaguggacuaaugaaauacauugaaguauuagcauuauaauauuuacuugaugaaaauuuauagaauuaucccaaaguuaacguucacuuuaaagauaaugaauggguaaauuuugucaagucucugaaaauauugaguaugcgucgguggucuuaaaggacaggacaaaguccuuuacuggacuuccuuccugggagcuuauuaaaacuauagaaucugcagccggguucccagagauucucuuucauuagcucugugauguaggaugagaaucauaggaaucgcagggagccugggaauuuggauuuuuaguuuuuaauuuugguugauauuagguuuucauguuauuuugaugcugcagucaaauuugaagcaguauucacugcuuuaaacuuuaaaguaauggcaguuauuuccucugcuaaugaaacaaaauaaacagguuuaguguuuuuuucuaauucuuuuugagacagggucuugcuuuauugcccaggcuggagugcagugguaagaucauggcccaccucagccuuaaccuccugggcucaaguaauccucccaaguagcugggacuacaggugugcaccucaugcccagcuaauuuuuuaauucaaaauaaacagauuuuaauaaaaucuucauagauuaugggaguaugagugccuugaguuugcaguuuuagaaaauaaaaaucucuauacaaaucuuacaguagauuuaacacuuauggauuugaacaauucaugagcagcccugaaggugauuuugaaaugacaggaauuugaauuacuuugauggagacucugcuguuugagagugaauuauuuagcuauugagcagaguauacuacucagcauaaugagucuuuguuguucucuacuugucacaauaacuucuaccuaggaucuuaaguggacauauaucucucaguuacuuuuuaugcaucauucuguggggaaaauggauuuuguguaaguauucuugacuuugaacaucuccaaggucucagaaaugucaaaaucuacuauuuuuucuugcccaaaugaagguaaauguggcaaaacuaugauguaauuuguuuucuccuucccuaucuaacuuguuucugcucacccuuucuuaaugugaacacuucuuuaaaugcuaauuuauucucaaacucuguuccucuaucggaacaaaaauacauuaaugacauuaaaucauuucugugauugcuuauacuuuagaaugaaugaauuuauguaaaccgauggucuuaacauuugacauauauauacauauauaauguauuuacauacuuguauaauguguauauauauauuuuuccuguuucugaaacgaaaugcuuucucuuuucaaaggaauuucagaccugaacaaucagguggacaacuucuugugacuuuggguauucugaaauuacuguaagucuacuucagucauuggauccaaauuagaaucuuagaauuggaugccuaugcccagaaauuucuaaagauggaggaaucucuaauuucuuuucagcuucugagguucacucugcucaaucuuuuuagcugguuuuaacaucaguccuaccucuaucuuuccuaugugucucuauucccagaugccuauuuuauaguauccaaaaauuuuuucauuuaaauugagaggcaauaugguguaguauuggauguuagaccuaaacagcuucauuuugaauucuggccuggccucuaaugagcugcaugacuuugaauaguuccuucaucucucugcuccucaguuucuuuaucuguaaaaugagauaucaaaggggccgggcgcaguggcucaugccuguaaucccagcacuuugggaggcugaggcgggcggaucacaaggucaggagaugaagaccauccuggcuaacauggugaaaucccgucucuacuaaaaauacaaaaaauuagccgggcgugguggcaggcgccuguagucccaguuacuuaggaggcugaggcaggagaauggcgugaacccgggaggcggagcuugcggugagccaagaucgcgccacuacacuccagccugggcgacagagcgagacuccgucucaaaaaaacaaacaacaacaacaacaacaacaaaaauuagccgugcgagguggcgggcaccuguagucccagcuacucgggaggcugaggcaggagaauggugugaaccugggaggcggagauugcagugagcugggauugcgccacugcacuccagccuggacgacagagcgacacuccaucucaaaaaaaaauaaauaaauaaauaaaaaauaaaagagguaucuaaguucucauaggguuguuuuaaggauuaaaugaguuaauauauguaaaguaaugaagaggcucuuaaaagauuucuggggaggauccuccuauacuucuuuugcuguaugacacagucacaauuuuuaugcugcuuuucacuuuuucccuagcuuuucuauuaauuauuugaaagaauauauagguuccccuuuaaagaaauugguucucuacauuaaugacucaguuuuuuuaauguaaauaugauagggaauaaaaaaaguaacagauucugaauuuuuuggugcccaagcuucccagauuuuuuucacagcacacaugguacaugguaaguuauacaacacaaaguaguaaaugacuggauaaauagggcugcccaaggcuggcaauggccauuggucaccaagaguuuagagcagucacuuggagaacuuguuaaaauacggauugcugaacaacgcuuccuaaguuucugauucuaauaagucuuguauuugaccaaaucaguuucaagaugaugccauauugaugcuggucugaggaaccacaguuuaguaauuacuaguuuaauguucuguauccuggugugguagguagaauaauggcccuccaaagaugucugcauccuaaucuccagaaccuuugaauauguugccuuacauggcaaacgagacuucacaggugugauuaaauuaaggauuuugagaucauugugaauuaucuaguugggcucaguguaaucaccaggguccuuaaaagaguaaaaaggaggcaggagagagagagaaacagaggaagaagugaccauggaauaauggccagggagauuaaaggcuuugagauggaacaaaggggcuaugaguaaaggaauguuagugcuucuagaaguugggaaaggcaaggaaauggauucuccccuaaagccuuuagaaagaaacagucuugauuuuuuagcccagugguacccauguuagacuucugaccuaucaacuguaagauuauaaauauguguuguuuuaagcaacuaaguuuaugguaauuuguuggcaccaauggaauacuaguacaucuguaaccaguuccguuuaccaguucgcuuugugcuaaaaguucccagucucagcucauaagaaagaguaaauaaaaacaagaggcaagagcucccuuauuuuucuaccaucaaacugacaaaacuaccaguauguuaacucauauuuuucuucccuuuuauuacauuggaggaaguacuaaacuucuaugaaaacccaaucugucggccuuuguuugaucccauucucuauugcccuguuuuuuuaaauugaagauauauauauaauuuagcaucuaaauauauauauuuuaauuuagcaucuuuaagauggaacacacuccuucaaugauuaggagagacacaagauagaaauaaugguuuuauuacuuacagguccuggauacaugacauaccuggaggccauacacggaggucagggaacacuucagagggaaggagagggagaaagauccucggguuaacaccuucauugaggucuagggccuuauccaaacagguuucucacugggagauuuuucuugaacacuuaauaauuguguacaguuaugguacaguaugauuuugauacauauguacaguguauaaugaucaaaucagaguaauuaacauaucuaucaccucaaacauuuauccuuucucuguguugggaauauuaaaagucuuauagcucuuugaaaauaugcacuaaauuauuguuaacuacagucacccugcagugcaauagaacaguagaacuuauuucuccuauauagcuguaauuuugcgucuguuagccagucccuccuuaucaugccucacacuuuccagccucuaauaaucacuauucuaucuccuucugugaaaucaacuuuuuuagcuuucauguaugagugagaacauaugauaugugucuuucuaugccuggcuuauuucacuaacauaauuguccuccaggcucauacauguugccuuguuugacaggauuucauugguuuuuguggcugaauaguaugccauuguguauauauaccacauuuucuuuauucauucaucuguuggacauguaaguugauuccauaucuugccuauucugaauagugcugcaauaaacauaggagugcagacaucucuucaacauacugauuuccuuucucuuggauauacacccaguaguggaauugcuggaucauaugguaguucuauuuuuuaguguucuuuuuuauauauguuuuauguccuguaaaauauuuuuguuauugucuuaaacagcaucaguaucuuuauccaaauauguauguauguacucuucacuucucuuccuuccuucuuggauuugccugauucuuuuuuuuuuuguuuuuuguuuuuuguuuuuugagauggaguuuugcucuuauugcccaggcuggagugcaauagcgcuaucucggcucaccgcaaccuccgccucccggguucaagcgauucuccugccucagccuccugagcaccugggauuacaggcaugcgcugccacaccuggcuaauuuuguauuuuuaguagagacgggguuucuccuuguugguuaggcugcucucgaacucccgacaucaggugaucugcccaccuuggccucccaaaguguuggauuacaggcaugagccacugcacccagcccauuugccaaauucuaucugauaacauuuuguuuuuccugaauuauuccuguuagcguauauuuuauuacaguugugcuggcaaaaacauucacaaaacuuguuuucuaaaaguguuuuuauuuuuuucuuuagcuuuugagguauauuuucaucagacauagaauuauaguuuggugauuuucauacuuuaaaaaugccauuuuauuuuauucugguuuuaauuauuucuuauguaaagguagccauuccauuuuguugaacagacaaaauuguuucuuugaaaauaagguaaauuucugaccaauuuuaaacuuuucucauugucuuuuucagcaucuugacucuacugugccuggauguagcuguguguuuuguguguauccuguucaugguuuguagaauuucuugaguuugugaguuaaggucuuucaucaauuuggaaaguuaucuaccaauauuucuucaaaauauugcuucuguccuauucucuguuccucuccuuuaggucucugauuauauuaguacuguuucuccuggauugccuaccugcuuuccucuuuguccuucagucuuacuacuuucucccaacuugcauuccaguucacuugucuccuguuaggcugagccuaguaggcagaaucugccgguauauucauguaaugcauuaauuuuaguuauauuuuauuuuguaguauuguguuguguauaauuuccauuugauuuuuaauagauuuuaggucacugcugaacuuuugucuuuccuucuguuuuuuuuaauguuaaucauaguuauuuuaaaguguucauauguuaagugcaauaccugaaucaccuguugcucucuuucuguuuuguacuuuuuuuucucuuggcuuucagucauuugauucuauuuuauaaugugcuuugauugaaugcaaucauuuaguacuauuuuauagcaugcuuauaaucuuuggauuaaacuaaaaacuguaguagcccaauuuuuuaaaugggcaagguguuugaguagauauuuuucaaagaagauauacaaaugaucaauacacacaugaaaaaggugcuuaugaauauuuuguuguuaaggaaaugcaaaucaaagccacagugagauucauacacacugggauggcuacaaucaaaacauggaugguaacaaauguuggcaaggauauggagaaauuggaaaccuuaugcauuacuaguaaaaauguacaguggugcaacugcuuuggaaaacaguuugggcguucuucagaaaguuaaaugcagcauuaucuuuaauggcauuuucaucagaggaaucuuuucugauucaucuuaaagaaaguaugccucacccguuauucucuaucacuuuacuauauuuuucuuuacagaaauuacuuaauguauuuauguauuuauuuguuuacuuuguguaucuaugauaucugccccacuauacuauaagcuguaugagagaaggcaucauguucacuauuguauucccagggcugaacacaguaucugguacguaguaguagcucaguaaauauuuguugaaugaaugaagucacccuuuuuuccccaaguguuuguuuuuuagaaguuuuauucuacaaaaaaagcugaaaaaaauagugcaaugcacauuuguauacacuucacuuggauuuaacaaugaacauuugccacauuagcguucuaucuuccuccauauguaauauauccguauguguguauauauauguguguaucaauuugucuucaucucucuguauccaugauuauuagcaguagaagugaaccauaugaaaggaaguugcagucauagcauuuuucucaaaauaauuccuuguuuaucuccuaugaacaaggucauucuccuacguagcauauuguuaagaaauuuaacacugaaacagugauauauuuuuauguacaauauucagauuuacccaguuguccccaugucuuuuauagcuuucuuuuuccuuuugcuccaggauccaauucaagauuucauauuguguuugguugucauguccuucuauuuucuuguaauugaaaauaguacuuuuaguauaauuuuuccuuucauuaaauuuauacuuuuuaaguguucaagcugguugucuuguugaaugucugcaauauggauguguuuugauuguucaugaucagauuuagguuacacauuuuuggcaggaaugguacacagaugaugauguacuugucauuccauugguaagaggccacaugauaucaguaugcugcuaaauuuggucauuguguuaaguuaguauuuaccagaucuucccauuggaaagauaccuuguucccuuuguaaaaaaaaaaaaaaaaauuaucuacuuugauacuuuucaaauaucuuuuugaccaacaauguuucacccaguauauuuuagcaugcaucaguggcccuugucugagucaauuauuacacuggugguaauuuuaccauuccuucuacauuuauuagcugucauguuuugaugaagaacuuucccuauucccaacacaugcaucuuuuuaaaaauuucauuuuuaauuuaauguguuaucaauuacuguuacuauuuuuaggcuuauguugucucaaauuuaauguauuaucaauuacuguuauuauuuuuaggcuuauauugucccacauuuggccauuggaugaccccucagaaugguuccuuuguuugcaccagucuuugagcacugacuguucugcacugguggagcaugauacuuagaaaccaaaaaugugggcacuaagugugcucauaaguacuauagugucauugcuucuuacaauggccuuuucacaguggacagagcuaggaugacauuuuuuuauaggcaaacagacaaauauauacaugcuuauuuaaguaaauuuguuuugauaacucaaauucauccuuaagaucccuuuccauauuuguuacuucuuuuucucacagugagaaaugacuuaaauauuugcucacuuuuacuaucugaaauauacauaaaauacuacaaccaacaacuacuaagauacauucuagauucacuuucaauguuuuuccuuuuauauuuaguugguauguaauaauuguauguauuaaugggauacagugauauuguguuacauguauacaguauauaaugaucaaaucaggguaauuagcguagucaucaccucaaacacaucauuucuuuauguugugaacauuaaagaucuucuuguaccuuucugaaaauauacaauaaauuauaguuaaccguauucauccaacagugcugcagaaggcaguaacuuauuccuccuaucuagcuguaauuuuguguccauuaaccaacuucucauucuccccuccuaccuccccuucccagccucugauaccuauaauucuacacuauacuuccauaggcucaauauuuuuuuaagcucccacagaugagugaaaacauaagguauuuuucuuccugugccagauuuauuucucuuaacauaaugugccccagggucauucauguugccuugaauaacaggauuucauucuccuuguggcugaauaguauuccauuguguauguauagcauguuuucuuuauccauucaucuguugauggauauuucgguugauucugugucuuagcuauugugaauaguagcuacgcugcaauaaacaugaggaugcagguaucccuuugauauacugauuuccuuucuuucggauuaauacccaguagcagaauugagagaauuauuuuuugauucucuagaguuuuuaaagaaaccuccacacuguuuuccaugacuguacuaauuuacauucccacuaacaggguauaugaauuuucuuuucuccacauccuugccagcacuuucuuugucuuuuuugauaauaaucaaucuaacugugguaagaugauaccugauuauaguuuugacuugcauuucccugaagauuagugauguugagcauuuuuuaauauauuuguuggccauuucuauguuuucuuuugaaaaaugucuauucagaucauuugcccacuuuuuaauuggguuauuuguuuuuuugcuguuggguuccuuguauauucuagauauuaguccaugucagaugcauaguuugcaaauauuuucucccauucaacauguugucuuuuuacuuuauuuucauugcugugcagaagcuuuuuaguuuaaauccguuugucuauuuuuguuuuuucuugccuguucuuuugauuucuuagccauaaaaucuuugccuagaccaaugucuugaaguguuuccccuauaguauuauaguuugaucuuauuuauaagucuguaauuuauuuuaaguugauuuuuauauaugguuagagauauggggacuaguuuuguccuucuacauguggauauccaaauuuuccagcacuauuuauugaagagauguccuuucuccaguguauguuccugguaccgugucaaaaaucaguuggcuguaaauacauggauuuauuucuggguucucuauugugucccauuggucuauguguuuuuauacuaauaccaugcuguuuugguuacuauagcuuuguaguguauuuuaaagucagguaguguaauaccaucagcuuuauucauuuugcucaauauugcuuugguuauuuggggucuugugguucuguaugaauuuuaggauuguuuucuaauucugugaaaaaugacuuugguauauugauagagauugcauugaaucuuuagaucaaauuggguaguauggucauuugaacaauauuaauucuuccaauccaugaguaugggcugucuuuccauuuuuauuuuuuauguccucuucaauucuuucaguguuuuuguaguuuucauuguagaggucuuucaccuccuuggguaaaauuauuccuaguuauauuuuuaauguuuuauagccauuuuaggugggguugcuuuauugaucccauugauuucuuacucagcuagaucauuccuggugaauaaaaugcuacuaauuuuuguauguugacuuuguauccugcaacuauauugaauucauuuaucaguucuaaaaguauuuuuggugaagucuuuagguuuuucuauauauaagaucaugucaucuguaaccaggauaguuacuuccucuuuuucaauuuggaugcccuuuauuucuuuauuuugccuaauugcuauggcugugacuuccguuacuauguugaauaagaguggugaaggugggcauccgugucuuguuccagaucuuagaggacaggcuuucagcuuuucccccauuaaguaugauauuagcuguggguuugucauauauugccuuuuauuguuuugauguauguuccuucuuugccuaauuucuugagaguuuguaucgugaagugauguugaaauuuaucaaaugcuuuuucugcaucuauugagaucauuguaugguuuuuguucuucauucuguugaugugcuauauaucacacuguuugauuggcauguguugaaccauccuugcaucccugggauaaaucccaucugaucgugguauauuaucucuuuaaugcguuguuggguuugguuugcuaguauuuuguuaaggauuguugcaucugagcucauuggggauuuuggccuacaguuucucuuuuccugcaucugguuugggcauuagggcaaugcugaccugguagaaugaauuaggaagaauucccucaauuuccaguuuuuuggaauaguuugagaagaauugguguugguucuuuuuuauauguuugguagaauucagagguaaaaccaucugaugcugggcuuuucuuuuuugggagaccuuuuauuacuggcuucauccuuugccaacuuugugaugauaauaagcaaguuacuuuacuacucuuaggcuuuuuuuuucuugucuauaaauugaggaugguaauaauaucuaucuuacagagauaguauauguaaaucuugacauguuaagcagauguuacauauuauuaucgauauauuuuaauaaauuugaucugagaacaguauauuguagccuaggccuaagaguuaggcuauuaguuaagaaaugcaugauacauaguuguaacaguuaaauaguaaaggacagauauuagaaauauuuuagaugaacaauauuuuaaaauuuuauauagcuuuaaaaaaucuuuaaaugguucuuuaugcuguuguuucauaguauuuauguguuccuuuuguuacaucaguaguuaauagcucacaaaugaguguaucuuuuuauaaaguacuuugacauacauugcugaauuugauucuaauaaucauucuaugagaguauuucuacuaggccccagaaggguuaaguaauuguugaagauuauacaaguuaguaaaauaaccaaugugaaacuugaaucuccauauuccuauucuagugauuucuccauuauuuccuauuacauggcaagaaguaauauauagcaaggaacuuuuauuaguccuuugaaagaguuacuaucuuuuuuaagcaucugccuuaauagaagaaacaaccaagacauggaaggggacagacuaguuuauaaucuacuaauuauauaauucauauguagacccagugacauuugaauauaaacuuugguaaaucaaaauauuuaguggcuacaauuugccauuuaaaauaucauuagaacugauaacaaacucuugguuuccugcaccaaauuguauuaggcacuuaguacauuuugggugauuguaaaauauuuuacaauaguuauuucuuaaguguuuuuaaauaguauugaucaugaaacuuuuugaaauuuaccaucaggccaaugguggcagagucuacauagaacuaugcuucgugguguucuggggaaaaccuuucgacuuguuggcuauacuauucaauauggcuguauagcucauugugcuuuugaauacguuggugguguugucaugguaaguuuuuauguucaagaauauucaucuuaaauauauacuuucuuucaaauggaaggaaaguguguuuuuccuuuugaaaaccuaguugaaguuauuuaaugacuaaacugugaaaguuaaaacauaaaaucuuucuaaauauuggaauaauaagagaguguguuugaauuggcacugauagaagguauaaggaccauuacuuaaauauuuucuguauucuguuucuaaugggcacaaaggguccuuuugaauaguauaacaauaauagucauuaccauuuauugaauccuauuuacuguguuucaggauauguuugauguuuuacacuuacuaacucauuuaaucuuuuacacuucuuugagauacuuacuaguaauccauuauacacaugaggaaaugaacugagaaagcuuaaguaauuuacuuguuccaggucccacaguuaguaaguaacuugaaauuucaacacauauuuguccaguuuucaaaauuccagcucauaaccacaauaacuguaauuaaaacaaauuaaucaucuguaauuaagacagauuauucugccuaaugucuauauuaaaauguuaaaguuuuucccuauccccaacuaauacuuuuucuuaauauuauauugggaaacuacaaacuguggcuguugauucaagccuuuugucauguaagugaaagaauaaauugauugaccagccagucaauuuuuuuuauuguuguuauuacuguuuuuuuuuuuaaauuagguuuacuuuaucagauugacagucacauaaccuccaguuaagguggaguaauggaaauauauauauuuaacugaaauuucccuucuuuuuuuuuuuuuuuggagacagggucuugcucuguugccugggcuggagugcaaucaagugaucucaguuuacggcagccucugccugcugggcucaaaacaauucucaugcaucagccucccaaguagcuaggacuacaggcgcacaucaccaugccuggcuaauuuuuguauuuuuaguagagauggcguuucaccauguuggccaggcugugcacgaacuccuggccucaggugaucugccuaccuuggcaucccaaaguucugggauuauagguaugagcaacuguaccuggcugaaacuugccuucuugauuuuuuuguaaguuagauugguacuuccaaagguagcaaacaaacuguaauuguauuuccuccuauuucugccugaguaggaacuuuugaguaaaaaguuuuauuuacaaauagaguaaauggagacugucggauuuagauuuuuaaaguggcgaugauaguuuuuucugauucugagguagaguuugaguaucccuuaucugaaaugcuugggaccagaaguguuauggauuuuagauuuuuuuggauuuuggaauauuugcauauacauaaugagauauuuuggggaugggacccaagucugaacgcaaaauucauuuauauuucauauguaccuuauaugcauagccugaagguaauguuauacacuauuuuaaagaauuuugugcaugaaacaaaaauuuugacugcauguuggcugugaugcaucacauggggucagguauggaauuuaccauuuguggugucauguagacacucagaacauuucagauuuuagagcauuuaagacuucagauuuuuuauuagggacacucaaccuguauauaucaagauuauuguuuugagacauacaaauaggaaaaucuuuaauugcuucauuguaaagauggguucuauuuagguugccagguuuggucuugaacuccuggccucaagucauucuuccaaaguuuugggauuacaggugugagccaccaugccuggccaugaaaaucuuuaaaguccaucucaucaugcuaguauuuuucaguagaacauuuaaguugcagccccaugaaaugaguaagcuauucucuuggaagaggaagaugggcauaagcucacugagaauaguauaauaccauuuaguaaaucaucaucauguucacuggauuauaucugauaguaauaagaaaauguauuauucucccauucauucaaccaauauguaugguuuaucaauuuuguaccaaacauuguucuuggcuuugguuauauagcuaggaacaugagagagaucucugccuucauagaacugagauucuauaggguggccuaaauuuggaaacauagguaauguuguuuuauucaggcauuauaaugugaaagcaauaauccauuuauaauguauuugucuauauuuccagacuuaguggcuacucuagaguugaacuuacuugagaacugccaaauuuucaugaaucaucccccaagcuuuaggaacauuugcuugauuuucuuucuuuuaagcuugcuuaaaagauuuauguuaaauuuaaaagagauuuugaauuuagauuacaaauuaccucucuuuucaguguucuggaccaucaauggagccuacaauucaaaauucagauauugucuuugcagaaaaucuuagucgacauuuuuaugguauccaaagguaaauuucugucauggauauauuaaauuuacagugaaaauacacacacacauuguggcuuuucugcaguuccuuaacuuuaucuuuaaaaccucuuucauaaauaaacauauuaauaaccagcuagauaaaauuuugagucaaauauucucuuucaguuugagaaauuuuaauaguuucucaaacauaugcagugucuugggucauuguaucucuugcaucauuuugaaaaauaauuagcagucccuuacaauauacauguaagcuuaacuuuuuuaauugggcuuuagaauauuuugaguuaagaacuaggaacuuagggauuacauuacagauccaaaucaauguuuuuguucuuuaauuuuaaaaauaauccuguaguucuauugauugcuaucuuacuuuauauguagucuaugaugaccguuugaugguuuuuauuuuuuuaaauuuucugauauacauuuuuuggaugaggucuugcucuggcucccaggcuggagugcagugacacgaucucagcucccugcagccucaaccuccugggcuccagugauccuuccccuuagucucccaaguagcugugacuacagguguauacucgccgcgcccagauaauuuuuguaguuuuuguagagacuggguuucgccauguugcccaggcuggucucaaacuccugagcucaagcaauccgcucaccucagccucccaaaguguugggauuacaggugugagccaccgugcccagcccauuugaugauuuuuagauuacaucauuguauauggcugagaaccaggaauuguauauauuaugagucuccugauuaauuauauuaaguugaauaacuccugggcaaauauugugugucacuaaaccuuuuaaaguccuauuucacagcaggcugaggcaggagaauugcuugaaccugggagauggagguugcagugagcugagaucaugccacugcacuccagccugggugacagagcaagacuccaucucacaaaaaaauaauaaugauaaaaaauccuauuucaaguggugguuccaauccuugugauacccuuuauuccaauuaacucuaugagaaugauuuauuccaaaugaaugucaaguauuaauaauuuaauauauuuucuaaagagcaccucucugauacccuaaaauuuugaguccauuuguuuuuuauaauucugaaaaaaaucuaugccugcuuucauuucaguaaacuacagauuugauucccuugagcuaguguuuaguuuauggcauauuaaguagguuuaggcacuucucuuucacuauucaccuuugcuauaaccuauuucacauuacugaaaauuguuaagaauacauuucuucacauuuacugaucuuucaccagccuuagauucugcagauagaaacucucuuggucaaccuguaugguuuggcaugcucccuagguaauucuucuucaaaucuuuuacccauaacaacuucuauauacuuaauuguagauacaggaauuauaaaauaaaacuuauauaauagauuguguuguugcucccuuuucuuuuuaacuuauaucaaauuauccuuauauagccuuugaauuaacuggagaccuagccccacuguagcaugaaaccaagcaucuguguuccaugccagugacauaauuuuauucacaauaauccuugggcauccugaaugaggagaugaacuuguuggcugaauaguuuuugaauacacagcuugauauuuuuaaaaaaauuacucguugcauucagauaagugaaacaaauaacuacauucaguaaaugaauucagauucuuugaagaucuuauuuuguacccuauucauccagguuacaggacagcucaaaaucuggcauuuaugagauauaccaaaguaacuuuuagagccaagauagccagcugguaacuuuuacuuaagaaauauuacuguccugaguauucucuuucuuuuacccacagcacagaacucaagauuucaggggaaucuuugaccccuggcaagguguccuguuguuagcugccuguuucuaaauguaaaauaaccuuccauuuaggcaagaauaaaaguuugcauaucuaguaucuaaagcacauggaugucucuucagucaacugcacagaacacucaaccuugagacagucagauuuuuacuauugcuuauucuuucaacaaauaguagugagcaccuaauuuauaagauguaccauacauuauagagaauguuaagauuaaugagauaauugacacuaguuuucaaaagcuuacuguguaguagaauaauaaggauguuuauaaauauaaaugagaaaauuuuuaauaagcuuccuuuuaaaacuauuugaaggaguuaagaauccagccgauauguauuuugaucuaaacgcuaugcauauaucuaguuagacuaccagaaauaaaguuuauuuauacuacuuucuacaaaacagcacgacugaauuaugauuucuauguugccauucgagugcaaaguuuguuuuaagggucauauugauuauuugaucaaagaacuuaagcuucauuagacacccauggaaaaacgucucuuccuccaaagcuacccaaaaucaacuuugauggcguguuacaaucuuugcaaauuuguucaucugaacagauccacugacaugguucuaguugguuagaaagaaaauaccuuuauucuguuuucaaaagaaggcaacacuguguugccuccaaauuauagaauguaacgauuugcuaccuuucaacucuuaccaagaauagccucaagagaucaucauuguaaauacuauuucugcacucuguguaaaauuucugauaaagaugguaucuuuuauucucuuauauaagaaaguuucuugugaauuucucuuugauuuaguuguuagggaaaauuuugucuuaccucccaagcuaaauguuauuuuauuaauuaaugauuuccauguaacuggucuuaauuucuucugacuuggcucccaaagaguuuagaacccauuuuaaugcuucuauagagcaguuauuagguuucugauuucuucauaauuuuccuuuuauucuuaugacuuuuaauauuauuuugacauaugcuucauuaaacuauuucuggaacuagguacaauuaauaagcaaauauguuaaauccuuuuaaacguguguuagucaacagaauucacauauugcucguuuuaugcagaaagaguauuguguucuguuugacuguggucauuaguccuacguucuaucuuucuuccuuuucacuuuuuaggaucuuucuuauuuuuuauuaccagauagauugucaguucuuccauaaaucaugacuucuguauguaaucagacccuuauugguuuuauauguuugauaucucauuuuauuuuucagaguguauauuuaggcagcuuuuagcauuuuauuuuguuguaucuuuugauuuuuuuucucaaauauaaguucuuuugauauggguuauaggacuuacaugcuaucauuccucaauuauuugaguucuagggaaacauggaugaugcuuuuaccuuuuuagugugcucuagagucaaucagugcuacuggcuggaccgcaauauuuauuuacuuaauuuguuaguauuuauauagaauuguguggaggguuuuuuuuucuuuuuuugguucacuugggguuuuucuugguuuguuuguuuugugugugugguuuuuuuuuuuuuuuuuuuuuuuuuuuggagacauggucucagucuguugcccaugguggcacgaucuuagccucacugcaaccgugaacuccuggcuucaagcaauccucuugccguagccucccaaagugcugagauuauaguugugagccacuguacccggccuauguagaauuguuuuuccacaauuuugguucuaagaauuuggacacaggaguaaagcauacuggauacaaugcaaaagauaauucuuguagaauuaucugaaaguuuagaaucuucugaaauuaucagaaauuuuagauagccuuuuuaucacucuuauuguuggauucucaccuaaaguauucagucacaaagguucucaaagccaguaaauguguggaagaguaaguauaugagaggauaaagguuauggcuuuguuuaaguugucuuauaaaaguauuaaagcagugccaugcauguguuuuugcuuaauaaauaauacagacauuucuuugacuuuucccccucagaggugacauugugauugcaaaaagcccaagugauccaaaaucaaauauuuguaaaagaguaauugguuuggaaggagacaaaauccucaccacuaguccaucagauuucuuuaaaagccauaguuauguaaguaacauuucaauuauguuauuuuuggugucauaauugauuaacauuaacugagugcugacaaaagaaaauaauguuuauucauauuuugaauguaagaaaaaagggcauccaguagaauuuaaauguuuauaucaagaacaauucagccguuauauuucauguauuuuaguuacuuuuaaaacccugcauaaacaucuuaguaauaauuguuacaggcaaaauuuaccaguggaugcuaaaauuauuggacaaaguuugaggagaaauagaauuuuacauaaucugaacuuaucucucccaaaauauuuauuacaaagggaaaaaaccuuagaggugaaaccugucaggcaccacuuuaacugaguuaucuucaucaucauaacacuacauaucaacauaagguagccucuggauugaagcaccaagaagggcacuugcaggaaaaaaaaguuacaaccucaaucuacucaugagaaaacauaagacaauaucaaauugagggucauucuacaauauaacugaucaauacucuucaaaaaugucaaggucauaaaaaacauggaaagauugaggcccugucauugauuggaacagacaaaggagacaugauaacuaaauggauuugggauccuggcuuagaaagauuuuccacuauuagggggaagucugacaaaauaauaacauccuauuuaaauuuugauaaucgaaauuguguguauugaaauuguauacaaccaccuugccuguacagcuagaaaaagugcaagaacaguaaaauggaagaaugaagaguagauagaauguguuagcuccuuucaccagucacauggcuucuguaacagagcuuauggggaagagauggccuuuuguuuacucagcauauacucuucuuacuugaauaauuauagcuuaauuuucuacuuuacuguaaaucuucugugucacuaucaaauuauuaaugcagcuguuuguuaacuaacauuaucucuauauucauccucaauguaaacacauaguugaauaauuacaaugucaucguaaauuuauuuugaaccguaauagccucugguugcccuauaaguaaguuugacuuuuaaauaaucaaucuuauuuauuuaccauuuuguaauagacugugguucagcuguacaaguguuuuugauauuuauuacuacaaugcuaaauacgcaguaauuguuaacuuauggugauaacaguguuaaagaugauagugugcugucagguaacauauuuuucuacggacacuguauccucuucuuaaaaaggguugauuuuccauuuaguuucaccuucauaugacuauuagcauuuccugagauauucuagucacuucuaaauuacuuuagcaucauguguguacuugaaagcagaaaugauaucaacagacagaacaaauaaauagcauccucuauguauuuaaaugccauaucauuguuguugauuucuuuuuaagaguuauuagaggaggaugucuguacaaaaggauucagauaaagucuuugcuaaguaaucagagaagauaaccagcacuguaagauguaaauuuuuuaaauguucuauucaaggaaaauauucauugaauuuuguuuuuguuuuuaauugaugcauaauaauuguacauuauuuaugggguauagugugauguuucaguacgaauauacauuguauaaaaaugaaauuaggauauuuaccauauccaucaccuuauguauuuuuuauuuccuuguagugagaacauucaaaauccucucuuucaguuuuuuuuuuuuuuuuuuuuuuuuuugacauggucuugcucuguugcccaagcuggagugcaguggcacgaucucagcucacugcaaccuccuccuccagggcucagaugcuccucccacaucagccuucugaguagcuccuucagcuguuuugaaauacacaacacaauauuguuaaccauaaucacccuacugugugguagaacaccaguaggguguucuauuaccgaguuuuuauauguuugauaaaugugcaaauuauaugacauugccauuuuguuccagguguauuccauucacuuuuguuggacaaauuuauaaguauacaguacaucauucuaauaaucuuggucagcacuuauuuuguacuuccuccauacuguugagaaucuuuucaaagguuaacuuauuuaauuaucacaacagcaacccgaugaguagguaacaguauuuuacugauagguaaucuaaagaaggaggcuaaauaaauugcccaauuucgaacagugagaggaagaauuaggauugaaacacauauaguggcuucagaaucuguaacccucacgaugccacuacuacuucuuucagaauacccuuugccuaucuauucuguuccuaugucaucaaauuauacuuacuuuaaaaaguauuugucuuuauuauuuuuaaaaaaacacagggaaguauuucugaucaggggcaguauugguucugaaagacaagccaguguuuuugaggguuucucccuugccaguuuuucuaugcuggguuauucaaguccuaagaauuguguagcuauuacagaaccgcuuuagcaaauguguuccauuaaucaaggugauuuauaacaaaauuucauccaaguuuggagugcucugaaaacauagccaaaauguucgcagggucuaccccucucgugugucccuuuuuuuagcuauuucagaagcacacuggugcaauauuuuacgaaaugaguuucuuccccuuaccucugcauccucuaagaaaaaucauuguuguuuaugagaugaagauccugcuauucauaucuugauugagcugcuuaauaaaaugaacaauauuaaaauauguuuugaauuccaggcaaaaaaaguuuauucuuguauguaggugcuucagaaagcaaaacaccaaaauuguucauuggaaccuagccuguagaguuuagcauaucaaagaaauagcauuguuuguagguuggcagaaaagaacauaaacaaaucauugguuaagugauguagugaugugggaucauuuuauucuuuccagaguucuuuuuuguuuguuuguuuuccauuccagaguuuuaaaagaccacauggcaagcaacgcuuauaaaucagcuuuauuuuuuacuguuagguauuuggaaacuaagcaguuccuauuaagaugcuguugcuggccggccgcgguggcucacgccuguaaucccagcacuuugagaggccaaggcaggcagaucaccugaggucaagaguuugagaccagccugcccagcauggugaaacccugucucugcuaaaaaugcaaaaaauuagccaggcgugguggcaggcgccugucaucucagcuacuugggaggcugaggcaggagaaucgcuucaaccugggagguggagguugcagugagccgagaucgcgccacugcacugcagccugggcaacaagagcgaaacuccgucucaagaaaagaaaagaaaaaaaaagaugcuguuugcuuuccuuauuuugaagguacugaagccaauaauucuuuccugggguuauguaugaacugagcauuggcuacuguaaagauaugagauuaauuugugacucucaaaagaaacaaauugucauaagcucagacaucuugaguauguugccuuucuguauauucuacaggaauuccucaguuugcugcuugaagccacugcuuuaucagaaaaaauaauuuaguuggaaguaggagcauguagcaaauaagaaauaaauaaaaugaguuggcauucuccuauugguuugcacagcaggcaaaaugcaaaguaaaccucuauuuaauucccuuagggaauguagggccagggcucagaaauacacuauaauuuuguuauaaagccaauuaaaagaagaagaaaagcacucauaauguuuauuaguauaauauugugugauaauccaggacuaugcuuuuaauccaugggauaacuaugaaauaggcauuuugaaauaugguaaauuccuaucaacaaacauguuguaaaaucugcaucuaaacaaacucccaugacaccacauccuccuauagggaagaguuguguauaguuacuccacucugagcuucauauuauuuuuucgaacucauuccaguuagacuuuggucuccaccacuucacugaugguucuugucaaagucgcuaaugacuucucuuguugucucuccagugaucaacucucaguccucaucauacuugaccuauuguuaauauuugaaauaguuguucucaaaaccugguuucacuuaguuuuugggacacugcuuuuucuagguuuuuuuccuaucuuucuucugaauuuccuuuauugguuccuccucauauccaaacauuggaaugaccuucaaacccugaaguuaacuaaagguucauauuuuaaacuucuguuguuuaucuacacuuauacuuuagcugaccucauccugucucaugguuuuauguacaguacuuuuuaacuuacucucaaauuuauaucaaguauaaccucuucccugaacuccagagucaugucuaauugucuaauaucuucacuuuaaugaauaauggucaucucaaacuuacuguauccaaagcuaaaauccugauuuucugucccaaaauggcuccuuccauacacuucccaucauauggggaagaaaaccccaugcuacuuguucaggccacaaaccuuagaguuauccuuacucuccucuuucacccuacauccaaucccguagcaaaucaugauuauaccuucuauauauaaucagaaucaaaccacguuuugccacugucacugcuaccauccauuaguuugcaagauaaacucaucucucucauuuuguugcaauaauuuuugaacuguuuucuuugcuuauacccuuccgauuuucuggcaucucuacccuuuccauuauacucuccacaccgcagcuaaggucauccuuuuugaugaugaugcuuuuuaagagcaauuaugucacucuucugcuuaaagaccccaguggcuccccaucucacuuacaguaaaagccauaggccuuaugguggccugcaagacccugcauaaucauuuugccugcugccuuucuuguaauuauugugucauuggaacacaauaaugcccauucauuuaucuguugucuguguuugcuuucucuaaaaugucaaaguugaauaguugugacagaaacuauauggcuugcaacaccuggacuauuuccuauuugucccuuuucaggaaaaguuugcugacccccugaucuagagcauaagauucuuggugacagggacucauuuuaaucgcaguugauuucauaucauuucaacugugauuuggcaucuaguagauuuuuuaaaauucuugaaggguggacagaucuagauauauaugaauagggugcuaguuucuuuucuacuucuacuccuuuuuuucuacuaguuucuacugcaaacuugcucccaaguaaaugcaugauguuacaacuucucagaagauguucauggagccuaccacgcugcugaacugcccaaucuguggucauucuagucuucauagacuugaaagcuaagcuauuuccagugauaagacuaccugaccaccuuaugacaauggcaggugaaaguuguagaaaauauuggaauguuccucuuacgguguaccaggagagcagagugcugauuaaauguuucuuuuccuaagugacuucuauuuaggacugcauauuuuucaggccuuucuuuaagcagaauaaaaauucaccaggcucugaauugacuuaucacuauggaauacugaacuuaguuaagauuaagucuccuaaaguauugggggaauugagguaugcugggcuuaccuuguucucauuuugaaggaagcuuuggugccccugaaaugcuauggugguuuuauuacgaugaaggcuaaguugcccuugcaacauucauugccuacuaaugagguugugugguaauaagaguuucugcauuucuguagucauacaugugccuuuuggacauauugaacuacuauacagauaauuuguucuuuugguccuuuuauugguuuauuggcuuaacgauggguaaaguuguuaccugaaguuuauaaauuucuccuucuaggauuuucugugguuuauuguaaaaugaagaaucauuuuuuaagucuuucaauuaaaaccuuauuuauugaauuuucaugucuuaaccauaguagcuacccuguauugagaauagacauauuaauagaauaugauuaugaaaauuucaguguauucugugguuagugugguuaguggauagcagucuuuugcuauuguuacaggaaacaaaucuguacuuauuagaaaaaucauguuuuuacuuuuaucugagggcuaccaaagauaucuggcuauuuaauuuaaagguuuuugguugucuuugguaccauagaugucagcauuauacacaaaaggugaaacauuguucaccaaauaguaauccauuaccacagcagagugaugggaggugaauaaguaauguaguuauuucuuauguuuuucuuugugaauuguagaguauguuaauaacaucaucauuauuacuggcagaaauguaagaaguagagacaauuuuacauuucagaaaggacugauuaaguguuaucaggauguacuggugguauaguguauuaaaauggaaauguaacaauauggcaauaauaaagcuguuuuaccguguauuagaaaauauuuaaauaaaacugauggacaaccuaagaaacaaucuuacuaauuagcauuacaaaauggucacuuuauauaguuaacacuaauaguccuuuaauguguacuguguauuuagguuauaguuugaaacccugaauauucuaaaugcugucuuucuguuuguuuaaaugucauuucccuuagcuaaaagucaaccaucuggucuucuauuaccacuuguauuauaaacagaaaaaaguacuucucuguagagagaggaaucaucagauugaaagggcuuguguauuauaagcugcugauauacuaaauccuuaugucauuuaaauagaagaacugccuaauaaugucacuuauuacaacuagaguaucuaaacaagcgacuuguuuuuugcagacuauagugauaaaaaccugugcuacacauccauuucucagcaacggcuccuaggauaaucaaucauggcauacugcuaaugccuugauugcagcugauauggaggaaauauguuuacucuuuugcuaaagugaaguucacugcggaggugacgugacuuuuucauucuauagcuaacacaauucugaagauaaauuucacucauuguuuacaagucugaaguguuuuuguucagaugucaacacuaaagaauaaucuuugaggcuccuagacuuaaaguguuuucugauguguucucugaauauuuucagaauaauuugagcuuaguuuaacaguaauauggaguuuauaauaaucuuauuuuguaguaguauauuuuauauguauauguuugaaaagauguauauaugaagaucagcaucucuguugaaagaguagcagguuguccugaaauuuguauguguugcucaccuggaaauauuuuaaccacucaaaaguuauaaaguuagugcuauugguaugaaucuagagaggcaggauacaguugaguaaaaugaaaauauuauauguauuuuuaucugcaaguuaucugggacuucuguacuuuaaaguugcuuaaaagucauuugcaaaaauuaaagaacaaaauuguaacacagguauucagugaaagcaucugaaccagacuccaaacucuguugguaguaaggagaauauauuccaagugugauguggcuuccuaaucuaaaacaaucuuuuuuauuuauuuauuuuugucuuucggagacagauucucagucugucaacccagguuggacugcagugcacaaucuuggcucacugcaaccucugccuucgagguucaagcaauucuccugccucagccuccugaguagcugggacugcaggcgcuugccaccaugcccggcuaauuuuuguauuuuuaguagaggcaggguuucaccauauugggcaggcuggucucgaacuccugaccucaagugaucugccugcuucggccucccaaagugcugggauuacaggugugagccaccgcgcccaggugcuauaacagucuuuacuagaucuacuggaaaaacugcuguugaguaagugaaauauauucaacucccuuuuggaauaagcaaguaaaugaaguuuugauguuaccacuuuggguaauuaaaauuugacagguuuuugugaacaacuuaaucuuagcccauaaaaauauucucaccaaaccaaacaauucucuaccuaaaacaagaaugaaaaaaaggaaaaauagauacaaaagcagguaugcauauuauaaaauggcuaaagauguuaaauuagcaagaaaauauuggcauuacaaguuauugcacugccaaucuggacguuagaguguuuuccuccugggacagaauuuucauaauuacuuuaagaaaauguauaaaucacuuagcauggcacagcuagugcuuguauccaacuaaacacaaaugcagagcuaacaagaaaaggagacuaagcaguauuuaacaaaguacuuacaauuauagguaauuuaaaauucuucgaugcaacuuaagauucucaucuacuuuguguacauuauguaugauucuugaaagcaagaaggauuagagaaaccuucuguugucuaaagagacuugaaauuugaccugacuucccaguguaaggaaagucaaaguaggucuagggacacagacugagaccgauaauggacuucugaccccagaccaauccuagcacucacacaucuuccuuaaugaggcugccucagaagcagccagaccacuggacuugggaggggggacaucuaaggguagacugggagagaagacuuaaauagcuuucaggaggcuauaggaguauacaaaauuugccagacauuaaccucucaacuuucuuuuucgaugugugcauucauuaauuccacagacacuuacugagcacuuacuugagggccaguacacguuaggguagucaucuuugcccccagcaacaccaauagaacuuucugaaauaauggaaauauccuguaucugugcuguccaauaugguagccacuaggcacacauggcuguugagcacaugaagcauggcuagugugucugaggaacugaauucuuaauuuuauguaauuuuaaaauuuagauagccacauauaugacuaguggcugccauauuggacaguguaacuuuaggagguuauaguuaaguuggaggaauagaugaaauuacaguauaguauaauagaauuaggcacaggugcuuugauaagacacaaggauauuuauccagacuggguuagaugggauuuuuccagaaugggaaagugaaaccugaguugaaguuuuaaaggguaaguaggaguuagucaaagaaagcagcauauucugaaggccuagaaguaaguacagcauugugcuuuuggggaacugccaaaaguaagaguuccaguguauggcacauguaguaggagggaugaguaguaagaagagauaaaaaugaaagguauaagccaagcaugguagucuguuacgugggaggauggcuugaacccaggagcucaaagucaaccugggcaauauagcaagaccccaucccuaaaaauaagaauuaaacaaggcucaguuccuuuuauguuucaagcaggggaauaacaugaucaggcuuaguuuuuauuuaguuucuguggggccauucuguuguuaguguagacuauuagaggauggcuaggauuaggagagccuggaggcagagagaccaguuaauaggcugugagugaggcauaacugagauaauaacaucgagaauaggaagaaguacaaagauugcagaaagauuaaggaaauaaucuagagaagauuggaugcuggaagaaagggaauugaaaggcuuaaaaaugacacccaaguuguuaguucuugccacagggugagugguacaauaaaauaggguuguugggggagauguuaauuugggaaauggaaagaagauauauaaaauuuuggacaaguguagaagucuacuaauaagauuaagguagauuauauuuuaaauuaauacuguggcaauuaaauuuuacagcaaguagcaaaaaaguacugcuuuccccagaugacaucuggaugcuuugcuauucccuccuugauguccauagucuguuucugucuccuagucaaaacaguguuuugaugcgcucagcccuagaucauucuuacuuuuuaaagaucuucagcuauucucuuuguaucaugcaucaucacuaaaaaaugccauccgucucgugccacugcacuccagccugggcaauagagugagacucugucucaaaaaaaaaaaaaaauucaucugucauccaccugccuaauuugcaauuuuguauucacaaaccuagauuuuauucuaaauaaucugcuggguuugauacauuagaguuguguuucgaugaguaaaacacaagcaggagaagucugucaaauauauucaacaaugccuguuuuuaaaaaaaugcaucaguaacaucaaguacaaaaauaccuacauauuuauuuuuaaucauuucuuuuuugaaguauggcaaccuuucuacugguaaucuauuucuaauacccuuucagauauaaaucuguuuuucuggccaaucucuaugugaagcagcuauguacagcaacaacaggagauugaaaagagcaacagagauucaucuguagcaauaaauccauauaggaugaguuuggauuugggaaagaauuaaguggagugccacgaauaaaacuuuugguggaaacauguuaguacauacuguguacaguaugcaucuaauuuacuguucagaacuguuuuucugagagcaugagaaaacucauuauuguaauacuuaacaccauuuucuacuacagucugaaauacccuuuguugaauuaaguugggcucauccuuuggaaggaaagcaaguauauagaucaagcuguauuaaaaugaaagugcagagauagucuuagaaugagaauauaaagugcuuuuuuuaaauccaaaucucaaaauagcagguaacauuguauuuacaaagagacagagguaaaacacagggacaauaguauugggaggcauggauagaaaggccuauaaacuggcuucagucccaacccucuucuccaucuccuacauucugacuaguugguaaaugguucugaagaaguggaugcuugauaagggccuaagcauucaauauuuaauaaacauugcuugaugagcaugcccauuuaaguucgagaccagcauagugaaacccugugucuacuaaaaauacaaaaauuagccaggcgugguggugcaugccuguaaucccagcuacucuugaggcugaggcaggggaaucgcuugaacccagguggcagagguugcagugagccaagaucgcgccauggcacuccagccugggcaacagagcaagacucugucucagaaaaaaaaaaaaaaaaagaauagaaauguuaguuuuuacugcuaaucuaggaugauuuuaucuuaaaaacugaauuucauuaaauuagguggcauaauugaugugguacuuacucauaauuaauguacauuuuuaauuauauuggauucaagucaaagacuuggguaacaccagagcuauauaauugaauauaguguaaaagaaaauaaccagaaacauaaaguaaaauagcaaagcacaguuaacuuugcagagaucuggguagacugccugggaaaccagggacaaagaaagcccaauagacauaauucacacuggcaaauguggcagcugcuaguaagugcucuuacugauugcuuccugggugccaggagucuuguuucauuugguucucauaguauuucuguaagguauuuauuagucucaguuguauugaugagguuuaaauaacuugcccaaggugcuuaacuaguaugcaaagcuguauuuggaccucaggacuaugugugacuguguggacuguauuuuuaaccacuauccuaaacagcccaccagagguuacuauucaggcuagauggagguauugagagcuuagggagaagaugaaagagcuuaucuugcaaucgccacgagaaugagcaagucaagccuuagacuaagcuuuaaaccuacucagcagggagaagcucaauaacgaaagagagacuguuaguaaaaagcauaccccuuacucaaaccccaaugcuauagguguagccuacugaaacuuuuguguaaauuccucuuuggugaugacuggcuaugaauguaagguggcaccauuuuuaagaagggaagggcaauaacaguucccagcaaugauguagauaggacagcaaugaggcugaauuuuaaaagggagaaaaggaagcaggaccguauagaaauaguacguauuaaaauagucaguguauuaacuauucugugccuggucucuacaaucccuuuauuaugcaucuagcauuuggaaacacuucuaucaggacuccagauacuccucggccuuaauuagcucagguagacagaaugugggcaaguaguuagggcgaggagaaugacaaugaaaauaaguaaaacuguuccuugaguuugcuuugagagauacccagaacugacauuucagacacucgcauuuuuaaaaauuaauguuuucucaccuuuguguucuaaaagucccuucuauuuauuguaucucagaauuuaauucuucacuuuuuuacauguguuuuuguuuauagcuucugcuggcacuauaggaaggguaaacaacuauuuacugauggugcuuccaauuuugcuguuacaugacucaaacaaacuggguuuuaugagaucuuuuuagaaaaauacuaauaaauuauucauuuucaaauauuaucucuaauagugugcauaggaucuuaauauggccacacuuugguuacauaagucaugauuaagcagaauauacaguggccacauaguagguauaauaacuugauacugcuuuuuuguaagauaauaagauaaaaaacaauuacauaauauuaauuauuggacuaaaaugacaucuuuuuaauauacauucaucauauagacuuuuuucauaggcaaggguauuaugcauuuuauagcccacugauuauuccauuagacacaaaauaaaaucuuugaaacaugcaaaaugaaauacuuuugagacuagaguaucguugcucuaucagucguuuguuuuuacuaaauagaagcaaaaaaagacuaucugauugcuuucauaaaugugugcucuuuuucuuguacauuacaggaaaaugaaaaaauaaucauuaaaaaaaggauucuaaaaacuuuguuccucaccuugcgucauaauuuuguuuguuucuuucaugacuauuguuuuguuuucuuugcggucauuuuagaaccauuaaagaaguacgagcaauagguagggccaaugcaaacccuaccauugcugguuguaaacuauaaaauauauggcaaauaaaguguuaauuaaaaaucagucuguucuuaggauuuucugguuuuugaaacuuuugaaggucaaacauacaacuauuuuuuagccagaacuuuucuuaauuagauguuauuugccuaaucaaauaaaugaauuugauuacaguuuaguaaauguguuauuugauauuguggacuguuucaucagauuucacuugaaucaagaaagguaacaccuguguauugccuccacaaaagccucuuuuguuaaauggacacccgcaggccaugaggcaauuacauuuguuguuugugcuaaaaaggaggcacuuaacuagaccucaguaaauauagcugagaacuagaggcuugauucuuuuguccagcccugagauuagguuuuaucauagcucaggaaguaaaccuagcucaggaaguaaaccucugucguagaaaggaaaaacaagaaugauuuaaaggucccuuuaaugccuuaaaauuuagcuguaaaguuagcuauaucugaggcacauggagaauucagguuugggcaaaauuaaaacaguuuauggcauucaugaaaacauauauucauauauucagucuuaugcauucauucaaaauggcauagcauauuuacaagaguacaaaauuaauccaacuuaaaaguuuugauuaugagacguaaugaacaaagagauagaauuaggcauuuccauuuugggccauuuguaaaacauuuacuauaaauguguuuauuagagugguuuucagccuuaguuguaaaguuaucauagcuuuuaaaaaaacacauuuuauuaucugucucugugagcacaaaaaaaggaaagaaaaauacauguuaaucuaccauuuuauccucuucauauuuuauuauuauaauauugcuauagaauucuuuuuucuauuaucugguuugaauuuucaacuuacugacaacuaguagguuaaucuaacagacaauaacuguguuuaaaguuagaaagaaaauguucuguuccuugccucauuccauaucaggaaagucagguguuguguuucagacccaaaccaaaaaauguguuuuacuguauguuuguuuaaauguguucuuggcuagaguaauauuuuagucaucuguagguuugaugacaguacugugaaauaaaugacaagucauuuacuuguacuguacaaagaagcauauccuacuauauggauuagagguuagguuaacucucuuuccacacuaccaaagacaaaaaaaaaaaaaaaagcccaacccugaaacaccuuuuaaaaaaauucaacaagcucccccaaccugcaucaugaaggaugaugcucccuuuuuuaaaaguaugaacaucaccaaaaggguuaagcaguuuguauuuuaagacacacauacacauauauuucuguguauauauacauauguauacuuuaaguuacuuaaauaguaugcacuggucauaaaaauguauauuuugaaauauauauuuuaaaaauuuuacaguuauacacauugcccugcaacuuauuuuuuccucuggcuaucucauggaaaucuuuccauuauuuauguauuuauuuuuacuggcuguuuacuaauauauaaaagaaagauauucuauuuaaccucugccuacugaggaacauuuaugccauugccagucuugagaugcagaaaauaccauagugaauuuccuuguuuguacauaauugccugcugaguuuggcaaaucuuuuccagaguuuugauagggaaaggguaaaaacauaaaggagacuccacugaaggggaugcaagauggagaugccaaagcacacgucacacaucaaaaauuuuagucuucacugaaaugauucucuuuauauuguugcaaguaugcuaaaaaaguauuuuaaggcugggcgcaguggcucacgacuguaaucccaauacuuggggaggccgaggcgggcagaucacuugaggccaggaguuugagaucagccuggccaacauguugaaaccccaucucuacuaaaaauacaaaaauuagcugggcaugguggugcaugccuguaaucccagcuacucaggaggcugaggcaggagaaucgcuugagccugggaggcagagguugcagugagccaggauugcaccacugcacuccagcuugggcgagagagcgacauuuugucucaaagaaaaaaaaguuuuuuuuaaauuauguaauuugaacaucugcuucuggcagugauggaauaacuggucaugaacuugcccuccugccauaaacaacuagaaaacuggacaaaaauaugugaaacuacuguuuuaauacauugcauagcaggcaguaugaaacuaauccuugagagaaaggaaacaaaauaagccuguacuugccccaacuucugucuuaaagcaguuuucagauaacaguacaaggagggaaagucaagcaaagcacagguggucuuugcugaguugagacaaagauuaggguacagguaugcuuaagugguugggauuuauaaauccgacuaccauggagcaaagagcuaaagaaagaucuccagaaaucuacguagauauucccuuggcuuugggcucaauacuaaauugugccugcuuauggugaaacuuaaagagacugaggaaugaaugacugcuggggagcuguaagccaaaaaggucccagaacucacacagagcugagagacauuuguguucugaccagccaguguggacagaucuuguugauauccagaacuuucaguagagacucuggaaaaaucaaaucuuagugguaggacuaaaauagcccuuagaauaaaauguaagauaaagacccaaccuagcaggcuuauaaacaaggcuugaaaggaauaaggugacugccgcuaacuuaacuaccucacagaaaccagacucccucaacauucaacacucuauaaaaacagacaacaaaaucuacucagcaagugaguguccaguuuaaucagaaauuaccagauaugugaagaagcagaaaaauguaacacauaaucaaaaguaaaucaguuaaauagacccagaaaugacagaaauuauggaauuagcagagaagcacucuaaaacaccaauucuaacuauuuuugaggaucuagaggagaugaacauauugaggaaauaaaugguauaagaaagaaccaaauguaauuuuuagagcuuaagaauacauuugguggucuuuaguagaucagaaacuacaaaagaaaagaucugggaauuugaagacagcaauuaaaaguauacaaacugaaggaaaggaaaaagucuggaagaaaaaaaaaugaguaacccauaggacaggucaagcagauuaacaugaaggcuauggaugccccaggauaguggguagaagagaaggugaucuauacauuuuuuuccaauuuuguccaaaaugaugaaucagagauccaagaaguacagaaagaaguucuggccuaauacaaagaaaaucaaaccagggaagacagagaaaaucuuaaccagagaaaaaauauauuacauacaacugagaacaaggaguuucugcugaucuauuauaaaaaacagcaagaaaagaaaaugaaaucuuuaaaguguuagguggggaagcacugucaauccagaauucuguauucacugaugaggaugaaaauauacugcugcgaaauucuuuccuuucuuaccuuacaugaagugguauaauaugugaagauaguuauaccugaagaaaagguggacugugauuaaugaugcauauuguaaacccuggaguaacaacuucaagaauaagaucuauguuaaauauggcaauugaauaaaugaaaaaauucagaaaaauaauccaauagagaggaggaaaaaaggaaacaaaaacagaugcaacaaauacuucacaucaugcacagaaguuaucucaaaauggaucacauaccuaaucaaagcuaaagcuauaaaauuuguagaauauaguauaauauguucauaaucugggggcagguaaagauuucuuaggacacgaaaagcacgaaacacaauaggaaaaaaaguaugaauuggaccucagcaacauuaaaaacuucugcuugucaaaacaucauuuaaaaagaugcagccugggagaaaauauuugcaaucccaucaaaggacuuguauccaugguaaauaaaggacugguacaaugaauaagaagauaacccauuuuuaaaauggccaacauauuuuaauggauacuucacaaaagauaauacuaguaugcauaauggaaaaaugcuuucaucagagaagugcaaauuaaaaccacaauuuaauauccuuaaccugcuagaauggcaaaacauuuaaaaacugauaauaccaagugcuggagagguuguggaacaacaggaacacagucauacauugguuguugggaguauacaauaguaucacuuugaaaaagguugguaauuucuuuaagguuaaacauagacuuacugaugacccagaaauuccacccuuagauacuuacugaaaagaaauaagacuuguacaugaauguucacagugcuuuauuuuuacuagcaccaaacugcaaacaacccaaguauccaccuccaguuucauagauaaacauugugguuuacaguggaauacuucucagaaguaaaaaaugaaugacuuuuacauacaacauagauuaaucauaaaaacuugcuaagcaaaagaaggcagacacaaaauagguacuuuguaauuccauuuauaugaaauuaagcaacaggcacaacuacuaucuaguaacagaaagcaguucacucguugacugggucuaggcauggcgauaggaacugacugcaaaggaacagagggaacuuuucggcauggaagaaacauccuguaucauugugguugugguuagauggguauguacauuuuucaaaacgugugucaaaacuuaaaacaggugcauuuuacuguauauaaaauauaccucuauaaaauugauuuuuaaagugaaauaaaguucucacucuuuucccccauaccaaaaauaauuauauauuuaaaaggaggaguaauugcaaacauuauguuuuuuuacugguaaacugaguauggguugagcaucccuaaucugaauaugcgaaauccaauaugcucccaaaucugaagcuuuuugagugccugugugaugccacaaguggaaaauuccacauaugacuucacaugacgagucauagucaaaacacagucaaaacuuuguuccuuggacaaauuauaaauacuguauaaaauuaccuucaggcuauauauauaugagguguauaugaaacauaaaugaauuucauguuuagacuugggucucuuccccuggauaucucguguauaugcaaauauuccaaaaucuaaauauaugaaaccugaaacacuucuggucucuagcauuucagauaagagauacucaaccugcaacuuauagagguggaucagcaaagaugccugcuuuaauuuuaaaagaucuguacguagagguuuucuuguuuuauagagaucuuguuagauuaaagguaacaucagugaugaagcuguuuccuugauuuguguacuuuacaugaaguguugucugagauguaggcaaucccuuuacuguaaauggaugcauggucauuaacauguauggauuucagguaaugaggaguuagcaugucucauauuugaaccuauuucuuuuuccuugacuaaaugucaaauuuaguacuucacagguuauuuuaaguaucaaaugaaaggcuccuggucauauguucuagauguuuuuuuuagaagauuccuuucuguaguuguuaauuauauuacuccagcgaugguugggcgcacuggcucaccccuguaaucccaccacucugggaggcugaggcggguggauugcuugaggucaggaguucaagaccagccuggccaacauggugaaacccugucucuacugaaauagaaaaauuagcuggguguggugguggacaccuauaaucccagcuacuugggaggcugaggcaggagaauugcuuaaacccaggagguggagguugcagugagccgagaucacaccacugcacuccagccugggcaacagagcaagacuccgucucaaaaaacaaaaauuacuccagagaugaugucgcuaauuugaaagaaacucaggucauaacugcuacaaaagugaccuagcuaauggcaguuaucauugugcuuucaaagaauuucuauuuacaaguauuuaaccaccagcaaauaucugaguuccacuuuugguuuagguacuguaaauaauuaaaaucaucuuuuaaaaagcauauggauauaaaaguaaauacugcauaaaaaacuaaaaacuuuguggaacauaauauaaaaagacaaaaaauagauugggaaaaauguuugcaauaaauguauuaaucuuuguauuauauaagaaauacacauagauaggaaaauugagaucccaaagacuaauauaugcaaaaguaggcacagacuauucacuggauauuaaauucaaucagaaaacacacagaauaauauuugacacugccaacaaucaaauaaaugcacagaaaaauauuaccaagguauuaaauuaguuauuauuuacaaaaauuaaaaacguucauccaagccuuauaaccauuugucaggauguacucccaaagaauaaaacaguuaaauguaaaagaagaaaccaugagaccuuucuaagaaagacucaaaauucagaagacaugaaagcaaaggcucauaacagaaaugagaaacugggaauauuugcuauuuguaccacaaagggcuaaucucccuaguauugaaagagugcuuaugaaaugagggaaaaaaaggagaucaauccaguagccaaauggcaaaagacaugcaaaaagauaucacagagaaggaauuaaaugccucuuaaacacgaaaagaagauucagcuucacucauaagacaaagguaucauuuuuugccauauauauuggcaaaaaucuauuagauuggugcaaaaguaauugugguuuuugccauuaaauguauuuugcggcaaaaaccgcaguuauuuuugcaccaaacuaaaaugcaauaaaagucaaaucauggcauuacugccuguugguuuauucugguauaaaauaguaaaaacugacagaaaagccaagcagguuaaaaauaauauuaaagguuauaauguagggccccaagcaaggcugacuuuguguguuaaguauuggaaacaaucagguugguaagggcaggcaaguuuagggaaagcuucaugaagagauggaauguagaaaccacugauccugguucaaugggauggucagacaaagauaucccuagauuguugauaguugccuuauuaguuugcauaauguuuuaauuuuacuuuuacugguguccauaacuacaugguuuuauuuauucauauauauuaccuguuuuuagaacucaggaaaaaacacauuuuaggaagaaacuauggaaauuuagacacgaaagauguucaccuuauagcuuuaucaaauaacacuucagaauguuaauuacauauggcuuuuccaaauucauuauuuuguuccuuuuuugaugacugugauguacacacuuuccuacuagagcagucuuacacuucacugcacauaugucuauuuuauuagauagcaaggaaguggccuugcuauuggcccuuggacaaacuaguuccaguaauaaaagugaaugaucauacaguuucugauauucuuucaguaaacuuauguccuuuuucuacaaauagauuuaauguuuaaauguaucuaaacgcagaguuaauuuggagauuuuuggcaaauauuuguacauaagacuuuccagaaucuuaaaaucgcuuacguaagugaaauucaaauuuuacauucuuguauacauuuacuuuucaagaaaguaauuugugauuaaaaaaaaaaguugcauuaucucuuauuaaacccaguaguguauuuuucuucauaaaagguuuacaaguaaaaccagucaaaagaauagugaaaauaaauuccuuccccauacauagaucauuuuggucuggucaauaauucaacugucuuagauaacaaaacuguaaaauaaaaacuuuuaaaaagcaauuuuaaagauuguugcuggaaaguaaguuuuuuaguuuacauugaacagaaauaggcaaaugucucauauugcagguggcuuaaaaaaaacaauguauucuguucuaaauaugcuuaugauugucacugaguaaaaaucuuguuauuuaccaguuuauacauagaacauuauaggagauagucuuuucauuuaggagaaggucaccaucauuaauuuuacaacugaugauuuuauaauagguccuucugguucuucauggucauuauugaaguauaaugcauugaagauauggccuguacaaaggcagaacagggauguuaauuagaauucugacaagccuacuccaauaaaaugaugagauuauuuguaauugaugucacaaucaauuaccauuuaguucaucaugagcauucuaauagguuuggcuuugguauuggccccaggauguugcugagugaguggcugcccugcuuauacuguuauugagacacaagggcgcauuuucagucagcauccuaaugaccucuuuugaagucuauuaaauuaaugacccugucacacuauuuugaucucuuauaaccucaguuugggguuuguauaacaaauuaauauuugggaaccauaugacaaaaaaagaugauagguuuuuaaaaaaguugaaaccuuugauauuuaguaaaaguuauugugcaagaaauaaaagcaaaaaugcaauauuaggauuuguaucuauucuauaaaagagagccuuaggacauuucucccuaccucugaaugacaugcuuuuuaauuauaguacccaaauuagguuuuaucuuuaagaggcugcauuucuucucuaauucuaggugccaaugggucauguuugguuagaaggugacaaucuacagaauucuacagauuccaggugcuauggaccuauuccauauggacuaauaagaggacgaaucuucuuuaagguaccauuuucugcuuaaaauguaagguuuauuuucugagcuagaaaaaguuucucucaaaaugaucucugaaaucuucaagcugucaguguacuuaacuguugcaccgaauauauuuuuugaaccuguuggccuuaacuuaauagccauaugcaaaccuauucccccauugccccugcucccauagagauaauaauaaaauccaaacuaccuuagcuauagccuaagaaaacuuuaauuugaauuuccaaaaguucaguucucucuuguacaacucuuaaaaccauguucacauccugcccagggcauauuuuaauaagcaugugcagaagaacagucuagauucaaacuaccuguaaaguagggauaccccaguugaguacugugagucacagacuuauugugaauguaugauuauuagggaagauuguuuucacuggccccuccuuuuuaucacaaucagugaggagaaaaacauucaugaauacauggagcuguuggauaauuuacaggauucuuuacauuuaaaacagaugccauauucaaguacuuaaaccuaagccccuuugguugaaaguacacaguuaacucuuacuugcaaguaguaaaagaaaacacagaccauauauucauacauauuuauucacacaccacacacauauaauuucauguacauuguuugaaugucccaaacuuuggaguuuaaacauauauacacauaaguuuauuuucucaagucuuacuuugauguagaaaauuuuauucuugauugaugaguaaggagaaaguguuuaucuggcauagagaaaagggacagauagcaaaagggaauaugaugauacuauaacauuacuuucacuaauugucuucaaccucauuuugauuuuacagauuuggccucugagugauuuuggauuuuuacgugccagcccuaauggccacagauuuucugaugauuaguaagcauuuauucuuuugacuugauuauugucuccuuuucaugugaauuuauuacucccguugaaaccguguacuuaccaauaaacuauuugcuauuc

SEQ ID NO: 191214 - RNA, 107765 nt, Homo sapiens
agcugcgcgcgcacccgcaucagcuggcgccgggauacugcaccugcgaccuccuucucccucacccugcugcccagucaggccagccugcguggccgucuccuccucuacugggacccugaggaagaacgacgagggggugaccugcgccggggcggggguaggggagaacgcgccuccggcaaaggggguggcucguccugucacacgcaggagaaaccuagcgagcggaccguggcucaguggacuagcuacgacuugccacgacucugagcugcaguccgaggugucuugauccgcuaaccuccucccagaccccgaggaccuuucugcuaggagaagagcgggcgcgccacccccaccgaccucucggagacaggaauccgcucugccccugcauccuccucugcucacccuucucucaguaguguggguuauuuuucccguuaugcaugugcaccuuucccaccagacccaaguggauugucgacaucaaaaacaccggguggcuuugcauacaccuccccccagccagaccugugggguauucaccugauacacaacagguggccggguguacaccuuuuagcaaucugauccacgcuauagucgccugauaaagguuugccugcacgcacuucgcccaacuagaaccgugggacacucaccagauaaaggacuaccucgacaggaaacugggggcugaggggagggaggcuucaucugcugcccugagaccauggcacugagccuucagccccggaccagagggguuagcuagguagcucuucauucugaaggaaagaagucacacaagauuggcauuguuuugucuuuuuguuuuuuguuuuuuucucucuuaaaaaauauauucaccuauuggugaugcacuuucuaggacagucggcuugaauucugaguagaaguauucuuaguuggggcuuuuuguguggugugaaucaagguuauugaaauguguuauuuuucaaguuaucuuuuguauugcagucaaaaguagcuagcguaagaggaagauuuugcgagguuccccccacuuuuuuuguucuuaaaaagaacaaaaugcauccuccagaaaccaccaccaagauggcuucaguucgguucauggugacaccgacaaagaucgaugacauuccagguuugucagacaccaguccggaccucagcucucgaucuaguucccgaguaagauuuagcucccgggaaagcgugccugaaacaagccggagugagccuaugagugagaugucuggggccaccacuucgcuggcaacuguugcacuggauccacccagugaccggacuucucacccccaggaugucaucgaggguaaguagaaacacagaccgcagcauacuuucauuacuggguucuuuauccaagaugaccaucuauggaucuggaagaucauaaucauauaauuaugauuauaauagucaucaggaaccaaggcaucucuuugugagaugcuuaggaacucuuuggaauaauagcauaguggcucuuugcaguaguaauuugguaugugggaagguguaugacaagaaggaaggcaaauguauauuuuaacuuccucauuuuugucuucuuagaaaugaaauggguauuuugguuaaaagugaauaucaaagaauguaaucguuuucagcacacagaauccuaaauuuuaaaauuuagugaguuggauauguguucuguagccaucauuggcuauuucagucugcuuuaagacugguuucauggaguaguuacuggucguaucuuagcagcuuuccuccaagacuucgaauguguauugcaaaauucuuuuuugaaaucuguauuuuuauggagaccuugacacaaguagcuaagcccacucagggugaugguggguagaccuaaugugcuauucugucaaauggaagacuucugaaaaggcuuuuagggccugauucccauguaauuuauucucucugagcuuuagauggaaagucugaugauuagaguuagcagguagcacacaagccacuccuggcucauguugacugcuacagaccuuuagcuuccuaaaccaguuugugugugucagcuggcuugguuuuauuugagguacugggaagaggugauggaagagagagaagagagaaaauggggagaucauaacauuuuuuggacucugaaauuuaaaaguuugagaccuguacugcuuuauauauuuaguuuuaugcuguguuguaacuaauguaaucuuuuaaugauaaaaauuucccuuaaagacucuuaaaauaauauuccacccaaguuugaaaaccauagccucacccacugacuugugaaagcaaggcuuacucaccauuuuccggugucaggaaauauuguuccuuuuaaccuaaaggguucaggaaaccagaaugauuuuaguucccuaauucuguuuguguuuuuaguaucuggagacaagguagauuugguaaaguuuacaguccuagaauucacucauccuugacuaaucauuuuuucuuuuauggagacauagguugguucucagacuuuacuguuuucaacuuuuugacaaauuuuacagugugucauacacuggauuaaaauuacaguauggaauacaaauuuaucauuuccucuuccuccaaauuaauuccaaauugugguuuuaguuuuuauccaucaugcuguauuuagguuguaaaaauuccagguaaagacuauaccaguguuaauuucuuaauauuguaauuaucauuagguaauuuauaguuuaguuuguuagacuugugacuuacauguuacagaauuguauuuuuauucuuuggaaaaguggacuuaguaauguguuagaccagcagaacagguuccuuguccagucugcgguucuuacguuacccuuaagcauucuuuacagucuaaagugguauccuuuuacacuauagggguaaaaaugggacuacagggguaaaaauggggacauaucuaagugaaauuuauguuuguuuacgugguuacagauguuaaaagcuugguucucuauauaacacauuccuuacuuaauguuuaaauauucuccgguacccagaugaaagggaaauuaauagucuggccauuagagaggacuuugcccuauucucguggaacuuuauacuuucucagugaccuaccuuuucucuuuuuuuuucuuucuauauuuaaaaaaauucuuaugaugacugucaucaugugauaaauuuuccccaccauuagaagaaaccacuuagaaacacaauuauuucacccuugacuucucaguaugugaaagcccuuguuagauuuagauguagaucuucaaagggugcuguugugaagaaaagggccuaauguuaauauacacuucccucuaggcuggcuuuaauauagauaacaacugcauccuuucuacaguugacucuccuuaagcucauagugcauuucacaguuaguuugcuauuuuaguauuuacaguucucugaauuuuuucacccuuuguacauccuucugugguugugacauuaguaugauucuccuuucccccaugccucccacguuucuuccuguagagaaacuucccacccgaaguuucuugucauaugucuucuacucacauuacaucacacaaacaggaggugacacaugaaguuuuuuuuguuuuuuuuuuuuuugagauggaguuucacacuuguugcccaggcugggguacaagggcgcaaucuccacucacugcaaucucugucucccggguuccagugauucuuuugccucagccucccaaguagcugagauuacaggcaugcaccaccacaccuggcuaauuuuuuguauuuaguagagaugggguuucaucauguuagucaaccuggucucaaacuccugaccucaggagauacacccaccuuggccucccaaagugcugggauuacaggcgugagccacagcgcccagcccuacaugaaguuuuaaauacuuauuucaguauauuuuaauuuuuucugcuguuggcuuucugaguaguuuucuuucugcuaucaaaguaauuuuucuuucauuuuggcaaggcuccauuugaauuuauaggacuguccaguugguaaaaucaagaaucuuagcaguguauuagcuuauguaugaagaacgccuuaaagauacaaaagaaacuguugagaguggaugccucuggaaagugaguuacaaaaauagaguggagccaggcacgguggcucacgccuguaauccuagcacuuugggaggccgaggcggguggauucccugagcucaggaguccgagaccagccuggggaacacggugaaacccugucucuacuaaaaauacaaaaaauuagccaggcgugacggcgugcgccuguaaucccagcugcucgggaggccuugacaggagaauugcuugaauccaggaggcggagguugcagugagcugagaucacgccgcugcacuccagccugggugacagagcgagacucugucucaaaaaaaaaaaaaaagaaaaagaaaaaaaaauagaguggaauuuucuuuuaccaaaacaauuaagggcauauacaacuuuuaaguauuuauaguguaucacuuuuauaguaauuuuuuugaaaagcaccacauguuagagcuaaugaucuagaaucuuauucugaucaaaccacauuuuaauaagugaggagacuuaaaaccccaauagauuagacuaaaaaaauaacaaaauaaaugaggaaacuaaggcuuauagagaugguuauuuguagaucacaaaguggcaaagccaagacugaaguucaggccuccugacuuuuaucuagugcucuuucuugcaucauuuugccucugcuaugaugaacauuuuuuacaugugcuuuauaaccauguggcuauaaaacauauuuuuauaugucauuugcaggaccuaauacuuuuuuucuuuuucuuuuuuuuuuuuugaggcaaagucucgcgcugucgcccaggcuggagugcaguggcgcuaucucggcucacugcaaccuccaccucccugguccaagugauucuccagccucagccucccaaguagcugggauuacaggcaucugcaaccacacccggcuaaauuuuguguuuuaggagagaugggguuucaccauguuggccaggcuggucucaaacuccugaccucaaaugauccuccugccucggccuccuaaagcucagggauuacaggugugaaccauacacccugccugcagucccuaauacauuucaaccuuuuauaagucaacagauacucccugagacgcugguauguaugaggcagucugguauuaauuguaggaaauauacagguaacauauaguuucuaccuuugcagaucucaugguauaauggugaaaaugacuagagcacuuuacuuauuccuucaccaaauauuuguuacucugagcaaugaguuaaggauaaggcacuggcuggcuguuaaagauguuggguguuaaagacagagaaaaagcauccguuaaucuguucuaaggaaaguuaugaucuaauagacaaagcaaacacauuuguauauaaauuauaaugcuguauaaguccaacaauagaaauaugcaaaaauacggcaaaggaaaaugaucaacuaagauaaaauagagacacuuaagagacuggaggacuugauaagguaaaguguggugaaaaguguagaaagauuaaagacuguggucagacgguugaauguuguuggagugagcaauuucagagguagagcauuucucauguaaugugaucuaguguguagccuuggaguggguuucugaaguggagaguugaggucuaaguguaacaacuuugagacuggcuguuaaccaaguuuuugugagagauguuagagacauaaaaguaauuuagauaaguccuuucuuuaaggagucauguccucucugaaaccuuuucugauugaaccccauauccagauauaauaaaccaggcucuuuuugucccuauauugcuauaauaccuauaucacuauauuuuguuuuuauuuacauauuaucuuucucaacuaugcuguaggguucuugaggacaaggauacaaaaucauuuacaccuaguguaauaugugauaucacauauaacuuguacaccauaaauauacauugaguugaagaucuuguagacuuaaaaacaagagacaaauuaaaaacguacucugauaaaggcauauuaauguauguacgagaguagugcuacuucaucuggcugcauaaugaaugaucuagagagcuuuucaaaaaaugccucuaggcugggcgcgguggcucacgccuguaaucucagcacuuugggaggccaaggcgggcggaucacuugaggccaggcguucgagaccagccuggccaacauggugaaaccccgucucuacuaaaaauaugaaaacuuagccagguguugcggugcaugcuuauaaucucagcuacucagguggcugaggcaugagaaccugggaggcggaaguugcacugcagccuggaugacagagcgagacucugucucaaauaaauaaauaccucuacccugacaaacaaaaccuaacaaaaaacaaaauuaucauuuuuagucacacaccaaaauaagugaauuauauuguuuugcuaaucauaggugacuauuacuuauuauuauuauuguuauuauuauuuuuugagacagagucucacucugucgcccaggcuggagugcaauggugcggucuccacucauugcaaccuccgccuccuggguucaagugauucuucugccucagccuccccaguagcugggacuacaggcacgugccacuacacccagcuaauuuuuguauuuuuaguggagauaggguuucacuauguuggccaggauggacuauuaccuuucucuuaaauaagucuucuauauuauauaauuauugaauacuauccauguuuuaccucagcauucuaauagcuaaaauauguugauuugguaccuucuuagcuugucugaaagaagcauccucuugauaguuuuguuuuuuuuguuuuuguuuuuguuuuuuuuuugagacagggucucauucugucaaccaggcuggauacaguggugugaucacggcucacugcagccucaacuuucugagcucaagcaguccuccaccucagccucuugaguagaugggaacacaggugcacaccacuaugaccagcuaauuuuuuuuuuguagagacaagguuuuaccauguugcccaggcuggucucgaacuccugcauucaagcaguuagcccaccucagccucccaaagugcuaggauuacaggcgugagccaccgcgcccagcugguuauauaccuuaacuguuuuuccucucuucucuauacucuguagccagauuaaacuuuauaauauacugcuuuauaccacaagaagcaaucagccaaauccagaauaugggaaguuuuauuggauaacuagauucuucaacaaauaauugggaugggguggaggaggagugaugggaagagagggaaagcuguuacagauaaaaagagccguaucagccaaaugcagugugugaacuugguuuggauucugaugugcauaaaacaauugaaaaaagauacuuuugagacgagugggggaaauuugaacauguacaugauauuaauauuaaggaauuguuaauuuucuuauagauguuuaugacauugugauaauguaaagcuguuaucuauaaagauauauauugaaguauuuacagguuaaaugaaauguacuccagcuccuuccuccccacuccuccccaaaaaaguuggggagagauagacaaaacaagauuagcaaauguuuauaauuuguugaaguagaguaaaagguacauuuuacuauuucuuagcuuuuaucuuugaagaugucugggaacuccugagcucaagugauccucucacuugggucucucaaagugcuaggauugcaggcaugagccaccaugccuggccaauuuuuaaaaagguuaaauuacaauuaaaggauuuucuuuugaguguguccuagaaugcuguagauauuugauuaaauaucagugaucaauacagugauuaccucaacuucuugucuuugaucuucgguggucucuucuguguccucacuaagucuuuccaucaugagcccaaauucuuuuguucucaguggcauguuucuagauuccagauucucauaaauuuugauauuaccuuuacuggaauggaaggaaaugaaagaagguacuccugcaaaccugggaaccuuaugaaaguuaugcuuucccauuuuaaagcuguuagaagaaggggaauguuucuaaugcugauguuuaaggcaacuuauaaugcuguaagcuuuugaauuauggcugcugcuucuuuugcccuucgugucuaacauauacuucuggacuacuaagaacuuugugcaaauucuaaaaaggcacuccuuugugcccugagccaucaugacuucacuggagaagggcaagcuggauuucaacccucuuccccuugcccuucuggcuuaaugcccucgugcacugucuacacagcuguagcuggugagcuuguuguuucagaauaaugaaguuacaugaguuuaaguuuuuggugauguguguuucugaggaguagguaugaaaguuuggagagcuauaguguaggaauuaugugagcauuugaauguuaaaacaauguauucuuuuaaugaaguuuuauaaguuuuacaaguauguggaaaaacaagaagcuauucucuguuaaaacccuguaauuagugcuucaguguauauauguuuuuauuuuuugagacagggucuagcucuguuacccaggcuggacuuggguaggcaguggcuauucagaggcacaacuguaguacacugcagucuugaacuccugggcucaagccaucuucccaccucagccuccugaguagcugggacuacaggcaugcaccaccaugcccagcuaacuuuuguauuggcuuuugguagagaugggguuuugccauguugcucagguuggucucgaacuccugagcucaagcgaucugcccaucucggccucccaaagugcuaggauuacaggugugacccaccgcaccuggcccugguauacuuuuaagaaucucaacaauuacauuugaagguacaagcacaaaacugcagaacauacaacauauacacaugcauacagcaccuugccuuaaugguaguucaguaccugaugaguaggaaacacuaucaccauauuugcucagcucuaagguguguacauuaccauauuuuaacauuucugauauucaggugcgucuuacuuuugaagaauuuuuaagcuacuguuaaaguggaauuuauacuuaacaagauuucagaaucaagucaguauuguaaauaagucagucugaggggcuuugcgaaaccugaaguuuugaaguuaccuuuggaugucuuaacugaaaaaaauguaacggcugaaguuuuuuucuucuuaaaauuucaguuuuuguaguugaaaacuguagaaauagaaaacaaaagccacauuguuaggaaaugacaggucuucuaauuuuagucuuuuuuuuuuucuuuuuaaaauuuccuguuaucuuagcucagagcuggguuucagucuccaguuuucuagcuaauuuaaccaauggcagcuuuuuguuuguaguuuuauuacggcauugcuaauccucauuauauuugucguggccuugagcaaaaaacucaauugaugacauucaccuguuuauagucauaaccauuugguaaauaacuuuaauuuuuggcaaaguagcaccugaauuucucucauuuuaccagacaggucuacauuuacuuugggguaaagcuauuuauuuuucauauugcuaguuuaaaaaaagagagaagagagaacacuaauaaguuaaaaacucuuauguacacauccacguuuucacuuugaggagcuaugagaaauugaaucuaaccaaaauuuacuuuuauucuauuuugagagcauuugcauuuaccauaucuaauuuuuuuuuuuuuugagacagagucuugcucuauugcccaggcuguagugcagugaugcggucucggcucacugcagccuccgccucacagguucaagcaguucuccucccucagccuccugaguagcugggauuacaggcgcaugccaccaugcccgguugauuuuuguauuuuuaguagagacgggguuuuaccauguuuaggucucgaacucuugaccucaugaucugucugccucggccucccaaagugcugggauuacaggcgugagccacugugccuggcuaaaguuguuuguuuguuuuuuuaacagccuuuuuuacagcuggcuaauuuacauccuaagaugcaaacaaaagauuauguuugguuuauuuauuuuuuucugguucagcagcaugcuacauuucaaaugaaauuuuaagaauugauaggaauagaaaaauauucuucccuauuagaugaggucaguucuuuccccuuuugaaaaaugaucaguuuugguauuuuuucauuuuuuaaaaagucauuuuauucuguacuaagaugaaauuuuucuuauccaggagaaaccugagguugauaagguuaaguaacuugcccaaggucauacaaauaauaaguugaagaauaaugauugaaccuaggcacauguaauuccaagaccagaauuuuugucauuacacugcauuuucucugguaugcuaauaauaguuggcccuauugaaacauuuauuaagacauaauugcuagccugggcaacauagugaaaccucaucucuacaaaaaaaaaaaaaaaaaaaaaaaaaaaagcagccaguugugguggugugcaccuguagucccagcuacuugggaggcugagauggaaggauugcuugaguccgagaggucaaggcuauagugagccaugaucaugccacugcacuccagccugggugacagagcaagacccuguaucaaaaaaaaaaaaaaaaaguaauaaaaugacauauucucugaauaacuuagauucuauguucguaaaaagaaaucuggcauaagaauagguauuucauugucuuuuacacaaauuaugugccuagagcaguguaguagugcugaguuacaucaacaguuauugauuuaguuacauuaaucauucuguccuaaagcuaaugaagauuuugacccaagucucaauagaucuaaaaaauuuuguuuuggauuguguuuucauuuuccuuuccucacauuuuuagaaauauguccuuaguuuuaacaauauguugcuuaaugucagguuuauuuucuauacacuuuuuuuguguugacuaggagcccguuuuuaaucuagcaagcauuucauaauggaugaaugaaauaucuuagaucagaaaugaaacccugaguaacugaaugucugucuucauagcugccagugcuacccucuuugguugggauucucagguccuaucugucauaccugggcuauauugacauuagacuaaggaaaaagguggcaaccuuuuauaaagaguugugauaugcugaaagaggcaacaguggcaacugaggacucagaggcauuugauaaugccugcuuugguauuuggaucagcggccaaaauggcugaaguagcuaucaaauuagcuagccaucaacuauccuacucuauucuuuccucuagugaagacacaacuuuuaggaaguugaaaaaguagcugggcagguggugguguguuguguucucaagguucauucucuaauuauagugcauuggacguauaauccuaguuuuguauugccuuugagucuauaguuaauuuggauaauaagacugugagcuccuugggcaggaacagugucuugcucuccauuucauuccuauuucuuggcacuuagugggcacucaaauauuauugagugaaugcaugauccuuucagccucaguuaaagcaugagauuuuccugaggcuuuaacuuggagaacucuuugccuuucuuacucuacaauaugaugaauccaccagaaaauaaugucuuuuauauauuuauaaauauauaaaucaccaaccaaagagguagcacuggcagcuaugaacacagacauucaguuacucaggguuucauuucugauguaugacauuuaauucuucuauuuuuaguuuuagccuccaaauucauuauauauucaccacugauaacauuucauaaaaaugcauuuucauagacaguuucaagucaagauuuaaaagacuuaagcuguaaguccuuaccaucccaugauaguuggucuuuaccaaaguaauugaugcauucaauucuuuuaauaauuuuauacauaguaaggcaaaauuuagaauuugugaucuuuuuuauauuuuucacuaauauuuccugucucaguugcagagggauaagaggguuugcugaauaugauaaauaaggaaaauguguauacaucuucuacuuaagaaugagacuauaccuuucaggcucugcuauaguaguagcccuaaauguaaguggugaacagcucauucuccuguaagauguuuauagcauuuucuaacacagaacuauucagaguguaguacgagacagugcuggcccaugagcuguuuauuauuugugaggagauaaguucagaaauugaguuuuuagaaacuugcauagcaguuugauagaacaaauuuaugucugucaaaucuaauaauaacaaauuggggcuuauauuugauauauauuuauuuuauuuuucuaguaauucauuuuuacuauuuuuuaacaaaauuauuggcccauaaugaauuggaaauucaaagaaaaaaaaaguucuuuaccagagauaauuugcaaagcaguguucuaaaacagugguucacauccuuucauguucgccuaaccuucuaaaugauaccacacucgagaggguacggaguaugggauauagagugcucuuucccuaccgguagcccucugauagagaauccuuauauugaaaauaauuucccacugacuuucccuuaauuguuucaaucuuuucacuaaaucuaacuuaaaauuuuuuuuuaauaaauggguuuaauaaaacagaacagugguuauuaugaguucugagcuaugcuaguguaacauauuaaguugcaguaucaaaauacuaccccaaaauagacccauuccucugaagaaugggcaugcuaacuauuuuuagcagguauaauauagucacaaauaauguguuuuacugaaacuaauuaauaacauaaauacaauauguguaagauuuggccuaauauauaaagcacuaugggaguaaugccauuauaaaugccccuuuugcccuggccugaccuuuauaucuuauuacuuaaaaauaccauaauuuuuuuaaaguauacaaauguaaauauuucauaccuguaugauuccuguuuaucguugaauaauaauucaucguaugccauguacugcagguugauuauuuuauugauggauaucugggcuguuuccugcuuggguuuuuaugaauaaagcuguuauauacauauuuguuugaauuuuuguggacuuacgcuuuuauuucucuuggguaaaaauacagagaacaagaauugcugggucuuaggguaggcauauguuuuugauuuauaaaaaaacuacuggaacuuuuuccaaaaugauugugccauuuuacacuccccaccaauguuugugcuacaucuuuaccaaaagucuuuuuuuuuugagacaagaucucacucugucaccuaggcuggcgugcaguggcacaauuagggcucauugcagccucagccucccaggcucaagcaauccuccugccucagcugggacuacagguauucaguagcaaaccuggcuaaauuuuucugaauuuugguagagaaaggguuucgccauguugcccaggcuagucucaaacuccugagcucaagcaguccuuccacuuuggcccccaaaagugcugggauuacaggccugagccaccaugccuggaugccaacagucuuuuaaaucagcaguccccaaccuuuuuggcaccagaggcugguuucauggaagacaguuuuuccacagacuaaggucggggacaggcaugguuuuggcaugaaacuguuccaccucagaucaucaggcauuagauucucauaaggagcacauaauuuagaucccucggaauugcuguucacaauaggguuggcgcuccuaugagaaucuaaugcugccgcugauccgacaggaggcggcucucaggcgguaaugcuugccugccucucaccuccugcugugcgggccccguuccuaacaggccagggaccaguaccaguccauggcccagggguuggggaccauuguuuuaaauugugauuuuaauuugcauuucccugauggccagggaugagcacuguuucagcgguuuuuagugguuugcauaucuuccuuugucaguuguuuaaaucuuuugcccauuuuauuugucuucauauuauugaggcguagggaauuuuuaugucuucuagauacagaucuccuuugucaaguauauguuuuaugaauauuuucucccagucugugacuugccuauucauuuucauaaugguguccauuguauuuuuucaacauuuuauuaugaaaauuuucuuuuauuuuuuucuuucuuuccuuuuuuuuuuuuuuuuuuuuuuuuugagacagaguuucacucugucgcccaggcuggagugcaguggugcaaucucagcucacugcaacuuccaccugccuggguucaagcgauucuccugccucagccucccgaguagcugggguuacaggcgcucaccaucacgacuggcuaauuuuuguguuuuuaguggagacgggguuucacaauguuggcugggcuggucucaaacuccugaccucaagugaucugcccaccuuggccucccaaagugcugggauuacagguguaagccaccacgcccagccuauuaugaaaauuuucaagcauacaggagcuugaaaaacuuucaucgugaacacccauacacccaccaccuagauacuaucauuaacauuuuauuauacuugucuuuuuacauauguguccaucuauccuauuguaugcauuuuaagguaaauugcagaaucaguucaccucccacaaauacuucacaaugcauuauuaugaauuauaaauuagaauucauauaauuaugaauuagaauucaguaacugcagcuuuuuuucuuuugagguaaacuuuucguacagugaaggcacgaguuuuuguuuuuguuuuuuuuucgagauagaguuucacucuuguugcccaggcuggaguggaaugaucccggcucaccgcaaccucugccucccggguucaagugauucuccugccuuagccuccccaguggcugguauuacaggcaugugucaccacgcccagcuaauuuauauuuuuaguagagacaauguuucucccuguuggucaggcuggucucgaacugaccucgggugauccguccaccucagcuucccaaagugcugggauuauaggugugagccaccacgcccggcaaaggcacgaguuuuaagugaacauuggcagaguuuugauaaaugcaugcaccuguggaauccuaaaccccaucaagauguagaauauuaccaucacucuaggaaguucuuucaggcccagucccaguuaaucuguauuuccauucuuccagauccagccauuguccugcuuuuucugcaucauagguuaguuuugucuguucuaaaaccuuauaaaaguggauucacauauuauguacucuucuguuuaaagcaucuuucaccuagccguaauguuuuugagauucaugcauguuguugaacauaucuaguuuauuccuuuuuauugcugaauaguaauccuuuguaugacuauaucacacuuuauccauucucuugugaauguauaccuaagauguuuccaguuuuuggauauuaugaauaaacuguugugaacauuuuugugcaaguccuuuugugggaauauauuuucauuuuuaaggguaaauaccuaugaguggaauugccagauuauaggggaaagugugagacccuuuuccauagugguuguacuaauuuauacccccaacaacaguguaugaaaguucuuuuuguuccacagucuugccaaauuugguguuuuuggucuuaggaauuuuagccaucuuggugaguguagugauaaccucauugugauaguguauuguacuuuaaauagcuauuucucacaucccaccuucuuuaaucacucuccaugcacaucacacaccucagcuuuacuaguuuucucucagcuuuuucuguacuacuuuaacuuugccuucaauuuucuaugccccugcacuuuuauauauaguucaccguaggagagaaccugugcagccaaaccagugcuauuaagaaccaaugaaauaaaauuuaggugaguguauaugaguuuucuuucuuugaaacauacucuauguugccuaccucagggcauuagagguuuuaaaguugaguuucaccacuuacaauggugacuuugggcaaguuucuuagucuaauguuucuguuuucguguugauuaaaugagaucgugauguaaaguuucuagugcaaugcagaguacaaacuaggucuuuauugcuuuccuucucuuuuagaagugguauauauuuguaggguuuucuuuuccuuuauuuuauuuuauuuuauuuuauuguauuuauuuuuuuugagacgagucuugcucugucgcccaggcuggaguacagugacgugaucuuggcucacugcaagcuccaccuuccagguucaugccauucuccugucucagccuucuggaacuacaggcgcccgccaccacgccuggcuaagauuuuuguauuuuuaguagagacaggguuucacuguguuagccagguuggucuugaucuccugaccucuugauccacccgccucggccucccaaagugcugggauuacaggcaugagccaccucacccagccuagcuuuuucuuuaaaaaaaaaaaaaaaaaauuguuuauuccaaaacaaggccaguauucuugcuagcauaaaucaguuaucaacgugauugugcuuuuauauuuaccuucuuuuuuuccucuuuaauccuccuuccccccuacccuuccuagccucugguaacaaccauucuacuuucuauauucaugagauccacauuuuuagcuccuacguaugaaugaaaaugugauauuugucucucuaugcuuggcuuauuucacuuaacauaaugaccuccaguuccauccguguugccgcaaaugacaugauuucauuuuuauggcugaaucguauucuguuguauauauauuccacauuuucuucauauacucauguguuaaugggcacuuaaguugauuccauauuuuggcuguugugaauagugcugcaagaagugguauauaacugaaugacuaagaauucaaagcaucauugcuucaguuaaauuuagcacaaccuuacuugucagauggaaggcauucccaauaacagaggccuuauacuacaucaucaauauggacauuacacagggcucaauuuacugaacuccccugcuaaguacagagguagaaccucauacucuaaagucgucagcugagaacuugauacaguugucugauaaauuauaucaagaauuaaguauguuauuuuaaggguaugcuaaaggaacuguacgccacuuaaagggauuuucugggacuuuuuuuuuuuucuuugaaacaaccacucuguacaauacaaaaguucugaacucuuuaaacauauauauuuuuuucuuuuucuuucuuuuuuuuuuuagacagagucucgcucugucgcucaggcuggagugcaguggcgcaaucucugcucacugcaaucuccgccuccuggauucaagggauucuccugugucagcuuccugagcagcugggacuacaggcaugaaccaccacgccuggcuaauuuuuguauuuuuaguagagauaggguuuccccauguuggccaggcuggucuugaacuccugaccucaggugacccgcccaccuuggccucccaaaguguuaggauuacaggugugagcaacggcgcacagccguaucuuucauauuuuaaguugauauagugccagucagucuuuaaagaggacaguauaaaaaugaaccauucccggcugggcacgguggcucacgccuguuaaucccagcacugugggaggccgaggugggcaaaucaucugaggucaggaguuugagaccagccugaccaacguggugagacccccgucucuacuaaaaauacaaaaaaaaaauuagcugggcaugguggcacaugucuguagucccagcuacucgugaggcugaggcaggagaaucgcuugaaccugggaggcggagguugcagugagcugagaucgcacuacugcacuccaggcuggacaacagggcgagcgagacccugucucaaaaaaaaaaaaaaaaaaaguuaacuguucucuaaucuuucuugugugaaauaugagggcagagguugagaucaugacaugcagauaagaaugacaacuucagugaaggaaauagaggagcaagcgguagacaguaguucacugugaauucuguccagucuccagguuucagcagcuuugggaagcaggcuaaacuguucuugggguucuucagguuaauaacaauaagcaaggguggagugcuuaauccuuuuaagugaaugauaaacacuguggaaggcgugucuucaagcgccccacucccucagggcuguaggucacgugagcuuaaaguacuucccgaaucccagccacugucucuuguaggcagggaucacagucugaaacgacagcaaggaagagguaggcagggaaaacuaacuggaaggaaguuuaaauacagaaagagcaaaguauuaucuaacuauaacaaugccacauuuuacugugacuaagguagaggacccagaggagggggcagcggcuucgaucucucaagagccuaguuuagcagacauaaaagcccggauucaggauucagaugaaccaggugaguacgcaacuugggagcuuuuggaaccuauaaaauguuucaugaaagaaguaacuaggauaucaaaauucaaaaugccuucuuuaggacagagaaaaguguugugguugagguguuuuucaguuacuuauuucacuccccuguguaucugauagcuucucuuacuuuucucacacacuggauuguuuuuccccacaaugaguucuguguucauuaccaacaggugaaacugaaucaguggcaauguuugaagaguuuucaagcaaaaagaaagacacagaagucaauuuauguggaauuuagaauucacuuuuuccucacaguuuagauuauaucuggaaaagacuuuaaacccaccgaguggaugacauuuaaacuuagcaguuuacauaauauuauauaaagagggagcaugguucaguaguuuuguaccguggacuuugacuguacuugugauuucucagguuauucaguauuuuaccucaguuuaccagcuuaaacuauaauucaauaaugaauggucuaagaauuuuuuaauggcagaacaaaaguacaagagauggucauuguggugacuagcauagcaucagguuaaaaaaaguauuugaugaaugugauuaucccuauuauuuucuuuaaaugguaacaguucacacuugcuagaggaauugugguuuugaauuuuuaaacaagcaauuaaaucuuuguuaauauuauaguauuaaauauaguuguaauuugaagccccuuauuuuucaagucuguaaaucgugagcagcgucuuuaguuauaugaauuaagaauaagggaauaagcucucaaaauuacuuuuauuuuauuuuauuuauguuuuuggagauggagucuuucucugucacccaggcuggaaugcaguggggugaucucggcuuacugcaaccuccgccucucgaguucaagcgauucuuuugccucagccucccgaguagcugggauuacagaugccugccaccacgcccggcuaauuuuuguauuuuuaguagagacaagguuucaccuuuuuggccaggcugaucucaaacuccugaccucaagcgaucccccgcuucugccucccaaagugcugggauuacaggugugagccacugcguccggccucaaaguuacuuuuaauuccgugauucugugauucucacuuuccuuuauagcauguaacacauugcaauuccuuggugucaauagcgguugguuaucuuuuucuuaaaaccauucgagaauuuuuaugaaucuuguuugaagaugcaaacuuuuaaggaaaauguuccuuuuguuuuuuccuucuagugagauaauuuauuaggggaauaucagaaaaaagauuuuauguaaacucuuuguccgcaagguuauuuucauuuugcugaauaggaugauggaaaguggaaagcaaguuuaaucugcuuugaacuugaauaugauucucuacaacucaacuucagcucaauuagguucugucucaggccuguguguauuuauuuauuuacuuauuuuuuacuuaaucccaaaugugauaguaaggcuaauguguauuugaagcugcaccuucuuugcuuauguuuuccacccuuacaguuuaaucccuuuaggcuuuugucuuugcuguugucuucguuaauuucauaagcugcaaacgaaguccaucuguaccucauuucauuuguuuuuuaaauuugcuuucuccaccaccucuacuguuuuuuauuauuucaucuuuacuagucccauuauguuugcagaaauuugcuuucuucagauuauaagagaguguuaaaaucauucaaucuguuagcaacuaccuguaaaagccauaaaaauuugauaguacccaacuuuguaaugaguggacauuauuagguguaauuuauuuucuuccauaguaauugcuuuuaacaaggaagaagugacagauauaaucuaaauugaguuuaauaagcauuuuuacuuuggcauuuuccauaacagcccagaaaauaccuacuugaauaaacuauugcuuagcaagugaacaacugcugguaguauauuaucuaaauugcacuugccuuuauuauaagguuaaauucaaggguaggaaggagggaaauguaugucagaacaaucuaaaaguuauuuguuuuuuuaaaccuaggaguaaaauauuuuugaagauaacaugauuuuuuggagcaguugcuuuucaugcaaugagcuuuauccccuuguucuccuaaguuaaaaaaaaaaaaucuuaaauugaucaugguuuuuucacaagcacuuccaacauuggccaguuauauaaccaguagcauuuuucauuguuuuuucuucugaauuuauauggagagaaaaauauguagugucauauaaauugaacauauuuagaauguaaaucauccuuuaaaauguguuuuuuaaauaugagauuuauuugaacgggacagaugaggaauuugagauaaaauagaagugugaauguagauaaucuaauuuuuugaaaagguacagguauacuuuggaaauauugugggcucaguuccagaccacugcaauaaaaugagucacaugaauuguuguuuuuuuuguuuuguuuuguuuuuuugagauggugucucgcucugucaccaggcuagagugcaguggcgugaucucugcucgcugcaaccuccaccuccugggacuacaggcacaugccaccacaccuggcuaauuuuuuguauucuuaguagagaugggguuucaccguguuagccaggauggucuccugacuucgugauccgcccgccucagucuccaaaagugcugggauuacaggcguaagccacugcgccuggccgucacaugaauuuuugacuucccacugcauauaaaaaugauauuuauuuauacuauacuguagucuguuaagugugcaauagcauuaugucuuuaaaaaacaguguacauaccuuaauuuaaaaauuauuuuuauuuuuuuuaaagacaggauuuugcuauguuacucaggcuggacucaaacucuugggcucaagcgauccuccccuccugccucagcuuccuaaguagcuuggacuacaggcauguacuaccauuccuggcucuaaaauauacuuuauuaccaaaaaaugcuaaugaucaucugagccuucagugaguaauaaucuuuuugcugguggagguggagaguguuggcucaauguugauggcugcugcagggugggcugcugaagguugugguaacuguggcaauuucuuaaaauagaacaacaaugaaguuuacugcaugaauugacucuuuuaugaaagauuucucuguagcaugcaacguuguuugauagcauauuacccacagaacuucuuucaaaauuggagucaaucaucucaaaccuugcugcuuaguuuauggaauauucuaaaauccuuuguugccauuucaccaguguucacagcaucuucaucagcagauuucaugucaagaaacuacuuucuuugcucaaccauaagaagcaacuccuuaucuauucagguuuuaucaugaaauugcagcaauucagucacauuuucagucucugcuucuaauucucguacucuugcuauuuccaccauaucugcauuauuuccuccacucaagucuugaaccccugaaagucauccaugagggcuaggaucuacuucuucccaauguuaauguugauuuuuuuuuuuuuuuuuuuaaggcuggucaagugaaggaguaggagugagagaaggaacaaaggaaucuguaacugguuaugaucaguuaguuguaaauaccauugcacucaccagccuaauguugauauuuuuacuuuuucccaugaaucacaaauguucuuaaugccgucuagaauggugaaucauuuucacuguacuuugcuuagauccaucagaggaaucacuaucuauggcagcuacagccuuagaaaauguaguucauaaguaauaagacuuggaaguugaaauaauuccuugauccauaagcugcagauggaucaaagaugcuguuguugauguuaugcuggcaggcaugaaaacaacauugaucucuuuguacaucuccaucggagcucuugagugaccagugcauuguugaagagcaguaauauuuugaaagaaaucuuuuuuuccugggcaguagguuucagcagugggcuuaaaauacucgguaaacuagcugggugcaguggcucacaccuguaaucccagcacuuugggaggccgagguggguggaucaccugaggucaggaguucgagaccagcuuggccaacauaacgaaaccccgucucuacuaaaugcaaaaauuaacugggcgugguggcauaugccuguaaaucccagcuacuugugaggcugagacaggaggaucgcuugaacccaggaggcggagguugcagugagcugagaucgggccacugcacuccagccuaagcaacagagcaagacuacgucucaaaaaaaaaaaaaaaaucaauaaaccaugcuguaaacagauuagcugcuauucaggcuuuguuguuccgcugagcauaggcagaguagauuuagcauaaaccuuuuuuuuuuuuuuucguuuuuaagagacaggagucucacuauguugcccagccagccuugaacucuugugcucaagugauuguccuaucucagccuccuaguagcugagacugcagaugugcaccauuacaccuggcuuguuguauaguccuuaagggucuuaggauuuucagaacaguaaaugagcauugacuuuaacuuaaagucaccagcugcauuagccccuaacaagagaggcaaccuguccuuugaagcgaggcauugucuuguccuuucuagcuaugaagguccuagauggcaucuucuuccaacauaagacugcuuccucuccagugaaaguguguuguuuaaugaagccaccuucaucauugaucguagcucaaucuucuggauaacuugcuauagcuucuguaaaagcacuugcugcuuuaccuugcauuuuuauguuuuggagaugucuucuuuccuuaaaccucaugaaccaacuucuguuagcuucaaacuuuuauuuugcacccccaucaacucucuuggccuucauagaauugaagagaguuagggucuuguucuggauuagguuuuugcauauuggaauguuguggcugguuugaucuucuauccagaucacuaaaaccuucuucauaucagcaauaagguuguuuagcuuucuuaacauuuauguguucacuggaauagcacuuuuaauuuccuucaagaacuguuccuuugcauucacaacuugcucuuuagugcaagagacauagcuuuuggccuggcggcuuuuaacaugccuuucucacugagcuuaaucauuucaagcuuuugauugaaagugagagauguccaacaucuuuucacuugaaaacuuagaggccaauguggguuuauuaacuggccuaauuucaguauuguugugucucagugaauagggaggccagaggagagggagagggaaaaggaagcagcugguugauggaguggucagaacacacacaacauuuauggauuaagucuucugugggcacaguucauggugccccaaaacaauuucaauaguaacagcaauuucaauagcacagaucaucauaaacaaguauaguuauaaugaaaaaguuagaaauauuguaagaauuaccaaaaugcgacagacaugaagugagcacaugcuauuggaaaaacagcacuaaaaagacuugcuugacauaggguugccacagacuuuaaauuuguaaacaaacaaaaaaccccaaaguaucugugaagcaccauaaagcacagcacaauaaaacaagguaugccuguauauuagaacccugcuuaauuucaaaacccuggguuucgaagggaaaagcagaaacucggacuuuccuuacgucuuucuugacuguuuucuuccuacccauucuguuuucucagcagcgugugcucagaaacaguacuuaaccacacacuguauuauaauaaucuguuuacuugauucucuccccugguacacugauuauaaacuccuugaggacuucgucagaucauuuucguaucuccagguccuaagguaaaaauauggcacauaauaagcaacucagugaguaagacaugcucccugccuuuuuuauucaccaaacacauguucaguauaaauaugucagguauuguacuuacuuuuuuccuaaggcuacagaaguauaggauguacgggaggauccccaccaaaggcagcagaaugagagucagagacuucacuuuaaaucccaguccuacuaauuauuaguagugauaauuuguuauuaauuauuacuugagugacuuuugccaagcuguuuaacuucucaaggacuacuuuccuucacugauaaaacagagaauaacagcaccugcuuuacagggugguugugaggauuacaugggauuauguaccaucuauaaagcacuuaauacauaugugacagcacucaaaaauaagaacuacuuuuaguggucuaauaagaaaaagaaacagauuuggauaacagaugauagaauaauaauauuaacuggacgggacccuggacagguaucucagaggaagggacacaauucuugcaggaagguuuagaggcaaugauaaaaagaacaauacaaaggaaugagagcaggguauagcacaugggaaauaaaaguuuagggcaguuagcacauugggcaugugguaaagagauaagagaugagggagagagguagauugaggccauuuauggaaguguuauuaauuucauccuuucuccacucugugggauagugggugguuauugccuuuuuagugauaaucugaggcuggugaauaagugacuugccucaggccacauggugaguagcagagccaauguucaacuuauaaauucuuugugcucuccacuauaccaugaugccaaauccuagcuuuuuacuaauaagaagagauuacuuuauaucuuaaugugccugagccacagauuuugaugugagcauuaucgaaacugugauuuuuaaaaauaggaccaauauaacaaaguuuuacugauuauugcauuuacuuaaucagauaugaauuuccauucauucauuuauuuaaauauuuauuuccacugcuucacuuggcuagccuaaaaauauauguauuaaaaaauaaaaauaaauauuaugguuaguauuuuugugaaauaauuguucgagauuuucuccccugcuccucaaaucuuauauugccuauggauuaggcagauuugaauugauaaacuugccuucacuggacacagauugccauuuagaagauuuucucuccuuuaaaauaagguucuaaggaaauuuuuagaaauggaccuauagcacaauagagagaggaaccuguacugguauugaagagcaucuccaaacaguaacucacaaguaauacaaaugguaggagagcaaacuaugagacaaauuucuauuaaaugagguuuaaauuuuauugagaauccacaggauguuagacuauuaacuaaauaauuguuacccaugaaagcuuauguucuaaaaaaggugauuuggcugggcuugguggcucauaccuguaaugccagcacuguggguggccaaggugggcagaucacuugagcccaggaguucaacaccagccuggacacgggacacacacacacacacacacacacacacacacacacacacacacacacacuugagcccaggaguucaacaccagccuggacacggggacacacacacacacacacacacacucuugagcccaggaguucaacaccagccuggacacggggacacacacacacacacacacacacacacacacacacacacuugagcccaggaguucaacaccagccuggacacggggacacacacacacacacacacauacacacacacacacacacacacaguugagcccaggaguucaacacuagccuggccacggggacacacacauacauacacacacacacacacacacuugagcccaggaguucaacaccagccuggacacggggacacacacacacacacacacacacuugagcccaggaguucaacaccagccuggacacagggacacacacacacacuugagcccaggaguucaacaccagccuggacacggggacacacacacacacacacacacacacuugagcccaggaguucaacaccagccuggacacggggacacacacacacacacacuugagcccaggaguucaacacuagccuggacacagggacacacacacacacacacacacacacacacacacuagcugggcgugguguugugugccuguagucccagcuacucggaaggcugaggugggaggauugcuugaacccaggagguggaggcugcaguaauccguuaucaugccacugcacucuauccugggcaacaaagugagaaagugagacccugucucaaaaaaaaaaaaagauuaucucuuuuuauucacuaacauuaaaauagauugaaauagacaacuaaagagcuucucugugucaauaaaaaucuuuucuauagugauugaaaagccuuuuauuuucuaguccuuuuaacaauucaugggaggcuuuuaccagccuaacuaacggaaauuuagaucugcacgcuuuaaaaucucaggaucaaagcuuuauccuuuuuuuaaguuggcucugugaggcauguuuuccugccuccuuccccaacccgcaguauccagccauugucagaaagacuaauaccucucugaaauaucuucccaauucuguuuacuauaucuaagaccuuaauauaagaauacaaauuugauuccuuucagauuuuuacauuuuaaaacuuuguuuagauugugacccuucuuucucauauuacaaucucagacacuuugauuucuuauuugagcacuguuaucaucggcuuuuuagaaucucucacuuccaaaauuuuucuagcuuaguauaccaaccuucugucaacugucugcuacuuuugccccacaagagauacaccagauuucaacugauuuaauucuauaaagauaaaaauugcuauaaaauaugcauauugcuuaauuuuuaaauucuauagucaaagcaauauuuaggaauauaaaaauauauuaaguguaauuuuaguguauuauaaaauauucaaaagauuuuuaaauuucgggcugaauuuagacauauggcauagguuaacaaauugauuauaagcugguaaauuuaaagaaucgagaauuucuugcuuuggccaggcugaaagaggaaacaauuuuacccagaaaaugucaucaacauuucaguaaaaauaccaacuaccauuguugagcauggugaguagcagagccaguguucaaaccaggcacugguuuguggcuuauuuaauccucacaacaaucaggacagguaaccauuaucaccauguuaaaaaugaggaaagugaggugccaaaaaauuaggaagauuauuuaagugacagauuuggaauucaaaauaagggcuguguagcucuaaagccauuauuuuucgccacaccacgcuguuucuacuuuaaacauauauguaauuauuuguguuuucugaacuaggcugcucuguuuuuucaguaguuacuaguucuucuuaagcucuauuaucuucauggauuuaacaaaauuaauugaaaguuaacugcuucuucuaccguuuuguuuuggauugcuuuuuuauuucgcauagaguauuuacaaauguagaauauucuuucaaauggcacuaaaaauugagaaaucugaacuugacuuaauccaacaaucugguuuguuuuuuuuuuuuuuuuuuuuuugucagguggacagugucuggcuuccuugcucaggcugaagugcaguggaguggucucggcucacugcaaccuccgccucccagguucaggcaauucuccugucucagacuccagaguagcugggauuacagacaugcaccaccaugcccggcuaauuuucauauucuuaguagagacaggguuucaccauguuggccaggcuggucuuaaacuccugaccucaagugauccacccaccucagucucccaaagugcugggauuacaggcaugagccaccgugcccaacccuuaauccaacagucuuuaguagcucuccacuccucacauuucuaggaagaugcaauuaucagcgagauagaaauaagagacuuaacaauucgcaggagacuuguaccagucuaacuaauggaaauuuagaucugcaugcuuaaagacuaaggguuagugauggaaaaaaaugggcauauggagcaagugaaauaauugaauuuuaauaucacugaagguagguaagauauuuuuaauauauuaagaaaaauuauauuucauuuucauggaaaugaagcugaguaaaaacuaaauucuuucuagagaaaaauacuaauauagguagaauauagacauggcaaagauuaaauaugguacauaaauaacaaaugauuuuaauaaauucuaaagccucauaugguaaauuagaucucauuuauuuuccuguauucuuuccaucaacauguaaccuuuugugacagaagauucugaugguuauauuagaaacagugaaccuauaguaaaagcccuaaaaguugucuccaucuuccccuuacuucauugccuucguucauauuuuuuucuucaucucaacuuucuucucuucugcuguuuccugccuacaguaaaaaaaauuacauauacccacauucaguuucauuacuucaagaccaaguucauacuuauuuccuccaagaugacuuuccuaaucuucuacuccaacuuugauuauaucauuaauugguauuaauggguggacauggugacucaugccuauaaucccaacacuuugagagauggaggcuguagaccaggaguuugagaccagccugagaacauagugagaccucaucuucaauuuuaaaaauaaaagaaaaauguaaaaaacaaagaaaaauaauugguauuuaucagcagucaaauauucuugcaguaacacuguaauuauauuuuaucucuucaccuguauugagggugagacauaguguuuuaauauuuuucugaaaauuacauauuuuauuuuuuauuguggaaauuucaaauucggaaaaguuuagugaacuuccuguucaugucuguuaccuguagguauucuucuuuauuuuuuagauaugcuuuauauuuagggaugucaaucccuuugggaaauaaauuccaaauguuuuuccccaucgguauuuuuuuaucgaggugcaguugacauaaaguuaacuguacaucuuuaagguguauauuuuguugaugaauuuugacauuuauaugcccaugaaauaauuauaaugaagauagugaacauuuucgucacccccagaaguuucuuugugcccuuuaugccccacucaccuaauuccuuggucccuaggcaaccacuguucucuuuuucugucaccaaauuaguuugcauuuccuagaauuuuauauaaauguaaucauacaguauguacuccuuuuggucugacugcuuuuauauaacaauuauuuucagaguccaucuaaucaguuuccuuuaauuuugacuuccauuaagaucuuccuuauuucuuaaauuuuuucuucagaacuuaauacuuagggcaguaguugaaaacaaugcaguccacagauguuuggacuuuacaguggcacuuuaaauuuuugacuuacaugccaagauuuuaaugcuuuuaggauuagucuguaaacaggacugacuuuucagagugaguucugggaagguggcuacuugaauaucucacuaucccuccauuccugcuuccagccuguaucugucaaucuugagugaaguggcuccuggaucugaugaacaguuggugcaauugaggccaugggcugugugagaacucugucagggagaguugguacaggacuuuuccucuagacaagagccuggaaaaucucaggauaagcauaagaauggcaaauccaggaaagaacuugguuugguagauauccaugaauuccuggagggaaggagaaaaggaaagagccaugggucugagaucuucccaucccuguggcuggcauauguaaggagaccugagagcagggaggcuuccuccugggccuccacaagggcugguggcuugccugcugcagcacugccuacccacagggguagagacugcuuugccuuuccauuuucuugagacugcuaccgcuugugguccuccaacaacuaaaucucaucccccaugaggugacaaagauaaacaacccaucuggggaagccaggcaaccugaaagagaaaaaccacuuagaauaaacaauauauugaguuagcuaaauagaaaugcuggaggaggcugggcacgguggcucacgccuguaaucccagcacuuugguaggccgaggcgggcggaucacgaggucaggagaucgagaccauccuggcuaacauggggaaaccccaucucuacuaaaaaaagauacaaaaaauuagccgggcgcgguggugggcgccuguagucccaguuacucaggagguugaagcaggagaaucacuugaacccaggaggcagagguugcagugagccgagaucgcgccacucccuuuagccugggugacagagcgagacuccaucuuuaaaaaaaaaaaaaaaaugcuggaggagagagaaacuugaacaugaaaauaauaaugggccacauuuaagacuuuauggaacaaaaaaugugauuuuuccaccuaaauaauuauuaucaccugacuccauuuauccucacacacuuauuuuuuuuaaaacuaucucugcuagaguguaagcaccaggagaacaggaacuuuuuugucuuguauucacugcuaaucuguugucaacucuaauaccuagaacacugucuuacacauaguaggcgcccgaaacauaauuauugaauaaaggaaugaaugaguaugaacaauuauugaccuggaagaucaaguaaaauaaauauuucaaagcauggagccaaaaaaaaaauacaaaaaaaaaaaacuuuuaaaaaagagaccuauuggaucgauucaggacaccuaacauggcuaauacaaguuccagaagaagaaaaaggaacaaauggagaaggaauaauuaaacaacauaaaauuauuuccugagcuaaagacuucagugugcagaaugaaguucugggggagaucagugaugaaaaacacauacauagggauauccuuguaaaauuuuugagcuccaaggauucaccuuggaggcuuccagauagaacagguugcaccuaucaaguaacagacuggaaucagaauucuaauucacaacacuggaaacuaggagaugguagaagaguauuuacagauuggggauuucacaaucccaaaucccuauuucccuugaagauauuucuccccuaugaggggaaacauguuacaacuauacaaaaauuucaaggauauaauacccacuuaacuccucugagaaaauucaagaagggguuuuagccaaauaacaagugaccuagaacagagaucacaugaugaaagggauagaaauaauggaaaaugacagacucuuugggaauguauuauguaaaugcuaaguaagguuuuuaaccaaaggaugcauaguucagagaacaauaauauuuacaaugugauaaguaagucagggcagaaccucaaaacugugggaacaaaaggaaguaacagcuuuccaauuaaggugaggagaggaaaaagcaccaauauguacaugaaaagaugcucaacaucauuaguuauuaaagaaauacacaucaaaaccaaaaugagguacaguuuuuucacacucacugggauggcuauaaacaaaaagacagauaucaaguguuggaaaggaugugaaguauugaaacucucaucugcuacuagugacaauguaaaauaguacaacuacuuuggaaaacaauuugacaguuucuuaaaaaguuaaacauagaauuaccauaugucccaguaauuaaguguauuuccacacaaaaacuuguacaggaauguuuauagcagcauuauaaauaauagcuaauaaagaaguaacagcccaaauguccuccagcugacaaaugaauagauaaaaugugauauagccauauaauggaauauuauuuggcaauaaaaacaaaguacugauuccugcuauaacaugugugaagcuugaaaaugcaaguuaaggaaucuaguugcaaaaaaccccaaacacauacuguaugauuccauucguaggaaauguccagaauagguaaauuuauagaggcagaaguuagauuaauggucguuuagucuggauaggguuggggagagugagauggggauuagccugcugauggguagaggguuucuuuuaguggggagacaaaaauguaaaauuagauuguggugacagcuacacaacagugugacuauauuaagaaacacugaacacuuugagugaauuauaugguguugucuuaguauguuucaugcugcuauaacaauaccacagacuggguaauuuauaaugaauugaaauuuauugacucgugguucuggaggcuggaaaguccaagaccaaggugccagcaucugcugagggccuucuugcugcaucuucccauggcagagggcagagaggguaagagggagugagagagaaggggaccaaacucccuauuuuguuacaaacucucuugauaaugacauuaauccauuguugaggguggcuuaauuaccuaauggccuaauuaccucuaauuagucccccaccucccagugauguugcauuggggauuaaguuuccaacagaugcuuuugggaggauauauucaaaccauggcaggucuguaguuuauguuucaaaauguauuuuuuuuaaagaggaacuaguguugauaauacacagcagcuugcaugaaucugcaaggcauuaggcucaaugaaaaaaaggcagucucaaaaguuuauauaugauuccauuuauauuuucuaaauuauugaagaucaugacacauuuacuauucaaaguauacacacuaaaaacaauguuuuuaaaaaauuccagaauacaguauauauaauaauaguuucuaguuuaaugucuggguuuaaaacuuuaggaaauguuauguucagccuacauuaagcaguuaaccuuugacuguaacaugaaaucaauauaggcucuuaaaauauuggaaauguucacaguagucucuuagucccccuaauuccccuuuuaacuccuuaguuccuaauuuguuguuuaggccaauuuucuccccuucuuguuaagaagauagucucuuauggucauguuuauuuuuccaaaaccaucuuuaaaaugaaaaugugaaauauguuuccacagugcaugaaaaauaauuuggaucauccacaagaccaaagaaugacauaaucuuuuuuuuuuuuuuuuuuuuuuugagacagggucucccuucucccgucugucacccaggcugaagugcagugucaugauuauggcucauugcagccucagccuccugggcucaagcaauccucucaccucagccucccaaguagcugggacuauagacauccacuacuacgccaggcuaauuuuuaauuuuuuuguagagacaaaucucccuguguugcccaggcuggucuugaacuccuaggcccaagcaaucaucccaccuccaccuccggaagugccaagauuauaggcaugagccacugugucacccaggcuggagugcaguggcacaaucucagcuuacugcaaccuccgccuccuggguucaagcaauucuuuuaccucagccucccgaguagcugggauuacaggcucccgccaccacaccuggcuaauuuuuguauuuuuguagaaaugggguuucaccauguuggacaggcuggucucaaacuccugaccucaagugauccacccgccucggccucccaaagugucaggauugcaggcaugagccaccacaccuggcuagcccauaaucuucuuuauacauaauuuucuucaguaauauuugcaacagccucaagauccauccuccuuuguuauuucuuaguaaguuuuuuuucuucuuuuuuaacuguguagguacaguccucuuguaucauuuauacuuuucuugacugaccaguuuguggauuuggcccaauaaacucucuuuauauuauacuuuggccuuuauuaaaucuacugucugguauuacucucaccaucuucucaguguuauaggcugagaagaaaauuacaaccauagguuguauaaguuauaggcugugaauuagaaguauaacuaucuucaucacugcugaguucuucaacuucuaguggauuuaucuccacauauuuggaagaauuucaacacaacuuaaucuaauguauucagaacacaguuuaccucauuugcauuuucuuuauacaaaucugagcucaaacaaaaaguggucuuaacauuucucuugcuugggacacuccacuaaauagcacugguuugcuuaagagccucuguuaaucuaauacuuauucuuagcauauguacuggauuuugaaggacauuguugaugaguacccaguauuaguggcagaucugcaggcuggucucgaacuccugaccucaggugauccgcccaccuuggccucccaaagcacugggauuacaggcgugagccaccacgcccagccuugucuggcugucuuuucuuuaaaauaagucagauggaucaaagagacgauugcuaaguaaauucacauacaauuucuucaggauucauguguuguguguucugcuccauaggcauguuuggcccuacauuuucacuacuuucuaccuuaauuaccauuuucuuccuucuaguaucuagacuuguugggaaaaauuggaaugacagcauuacagucauagugucaauaauuuuuuucccucuguuuccuucucuagcauucugagcccuuggucucaggugcuuucucuuuccauuggcuuuuaggaaaguucauccuucugucuucagcucuuauguuuugaugaggacuuuguuucuuuguuuccaucaucagccuuuauuaaaacuaauccugaauuuuggucucuugguauuugucuuugaaaucacuucaacaugagucaguuaacaaacauguugaggccgggccugguggcucacaccuguaaucccugaccucaccugaggucaggaguucaagaccagccugaccgacauggugaaacccugucucuacuaaaaaagacaaaauuagccaggugugguggugcaugccucuaaucccagcuauucaggaggcugagacaggagaaucgcuugaaccugggaggcggagguugcagugagccgagaucgcgccauugcacuccagccuggacaacaagagugaaacuccuucucaaaaaaacaaaaauguugaacauuuuauaaauguuacaugaagcucugucuguauuacaugaaguuguaauugucacagcaacguuaaaacaaaauucuugucucaaaaugcuuauaaugggcagauaggaccccugccccucaugcccccaaaccugcuccucucauucuuuuuuuuuuuuuuuuuuuuuugagacggagucacucugucucccaggccagagugcaguggugcgucucagcucacucacugcaaugucugucucccagguucaggcaguccucgugccucagccucccaaguagcugggacuacaggcacacaccaccaugacuggcuaauuaaaaacuuuuggguguguguggagacagagucuucuauguuuuccagccuggucugggcucaagugauccucuugccucagccucccaaagugcugggauuacagacaugagccacugugccuagccaccuccuuucauucuuaauccuggcagcuguguuauggcuagggguaggggaguaggggaaucucacagccaugaaaacugauaccaccauaaauucaucauuuccaacaauguuguacugucgacacuauuuagacauucugugugauucuaguuagcuucccuucucaauccuuacagaguuaaaaugcuuaagaccucaauccuccauucucauauagcuaaaccuucuacuucacagaguaaacuguauuucuuuauuucuaauauucuucuucauaaguucuuaccagcaucuguguugacaccuauccuuuaccaccuuccuuguugucguucaauauugauccauacaccugugcucuagaaccuuucuugcuuccuaacucuugugauuucuaauuuuuuuauugacuccuucccccuugauauauuacaauauucaaucucucugucacucuuuccuuuucuuucucgccgauuuuugcucauuuagucuuccaaauaauucucaaauuugucccguucucuccaucuucacugcuacuauccuaguccauuguuauuuuuugucuaaccuccuaaagccauccauuacaguaauuaccagaggaauuuuucucauauguaaaucucauccuauuacucccucauuuaaaacccccuaaugucuccccaugcugacaaagucuguacugcuuagcagguacauguaccuacacgaucuagaacaucccagcuuaauagcuuccuuguuuauuacucuuuuguacauacugcacaccagauauaaugaauguucuugaaugucucuguugcuuuaacacauuuauuccauccucuuggaguguucuucaguuaccuagcaaacaaucuucauguuaagacugagcucaaauaccacuucuuccuuaauggucccugugaucacuccaggaaauguaauguaauguacacgcuaccauacucuaugucuacaccuccaauauaguacuuuagucacccacugcaaucacuugucuuacccguaugugcuguaagccccuuagggguagcugcugugcucuauucaucuuuaugcaucuccagugccuagcacauaaucugacauuuauagaugcuuaguaaauauuuguugaauuaauauguugauuaauuaaaagauaauacaaggcagcuuauacccaacaguugagaaaagguuaaacuaaaauauaaaggggcuuaaaugccaagcugaaguuuuucgaguucacccuauaagccaauggguccaaauaaguaaaccacaaucuauuuauaaaugucuacaccaguagccuccgcuaccaccaucauccccaccaucaucccccagccugagauuucaaaguaggaacaaagguagagcuuacaaaggcagcccuuccccuuugcuuugagggacucagauuaguaccccacacaugauguagauuacaaauaaacaagugaaaaugaucuucacaaaauguuuggggucuccuggcagugucacuuggaaagcuuucaaaguauuuauuuuguuguuuaagcaaugaugcaaacugauaaaggcagaauuuuaggauuauuaguauggaggaaaauguaggauuguuugaagaugggagaauugguggcaauuggucuaagcugaaaaggaugagaaucuaaaugauggcagugcaauggaauagauugguguggaagcauacugaagccacauuuaacuggauuugaugacuaaauauugagacugagggaggaagggggaagaaucagguuggaaguacaugugcucacugcuucuguguacccacuuucucugugaaugacaggauucuuuucuucuuuuuuauguuagguauauuaaauccugcuauuuuaucucuggaaugucucuccuccauuuccccccacccauuuuucuacuuuuucaugaacuaaucauccuucaagauuuagcucaguuauccccuugacaacaucucuuaccauugcuuuauuuuuauuuuauuuauuuauuuauuuauuuauuuugagacagagucucacucugucgccuaggcuggagugcagaggcaccaucucagcucacugcaaccuccgccucccggguucaagcaguucuccugccucugccucccgaguagccaggauugcagaugcccaccaccaugccuagcuaauuuuuguauuuuuaguagaaacgggguuucaccaucuuggccaggcuggucucaaacuccugaccuugugauccaccugccucggccucccaaagugcugggauuacaggugugagcggccuauuuuuguucuuuccuucuugagucccacaguauuuguacuuaaacuguaauaauuuuauuguuucauaauuguguauuuuuccccucugaacuucuugagagcaaauggucacuguuuuugauauccauagugccuagcauguaccugacauauaguaggcauucagagucuugguugaauuaauauuaauaacuacuacugcuguccuagacaguuagccuuagagauguuugcacauggacagaccgccguggucuauuaaugagucugccugccugucucuaauauaucuagcauuuauuucuuuuugcauuuuuguacucauguuuccuugccuaaaauacugcuuucauuuuuagacuucuacauagagaauuucaguuguuuuccaucuccuuuagacuccucuauuugccuuccaagauuuuccuaauaugacccaaucuucccaagcaaaucuuuccagacaugugcuguauuuauuccuccucugugauuuugagcccuccaugauuuuuaagguuuucaaaaauccuccuucaaguucacacugccuugaucaauguugcacgucucccuguggacccucacacugcuuccugcuagugagaugauccaagaccacagcugaggccuggcuuugccaugguuccauuggcuuuauuggcuacaccaccuugggcaaaucauuucagcuuucucugagcuaguuucuuuaugaauauaggaauaauucuucuucacaugguugcugugcaguuuuuaugugaugauaguaggaaauuuucccuaaauucagucuuuuagagacuaccuuuguaaucuuucuauuuuuauggaucaucuuuguguuuauuuaauuuuuuucuuaaauugagucacugcuuuuaugguuuccuuuuaaaaaggaacguugucacuaaaugaaauaccagcaugcuugccauaaauagaguauaaauuaaaaauagauacaauaaagcagcuaaucuuguuagauacuguugccaagcuuaggcucugacuaagccuguuaaaaaagagauuagcaacauuugaagagauuuuaaagauauucuagcacaaacauuuuuaaaaaugauauuuggcaaagugcuuccaacuuucaguuagcuggguuaauggcaggaugaggggagaagguagaaucaguuaaaacuuaucaagauguuuaguagaaaaugaacuuaauaaacauuuguaguuaaauuuucaaaaauuugauucuuauggaguuaucagaaguauacaaauaacacaaguaaaacaguuugguuacuaaaauuuuuuuucaaauaucaaaguagaagcauaucuacuuuucuauguggauguucuuuaucucuucuuaauuucucuaccuucaguccugacucucuguuggauuccauaaccacaugagcuuuccuuuaccuucucuguguucugccaugcucuuggcaaaaagggauggggcagucuuaccugggucggcaauguuugugaacucugcugcauuagcaacgcaucgauauggccaucuguggucacuguguaguuccaugcaccagauaccuacucugacuauuuguaauuauuucauacaugccuuguugugaucuugugccuuagauaauuaucuucccuggauaauuaaaaguuauguauauuaccauuauucauucuuguaccuaaauuuuaggaacaaccaguaugauauaguagacaaaucagaauccaaguucaagcgagucuuuuuugaaauuuacacucaguuugccuuggaugaaccauugagccuaaucuugcuuuagcuuuuuaauauuuccuaucuguaucacaggguuaucaugagaaccaaaagaaauaugugaaaauauuuuaaaaacuguaaaauguuacuauguguaaguuacuauuauuaccaucauucuuucuuaguuucuuaaguugaaguugacuuuucaacuagauuaugagcugcuuaaugucaggaaauaucuuaugcucacucuuguuccccacagcauccaacacagcuuuaggcauguuuaaaacuuauggaauuaaauuaucauuguuuauuugaauuggaaucauuaauaaaauuguacugggaaauguaguacagacaguccuuaacaauuacuauuauaaauaauuguaucacaacauuccaaacuguguguuuguuuguuuuugagaugaaguuucgcucuugucacccaggcuggaguacaauggcgugaucucagcucauugcaaccuccuucuccuggguucaagcaauucuccugccucagccucccgaguagcugggcuuacacgcaugugccaccaugccuggcuaauuuuuuguauuuuuaguagagauaggguuucucuauguuggucaggcuagucuugaacucccaacuucaggugauccgccuaccuuggccucccaaagugcugggauuacaggugugagccaccgcacccagccuccaaacuguauguuaauguguauuuuguccacacuauaaauguaucaaauuuuuugauacaagaauagugacucaaacuauuauuaucacaugacuguaucguuauaaaucaauguguauaucagugcuaagaauucaaccacauuacuuugauauuuuccacaguacuauuguacuacaaaauguuuagaauuccaagaaauaugcccagcuaccuaaauucuaauuugucgccaugacucuuuuuagcauauaauuguuauuaugucuguugaggaucauucuguggcuuaucucaauuuucugugauauaguauuauuccuauugcauagaugguaaauuaaagcuaagaaguauugacucauuuucccaagguuacacuaauaacaugugguagagcuaguaucucaccugagcuuuaccugcuucccaguucuguguuaucuuuucacucugccucaugucugcgcucugggauaguugcacagcugucauagugggcucugucuucagcaucauccuggagguucccuuugccuuuccuguaaaauggaacaaucaugauaguacuuacagcauaggaugagauugcuguaaaugagauaauacagguaaaacguuuaggugucuaucacauacauacccuaauaagugcuaacuguugauaauucuuucuauuguuguuaugucuacuaggagacuuuuauuggucccaaaauuauucaugacacuuguauuuauuauaaauccauaauuuaaccaaauauuacacaaauugauguaauaugaauagggaaaguagaguugugucuauaaaagcuaacguggauuauuuagcaggucauuaaacacuuauuuaaggcugggugugguggcucaugccuguaauccuagcacuuugggaggggaagcaaaaggaucucuugaggccacaaguuagagaccagccugggugauauauuuugucucuaccaaauaaauuagccaguuauaguggugcacaccaguaauccuagcuacucaggagacugaggugggaggauugauugagcccaggaguugaagauuacaguaaccuaagauuaugucauugaacucaaucaugagcaacagaacaagacccuguaucuuaaaaauaaaauuaaaaaaaagguauuuagggccaggugugguggcucacaacuguaaucccauuacuuugggaggccaaggugggugaaucacgcggucaagaguucgagaucagccuggccaacauggugaaacccccucucuacuaagaauacaaaaauuagccuggcauuuuuguaucacauuuuggaucacagguggugagugccugugaucccaccuacucaggaggcugaggcaggagaauugcuugaaccagggagguggaguuugcagugagccgugaucacaccacugcacuccagccugggugacagagcaagacuccgucucaagguggggguggaaggaaguauuuaaauuagcaguggacaagagaccuguaaaagaguugggaguggggcaaugacaaagcuuugaaaagaauauagauauugcuucauaaguaucuuuaaaccaaaguuggaaaucacagacuuaugccuuauggguguaauuuacacaagaaagaaaaugaauaaauucaaucugcauaguuguaucgcuuuuacaaaaugauuggugaauuaauauacauuugcaaguuuauauacuuuuauguugaaauauuaaugugugagccauuuuugugugugugugauucucuauuucaaccagcuuuuaaaauuaccuaucagcccuggcugggcauggugguucacaccucuaaucccaacacuuuggaggcugagacaggaggaucacuugagaacaggaguuuguggccagccugggcaacauagggagaccuugucucuacaaaaaaacauuuuuuuaauuagcaaggugugacggcacaugccuguagucccagcuacugggaaggcuuaggccaggggauuacuuggaccugggagguuuaggcugcagugaacugagauugugccauuguacuccugccuaggccucagagcgagacuuugucucaaaaaaaugaaauaggcuaggcgcgauggcucaugccuguaaucccagcacuuugggaggccaaggcagacaggucaucugaggucgggauuucgagaccagccuagccaacauggcaaaaccccgucucuacuaaaaauacaaaaauuagcuggauguggcagugggcaccuguaaucucagcuacucgggaggugaggcaggagaauugcuugaacccaggagguggagguugcagagaucugaguuugcaccacugcacuccagccugggcaacagagugagacucugucucaaaaauaaauuaauuaauuaaauaaaauaaaaaccuaucaguccugacagcaauagauagaauuacuuuuacuacauuuuacuaauuucccuguuuuaccuaauugcuguauccuuaaagccauaucagaacucaauuaagauuuuuuaaaaaacacguaucuuaaggagucgcuuccaagauggcugaauaggaacagcucuggucuacagcucccagcaagauugacacagaagaugggugauuucugcauuuccaacugagguaccugguucaucucauugggacugguuggacagugggugcagcccacggagggugagccaaagcaggguggggcauugcuucacccaggaagcacaaggggucgggggauuucccuuuccuagccaagggaagccgugagugacugugcuuggaggagugguacacuccugcccaaauacugcgcuuuucccacagucuucacaaccaucagaccaggagaucccuucccaugccuggcucagcaggucccacacccacggagccuugcuagcugcuagcacagcagucugagauugaccugggacgugggagcuugguggggcaaggggcgucugccauuggugaggcuugaguaggcaguucugugcucacuuggaguaaacaaaguggcagggaaccgcgaacugggcagagcacaccacagcucagcaaggccuacugcuucucuagauuccaccucugggggcagggcauaucugaacaaaaggcagcagacagcuucuccagacuuaaacgucccuccuggacagcucugaagagagcagugguucucccagcgugauguuugagcucuaagaauggacacacugccuccucaagugguucccugaccccuguguagccugacuaggagacaucucccaguaggggccgacagacaccucauacaagcagguuccccucugagacgaagcuuccagaggaaggaucaggcagcaauauuugcuguucugcagccucugcuggugauacccaggcaaacagggucuggaguggaccuccaguaaacuccaacagaccugcagcugaguggccugucuguuagaaggaaaacuagcaaacagaaaggaauagcaucaacaucaacaaaaaggacauccacaccaaaaccccaucuguaagucaccaacaucaaagacuaaagguagauaaaaccacaaagaugggaagaaaccagagcagaaaggcuaaaaaauuccaaaaaccagaaugccucuucuucuccaaagaaacacaacuccucaccagcaagggaacaaaacuggauggagaaugaguuugacagguugacagaaguaggcuucagaaggucgguaauaacaaacuucuccgagcuaaaggagcauguucucacccauugcaaggaagcuaaaaucuuugaaaaaagguaggacaaaugguuaacuagaauaaccaguguagagaagagcuuaaaugacaugauggaucugaaaaccacaguacaagaacuuagugaagcauacacaagcuucaauagccgauucaaucaagcggaagaaaggauaucagugaucgaagaucaaauuaaugaaauaaagugagaagacaagauuagagaaaaaaaagugaaaagaaaugaacagagccuccaagaaauaugggacuaugugaaaagaccaaaucuacguuugauugguguaccugaaagugacagggagaaugaaaccaaguuagaaaacacucuucaggauauuauucaggagaacauccccaaccuagcaaggcaggccaacauucaaauucaguaaauacagagaacaccgcaaagaugcuccucaaaaagagcaacccuaagacacuuaauugucagauucaccaagguugaaaugaagggaaaaauguuaagcacagccagagagaaaggucagguuacccacaaaaggaaacccaucagacuaacagugcaucucucagcagaaacccuacaagccagaagagagugggagccaacauucaacauucugaaagaaaagaauuuucaacccagaauuucauauccagccaaacuaagcuucauaagugaaggagaaauaaaauccuuuacagacaagcaagugcugagagauuuugucaccaccaagucugucuuagaagagcuccugaaggaagcacuaaacguggauacgaacaacugguaccagccacugcaacaacauaccaaauuguaaagaccaucagugcuaugaagaaacuacaucaauuaacagaugaaauaacaagcuagcacauaaugacaggaucaaauucacacauaacaauuauuaaccuuaaauguaaauaggguaagugccccaauuaaaagacacagacuggcaaauuggauaaagagucaagaccuaucggugugcuguauucaggagacccaucucacgugcaaagacacacauaggcucaaaauaaagggauggaggaagaucuaccaaggaaaugaaaaacaaaaauaaauaaauaaauaaagcagggcuugcaauccuggucuguuugauaaaacagacuuuaaaccaacaaagaucaaaagagacauuuacauaaugguaaaggaaucaauucaacaagaagagcuaacuauccuaaauguauaugcacccaauacaggagcacccagauucauaaagcaaguucuuagagaccuacaaagagacuuagacucccacacaguaacaaugggagacuuuaacagcccacugucaauauuagaucgacgagacagaaaauuaacaaggauauccaggaacugaacucagcucugcaccaagugaaccuaauagauaucuacagaacucuccaccccaaaucaacggaauauacauucuucucagcaccacauagcacuuauucuaaaauugaccacguaauugaaaguaaagcacuccucagcaaauguaaaagaaacagaaaucacaacaaacugucucucagaccacagugcaaucaaauuaaaacucaggauuaauaaacucacucaaaaccacgcaacuacauggaaaaugaacaaccugcuccugaaugacuacuggguaaauaacgaaaugaaggcagaaauaaagauguucuuugaaaccgaugagaacaaagacauaacguaccagaaucucugggacacauuuaaagaaguguguaaagggaaacuuguagcacuaaaugcccgcaagagaaagcaggagagaucuaaaaucaacacccuaacaucacaauugaaagaacuagagaagcaagagcagacaaauucaaaagcuagcagaaggcaagaaauaguuacuaagaucagaacagaacugaaggagauagggacacaaaaucccuuaaaaaaaucaaugaauccaggagcugguuuuuugaaaagaucaacaaaauagacugcuagcaagacuaauaaacaagaaaagagagaagaaucagauaggcauaauaaaaaaugauaaaggggauaucaccaccuaucccaaagaaauacagacuaccaucagagaauacuauaaacaccucuauguaaauaaacuagaaaaucuagaagaaauggauaaauuccuggauacauacacccucccaagacuaaacaaggaaaaaguugaaucucugaauagaccaauaacagguucugaaauugaggcaauaauuaauagccuaccaaccaaaaaaaguccaggaccagaaggauucacagccagauucuaccagagguacaaagaagagcugauaccauuccuucugaaacuauuccaauuaauagaaaaagagggaauccuccauaacucauuuuaugaggccagcaucauccugauaccaaagucugacagacacaacaaaaaagaauuuuagaccaauaucccugaugaacauugaugcaaaaauccucaauaaaauacuggcaaaccgaauccagcagcacaucaaaaagcuuauccaccaugagcacgugggcuucgucccugggaugcaaggcugguucaacauagcaaaucaauaaacguaauccaacauauaaacagaaccaaugacaaaaaccacaugauuaucucaacagaugcagaaaaggccuucaacaaaauucaacagccuuucaugguaaaaacucugaauaaacuagguauugauggaacauaucucaaaauaauaagagcuauucaugucaaacccacagccaguaucauacugaaugggcaaaaacuggaagcauucccuuugaaaaccgggacaagacaaggaugcccucucucaccacuccuauucaacauaguguugaaaguucuggccagggcagucaggcaagagaaagcaauaagggauauucaaauaggaagagaggaagucaaauugucucuguuugcagaugacaugauuguguauuuagaaaaccccaucgucucagcccaaaaucuccuuaagcugauaagcaacuucagcaaagucucaggauacaaaaucaaugugcagaaaucacaggcauuccuauacaccaguaacagacaaacagagagccaaaucaugagugaacucccauucacaauuacuacuaagagaauaaaauaccuaggaauccaacuuacaagggaugugaaggaccucuucaaggagaacuacaaaccacugcccaaggaaauaagaggggacacaaucaaauggaaaaacauucuaugcucauggguaggaagaaucaauauaaugaaaauggccuuacugcccaaagugauuuauagauuuaaugcuauccccaucaagcuaccacugacuuucuucacagaauugggaaaaaacuacuuuaaaguucauauggaaccaaaaaagagcccgcauugccaaggcaauccugugcaagaagaacaaagcuggagacaucaagcuacccgacuucaaacuuugcuacgaggcuacaguauccaaaacagcaugguacugguaccaaaacagauauauagaccaauggaacagaacggaggccucagaaauaacaccacacaucuaccaccaucugaucuuugacaaaccugacaaaagcaauggggaaaggaggcuacacaaacuacacaaacauauacaugguguugggaaagcuggcuauccauaugcagaaaacugacacuggacccccuuacaccuuauacaaaaaucaacucaagauggaucaaagacuuaaacauaagaccuaggaccauaaaaauccuagaagaaaaccugggcaauaccauucaggacacaggcauaggcaaagacuucaugucuaaaacaccaaagcaauggcaacaaaagccaacauugacaaaugggaucuaauuaaacuaaagagcuucugcacagcaaaagaaacuauuaccagagugaacaggcaaccuacagaacgggagaaaauuuuugcuaucuauccaucugacaaagggcuaauauccacaaucuacaaagaacuuaaacaaauuuaccagaaaaaagcaaacaaccccaucaaaaaaugggcaaaggauauuaacagacacuucucaaaagaagacauuuaugcagccaacagacauaugaaaaaaugcucaucaucacuggucaucagagaaaugcaaaucaagaccacagugagauaccaucucacaccaguuagaauggcaaccauuaaaaagucaggaaacaacacaugcuggagagguugugggaaaauaggaaugcuucuacacuguuggugggaguguaaauuaguucaaucguuauggaauagaguguggugauuccucagggaucuagaacuagaaauaccauuugacccagcaaucccauuacugggcauauacccaaaggauuauaaaucauuuuacgauaaagacacaugugcauguuuauugcggcacuauucacaauaggaaagacuuggaaccaacccaaauguccaucaaugauagacuggauaaagcaaauguggcacauauacaccauggaauacuaugcagccauaaaaaaggaugaguuccuguccuuugcagggacauggaugaagcuggaaacaucauucucagcaaacugucacaagaucagaaaaccaaacaccacauguucucacucauaagugggaguugaacaaugagaacacauggacacagggaggggaacaucacacaccagagcccggggggguagggaagggauaacauuaggagaaauaccuaauguagaugacggguugaugggugcagcaaaccaccauggcacguguauaccuguauaacaaaacugcacauucugcacauguaacccagaacuuaaaguauuuaaaaaaaaaaguacuugcuuuggcauuugcuuugcuuugcuuccucauuggcuuuuuucaagcaaauuguuauaaguaauuucuguagcugcacuaggugucaucauauuuaagcuuuauuauuuguccucuuuugaagcauaguaugaguacauaucuugugaauuaggagauaagguugcugcauaauuaaugcacauagggaaauuuuuuauuuuugagacagagucucacuuugucuagaaugcaguggcgcaaucuuggcucacugcaaccuccgccugccagguucaagcgauucuccugccucagccucccaagcagcugggguuacaggcaccugucaccacacccagcuaauuuuuuguauuuuuaguagagacuggguuucaccaugcuggccagucuggucucaaacuccugaccucaagugauccacccaccucaaccucccaaagugcugggauuacaggcgugagccacugugcccgggcagggaaauuuuaaaaauggaaaauggagcucuccuuuuagacuuaugaaugcuauuaaugaagaccacaauguauuagccaaaagacuacggagucaaauacaauuuuuuaaauuguggcuuaaaaaaauagcauaaggccaggcaugguggcucacgccuguaaucccaacacuuugggaggcugaggugggcagaucacuugaggugaggaguuugaggccagccuggacaauauggugaaaccccaucucuacuaaaaauacaaaaaaauuaguugagcaugguggcacgugccuguaaucacagcuacucgggaggcugagucaggagaauugcuugaacccgggaggcggcgguugcagggaacuuagaucgugcuaccacacuccagccugggugucagagcaagacuguuuaaaaagaaaaagaaaaaaaaaagcaauaaaaccuagcaucuuaauaauuuuuuaguguauaguucaguaguguuaagaguauuuccauuguugugcagaucuccagaacuuuuucauuuugcaaaacugaacuucuauacccaaugaacaacucuccauuuuccacucccuaccaccccguuaaccaccauucuguuuucuguuucuauuaauuugacuccuuuagauaacuaauauaaguggaaucauaugguauuugccuuuguaugacuagcuuauuugauuuaguguauugcugucaagauucauccauguuguagcaugugucugaauuuccuuccuuuuuaaagguugaauaauauuccauuuuauguaugacaaacacacacacacacacacacauauagcacauuuuguuuauucauccauuaguggacauuuggauugcuuccaccucuuuaaaugaauuuuuucuuacugccauuugguggguacauggagaacucacaccuaauuuaaaaacccaucccacugguuuuccacuacacaggauucccuacuaagcuggcuuggaaaaaaaaaaaaaccaucauaagcacugugccuuuaauucgauugcuagcucucugucagucuccaacucaguaaaggguaaauggcaucucuguucaucuaauugcuguggaaauaucuuugacucuuuucuuucucucccacccuguagccaaucaucagcaugccaaucuugucagucccuccuuugaaacauaccuaggcuagucaacauauccagcaucugaccacuucucauuaccucuaguauuucugaucugauccauacuaccauuaucuuuucuuggaccacuguaaaagccuucuaacuuuuuucuguuuauuugcuuggucccugcuaucugcucauuccagacuauagcuguugugaucauguuaaaacagaaaccaaaaccuuucaauggcuucuuaucucacaguaaaaacaaaaauccugacuauauccuacaaggccgcacaugaucuuugauuccuccuccaacaucuauauccaucucuuauuccauacucugucacuuucaacuugcuuauucugucugauaauccggucuccuugcugccauucaucaaacaugucaauacauaccugcuucgcuuagcacuaacuguucuuccugcagauauuuguaugguuagauaucuucaauuuucugcucagaugucacauuaucugagaggccuuucagacugaguaucuaagugugcacacaaaccacucucccacuaguccucuguauucuuuuacucagcuuuuuuguuuguuuuauagcuuacuguucuugacauagguuacugguuguuuuuuucuccacuaaaauuuaagcuccuugauggcagggauuuuguuacuacauuucuaguaacuagaauaguguuucacauguagaagguucucagaaaauauuuacugaauacauuaaugaaagagcuacagaucucaaaguaacaugggccaggcgcaguggcucaugccuguaaucucagcacuuugggaggccgaggcagguggaucacaaggucaggaguucaagaccagccuggccaacauggugaaacccugucucuacuaaaaauacaaaaauuagcugggcguggugggcgggugccuguaaucccagguacucgggaggcugaggcaggagaaucgcuugaaccugggaggcagagguugcagugagcugagauggugccugccuaggcaacagagcaggacuccgucucaaaaaaaaaaaaaaaaaaaaaaagaaaagaaacaaagaaaguaauauggacauuacuuuugaagacuagcccgugagcucucuuuccguaagauaucaucaaccugccucccuccaucagcuucacuacagccauuaucaugucuuucugugguuucuucaguaaacuuguaacugguuuccccauuucuguucuuggucuccccuacaauccauucucaaaccagcagccugcauuuuuaaaaaauuaugcuggccaagugugguggcucacaccuguaauccucggaggcugaggcaggagaaucgccugagccccagaguuugagaccgagacgagcauaagcaacauagggagauccugucuccauaaaaaaaaucaaaaaacuggcuggguguaguggcacaugacugugaucccagcuacuaggaggcugaggcgggaagaucacuugagccugggagguugaggcuguaguaagcccugauugcaccacugcacuccagcuugaugucagcgcaagacccuguuucaaaaaaaaaaaugcuaaccuuucagucguuuuacgucauuuucagaguaaaauucacacuccuuauuauagugugcuacacuacaagauguagugccuaccuaauuuacccucuuuaaaaaaaaaacacuuuguuacucacuaugcuuuagcuacauuaauauuuccuaaauauaccaagcugauucccaucuuagggucuucucacagcuguuccucuguccuaaucagucuuuucaggauccucauaugucuggcuccuuuucaugcaagucucaccuuaaggguuaccuccucagaaagguccugacaguccacccaauaaaaaauagccucucuaaucacccuucuuuauuuucuuuauaacaccauaagcugaaauuaucuuauuaauuaucuuuucuauuuuuauuuuuauuuuuuucgagacagaguuucgcucuugucacccagguuggagugcaauggugcagucuccggucacugcaaccucugccuccuagguucaagugauucucuagccucagccucccaagcagcugggauuacaggugccugccaccaugccuggcugauuuuuguauuuuuaguugagaugggguuucaccauguuggccaggcuggucuugaacuccugaccucaggugauccaccugccuuggccucccaaagugcugggauuacaggcgugagccacagugcccggcuauuaauuuucuuuucuuauugauguucccauaucugcaugacaaaaggaacuuuuucuuauuuaccuucuaucccuagcacauggaaaaaugacugggacuuauuagucgcucagauauuuaaacacaggaaugguugaacgaaugaaguuuuauaguagccaucugaggcacuugguaaaacuacagaaucucagccuccucccauaaaauugagucauuaggguuaguuaugugacccagaaauuuguaguuuaacaaauaccccaugacuguuguaaccaggcaaauuuugaaaauacugacuuaauggaaauagugcugagugaaugaaugagugagugagugagugagugaucauagcucauugcaaccuugaacuucugggcucuaguauccucucacuucagccuccugaguagcugagaugacaggcacacaccaccacacccagcuaauuuuauuucuuuuuuaagagauggggucuugcuauguugcccaggcuggccucaagcuccuggccucagguaguccuccagcuucagccuccugaguagcuagaauuacagacuugaagcacugugcccagccagggaguuaucuuuuaaccuuaguauauugauaggaauuaguucaacguuucccaaaguguauaucauaggacacuaauuauacaagguauuugauacaaaaugaaugaucuuuuccuauguguuuaggaaugcugaauauuauauucuucuuuuggagauuagcuaggcagucauuagcauuuugaaggguaugagaaauuacacuuuagagcaaucuacuuaucuauuaaauagauuugacaagucuacuuacaaucccugccccaaaccguuucuuaccaaaucccuauuaauauacuaaggaauguguacuuaugcccuaaggacuauacacuguacaugaaguagaguaugugguuccuugcuacuaucgcagcuuauucuguucaugguuaacugucuacacaagccacuauguagcagaugguguggacuaaaguacacauuuuagcuuaaugaucuuuagcuauuuuuuuuuggcauauguaggcucuauauaucuuuuuuaaacuauauuuuuauuacauuaaaaauuaaaauaaggauuuuuguccuuuaugagguaguguagaaacauaaagaauuaacuuuuuguaugcacugguuuacauugccaucuuauugcuuaauuacuuugccuaaaauugccuacuauuuuuuacuuauuuauuuauuuauuuuugagacagaaucuugcucugucaccaggcuggagugcaguggcgccaucuuggcucacugcaaccuccgccuccugaauucaagcuauucuccugccucauccucccaaguagcugggacuacaggcaugcgccaccaugcccagcuaauuuuuuguauuuuaguagagaugggguuucaccauguuggccaggauggucucaaucuccugaccucgugauccacucgccucggccucccaaggcgccaggauuacaggcgugagccacugcacccggcuuacucauuuauuuaaaccucauuaaucucauguuaguuuuucuaggucuaucuaguucauugcuauaaauuuagaauauauuauguaaagaggaugggcuuuucagauuuugacuuaguucaacuuguuuucccaccaagaugagauccuacccauauagacaggcagaaucuaauaaaugugaauguuagaguaauugucuuugguuccaucuuuuuuucaauaccuauuaaaguauagugaucagaucaauguaauuaguauauccauugucucaaucauuuaucauuacuuuguauuagaaacauucaauauccuccuccuagcuauuugagucuaauauauuauuguuaaccguagucauccuucaauaguguagaauacuagacuuacucuuuuuuuaucuagcuauacuuuuguauccuuuaacaaaucucuuccuaucccccugcccuccgcccauacccaugcccuucucacccucaaguaucgucuguucuaauuuuuacaucuaugagaucaacuuuuuuuuucugacucucacauaugaaugagaacaugugguguuuagcuuucuguuccuggcuuauuucacuuaacauaauguccuucaguuccaucuacguugcuaugaaugauaggauuuuauucuuuuuaagagcugaauaguauuccauuguauauacauaccacacuuucuuuauccauucaucuguuuuuggacacccagguugaguccauaucuuggcuacugugaauagugcugcaauaaacaugcagugcaggugucucuuugauauacuaauuuuacuaauuuccuuugcuuuguauaaaugcucaguggugggauugcuggaucauaugguaguucuaguuguacuuuucuugaguacucuccauacucuucuccuuaguggcuauacuaguuuacauccccaaauucaguuccaucuuuaacuaucuuaguuuaauucugaguuggaaucguuucuuuugaugaugaugacgcuuugguuuuuuuaaaaacugggaguuaagaaaguuagaaaugccuuacguguuaagacuagucauuucaguuguuuguuuuccugaaacaacuuuugugauaugucuagauaauacagccaguagcauaacagucuuaauucugauguauaugcgcuuggucaugccuacuucuuuaucuaaagaauugggcaacaauuucugcuguugguguguuauuuaauuauauuacugauucuagauuuaauaaagacuaaaaccuucuagcccuguguuuuagcuacaagauaccagcuagccuuuauuugcuucaaauugucugccaaugaugguaaacaaagugauucucaaaggaaauuuuguucaaaauagucucaaagacuauugcuauuggcaaacuaaggaaaauaauaaagcucuucagaaaaacuugacagaggcaguuuugcaagugaguaccacccacaaucauuucacucugucuccauucucccaggugcauggcaggaaacuaaaaucuucauucuuacuauuuacccaagauaaguuaaauauauugagcaagugcuuauuuguaaaacuaccauaucauuaguguuacaaggaaauauuuucaguucaucuuucugauuacaucuaucuguuuuuaauagguauauaguuuguuucuauuuuuuauuugaucuaucauuuugacuuauagaguaucucuggcuuuugauuauaaccugauuguauuuuguccuaagaguagcuuuauuuaugaagaccaucaugggguaaaacuagugacauuauuggcacauaguuccuauuagagagaauaaucugguuuaaaauaaaugucauuuugaguaaucuuuaggacaacucccagucuuaggcaaacuugggugugcccucaccaaugacauagucaggaaaagugguaaaugggggaguuuagacacagaacaauugaagggugcucagacauaucucagcaguguuagcaugaugacugcacaauuuggauugcaaacccagaaacgcccuucaaguuaaauccacugaacaauuguaauuuuuacaggcaaaacuaguuucauucuaguggguucacgggccuauauacucccagauugaccuuuauuuuaguucuuuguuuuuuuuguuuuguuuuguuuuguuuuuuguuuguuuuuuugagacggagucuugcucugucgcccaggcuggagugcaguggccugaucuccacuaacugcaaccuccgccucccagguucaagcaauucucugccucagccuccugaguaucugggauuacaggggcgcaucaccaugcccagcuaauuuuuguauuuuuaguagagaugggguuucaccacguuagccaggcugguccugaacgccugaccucaugauccacccgccucagcuucccaaagugcugggauuacaggugugagccaccgcuccuagccuuguuuuagcuuuuauauauauuaauaaaagauuugcagguucuuggagguuagucuucacauuacuaaauaaguaucaaggauugcccauaauuuuucaauuauaauaaaugaaaauaaaaaucuaaguugaacuuguagggaacuacacaaaagacuuguuucuggcuggacucaguggcccaugccuguaaucccagcacuuugggaggcugaggcagguggaucaugaggucaggaguucaagaccagucuggccaacauggugaaaccccaacuguacuaaaaauacaaaaauuagcugggcgugguggugggcaccuauaaucccagcugcucuggaggaugaggcagaaaauugcuugaaccuggaagguggagguugcagugagccgagaucgcgcuacugcacuccagccugggcgacagagcaagacuccaucucaaaaaaaauaaaaggacuuguuucuacucaucugaaguauaggaggguguucaaaggaagacuccuggcuugucuagagaguauacauacgucauguaugcacagcuuagaaggcaagaaaguauauuacacaauagaggaguuaauuuuuuucuuuuuuuuugagauggaguuucacucuuuuugcccaggcuggagucagugguguggucuuggcucacugcaaccuccaccuccuggguucaagccauccuccugucucagccuccagaguagcugagauuacaggugcacgccaccacgcccagcugauuuuuuuauuuuuaguggagauggcauuucucuauguuggucaggcuggucucgaacuccugaccucaggugauccacccgccucggccucccaaagugcugcaauuacaggcgugagccgcugcgcccagccgagcuaauucuuuuuaaaggaaaagucauuuauauuuuccucucuaaaaccauaccuagucugucagaguuaucugagauguuuuccuauuucucuucauagguuguauucccuggcaauuucgaauaacuuguuuuagccuaucauaccuuguuuuagaacaagaaaguuagaauuacagaauauugggaagcaagaacauaaguucucaaagcaucaagacuauaaccuuuuucuuugggcaguaguaugaugugucuuuagccacugauuaacccaggcauuaguuuuuuagaacuauaaacauuaaaauaugagguucucaacuuuucuguuccugcacaccugagagauacaagguauucauauuagugacuauggcugggaaucagaaucuugaaggagagguguugguaugauuuaaagagaaaaauaaaugaugugauaacacuuccucagcuuuuccucuagagucacuggaguagguuuagaugaugaccaagguucuucuaguucuaaaauucuguuaugcuuucucuacucuucuuuucaugccagcuacaugcuuguuucuccauaaugauagggcccaauuuucccuaagagagagagugacuacagaacuguuauuccuauuuugucuuaugugcaagaacauuccuacuuugucuuaugugcaagaauauauauauauagugggggguugggggagagaugaggucucacugucaccccggcuggagugcaguggcaucaucauagcucacuggggccucuaacucuuggguucaagggaaccucuugccuuagccuccugaguagcugggacuacaggugcacacgccacuaugccuaccuaauuuuuaaaauguuucauagagaugcggucucacuauguugcucaggcugguuucaaacuccuggccucgugauccucccgccucagcucaccaaaauacugggauaacaggcaggagccacugcacccagccccaguauccuuuauuuagaugggaaguaagauaaguuuaaaguaaaaacugggaauucacuugcugguauguuuggggaaaauauucuagaauaggaacauuucaaauuuuccuuuuucaaagcaaauuaaggaaaaaaauccccugaaaauaaauuguuaaauguucaaauagcauuuaaaacuucugugguagaaaucagauuucuaccugacuuccuuaauuaaaauauauaguguauacuccaauauacaucagaaacuggaauuuguuaaguauucugauuguuucuuucugucugggaugcuuaaaguguuaauuaaaugauauguaaaacauauguggacuauggauuuugucuaaaacaauaaugugauauaaaaaugucucagauuuauuguuagacaaaaucaaagguacuuuuauguaaucuguugcauacaucauagcuguagaaaauccuuaacuucaguuagagguuagugaaaauaaagaugugacuuuuuuucccauuguucacauaaacccuggucuaaaauuauuuuuauuaccccaggcacauucaaggaagccagaaucaucagcgucucaagagauuuagucuuugaggaaaguggagcuuagucuuuucuguuuuuagcucuuagugcuuuucaaaccuuuaaaauaaguaagugguugacuguuaaaugaugauugucaauaucucuugcauuaggaacuuggcuuauugccacgaauuuuauuucagauuacuaaagaaauugauauuuaugaaagccaauguagucaguguaucuuaaagucaaacuacuagaauauaucugcuaauaguaauaagugcuuuauuuaugucuugacuuugagcugcuauagccauaaguauuuuuugucauuaaaauguuccuucgucauuaaaaauauaauucauaucacaauccugaaucauccuucuacuuuaugaaacgacugcuuggucaaauuugugugauuauuauuuuuuuaauuuacuuuuuauuguggcaaaauauauacaauacagaaguuaccauuuuaaccauguuuaaguguacaacucaguggcauuaauuacauuuacaguguuguacacccauuaccacuaucuguuuccagaauuucucaucaccccaaacagaaacgcuguacucuuuaagcaauaacauuccauacccuacuccacccagccccugguaaccucuaaucugcuuuccaucuccauaaauuugcccuuucucaacauuuuauauaaauugagucauauaauauuuaucuuuuugugucugguuuguuuuccuuagcauaauguuuucaagguucauccauguugucacauguaucagaauuccauucauuuuuauagcugaauaauuuuccauuguauguguauauuacauuuuguugauuccuucaucuguagaaguauaccugguaaccuuuuggcuauugugaauuauuuugucauaaacuuugugguaaaguaucuguuugagucccuguuuucaauuauuuuggaaguauaauuaggaguagaauugcugauggugauuauguuuaacuuuuugagcuaugugaucauucuuuacacuaguucauucuauuuuuuauuaucuucacauuaauauuucauaaguuuuuaaauuuuuuugcuuauuuccuugguugacuuuuguugcugauuuuaaagaaauuauuuguuuugaucauucauuuuuuucuuuucuuuucaauuguuuguuuuucagaccugagucagaacuccaucacaggggaacacagccaacuguuagguauaguauuacuguggggauugacuuuauccaaagucacccuuaacucauuuauccuaacagacauuacucccuucucugauucuauuuucuauccccuccuuuucuacuucccacccaacaacuuuuuuccugcuguuucuauucccaacuugccaaguuuuaggaaacuacuucuauaauugauuacuaagacucaguuaaauuaaaaaguaauuuugcaugguuuaugguuaaaaaaaaucuaagaacuagaauuuuuuaaagauaauuuggaaaagaagauauuauaauagcuuuguaauaucugacuuugcagcuaauuuucccuuuuuauuacuuuucuuggccuuuugauccccuuuuuaauuauugaaaguacuucauaaacaguauguccuuaagcaguccuuagaauuugguguuccaguuccuuaucuaugaaacaaauuauggaaaugaauuuacuuccucuggguaccacuucuuuaaaguaagugcauaauuugacaagaauuucucuuuuuuuuuuugagacagugucucgcucugucaccaggcuggagugcaguggugcgaucuccacucacugcaagcuccgccucccagguucaugccauucuccugccucagccucccaaguagcugggacuacaggcgcccgccaccacacccagcuaauuuuuguauuuuuaguacagacaggguuucaccaugucggccaggauggucuccaucuccugaccucgugauccgcccaccucugccucccaaaaugcugggauuacaggugugagccacugcacccggccuugacaggaauuucacaagaccucaggacugauaaauuuucaaaguguaaaaagaaacauacccugaugaggcauucagcucaaacaaaaggcauauauaaagaaaguaaaaguaucucuucuucuuaccaccucauuuccaccucuuaaaaguacuugcuguugacaguuucuugggaauucuucuagaaauuuuuaauuauaaauuuuuguauuauauaugacuaucuuuuccuuuuuauaucaaugguguuauaguaaauggacuguucuauuauacagacugcuucuuuuuacuuaacauuuuaccuuggacaucuuaguacauaaaguucugcuucauuccuuuguuugugauggaagaguauuucauugugcuccugcacuauaauuuuauucagccaguuuccuacucaugagcauguauuuccaaguguguuacuguuguaaguuguguugcaaugaauaucuuauacuuauauccaguauauaagauagauauaucagucuuaaugccaguauauuuguaggguaaauuccuaacaguggaauuccuuacucaaaagauauguacauguuuaaaaagauacaucagcuuaaacucucaccaguauggaguaaugcuugacucucuauaauaaaaaaaaaaacagguauuauuaaucuuaaaauaguuucuuuaccuaauaggugaaaauggcaucucuaguuuuuuauuuauacuuccuucaguguaagugagguuaaguaauuuuuaguauauuauuugguauuuaacacuugugugucuauguaugcuuugauuugaggcuuauuuugaucccugcugagcuuuuagcuguuuaaauauguguaaagcagcuauggaaaaauaagcuaucaaaaaguccaaaguagggaaaguaaaaacuucagaggauuaguugaagaaacugggauacuccuuuuucguucuuucuauauuaaagacuuaggauaguccuuggguuaaugagaagaguuuaugagaccauagcccucauuccuuuagugaguuuauaugcugaaacaguaccugacauccuaggcacucaguauauauuuguuaaguaaaugguuugacauaaauauacaaaucugaucaccaagguccugaccgugugauguuagagguuuuuuguuuuuuugguuuuugguuuuuuugagauggagucuugaucugucacccaggcuggagugcgguggcacgaucuuggcucacugcaaccuccaccucucagauucaagcaguucucuggccucagccuccugaguagcugggacuacaggugcacgccacagcgccuggcucauuuuuguauuuuuaguagagucaagguuucgcccuauuggucaggcuggucucgaacuacugaccucaggugacccacccacuguggccucucaaagugcugggauuacaggcaugagccaccacucccggccacuuuuuuauacuuuuauauuggauaguuucuauacauugcucaaaauuagucuucuguauauaaaaauuuuauauuuggaucaggaacgauuaaacuuucauugaaaaauuuugccagaccaugaaaagaacaucuuuccucuaaacuaugaaaguguuucugucccugauacauacaugacaggcagagauguuugagaauaguucauuaucaggaacacauguacaauggaggcagcuuagcuagugaaauggacagucaaaaguugauacaguucuaguauuacuaagcuggauuuuguucccagcuaaucaccugcaguaaaggauaccuggggaacuguaggcaaaaauaaguaacuuugauuaugaaggaagaguuaucuuagucauuauuagccaaaaaauucuaauaguauuugcaaagagacugcuucaaacauuaaucucauuuggcagccuacaguugcauucaauuuuuagccaaccugaggauucauccagucuucuggccagauuaucagguauguccauccugccagccugaguucucucuccuagauucauggagucagaucauauuuuccuuuuuucucaugcucugaagaacuauccucuucugucuucugucuuaaguaucuuuguuuuagcuguagccucaaaaccuuuaaaagucugguuuaauuaaaagaaauucaugaguuugcaaaagacugaaagauuuuuuuuguuguauuuucuaaccaucugauaaguuacucagaaaaggcauuauaagguugaaugaaaaucuuccaaccaggcgccgugguucaccacgccuguaaucccagcacuuugggaggccaaagcaaguggaucgcaaggucaggaguucgagaccagccuagccaagauggugaaaccccaugucuacuuaaaaaaaauuggccgggcaugguggcgggugccuguagucccagcuacuugggaggcugaggcaggagaaucgcuugaaccaggagguggagguugcagugagccaagaucgcaccacugcauucuagccugggcggcagagugagacucugucucaaaaaaaacaaaaacaaaaaaagaaaaagaaaaaaaaagaaaaucuucccagcucucccuaaaaaccuuguuuaggauaauuuggccugguaggugaaaaacugguucaauugccuugccugcuuaauugaauuuguaauaacaucuuucagaccuuugcuguugaauuggauauauaaaagcccuuuccaguccuucuaaauguuuuuacugucaacagggcacaguuauuuuaauguaucuacuguucccacugacucaucgggucucuugcaaaacucagggucaggcugaggagauauacgggagggugaaacugcuguuguaauaaucaagcuguacaccugugauuuaugaacuuuucuguguguguguguguguguguguguguagcuuugcacuuaaaaaaauuuuuagaaagcuagcaagcaaacaagccauggguccuggcauuauuaaaaguuuuaucaggcauccaaggaaaaauaauucgagucuucugcagucagucucucauaaggaauagaaaaccaaguaacuacuaccucaguuuugaggcuuuugcaaccuugauaaccaaaacuuaagaauggcaacaugagauuaaaaaaaaaaaaaaguauaggccaaccuuacuuaggaacauaucuacaauccugaacgaaauauuugcaaucugaaucgggcaacauauuuuuuuaaauuauccccucaucaaguugaguuucugcuagaaauccaugguugguuuaauauugaaaguuaauuuauauaauucacuauguuaacaaauuaaaagaaaaauauuguauaauaaucuuaauagagguugaaaaagcauuugauuugaaacauaccugauaugguuuggcugugucuccccccacucaucuugacuuguaauucccauaauccucacguuuugugggagguaacaaucaugggggcgguuuccucuauguucuuaugauugugagugagucucaugagaucugaugguuuuauaagcaucacgcauuuccccuccuugcacucauucucucuccugcugcccugugaagaggggccuuccaccaugauuauaaguuuccugaggcuucccuagccaugcugaacuuggagucaauuaaaccucuuuucucucucucuuuuuuuuuuuuuuguuuuuuguuuuguuuuguuuuguuuuuugagauggaaucuugcucugucacccaggcuggaguacaguggcaugaucucggcuuacugcaaccuccaucucccagguucaagugauucuccuuccucagccucccaaguggcugggauuacagggacccaccaucacaccuggcuaauuuuuguauuuucaguggagacgggguuucaccauguuguccagucuagucucaaacuccaagccucaagugauccgccugucucguccucccaaagugcugggauuagaggugugagccauugugcucagccaaaccucuuuucuuuauaaauuacccagucuuggguauuucuucauagcagcaugaggaagggcuaauacaguaaaaacccaguauuuaaguuuaugaguucauaaugauaauuuaaaaaaugagccaggcacaauggcacacgccuguagucccagcacuuuaggaggcugaggagggagguaggaggauuacuugaggccagggguucaagaucagacugggcaacauugcaagaacccaucucuacaaaaaagcaaaaaauaauuagccuggcaugguggcacacaccuguaguccuagcuacucuggaggcuacaguaagcugugauggugccacuguacuccgcgacagagugauacccugucucuaaaacaaaacaaaacccacaacuaacuggucaccauuggaguauuuagugaaccaauuauucugagaacuggucaguaaagggaaagaauuauucguccuguuuuuaacugaaccacuugguaaucaaauaguagauuaaaggaaaugucucuuuuuauagagguauucuagcuaauaaaugaaggaacaauaauagaaugagaauauuaccauuuggugaccucucauaaauuaauggagcuaggcauuacucaucaacaauugcuaauaucucaaaaggaaagacaaccagaugacaaugacauguaccuccuggcaguucauaauaccacugugaaguaguuuuccucccuacccuccuagaaguacugaaugugauuaagcuuuuagauucaacuaccaauuuauaggaauuacaaaaaaaaaaagagcauguuaaacagcaucacauggaugccaugaucaaaacccagaccaucagaaacucuccaggacaaaugacaugguuuccuuaacacaucaauggcaaaacaaaguauaaaaucaaaaacauguagcauuugggauaaccuuucagauucacauagucacauaguacaaacccaaaccugugccaagggaaauuagguacaccuacugcucucuugccuaacucagacuagcaaaggccauuugacaagaucaggaagcuaaaggaguaacuugagauuuaucuagggcccaaauuauaguauaagugguaauugacaaaugcaacauuauagaaguaauaacaucacaacaguaaaguguuuauauaaagaguaagaccuuugguauaccuuuuuucuguuuacaaaaaaaaaauaugccaugaaaaacagaaaucugaaauauuuaguagaauuauccuaucaguuuucauuugaauuaugcagugaaacaccaguaaguuucccaaaaaugucagcauuauuuagauaguaaaaugagaaaaaagaaacauaauagugucugggcgcaguggcucacaccuguaaucccagcaguuugggaggcugagguggguggaucaccugaggucaggaguucaagaccagccuggccaacauggcaaaaccccaugucuacuaaaaauacaaaaaauuagccaggcaugguggcaggcgccuauaauuccagcuacucgggaggcugagguaggagaauugcuugaacccuggaggcggaggucgcagucugcugagauugugccacugcacugcagacugggcaacagagcaagacuccgucucaaaaaaaaaaagaaagaaagaaaaaaagaaacauaauaguaaucugacaggugauguaaugcaaaccauuacugaggccagucucaguggggauccuucaaaggagucauuuuaggauucugaauaauccuaaaagagcccuggaauauggauuugguucuuaguuccugcagaguaaagauuauuugcuacucagaaacuagaaguuccauuccaucugguauuucuuggggucacaacagugaccuaaacuuuugaaggcugaacucuaaagcagcaugguuucccaccaagauauucaagccaaaaauuaauccuugccuuucaauauaaucacuucuaauuucaugccuuuugguauaaccacacuugaugaaugcuucauuucuugccuuggaaagccuugaccuuucaugacuguccacaagccaugauugaccaggaacucuuugggagccucccauugcacaacacuaccacaaguagaccaugaguaggacauuauugguuggaggcaucauuggucucauaaaauguagacaaaaaucuccagggauauucuucuaccuuucuaaaaaaaguaagcaagcaaauggaaggugggccagaaacagccaggauccagacugucugaugauaauaagacaaggcaagccagagcugcuaggagguggcuuggacagcagguagcagaaugggacaggauugucucaugccagauuuuuguaacagcaucauuguaagguuauugaauagcagagagguaguauguugaacucuuacuuccauaacccucaagagaaaugacaugguccugagucugggauacaaaauucuauuaaauguuuaaaucaguagaggaugcaguuaggaagaugagcaaacuccucaggaauaaaagacuguuuaaagagaaggaaaauaaauggaaauucuagaaaagaaaaaauauauauagauauaaaaaagaaauuaaacaguagcuuaguaguagguaaauagcguaaacaaaaagaacuacaccuagauacaucuuaaugaaacugcagaaaaucuaagaaaagaucuugaaagcagccagagagaaaggacaguucaucaaaggaacaacagaaugacagaagaauucucaguaccaaaacacaaaguuacaagccagaaaacacaaauaaguguacacaaaaauuuuguagagacaaggucucacaauguugcucaugcuagucucaaacuccugcccucaagcaguccuccugccauggccucccaaagagcugggauuacaggagagggcugcugcgcccagccuggagacaucucugacagucacuacuggaggugcuacuggcaucuaaugaguagaggccagggaugcucuuaaauauucuacagugcacaggacagucccucacaguaauuauuugcuccaaaauuccauagugcugaguuugagaaaccuaaaggaauucuaaggaauauaccucaagaaagaauaaaaugauccuagaagacuaguagucugaaauguaagaaagaguagugaauaaaugaacuaguaaacuuguacaucgacucaaaucaguguugucucaauaaaacaacucuaauaucuuauuuauggaguuuuuuuuuuuuuuaaaaagagacuacugggaacguuggacaccaauauuagguaagucaggaggagaaaauuggaauugaaguauuagaaagucuucguguuguucaggaggaugucaagcaauuguuuaaacuuauuuaacaauuuaagauauauaguaaaauuucaaggguaauugcugaaagaacagaaauagagaauggaaacuagaggggaaaaugucauuaaggaaaaacaaaccagaaaauccaaagagugggagagauagaggaugagaaugagucauagagaaaaaacaaauaaaaagauguuagaacccugucuaaauauauuaaucacuaagguugauggacuaaacuuggcaguugaaaagacagauugucagacuuuuaaaaauccaacccaaacaaauagaugauaaacuguguuguuuaaaaugccaauaaauuuggagguaauuuguugagcaaaauaauaauaauaacuaaacaauagauguaugucuaaaauuguugugccagccaggcccgguggcucacaccuguaaucccagcacuuugggagguugaggcaggcugauggcuugagucuaggaauacgaggcaacauagcaaaaccucaucucuacaaaaaauccaaaaauuagcucuucaugguggcauaagccuguaguccuagcuacuugggaggcugaggugggaggaucucuugggcccaggaggcugaggcugcagugagcugugaucgcaccacuguacuccagccugggcguaagagugagacccugucucaaaaaauaauaauaaugauaaauaaaauuggcaugacuucuugguggauuaaaccuuuuguuauuaugugguauaaacaaaacugucaugccuucuugguggauuaaaccuuuuguuauuaugugguuaccuucuaauaccuaauaaaauguuucucauaaauuuaucugauacuaauaaaauuauaucagcuuucuuuugguuaguauuugccugauauaucucuuuccuuaauguuuucuuaauguucagcuuuuguauguccuuauaucucuuauaaauaguauaugucuagauuuuauuguuuaauccagucugucaaucuuugucuuagucuauuuacauuacugguuuuauugauaugcuuggaccauugugccauccuaaauuauuugucccacuuuuucugcuucuuuauaaucucuucuuaaaaaaaaaaaaaaaaaaaaaagcuuucuguauuaccccugcuucccaaaugaacuauuagcacacucucacauuacucucuccuuuggaaaaucuauccauuaacuaacuuacguggucuggcuccuuucugucuuucuaaauaugcucuccuuuccucacuguccuuuagcuauauuguccuuucugcuuuaugaauucacuugaauugguucugcuuuaggaucuuuuaaaauugcuguguucccucugccugaaauguaggcuuuuccuuacuauccuaugccaggagugugcugcagccagcuuauaccagcucacaagagccaguuaaugcaaaucucuucccaaaaccagguucauugucuucacauuaguaguuugaaaauggccaugugugaguauuuauaccacagaaauugucaaguacuguaagucggauuuguuuuaauucuuuagaggcuguuaucagcacaccaaugaucuuacaugaagucgucauuccccucccuagucacagucucucccaguaccuauuugauuuucuuccuugaacuuaccacuucuugaaauucuuuuuggguuuuuuuguuuuuauuuugucuuuuuuguuuguuuuuuuuuuuuuaauugcuguuguuguuuuuacuuacuuucugucuucuguaacuucaguauaugcacaguaaaggcagggucuuuaacugccauguccacugcuauaucucuaggacccagaacaguauccaguacauccuaggaauuuaauaaauauuaguugaauaaaugaauuacucagaaguggugauaauuuuaagcuauacucuuuuuuuugagacggagucucgcucugucgcccaggcuggagugcaguggcacgaucucggcucacugcaagcuccgccuccuggguuuaugccauucuccugccucagccucccaaguagcugggacuacaggcggcugccaccacgcccggcuaauuuuuuguauuuuuuaguagagacaggguuucaccguguuagccaggauggucucaaucuccugaccucgugauucgcccgccucggccuccuaaaguguugggauuacaggcaugagccacugcacccagccuaagcuauacucuuuagaauuuucuggagccauuaagaagaggaaaagaauuacauuuuucuauuuauaacuuuuuguuacugaaaauaucaaagguacagaaaaguagaauagcauaaugaacuuuuaugaaugcaucacccagcuucaucaauguuacaaaucuguuuugaagacccuaccuaauuuuucccuaaacuguuuuaaagaaaauuccagacaucauaugauuuuacuugcccuuuuuaaaaaaaagagugauauauuuucucuuauuuuuuguuucaaaaaugccuuuuuaccuuugauguguugagucaggauccuaacaauguucauuugcaauuaguugauaugucuuuuaagucucuuuuaucuauaaaaguucaccuuuuaaguuuaugccauuuauuugcugaagaagucagaucaucuuguaaaauuucucacauucugaauuuggugauuagauccuucuaauguuuaacauauuccuccuuuguguuuuccuugaacugauaguuagauuucgaggcuugauuagauucaacuuccauucuuuuggaaagaauacaucauagcuuguacaguguauuuuucauuguauuacaggagauuguguugucauaccuucagagauguuaaagcugauaagcaggcuccagaucagccugauccauccauuguaaaguuuugccucagccuuucaccuaaugguuuuaacaaccauugauuaucguugccuaaaucuguuauuuuauuagugauuuuuuucugucauuccaucuaucauuaauuagcuggaaugcuucuauaaggaagaaauuuucuuuuaauuauugguuacccugaaauacaguuggcacaagaaaggcaagaugauugcuuacuucuuuccauuuuuuuuuuucuauuuauuaaugucauuuuucagagucauguguuguuuccuuaaccccgcaaaggugacuuuuucagaauaucauuuugaguauuucauaaauuugcauuucaauccaucacauuauuuauuuuuaauguuuguauuauuccauuuuggggcauugggaaccccuucaguuuggcucugugcccuuugaugugacccaguaauuuugauaguuuauugacuguuucucaagcccauccuuauacauuuaagcuuauaggguuuuuaauucuuuaauuuuuauauugguauuuauuuccccaguauugaaaaucuuggcuuuuaauagcauuuauguuuuuuuuucucuucucuccuuccagacucuguaauuauauaacuuuugcauaauaaugaaacaaaguuaaggaagugcucaaauaaaguuugcugucuuaugggccuggucuccuuuuuuuccucauagcucuuucaccgaauuuuugucagaugccucuuuuaacauuaaaaaaaaauguggaaggguuuguacaaaaauaauaguuaaaugacauaauuuuuuuucuuuuuucaacucccccacaaaccugccccgagacagggucucacccuguugcccaggcuggagugcaguggaucagucacagcuuacuugcagucuugaacuccugggcucaaggaauccuccugccugaauagcuagaacuauaagcaugcaccaccaugcccugcuaauuuuuuaauuuuuuuuguugaggcagggucucaauguugcccaggcugguccagaacuccuggacucuagcagucucccaccugggccucccaaaguucuaggauuacaggcaugagccaccaugccugcccuauuuuuuuucaacuuuuauuuuggauuuagaggguacauguacagguuuguuacauguguauauugcaugaugcugaggauugggguauggguaauccuuucacccaaguaggaagcauagugacacaggauuuuucuuggccacuuugccagccagagaccuccagccagcaacauccaugcccaggcuuugcucaggcccgagcucaccagaagagaugcccugucuauucauccugcugggcuaugccuggcuugcgcuccaaugcagauccugcagccguggcaauugcgcacuggugggagggggugagggagugagcgagugcaguguccagcuggcugcuccaagcagugagacagaagcgggcuguauguagggauugcugcuggaccaggcaugucacacugaggggaacaugguggcgcccagacggguguccgcaacccugaaaccucagaggggguguuaccgugugcuaauagcucuuuuagucccaccaucugcagccccauggauggcggcauguuaacagcucugucuguccugucgccccugcucccgcccgcugcugcuucccgucgcgugggguagcugcccuccacuggcagagcguggagggccacaguauuacagccuucuuuguaccuguguuugguggguccugaguucuuguuccacauccaagaagaaugagguugugcugauaucaaagggugaggagggcggagaauaauuuuauugaaugaugagaaacaauucucaguggagagggcaugcgaggguggucucucucauuggggcuggggcuggggccuuuaugggcucagaauaggggaguguaugcucauugguuugugaguaugcaaaaaaaggcuaaaacaaaggcacacaguguaaaaaaccaauuagggaaggguagauauauguaaaauagguaaagaguggagaaucaauuagaggaaaguaugccaaacgggaagagagguucucaguucaguccauggauuuauccaggacuuguagcuaggcuuuaaacugucuuuggcuugaagguuggguuucaauuguauguaaugaacauacaagugcaugugucuuuuugguagaaugauuuauuuuccuuuggguauauacccaguaaugggauugccggguggaaugguaguucuaaguucucugaggaaucuccaaauugcuuuccacagugacugaacuaauuuacauucccaccagcaguguauaagcauuucuuuuucuccacagccuugccaacaucuguuauuuuugacuuuuuaauaauugccauucugacuggugugaaaugcucaucacugaaaucaucagagaaaugcaaaucaaaacuucauauaauuuauaaaaggucagacagcuguggaggcagagagcuuuuacugucauuaucagcagcaauaguguguaaaggagacuacaucuaacacaguauuauacccugaguauauacucaauaucuuuuuuuccuccuaaacuuaggugacuuuaagaguagagucucggcugggugcaaguggcucacgccuguaaucccagcacuuugggaggcugaggugggcggauaacuugaggccaggaguuugagaccagccuggccaacguggugaaccccuaucucuauuaaaaauacaaacaaauuagcugggcaugguggugcgugccuguacucccagcuacuucaaggcugagacaggagaaucgcuugaaccagggaggcggagguugcagugagcugagauugcgccacugcacuccagccugggcggcauagcagcuccaucucaaaaaaaaaagagucuucaugggcuggaauuccaaaagaauagcgucucuaggggucuugauuauuguuaaggaaaggaaugacccauguuuacuucucagaguuuucuuuuuguuccugcuggagaguuuuauuuuguuccauauucuccaagcagugcugauugaguucuaagauuaaauuugaauaugaaaauggguuauauuaauaccgaagcaaccugcacuuaucuggugcugauguuucuucgucagaaaccagugagaaacuaacuuggucuacuuuuuuuuuuccagacgacggacauaagaaagcucgaaaugcuuaucucaauaauuccaauuaugaagaaggagaugaauauuuugauaaaaauuuggcacucuuugagguaauauuuuggagaaaacuauggacugagacuuuaggaacagagaucucaugauagccauauuuuaccccauuugguuuaaaaauuuuacaagcuggauaauuuaauguuaaaagaaaauauuguaacuuguuauuauaguaaauuuugucuguguaaucuaauuauagugaguaacuauuaaaucaaauuguuauguaguaaggaagaggaguuugacuucuuggacauauagauuaccuugcaaucuaauucagcugugauuuaauuguuuuuauuagaauaaucuuucuucuaacuauaaaucaguguauuucuccacccuuugucuggaaagacuaucauuugccuuagaacuaacuaaacaaggccgggcgcgguggcucacgccuguaaucccagcacuuugggaggccgaggcggguggaucacaagguuaggagaucgagaccauccuggcugacacggugaaaccccgucucuacuaaaacuacaaaaaauuagccgggcaugguggcgggcgccuguggucccagcuacucgggaggcugaggcaggagaauggcaugcacccgggaggcagagcuugcagugagccaagauugugccacugcacuccagccugggcgacagagcaagacuccgucuccaaaaaucacuguaggaagcaggcuuccagauuagcaggaccuucauguccuuuuuuuuaauugucaaauaauaacuguauauauuuauggauuacaaugugauauuuugauauuuguaugcauuguggaaugauuaaaucaagcuaauuagcauauauaucaccucguauacuuaucauuuucauggugaaaauauuugaauuugacuuucuuagcaauuuugaaauauacaauauguuaacuauaguugcuaugcugugcaauagaucucaaaaacuuauuucuccugccuaacugaaacuuuguauccugugacuaaccucucccccuuccccuacauacaccccaagcuuuugguaaccaccauucuauuacuacgaguucuacuuuuuagaucccacauguaagugagaucgugugcuauuuaucuuucugugccuggcuuauuucacuuaacauaaugaagaggacuucuauaucuuaucugaauaagacaacauggacucuguggccaggcuccauaagcuguggccagguuguugaaaggagccugguuuauuucagcacuaccuuuuucuggccuuugacaaugaugcaagugccacuucucucaauguaccauuuuuaguuuguuuuugagacagggucuugcucugucacccaggcuggagugcaguggcacgaucacagcuugaccuccugggcucaaaggacccuccuaccucagccucccuaguagcugggacuacaggcaugugucaccacaccuggcugauuuuuaaauuuuuugcagagacagggucucacucuguugcccaggcuggucuugagugccugggcucaagcgauccuucugccuugcccucccauagcauuggguuagcaggugugagccaccaugcccaacucaauguaccaauuuuuuuuuuuuuuuugagauggagucucccucuguugcccaggcuggagcgcaguggcgcgaucucggcucacugcaacuucugccuccuggguucaagcugauucucccgccucagccucccguguagcugggauuacaggcacgugccaccacacccagcuuauuuuuguauuuuuaguagagacgggguuucaccaucuuggccaggcuggucucaaacucccagccucaggugauccagccaccuuggccucccaaagugcugggauuacaggugugagccacugcacccggccuaccugugaaauauuuuuucauuuaauuugaaguuuucugguagcaagauuauuuugauacuuauguucaguguucuuuguagcucauuucuuccaugucacuggcuuuauaggaagaaauggacaccagaccgaaggugucuucccuccucaaccgcauggccaauuacacuaaucugacucaaggagcaaaggaacaugaagaggcagaaaacaucacugaagggaaaaagaagcccaccaaggugaggccucagaauaacaaggaauacauagaaagagcccuguauauaagaaagaaggaaauaccuaaggcaccauucuguguucagcagcuauuuauuaaaugcuugagaggugccuggaacuguucugggcaccagcgucauagcacaaagaaaacauaugaugcagucuaaauucugauguggggauacaguccuuaagcuguuuuaacugccaaaguauauaacauauuaaguguugauaaauucccgagcaaaaaauuaagcagaguagagagacugaaauuggcaagggauccagaguggagggcguugcuacuuacauagguuggacagggaaagccuuucugacaaggugauauuugaggagagaucuagcugaugggagggagugagcuaugugggaaaagagcauucagggagagggaauagcuuuucaagagaagaguguccauacccaucugcugaugccaucugucuguugugaaguuguuggguuuuuuaaacaccaaacaucaguuugucucaaaaugaaaauauaagacauucaguuuaccauucugguuguucagcccuuucaaaaagggauaaaacggcccucagaucuucauuuugccaucuaauuuauuuacuaacuacugugaagaauuuaugccaaauucugaagaaauuccaucaaguccuuauuguuuuuaaaugaaaaaagccaacagcuuugaaaaacaaaauuuuaaauuguugugggugcacauaaaaguuuauuuguggccaaaugccuauguauaauaaacacaugcaggaaccuuuguaaaguuaaaauauauagcuuuaggaauaauaaaaguauggugauaaacacuugaaagauggagauuuuauaugugcccuuuugaagguauugauuaaacuuaugauuucugcuuggagguuaauaugguaguuagggagcaaguuauuacauaaaagaauaaaaaccucucuuuaggauaacugugugauuuuuuaucaaugucuuucuuucuagaccccccaaauggguaccuucaugggugucuaccucccaugucuacaaaauauuuuuggagugauccuuuuuuuacgccuuacauggguggugggcacagcuggaguucuucaggcuuuugcaauuguccuuaucugcugcugcuguguaaguacugcacuggcuccuagagaucaccugaacguugcaaguucucaagagcagaugcacaugaccucuuugggaauaaaacaaagaauacuuagggaaggacucaugaucucaacagaagaaauuauucugauauuaaaaucuaaaggauuuucaguuauucagugccuguuagucacugcuugcuaucuauuauaugauguacuagaaauuacaaagcaagacuucaacugaaaauggaagauaaaguuccugucuucagagaauucagaauccaaacuauuugagcuugauagcaccaaaguugugacagaaaauguguuagaaaaugugauguaucacuccaguauauauugagaaacaagacagguuauugcggaugugagggguauuugguuuuuuuauuugguuuugaaguuucuucccuuaucccuuccuuagaaauuuagauguucuuuccaggucuucucucuacugagaacauuuuuaucuuccuuuaauuuaaacuucucauuauguaucccagacacaccuaugaauuuuauaguuuucuacuguccuuuuuuaucacuaugaccuuuauacccuaccuguauauuauccccagcugaugagcaaaacagguuaagcaggcacaguucauauuuuuaauaacuuaaaauguucaugguaccaccuuuuuuuagucucaggcuuaaaaccucaaggcuguguuuggcuucuuaauugcuuuucacaucuaaucagcuaccaacgcuaaucuauucucugaaaucuuuuacacucagcccuuuuuauucacacuaccaccacuauaguuuuuaccucucacugaacuacuaugguagccugcuaaccaaucacucggccuccagcuacuccuaucugcagcgcauucuauacugugcuaccggguaauauuuuuaaaaugcgguuccugugugcucagaagccuucagugauucccuuucuuacugaacauuguucuugauauuguauuuagucuuuagucagguucuaaccuauuuucugaguuauuucucuaguucuuccuuuugaguauacuaugcucuauuuccuguguaacuaggaaauccagagugagauuagcaguucuuaauagcaccugaccuacugaugugggagcauuuugacagaauccuccagauauuagugguaugacuagcgcaaugaauuggaccauaucaucuuauuuccauaccauuagguaugacuguccauaaaaguagguagaguuaaauguuugccaagugcucuuggaacacaaauggagaaguaguauagaaaugucaucuuuacacaguaacaauccucuccuuuccuuuucucugcagacaauguugacugcuaucuccaugagugccauugccacuaauggaguggugccagguuaguaggucaagguuguauuucaggauuuaucaguguugacucuguguuuaugcuauaaagcuagaggugcaaacuucugaagaauagaauacuauuuggucuguucugugcuacaacagaguaauggucuauaggacguagacauaauacuacuugacuuuaagaugccgucuuuaaaaucucuuuauuuuuuaaacuagaaugcauuaauuucagucacauucuuagcuuuuauuaguuggaauauauauuuuuuuauagacagagucucacucugucacccaggcuggagugcagugacacgaucauagcucacacagccuccaacuccuaggcucaagcugcuuucccacuucagccuccugaguagcuggaacuagagguguacaccacuaugccuggcuauuuuuuuuuuuuuacagaggugacauuuuacuauguuacccaguuuggucucaaacuccuggccucaagcaauccucucgccucauccucccaaagugcuaccauuagaggcgugaaccuccacacccagccagaauauauuuuauugggcugucucaugucauaguaaauauucucuaauuuuuuucuaaguaaaugcuggcaaacuauugcuucauauggcucauuacauuaguugugcaguauaucccacaauaacacuuucaccuuuuacuucccacuagcacaucuuuuuaucacauugaggguuugcagaagccugaaacauuuaaccuuuauguauauauuuuuucuuauuucuguuuuauucauauuccucuugcuaauacacacucuuucuucuauucaccuucuguuuugucuuuuagcugggggcucauacuuuaugauuucccgggcacugggcccagaguuugguggggcuguuggccucugcuuuuaucuugguaccacauuugcagcagccauguacauccuuggugccauugaaaucuuucugguaaguaaugacuucauuguggucuauaauauagaagaaauauugauuuagguuuauucuuugcuaugaaagcuucugagagaucagcugugggaauaaaucaggugauugacugccaacgucaguuggccucuuacaugaauaugagguggaaagguugaaauucuguuugccugccugucccuuccuuucuaccugauugccaccacucugccaccucauccaagagguucaaguccaauggggaaaaaguaaaauaaaguuuaucuuuuuugauaucuucaucccuaugaaauaaaaugcuucucauaucucucuucacugagacauauuguuuacuauuuaaaguagugauaguagagucaggguuaaagaucaucauuauaauuacuuuauauaacccuaugaauaaaauuaauaauuuguuccuuuccuuucuuuccauuuggaaauguaguuauucagaacagcauguagaccaaaaaaaaaaaaaaaauccaugacaucccauuucugaaggcauuucagauccuauuagaaacuaggcuaauuccccagucauuuucucucucagcuuugcuuucuuuugugaaaguaaaugcaaacgaauacagccuuuuuacuuaauuauuuugaaauaaccuaauuuucuccuuuauuuuuaccuaacaggucuauaucgucccccgagcugccaucuuucacagugaugacgcacucaaggaaucagcagccaugcuaaauaacaugcgugucuacggcacagcuuucuugguccuuaugguauuagugguauuuaucggcguacgcuaugugaacaaguuugccucacuuuuccuggccugugucauuguguccaucuuggccaucuaugcuggagccaucaagucuucuuuugcuccuccacacuucccguacgugucugucucucugccuagccauccuuauuggguaguaauugaaaauaucugguggugugauaauuuuaagucagaauuucauagagucucucugagauuuucccucucagauaagcccaguuagacuuccuuccucaucuaggcaggaagccuaccagcaaacuaugucccguucauccucuuucuuauguccuaagcauagaacuaguagcuguaaccaucauuuagguucagauauuagauuuuuuucucccugauaauuguacauaaucuuuuuuuauuauacacauuuugaacuauucauaaagggcuuugcagacaguguaguuauugccagcaaccuuuauaaggcccaccuuggccucccgacgugcugggauuacaggcgugagccacugcgcccagccuaggucagggcuuuuauccauuacccaaauaauguacuuuguacccauuaaguacucucucaucauucaccaccuccuucaacucccuagugcgaauacuuuaaaguauguuuuuugaaguaguaauggauuugugcacaucugugacucacaggcucacuuuucccuuugacuaguggcauagggacuagcuggcacucaguguuauuuguagucuuguuacagaauuaucuugaagagucaucuggauuaucugaggaucaaacucaucgguucuauguugauuuaaccagauuacagaaaaaaagauuuuucaagacaaaaagacaguuccaguagguuuaaugacuuaccucaaaguuaauuaauggcagagcaagaagaugaacugugauuuccugacuccccauucaguauuucuucuaugcuaugcugcaugauggcagaaguagauuccaucuuaaacuuuuaaucugcuuaucuagggacuguaauacagcugaagguccuuuuuaggggcauaaaauuucuaaaggugacauucugguuauaucucaauuugggaaauuccauuuugucucagguucaccuuuggggcuucuccucuuuuuugauuaguacacggucauaaugcaugguauuuucuuugagauauuccagcaaaacaagacaaaaaaucuagaauaauacaugaaacaagacugggaaauguugagaguuguugaagcugaguaauagguacaugguucauaauaauguauucaaucauuuugcaaauuuuagaagucccuuuguuggaccugagagguauuuuaacuauggauguauuauuccuuuguuuauauuugugucucuggguuaaagaaaaaaguaaaaccagcagguuaauauuuauguuauccuuaccgucacucccacugagucuaggcuuaaauucaaaaacaguuuucucuuaggccauagagggaucugccuuuuaauucugaccaagcuguuuuccuugcaacaguagccagaagauucaaccuuuagcauaacauuuucaagguguuuguuaugaauguuaggcuuuucuaggccaaaaaaagaggagugcuuuuuacuuuauaagaacaacaaaaggacuucaguauucuuuuagaccuaacaauuuuagccaaaaauuuuggaagaugagucagcauaaugucuucagacaguucuucaauuugacuuccuucacugccaccaccuaugaccuuggacagauaacuguauuucccuaaccuucaauuaacucccugucuuccuaaacuucagugccuccauccacaacauagaaauucuaauacauugugagguugcuguaaguauuaaauuggcagaaaauguaagucaccauucacaguguuaaaauaaauuauaaauaaauaaacauuaguuccuuucccacccauaacaguagaagcucuuaaagaugggguucuuguuuccuuuacuaaccuguuuccuuuuuuuuuaauguacuuuuuuuccuuacuugaucuuucucccuauuucuuuucacuuagggucugcaugcuggguaaccgcacccuuucaucaagacacauugacguuugcucuaagaccaaggaaauuaacaacaugacagucccaucaaaguuauggggauucuucuguaacucgagucaauuuuucaaugccaccugugaugaauacuuuguucacaauaacgucacuucaauccagggcauuccuggauuggcuagugguauaauuacagguaaguuagggaguuauuggacaaguuuuuuccuauuuucuggggaaaauaggccuugucaucuuagauuccucuacuguccauaaagauucacugccauggugcuaauucccuucuuaagcacaccacacagcucuuaauucaccauauuucugcuuuuccauuaguaaagcuguccuuauucaguacuccuuuacagagugaugucugcuaaaauucaccuccauuucagagcagaguugagcaaaucacuuucuaaccuuacgguaaaauauuccguguauucuuguaaaauugccaauguucuuccugcacugacagaauagaccuguuuuaauguccacauccacauguaucuuccuaacuuagcuaaauuccugaaacauuccuuaagugucuucuauuauaaauguuuggucuauaaauuucuuugcacauaaguaaguuuacauuaagguguuagaaacagcacugaugacaaauaauaaugggauuuguggggcauuuaguuuuagucuguuuaacuuuuacuaauuugcauuaguaaaguuaaacuauauuugcauguaccaaaucauuuugucaaauuauauuuaaauuagauaagaaagaacauuauguuuagcugggcgccguggguuaugccuguaauccuagcacuuugggaggccuaggugggaggaucaugaggucaggagaucgagaccauccuggcuaacauggugaaaccucgucucuacuaaaaauauaaaaaauuagcugggcgugguggcaggcgccuguagucccagcuacucaggaugcugaggcaggagaauggcgugaaccugggaggcagagcuugcagugagccaagauugugccacugcacuccagccuggugacagaguaaaacucugucucaaaaaacaaacaaacaaaaaaaaaacuauguuuuuauuuauguguguuuuauugugcaauguguguguauacaugugcucauguagaagcaaacacaccuuuagaaacuguauaaaugaggagccugauuuugaauguuuggguagaaaauuaauuaucuuuuuuuuuucauacugcugcugcuuaaauucccauuuuucccacugcagagaaucuuuggaguaauuaccuacccaagggagagaucaucgaaaagccuucagccaaaucuucugaugucuuaggcagcuuaaaccaugaauauguucuuguugacaucaccaccuccuucacgcuucuggugggaaucuucuuucccucuguuacagguaaacacauaggcuguuguauauuuuagaagcugucagacccacggagugauuuuucucaggaggcagaauucucaggguuccuagauuugcuucuacucuuugcuaucaguaucaauaucaaaguguccaagaaguuaacuugguuuuuucccccuuaucucuaaagguaucauggcuggaucaaacagaucuggagaucugaaagaugcucagaagucuauuccgauugguacuauccuugccauccugaccaccuccuuuguuuguauccuuuuuauggauccagucugagucuuagucauaggagcauccaguagaacuagaugaucaguauuuuuauccugguaacaaagauaccugcuuucuaucacuucacuucuugccagauuaucugccuaccucauauagaaaauucaaaaaagaauuuauaggaguauuuagcagcucauuuuacugacagaagaaagugucuacugagugucuacuuucuaucucauguuagaggguaaacaacaguuuccuugacucucaauaugguagauuuaagcaauguuguccuuuuuggugcauguauugaagggguuguucucagagacaagugaguaaugaauuucuuuguaacaauuaugugugugucugccaugacuucugaucauuccacauagcuccaagacaguuacagacucaacacagccaggcaccguggcucaugccuguaaucccggcacuuugggaggccaaggcagguggauugcaugagcucaggaguucaagaccagccugugcaacauggcaaaacccugucucuacaaaaagcacaaaaauuagccaggugugguggugugcaccuacaguccuggcuacuugggggacugaggugggaggaucacuuaagccugggaagucaaagcuguagugagccaugauugugccaccguacuccagccugggugacaaagugagacccuuucucaaaaaaauaacccaaccugaguuaucaaucaugacuaacaauaagaaaauauaugaauguaguucccaaaggggccaguauuuucagugaauauaugagacaguuaaauacaguccuucaaaaaagcagugaaugugucugaauaaugaggacuucccuguccaucaagaacuguucagaaacgagaccaaaagucaagaagggcaaguaaauaaaauuucaagugucucuagcaucuccuuuaugagagauaaguaucuaauuguguuuggcauucuaaauaaaagccugaaacuuacuuucuucauauucuguucuuuucucuucucuucuuuucuuuucuacuuauuuauuuagagacaaggucuugcucuguugcccagacuacagugcaguggugcagugacagcucccuacagccucaaccuccugggcucaaguaauccucccgccucagcuucccaaguagcugggaccacaggugcauaccaccacacccagcuaguaguuuuuuuuaauuuuuuuuguaaagauggggccuuacuauguuguccaggauggucugaagcuccugggaucaagcaauccucccaccuuagccucucaaagugcuaggcuuauaggcaugaaccaacacacccagcccuuuccgcuauuauuuuauuaaaauuucccauacuacacagauguauccucuauucuuuauccacaucacucacuuuguacagaccuucaggauuuuugccuauguuauuguaauaaucucccuuuuaguucuagccucuaauccuucuuccacacugccaccagaaugacuuuucuaaaacacaaaauuugaacauacaaaccucccugcuucagagccugccaaagccuguuaaaauccaucacuguaaucuggcccucucuaccucuuuuuacuguuaucuccugccauucccucauaagcucccuaacuuagaguuuaauaugucuuauuaugucuccacguauaaacacauuugucuguguuauuuccuuugcuuagaauagguuacucccaccuggccaacucauauucauccucuuagagacuaggcuaagggucuucucuccuguaaagcuuucccauacucacccaaacagagguaaacacuccaccuuguguucagcaacuccauuugaauauacuauauuauagcauuuaugaugcuauauugcagcuacuuguuuucauauuacucuccccuacacguugagcucuuugaggacucgaagccuaacagaugcaauauaaauauuguugacaaaaauaaaaagcacaauauauauauguauauaacacaguauauguguguguguguguguguguguggguggggguguauauauguauguauauaguauaguauauuacuauaccauuguaguaggaaauucauggagcuuugguaaguuacaccaugauauaaaaauuauuauugagaguguaaauuagaguaucauuuuggaaaauuauugguuauuaucuccuaaaguugaacaugugcuuaccuaugacucagcauuuccacuucuagguauaucuaacagaaaugcuugcacaugugcaucaagacuaauucacaagaauuuucacaguaguguuauucuuauuuauuuauuuauuuauuuuugccugcuucauuuucucuucauaaguauucuuaauagccaaaaccuggaaauaauccaaauguccaucgcuaguagaaugauuaaauuauauauucauguaauaggaagccauacagcaaaguaagucauagcaauauacaccuccccccaaaaaaauucacaagcaaugcuaagugaagaaaaccaaacacaaaaguauguacuguguaucauuuauauaaaguuuuaaaacgguaaaacucuauaguauucaaagucagagggcuggguaugguggcucaugccuguaaucccagcacuuugggaggcugaggcuagaagauuguuugaggucaggaguucccagaccagccuaggcaacauagcaagacuuugucacuacagaaaguaaaaaauuagcugggcaugguggcguaugccuguagugcuagcuacugggaaggcugaggcagaaagaucacuugaacccaggagguugaggcuacagucagucaugaucacagcauuacaguccagccugggugacaaagcaagacccugucucaaaaaaaaaaaaaagucaggauaguggagaggaagaaaggacuaaugaguggggaugggcauaagagagaauuuuggguacuggcaguguucuguuucuugaccugcaugguaguaggucaacaccuacagcauggguguuggauuuguagaaaucuucagaugugcauuuguuguuuuuuugcacauuacuuuuuuuuuuuccccuagauggagucucgcucugucgcccaggcuggagugcaguggcgcagucucggcucacugcaaccucugccucccggguucacgccauucuccugccucagccucccgaguagcugggacuacaggcgcccgccaccacgcccagcuaauuuuuuguauuuuuaguagagaugggguuucacuguguuagccaggauggucucgaucuccugaccucgugauccacccgccucggccucccaaagugcugggauuacagccgugagccaccgcacccagccuugcacacuacuuuuugugugugauacuuaauaaaaauuguuaaaacgaguaauuaaacugaugcuauguuucacccaucaaauuagaagugaccuuaauuuuuuuuaauacagaagacugguguggagugugcaugugccacaagacuugaaucuucuuauauuuccagugggaguaaaauuuaguacaaacuuucuggacagcaguuuaguagugauuuugaaauguuuuaagauauugaucccuuugguuaguuauucccucuuaagaaucugccauaacuuagcugggcacaauggcucaugccuguaauuccagcauacugggaggccaagaggggaagaucacacgagcccaggaguucaugacaagccugggcaacaaggcgagauccugucucuacagaaacuuuuguaaaagauuagucagacaugguagcacacacuuguggucccagccacgugggaggaugaggcaggagcaucgccugagccagagaggucaaggcugcaaugagcugagauagcgucacuguacuccagccuuggcaacagagugagaccugucucaaaaaaaaaacaaaaccugccuuaaggaaaaaaaccugaacugugaauguagauaugugcauaaagauguuaauuauaauauuuuauauaauagaaagucaacacuagaagaauggauaagaaauugugaugcaauauuauucaaaucacuacaaauuuuuauucauagcuuuuuaugacauagaaaaaugcuuacauuucaagaauacagaauuauagugcagugagaucgcgauuuuucuaaaaagcagauauuuugauacccugaaggggaaaguuacaacugaagcuuagcuuauuuucuagccccauauguauuuuuuuccuaauauaggucaauagugccguuugaucaaaucuggcuaucuuauauuucguaauauuauuugucucacuuuugauucucuaaaacuuagaaaaaaaaaacugggugggcuggacgcagugguucacgccuguaaucccagcacuuuuggaggcugaggcaggugaaucacuugaggccaagaguucgagaccagccugggcaacauggugaaaccccaucuuuacucaaaauacaaaaauuagccagguguguuggugcacaccugugaucucagaugcucaggaagccgaggcaagagaauugcuugaacuuggggggcggaguuuggagugagccaagaucacaccacugcacucuagccugggugacagagugagauucugucucaaaaaaaaauugggugaauaucucuagucuuucagucuaaaguuauuuccagauuaaauuucccacuccuauuucuuucccagguucggugaugcugugaaagguaauuuggugguaggcaccuuaucuuggccauccccaugggugauuguuauuggcuccuucuuuucaacauguggggcuggacuucagagccucacaggugcaccgaggcugcuacaagcuauugccaaggauaacaucauaccguuucugagggugagugaccuuuuauuaugcccucuucuuuuuuucccagcuuuaaugagaaacaguguggucuucaugggcuuagaaauuacuagaucauaaauguggagacguggguuuuuaguacaagaaccucuaaaucccaagcaugaguuuaccugugagugcuguaaagguauuuaaaagguaucacaguuguaacacuguugucuuccagaugucugaaaacuguaggcuagagaaaucagagagcaaugacucaguacuccugugccugauauuucccuucuguguacagguuuuuggccacagcaaagccaauggggaaccuaccugggcuuuacuucuaacugcugccauugcagagcuuggaauacucauugccucccuggaucuuguggccccaauucuuuccauguaagagccagugauucucuucaguuauucuugcuuaaaugauaaauaaugcauguuuauuuccaucagucauauaacaguagugauaacagagugggcuaaauacagauguaacuucacuuaaauaaaaaucauuccugagaacuuccaaguaaggcuaacuuuuguaaguuauuagguuuuuuccuaccuauuuaacuucaaaaguucuuuggcuucauuucuaauucauugucaauugguuguagcuuuuaccaccacuguuaguuuuuauuuauuuauucaccuaugacuuauugaugcuuacuacuuaccuggcacuguguaaugugguauucugggaauacaaagauggauaagacacaaucuuauggaacugauaauggauaaggaaaccaaugauucccauauagcgugaugagugccaugauaaaggugaacacugagugcccuaggaacaccagagcaaggcaucuaaacagauggaaacucaagaaagauuuuccggaggaagugauacuuguaucuugaagaauaacugguuauuugcuaagaaaauaaggggugaagaacauuccaggcagagaaugcauauaaaggaauugagggauggcauaagguagcacauccagagaacuggaaguaguuuggcuuggcuagaguggaggguacauguugagggaauaacagaauagagaaguagguagacccagaucacaaagguccuggaacuuuuaccuggaaguaguggguaauccuugagcacaaaaugauaaugcuuuaggaugaucaaucuuguauaaaagauggauuagaaggaggcuagaauugagcugggaaugcuaauuggaaagaagaaaugagagccugaacuaaggugauuaguaguagagaugaaaaggaagagaagcagcuuaagagauuuuuaaauagaauccauaggacuugguaagugaauuuggaacaaggguaaggaagaggaaaccuggauuauccuaagaacaacuggguaaagagugguugugucauugacugagagaacagagaaggaugaacaguuuuguggggagagguuuaaguuucccuacuuccuacuuaaucaaggguuaguugucuagaaacaggcuucaauacagcaaagguauucaguuacuuaaccuucaaagaaucaucuuccaguaauaaucauuccucuuacucuuuauucuucagguuuuuucucauguguuaccucuuuguaaacuuggcaugugccuugcaaacauuacuucgaacacccaacuggagaccccgauuccgcuacuaccauugguaagucugcuucuuuuauucuuuuuacucacguuuggagagaacccaucuuugaacuagaaaacuaggagagucuggguucucgauaaaauuuuuuucuuggucagccauuucauacuguuucaacuuucaauucuuaucugaauccucauccuccuauccuauuuuccuauaucacuuuauaauaacuuauaacacccaauacgaauagagcaaaagcacuaaauagagauauccagccuucuauaauuuucagguuaaaacaaccuucucuugcauguuuauuuuccuguuugucucuuaggguuacagagucagagguucuaaauuccaaucucagcucuacuauuuccuagcuuuguaaccuucagcaaagcacauaaccauguaaaauuuaauuuuauucauuuguaaaaugggacuaauaaaucuaaagugcuuaucguagugccugauacauaguaaagcucagcucucaaugaacuguugcugcugcugcuguuguaguuaagucuccccaguccugaaggggucaucaugaaagauuuuuggcuaccaucccaucucuuuccucuuauagcucagagcucauuaauuauguccuguauguacccguugcuacauucuucuuugcuaacuuucuccuuguucccuuucugucuucacuuaccaauggugggcagugauguaacguuuacugggcaaaaauuaaaaucuucaacugauuuuuaaugccucaaauccucuuucuagcuuuaauguuaguuagaaguucuuuaugaggccgggcgugguggcucaugccuguaaucccagcacuuugggaggccaaggcaggcggaucaccuaggucaggaguuugagaccagccugaccaacauggggaaaccccgucucuacuaaaaauacaaaaguagccgggcaugguggcacaugccuguaaucccagcuacucaggaggcugagguaggagaaucgcuugaacccgggagucggagguugcagugagcugagaucccagguucacaccauucuccugccucagccucccgaguagcugggacuacaggcgcccgucaccacacccggcuaauuuuuuguauuuuuaguaaagacaggguuucaccguguuagccaggauggucucagucuucugaccuugugauccauccgccucagccucccaaagugcugggauuacagcugugagccaccgcauccggcccaaaaauaauuuuucucagugaguucugcaguuaugcuaauaaguauuuauaaaauuuuuagaaauauuuauaugaaauuuuuuaaaaagauccuagaguuauuaacauuucuggcugcgugucccauccuggcuuugccaaguaaguauuaauuguccucauaacugcagaugacugauaguguuccguuauuuauaugguuuuccagcaguuggaaacaucuucuguugcaaaggacaguuugggguuuagugcacaucuaccgacuguuucaugauaagacaacuauagaauugagaauaaucauuuagaaacuuuuguggcaguuugacauugcuacagcauccaggcaugugauaauuuuucgaauaauucauuuuuauugcauuuuacaaaaguucuauuuauaauaguuucaaaguuuuuaaaaaauaauaccucaccacagauaguuugagaagcaccuuuaacauaggcuucuuuuucagcuacuuuaaaagauacuuuuuuguuuuuaauuuucuagggcccuuucuuucaugggaaugaguaucugucuggcucugauguucauuucuuccugguauuaugccauuguagccaugguaauagcugguaugaucuacaaguacauugaauaccaagggugaguguggauuuaaucuugaucacugcuaaaaguagcaagacuagcuaguuugguuagagccagcucagugaaaauaucuuaaggacucagguaacuucauuuucauaacuauauuuuguaccccuaauucuuuaaccaucuuaaugaugcaagcuuuucaucacaagggagauccauugagaaaguaugaauggaucaauggaaaauaacaaaggacauuuccaaauaauaauaauuaguacuaaacaaaguacaacacaaauguaaauauuuuugcuuaucucuucagucaagggguugucucugaaaugaaaaagaaauuaguucugaacaacuuaguaacuacuaagacuuacagcuuucaaaaaugaggacgaaauaacauucuuauucagaagaucacauugaacuuuacuuucucugcauuauuuucaaaguaacuuaaacuccaggucuguuauaauuuucuaaucuaaauugcucuuuuacauuauuguuuugaacaauuacauagaaggacugaaugagugaccccuucaggcuuuauugggaacuguuugugcagugcagucuguuggugcuguugaucuaccuacaucagguucauuauguuaguaaagaacauuauguaaaucauuaaucugagcuuuaaucuucuaccuugcacaugugugauuuuuagauucagaaaaaaacuuuauuuuuuaaaauuauacuuacuauaguuuaaauuugucucugcucuuuucuuuuucucacagagcugagaaagaauggggugaugguauccgugggcugucccucagugcagcccgguuugcuuugcuucgauuggaggaaggaccuccacacacuaaaaacuggagguaaagaaaucaacacuagcaguauuuggcacaugguuaacacacaaaaauauguguuuuguugauuuuaggauaaggaaaccauauguggcucaaggaauugguauaauggaccuguuuugaacuauucuaaauccuuaauuuuuuuauucccuuuucuucaugucguuuaugaucaagauuucuacaauuuauuauucuuccuugaagacugaucaacuugagauaguacugggagcauucaaaauaaugcccuuauccugucaucuccugugaucucuuccuucugucaaauuaccuguuucauacagaucuccugaauuaaaggguggagucugucauucuguuccccaaacccaaaauguuuucuccuccccuccaacccccaccaaccucuucacaggccucaguugcuuguauuacugaaacuagaugaagacuuacaugucaagcauccucgccuccucaccuuugccucacagcucaaagcaggaaaaggucucacuauugugggcucugucaucguggggaacuuccuagagaacuacggugaagcuuuagcugcugagcagguaagagucaggcuuuugagguauuggaacucaguuuacagcuuugugauguuaaguaguaagaccucaaacuucuacuugaaucuuguuccugagugaucuaggagguuucucacuuagugcugaccuuugaaaggacacuuuuucccaaauaauaagaugagccaaaaauaguuauuuauuauuucuuccuguuuaaagcauuacuaaauuauaagauuauuaagucuaaaccuuauguucaaauauacuccaaacauuaaucuaagcacugagaaaagucauguaaauaaauugaucccuugaacuauggagaggguuccucucaaucuugugacaacaaggaguaaugaccaaauuuucuuccucuuuacuaaucuacgugguaucaugagcaagauuccuuugccacuucugguuagcuguauugaacauuaaaguucuacuuuaacaaggaaguuguuuucacucuaauacuuauuauauaugauagaacuaauccuauuguuuuugaaaugccauuguguucaauggcauuucaaaaguuuuacuguggggggaggggggaaggauagcauuaggagauauaccuaauguaaaugacgaguuaaugggugcagcacaccaacauggcacauguauacauauguaacaaaccugcacguugugcacauguacccuaaaacuuaaaguauuuaaaaaaaaaaguuuuacuggauuucauuuuggaauccuuugaaauccuaaacacuagaaaugcugaagaaacauuacuccagaaugaugguaaaaauuaauaaaagguacacaggauugaaaaucaggagagccuaguucuuagccgcaucacugauuuaaucugugccuuugcaaaaaucauuccauuuuccauaccauuauucccaggguggaguaagaguaaaugagaugauaucuccaaauugguuugacuaaauaaaggaagaguaaugcaaauacaagugucaugaauaaucaccauuaaaaugucaaaaagcauaugggaaugggagaggcgaaaaagaaaacauaccugagaaaauucuaaagugaaacugaaucaucauacugaguuucugguaagaugagucagggcaugacuggggcugaggcaggaaggagaucguguucacaauagugaaucacccuggucaacugagaaagaauguugaauauucacuuuguagagaucccuguucccaguuuuuugguauggugcaaaggaacaaaagcagaacagaggaaaaagcagagaaacuacauguagacaaccagcuacagaggcaaaaauacguaguaagcaaaaagacaaaagaucaugaaauuccuuugggauaauuuuaacuuuuuggacuuuucuguagaugauauaguauuaugaagacuuuggaaaaaggugggggauauaauauggagaaggaacaauggguuaaaauguccagagugaaccaguucaguguugcgguccugugucucuuucagaccauaaagcaccuaauggaggcagagaagguaaaaggauucugccagcuggugguggccgccaagcugagagagggcauuucccaccucauccagucauguggccuugggggcaugaagcacaacacgguggugaugggcuggccuaauggcuggcgucaaagcgaagaugcccgcgcuuggaagacuuuuauugguacuaaccauuucucauacaaaccuaaaggcccaagucgaggguauauaguuaaaucucugucacccccagccuccuaaaguagagacuaugccauugcugaagcauagucuuauaaggcaaccugaaaaacuauugguaguaauacccagauucuaccuacccccuucagcuucacauuauguucaugaauuauuucugucaagucuugugcuaggaauuaucuccaaaauugccguguuuucauuugugauuuuccauauugauguucucacaggaauugcaagaauuguucuucagcaucauaaucucucaaauucacauauccccccuuagaaauguaguaaugggaauauaccuaguaacauaaacugugguucucagucuguuagcuauucagauuuuucacaaugguuuuugauacguaaugagaaauaaccuacuaaguaaauaggaccccuugcucaaagaagugugaaaagagcauuuccuugcuuuccugacaugcuaggaagcaaggcaagccuaaggauucuucucugcuuauucuuuuuucucccuaggcacaguucgagugacaacugcugcccaucuugcacugcugguggcuaaaaacaucuccuucuuucccagcaauguggagcaauuuucugagggcaacauugaugugugguggauugugcaugauggggggaugcuuaugcuacuaccauuccuacugaaacagcacaagguauuuuauacaacuuuuuuuuuacaaaagucuuucucccuucuguccugguucacaggacagacaaauucuuccucugauuauaauaguguugggguuuagaaucagaagaguuggaaguuauucuaggcuuucccaugaucccacuuucaaacaagagaaaucauugucuuuguauuugauaccuacuuaucuccaagugaaauucagccaauuaauaaaguuccauaugagcccuaggggaaaacaacaagugaacacaucuuuuuuuaaaaaauacugaaaacuuaagguauauguauauguguguauugcacgcauauaugcgcucauuccgugguaagacuaauuaaaugagauuuaaaauaguaaauauauagucugcauguugucauugauacacugucugaauaaaguacccucuuaacguaucgugaaccaucuuuucuuuugccaguguuuucuuguuaugaaauuaaggacuccuuaaaacuguauuaaaugugguguuuagucaaucuuuugcccuaauacaauaacauagcaaguaggaagcuaggaacaaauagccuuauacuacauauagcaagguucuucuagaccacaaugucuaaugucuuaggaaauaaccuuuuuugccuccuugcucuaauuuuucacauguguaugucacucucucagguguggcgaaagugcagcauacggaucuucacaguagcccaauuagaagacaacaguauccaaaugaagaaggaccuagccaccuuccuauaucacuuacgcauugaggcggagguagaagugguggagauggugagaaagcugaguuugagauacaagagguucauucccccauuccucucccugucuuccuugaaucuuuucugguuugggaaauuuuucagaucuaaauguggauuaauccccuagugccaaaaaaaaaacaaaaaaaaacccuaauuuguugcccuaaguagaauguauaugugaugcauguuugauguuauuuuuugguuuugcuuucuuguuuauuacacagcccuuauauuucugccagauucucaucugcuuaauauaguuuuaugaaauuuuuauucauauauucagcuuaaaaucacacauggcuuuuaaaaaaaaccuaacaguauaaaaaagagagacuggaguuuguauuuuguguuucaaggcaacacaugucuugguuagauuauggaaaagacucucagggccucugaauuuuaucuacagucacaaaaacauuuauguagcucaaugacuaaacaaaguaagggugaagcuuagguuaauauagugaugcugucccugguuuaauuuagugacuggaaauaaaaauguaugguucauccuucuuucuccuuugugcuuuuugccccuuuuaugugaugucuauggcagcaugacagugauauaucagcauauacuuacgagcgcacuuugaugauggaacaaaggucccagaugcuccggcacaugcggcuauccaaaacagagcgagacagagaggugagacauuacugcaucaauccaauccgugcucucuaaagucugucacugaaagggaugauacugggcugggcaugguggcucacgccuguaaucccagcacuuuuggaggccgaggcggguggaucaagaggucaggaguucaagaccagccuggccaagauggugaaaccccaucuguacuaaaguacgaaaauuagccgggcaugguggcacaugccuguaaucccagcuacucaggaggcugaggcagagaagugcuuaaacccaggaggcggagguugcagugagccaagaucacgccacugcacuccagccugcgugacagaggaagacucugucucaaaccaaaaaaaaaagggaugauacuauauuguuuucaaggaugacaaauuccuucucacucugucaguuauuccacuauaacccauuacugcuucaaaauaaccaaagaugaagcauaagagaaaauuugguagaauaacuuguguuggaccuucuuccucaggcacaauuggugaaagaccgaaacucaaugcuacgauugaccagcauuggcucugaugaggacgaagagacagaaaccuaucaggagaaggugcacaugacuuggacaaaagacaaguacauggcaucccggggacaaaaagcgaagucaauggaaggauuccaggaccugcuuaacaugcguccguaaguuuucccacucccaaguuuaucauaaaauuaccuaaucaguggcacaaaugugacuuugccuggacacacaggauggagucuguucauuucacccugaaucuagccaccucauuauuguuugccuguucauacuggcucccaaugaacacuguacacaagcuaaccauccccucuauccacauaguucaccuccauacuguguucuuacuauaaaauaagccaacagagaaugagaaaacccagauauuaauaucauaaagaaaccauuuuagccugggcacaguggcucacgccuguaaucccagcacuuugggaggcagaggcggguggaucaccugaggucaggaguucgagaccagccugcccaacauggugaaacccuguuuuuacuaaaaauacaaaaaaaauuagccggguaugguggugggggccuguaaucccagcuacucgggaggcugaggcaggagaaucacuugaaccugggaggcggagguugcugugagcugagauuguaccauugcacuccagccugggugacaugagcgaaacucccucucaaaaaaaaaaaaaaaaaaaaucauuuuaucagauuauccauagucaagugaaaaagcucaggaucucaaguuuuuaacguugacuuuauggcuaguugucuuuuuaccuuaacaaccuuuauuucuuccccacucagggaccaguccaaugugaggcggaugcauacagcagugaaacucaacgagguuauaguuaacaagucccaugaagcaaagcugguuuuauugaauaugccagggccaccccgaaacccugagggugaugaaaacuguauccuuuccaagaguggggcuuccaguagggaaaaucuccuuaaccucuuucugagauaacuagguaacaauaaaagucauugucuaugccccacuuucccucuuuaaggaagggagacuuaaaaguccuaggcaaggauuuuuacaaaguuauaagauuaaacucuuuuaggggaguuggggcaaauauaauucaguucuaguuuuaggugguguauuugcaacaugacaucuaauauucaguguauaaaacccuuccugacaauccuacagacagcauacccacauccuuucgccuuuuuagguucuacccgcuuugcaaagccuuucuuuuggauagaguuaggggagaagcugagauagaaccuccuuuaacugaggggaaaaaagagauagggauucuuccucauaccuucaucccaggacuccugggauacgggaaacccuucagcauugacacauaaauuagcuuauucccaccaguaccauuaagaaagaagagguuuaggccaggugugguggcucaugccuguaaucccagcacuuugggaggcuaaggcagguggaucaccugaggucaggaguucgagaccagccuggccaacauggugaaaccccgucuccacuaaaaauagaaaaguuagcugggugugguagcaggugccuguaaucccagcuacucgggaggcugaggcaggagaaucacuugaaccaggagguggagguugcagugagccaagaucgcaccauugcacuccagccugggcaacaagaggaaauucugucucaaaaaaaaaagaaagaaaagaaaaagguuuaaaaagaaaaagacaaaccgaacuggcagaaaaaucugacuugagcagcuucacuuagaaauuacuuggguucucucuaggaaucuuguuagcugcccuauuguggcuuuucuucuucuuucaucauuuuuaucuuauuuagaguaacacuucuagguuuucccauuuuuuaaauacacaaaugggagucugguauuauguaugcaaaaggacuggaucucugguuacuucacaggguuaaauucaauccaaaguucagacuuuucugaauauauaauaauuaagcagcuaauuuuguagcucuaugaucagauaaccucagauuaugaugaugccagguuuuaaguuugugcucuucuuuugccugucuccuugacaaguuuugaagacauggaguuccuagaggugcuuaccgagggacuagagcgaguccuacuuguccggggugguggcagugaagugaucaccauuuauucauaaccuacucugaaugaccgugcuugaccuguuuucuuaaaaggccuacguccuccauggaagugccagcucauuacuaccacucccacucaacuagaagccuguguucuguacacaucauacugaacucuugaugagcugagccucaaguaccuguguaaaagagcucccaucugaucugcagucauuacagaaaaagcaaauauucccucaacaucagaacaaugcucaagucuuucaagccacgucugagcagucaaaggcaaauuagaauuaacaagcugagccaauaaaugaauugguaaaagggaugcuagaaauucaacugaagaaaaaaagcaagucaaguacguauucagcauuaaagaugaaucucagaagucaugguucaauguugacacugugaggauaacaacuagagacagcuucaucuuacuaaagaauuuauggucaaguauauuuggaccuauuauccucggcaagccaagaugcaaacauuuuuuagcuauauuucuuuaguauacccacugcuguaauuuuauauuaggauacuaacuugaaacauggcugcagccucuacuucuucaaaaacauccccccaaaauaccagauuuaaauauccaaauacugugucaguguauacuucaacuguuuuguuucucuuaacucaaaacccauucugucauuguaacacaggcaguguuaccauggaaauuguuuuugguaagguaaaaauuauuucuuucagguuccuuucaaauggccgaacuaagagaacuccaaaaggaagcuauuaacauuuacugaaauagucugugguucucuauacaacauggacaaaacauacaagcuguugucuaagaaaugcaggucauggugcacauuaaucaacagguucuucuccccccgcccccacccccgcgccuuuuuuuaugcccucuuauuaagcacaggucaaaaaaucuuaaggaacaaauacuaggaaaacuggcuaaacauccuucccugaaagcacuggaccaucuuuuaaagggcacaucuagcaauggaauuggaaguucuagagccacacucuuucuuuagugccaacguuacugagcggcuacucuccuuaccuacuuuacuaaaauggcauacagauuggcauugaccuguugaagaaauuuuaccacuaagaaaucuuuugccucaucuacaaagccauaguuaagacuugaggcauucaacuuaaugccaaguauaagcauuucccccuuuuucuuucaauuuuauucuucauucugacuacagaaacuuggcccugaacuacgagauuagccaagccaacagucuucuaauuuguuuucagaaacuucaggccgggugccguggcucacaccuguaaucccagcacuuugggaggccaaggcaggugaaucacuugaggucaggaguucgagaccauccuggccaacauggugaaaaccugucuauacuaaaaauacaaaaauuagcugggcaugguggugcaugccugugaucccagcaacacggaaggcuaaggcaggaggaucauuugaacccaggaggcggagguugcagugagccaggauugcaccucugcacuccagccuggguaacagagugauauguuucaaaaagaaaguucagugugccaaggaaauacuuguguaagcucagcuuuuuauuuacuaauauacugaucaaacaucuggcuuacaagcauagggaaacuacuuauguggcuggcugagcaguaauuucaaguaugugaaaucuucauuucuuuuacagaauaguuauuuagagaaacuuuucuugccuguauucauggcuguuuuugaauuucaauuuauuagucauaaauagugccacucuucuuugauuacuaaauaggacauggagcaagcugaccuaggugucacaaauuauucauuugaccuguaaggacagagaaaacccuucaauauagcuuaagaaauugaguaauuuugggccgggugcagugacucacgccuguaaucccagcacuuugggaggccgaggcaggcggaucacgaggucaggagauuugagaccauccuggcuaacacggugaaacccugucucuacaaaaauacaaaaaaauuagucgggcaugguggcgggcgccuguagucccagcuacuugggaggcugaggcgggagaauggcgugaacccgggagguggaacuugcagugaaccgagauugcaccacugcacuccagccugggcgacagagggagacuccaucucaaaaaaaaaaaaaaagaaagaaagaaagaaauugaguaauuuugauuuguucccuuugcuugcuucaaccuccaggcccacugaggauggcaaagcggauaggaucuuaagucuuuuuuucuguuacuuccuacagaugguagaagcauuauuuacaacucccacugcaacacuccauugcuuaguugaguuuaacaguagugagucauguccugcaggauccaguaucuuuuuuuuuuuuuuccgagacguaguuucgcucuuguugcccaggcuggagugaaauggcacaaucuuggcucaccgcaaccucugccuccuggguucaagcgauucuccugccucagccucccgaguagcuggaauuacaagcaugugccaccacacccagcuaauuuuguauuuucaguagagacgggguuucucuacugaaacugauguuggucaggcuggucucgaacucccaaccucaggugauccgcccgccuuggccucccaaagugcugggauuacaggcgugagccacugugcccaaccaggauccaguaucuuaaaggcccauacuguaaaggucagccugccuaggaauucugccacauuuacacacaccccuggccaaaguaauauuuuuuuuuuccauguagaacaaauuaugggcagaaaguaaaguuaguuuuagaagugcuguuugugguuggagaauuguaaaaaucuuuuaaagggauaagggaauuaguggcuuuuaauauaaccacugcuucagcccgaaacacaaaaucacuguuacauggaaaacugguuauuaggccagauuuauauucaugucugucuagaguauuucauguguguauguguugcuuacguugucugucuccaaagucucucaucucuuuuaaucacugcaaauaaagcaauacugaaaacuugagagaaugcaccuuaggggaaggggcuauuucaagacagaaaacaaaggaaauaccugccuuuugaauaagaucccgcuuuugagucuuaccuaugacuuuaccaggguagauuagaaauacacauccuccugcugacccucugccuucaauagcuaucuaucuuaaaagcugaaguuugaacugcagcaucugcuugacaggugccagguuccuucggcagggggacgaucacucuauauaucuuccguugccucagauuccuguggcccaaggaucccaccaauccucguucccccuaaacaugcuaacaaaaaucccuuaucguggguauuaaaauaauaacaguuacacuguaugcauauuuaugugcuccuuuugucugguuuuucuuuucaucauguauaagcugaauucagcauuaguuucucacaucuucccccagguauccccaacagaauuuuuaugucccagcuuguauuaaauagaagugaaauauuaaggaaaauaaggaacuugugcaacuuuuuuuaugcauuguucucaaccauuuaauuuauugaaaggagaugcugcaacaguucuugauuuagcagcaguuauucucuuguuuacauaguuauguuuuuuuguuguuguuuugcucuguacuggaaacaaaaauaaaguuuucuacauuauuuuca

SEQ ID NO: 191215 - RNA, 5108 nt, Homo sapiens
uuaugcauuguucucaaccauuuaauuuauugaaaggagaugcugcaacaguucuugauuuagcagcaguuauucucuuguuuacauaguuauguuuuuuuguuguuguuuugcucuguacuggaaacaaaaauaaaguuuucuacauuauuuucagccuuggguuaugguauaguuucuuuguguuugucguaauaugcacauuguccuucuaggaccugucaccccaccauggagaaaagagucuuuugguucuuuuuaacauaagugauuaguuuaagaguaugcugaggagccacugggcuuaaagaaggauguaaauaagacccaaauacauagggaccaggcgcugcuuucucauguucacaaaagcaguccuccaccacugaacuccauucucugaaagaagaaagaaagaauaaauaggugaguggcaaaugaguguuaaaauaacuuccugaaucaauuacuuaauacuuuaaccacaagcucuauuuugccuauccuuaaaaaagaacuuccaggccaggcgcaguagcuaaucuuagcuaaacacuuugggaggccaaggcaggcagaucgcuugagcccaggaguucaagaccagccugggcaacauggcaaaacccugucucuacaagaaauacaaaaauuagcgagccauuggggugcacaccuguagucccagcuacuugagaggcugagugccugagcccggagguugaggcugcagugagccaugaucacaugacugcacuccagccugggugacagagcaagacccuguuucaaaaauaauaacuuggccaggcaugguggcucacaccuguaaucccagcacuuugggaggccgagguggguggaucaccugaggucaggagcugaagaccagccuggccaacauggugaaacccugucucuacuaaaaauacaaaaauuagccaggugcaguggcaguugccuguaauuccagcuacuagggaggcucaggcacaagaaucgcuugaaccuggggggcggagguugcagugagccaagaucacaccacuguacuccagccugggcgacagagugagacucugucucaaaauaaauaaauuaauuaauuaauuaaaaauaauaacuuaaaaacuccuaauggcucuuauuuuuuaagaaacccuaggccaggcgcaguggcucacgccuguaauccuagcacuuugggaggcagaggugggcaggucacuugaggucaggaguucaaaaccagccuggccaacauggugaaaccccaucucuacuaaaagauacaaaaaaauuagcugggcaugguggcaggugccuguaaucccagcuacuuggaaggcugaggcagaauaauugcuugaacccaggaggcggagguugccgagaucaugccacugcacuccagccugggcgacagagcaauacuccgucucaaaaaaaaaaaaaaaaaaaaaaagaaacucaaauaccaacuccaauuuccuaccaucaaguaggucagcuauucacuguauacuacaacuacccaaaauucagcuuuucuuuugccuuaccucagggggcucaaugaaggcuaaccaauccgaugcauguguagguaacagucccauggacuggcacuuguaaacagccaaugccaaacccaucagguucccaaugagauagaccaaacccugaagaaacuucuggcuugaacuuucuaacaucuugaaagcuguugcgguaacagaaguugucaaaccaaaagaacucuuucccccaauacgaaucaagccaacuguauauuaaauucauauagacagacccauaguaagacagcaaauaggaccauuaaaggcaaacagaaaaccaugguaagcacuacacuccccuccaugccaccaccauuaccccacuccccuauauaccuguuagccaaaaacugucccuaagaauuuaccuuuaauucuuccuuuuuuuugagauggagucucguucugucacccaggcuggagugcaguggcacgaucucggcucacugcaaccucugccucccagguucaagugauucuccugucucagccucccaagcagcugggauuacaggcgugugccaccacgcccagcuaauuuuugcauuuuuaguagagacaagguuucaccauguuggccaggcuggucucgaacuccugcccucagaugauccacccagcuuggcgccucccaaagugcugggauuacaggcgugagccaccaugcccggccugccuuuaauucuucaaacuuauggaaggguuauuguuucaagaauacuuacuggcugaaauggccauaagugccugaaugggucgccaggccaucauacacaccaucauaguagggaagauggagauaguauugccugccauguacaugaugaagagauucaugggaaucuguuugaggggacccaaggcgaugucccagcagcgcuaaaacaaaacacacaauuuuaacccucugaucacuacccuuagucccacauuugccauaucacugaugcuaaaucacaugaacggaauucccaacucccugcuucuaacugagcugacuccucaauucuacgaccucuucccuucuccacguugccacaggaaggcucuccuacucaagauaaaguauccuuaccaucuguuaugccuuucccuauagguuuuccagaugucauuuuuuucuccugauuuuggaaaaaagaucucccugcuuuuguccugguacuuauguaucuaucaauguccuaucuacaacugaagaaauagauaaauccacauaaugggagauuagcacaccucagucaauaacuaauagaaccaucgaacuaauuuaguuccagaaauaauagaauuagcaggcaaaucaagacauagaagauuugaaugacauuaacaaacuuaacccaacugacauguaacacugcacucaacaauugcagaauucacauucuuuucaaacaagauauucacaaaaacugaccacucgcugagccaugaagaaaaugucaaucucaaagaaugcaaauuguacaaaacauauucuuugacuacaaugauauuaaacuagaaauaauuuuauaguaacuagaaaaucucuuauguuugggaauuaacaaugauacaugaagaaauuauaauggaaaauagauuuauaugauagcaaaaguaccacauuuuaaaacucgugggacacagcuagaguucugagaaauuuauaaccuuaaauacauacuaccagguugcugcaaaaguaacugcgguuguugccauuaaaaguaauggcaauguggccgggcgcggugccucacaccuguaaucccagcacuuugggaggccgagcuugguggaucaccugaggucaggaguuucagaccagccuggccaacguggugaaaccccgucucuacuaaaaauacaaaaaaauuagcuggacgugguggugggugccuauaaucccagcuacucgggaggcugaggcaggagaauugcuugacccugggaggcagagguugcagugagccaaggucgugcuauugcauuccagccucggcgacaacagcaagacugucucaaaagaaaagaaaaaaaguaauggcagucuaaaaauaaacuaagcauccauuucaagaaacuagaaaaaaacccaaguauuuuugaaaagauuaauaaaaucaauacuggugauggguacagugaccuguaaaaauaaaugaaaauaauuuuuaaaaaaucaauacuggugagccugaugaagaaaggagaggagacaaaauauucaauaucaggaaugaaaaaaugaacaucacagaucuugcauauauggaagugaucauauuaugaacaacuuuauaucaauacauuugaaauuuuaggaaauggauaaguuucuagaaaaaauguaacaaaaugacaggagaaauuagaaauauaaauagccccgggccgagcgcgguggcucaugccugcaaucccagcacuuuggaaggccaaggcggauggaucaccugaggucaggaguucaagaccagccuggcaaacauggugauacccugucuguacuaaaaauacaaaaauuagccgggcuacugcagaaaucuagaugaaggaugguggcuuggauuaggaugagaggugaacacaggaaaaaguaguagguaaagccaacagaguauccugacaguuggauaugugguguaagggaaccagaguagaaaaaggaucacuucaacuggaagauguugccaccaaaagauaguuuucaaccuacuuucuuauaccuuauguuccaaacaucuucuauuuuucaaauuauuaagcacuuuuguagcugauauauaaaauaccgaaauaccagccucaagcaguuuaguuuccaaaucuucaggauaagagcuaucuacguuaacuccaccuaggagaagaggaugaguguguaacucaggacuggcccaugggcuacgguaacaucuauaccucuguaccuucuccaccaggauccggucugucucuugcacgcugguaucaggcacuugcuuguccaaguaaccgacuggguagagcgagucucccuggccacugccccggucacuucgaccccuaaaaaaccaaaccaagaaacuaaagcugcaaccuccgauacuucuuaucccacauuuccugaucuaccaaucauaggaauaaagaucuucagaugcaccuacucagauuagaccaagcccccucguauguuccucaguccuuugacuuaucaggaggacugauguaagcauuguuugagcagagaaacuuccacggcagaaaagccgcuaccuccccaggugaugucugugugccacccaucuuuuucagaguuaugccugagggcucaggucucauuacucuggugcaguucugggaugaacagugauguacagcuugcccaggugccucaccugcugccuccuccaggcccgcuuagcucaauggcccacuugaagcgccggccucgguuagccaccaggccccccugggccgucauggcaacagcugcguccuauagccucgaugcuucucaguccaaagcguacuccacaacaggcccaccagcgu

SEQ ID NO: 191216 - RNA, 5108 nt, Homo sapiens
acgcuggugggccuguuguggaguacgcuuuggacugagaagcaucgaggcuauaggacgcagcuguugccaugacggcccaggggggccugguggcuaaccgaggccggcgcuucaagugggccauugagcuaagcgggccuggaggaggcagcaggugaggcaccugggcaagcuguacaucacuguucaucccagaacugcaccagaguaaugagaccugagcccucaggcauaacucugaaaaagauggguggcacacagacaucaccuggggagguagcggcuuuucugccguggaaguuucucugcucaaacaaugcuuacaucaguccuccugauaagucaaaggacugaggaacauacgagggggcuuggucuaaucugaguaggugcaucugaagaucuuuauuccuaugauugguagaucaggaaaugugggauaagaaguaucggagguugcagcuuuaguuucuugguuugguuuuuuaggggucgaagugaccggggcaguggccagggagacucgcucuacccagucgguuacuuggacaagcaagugccugauaccagcgugcaagagacagaccggauccugguggagaagguacagagguauagauguuaccguagcccaugggccaguccugaguuacacacucauccucuucuccuagguggaguuaacguagauagcucuuauccugaagauuuggaaacuaaacugcuugaggcugguauuucgguauuuuauauaucagcuacaaaagugcuuaauaauuugaaaaauagaagauguuuggaacauaagguauaagaaaguagguugaaaacuaucuuuugguggcaacaucuuccaguugaagugauccuuuuucuacucugguucccuuacaccacauauccaacugucaggauacucuguuggcuuuaccuacuacuuuuuccuguguucaccucucauccuaauccaagccaccauccuucaucuagauuucugcaguagcccggcuaauuuuuguauuuuuaguacagacaggguaucaccauguuugccaggcuggucuugaacuccugaccucaggugauccauccgccuuggccuuccaaagugcugggauugcaggcaugagccaccgcgcucggcccggggcuauuuauauuucuaauuucuccugucauuuuguuacauuuuuucuagaaacuuauccauuuccuaaaauuucaaauguauugauauaaaguuguucauaauaugaucacuuccauauaugcaagaucugugauguucauuuuuucauuccugauauugaauauuuugucuccucuccuuucuucaucaggcucaccaguauugauuuuuuaaaaauuauuuucauuuauuuuuacaggucacuguacccaucaccaguauugauuuuauuaaucuuuucaaaaauacuuggguuuuuuucuaguuucuugaaauggaugcuuaguuuauuuuuagacugccauuacuuuuuuucuuuucuuuugagacagucuugcuguugucgccgaggcuggaaugcaauagcacgaccuuggcucacugcaaccucugccucccagggucaagcaauucuccugccucagccucccgaguagcugggauuauaggcacccaccaccacguccagcuaauuuuuuuguauuuuuaguagagacgggguuucaccacguuggccaggcuggucugaaacuccugaccucaggugauccaccaagcucggccucccaaagugcugggauuacaggugugaggcaccgcgcccggccacauugccauuacuuuuaauggcaacaaccgcaguuacuuuugcagcaaccugguaguauguauuuaagguuauaaauuucucagaacucuagcugugucccacgaguuuuaaaaugugguacuuuugcuaucauauaaaucuauuuuccauuauaauuucuucauguaucauuguuaauucccaaacauaagagauuuucuaguuacuauaaaauuauuucuaguuuaauaucauuguagucaaagaauauguuuuguacaauuugcauucuuugagauugacauuuucuucauggcucagcgaguggucaguuuuugugaauaucuuguuugaaaagaaugugaauucugcaauuguugagugcaguguuacaugucaguuggguuaaguuuguuaaugucauucaaaucuucuaugucuugauuugccugcuaauucuauuauuucuggaacuaaauuaguucgaugguucuauuaguuauugacugaggugugcuaaucucccauuauguggauuuaucuauuucuucaguuguagauaggacauugauagauacauaaguaccaggacaaaagcagggagaucuuuuuuccaaaaucaggagaaaaaaaugacaucuggaaaaccuauagggaaaggcauaacagaugguaaggauacuuuaucuugaguaggagagccuuccuguggcaacguggagaagggaagaggucguagaauugaggagucagcucaguuagaagcagggaguugggaauuccguucaugugauuuagcaucagugauauggcaaaugugggacuaaggguagugaucagaggguuaaaauuguguguuuuguuuuagcgcugcugggacaucgccuuggguccccucaaacagauucccaugaaucucuucaucauguacauggcaggcaauacuaucuccaucuucccuacuaugaugguguguaugauggccuggcgacccauucaggcacuuauggccauuucagccaguaaguauucuugaaacaauaacccuuccauaaguuugaagaauuaaaggcaggccgggcaugguggcucacgccuguaaucccagcacuuugggaggcgccaagcuggguggaucaucugagggcaggaguucgagaccagccuggccaacauggugaaaccuugucucuacuaaaaaugcaaaaauuagcugggcgugguggcacacgccuguaaucccagcugcuugggaggcugagacaggagaaucacuugaaccugggaggcagagguugcagugagccgagaucgugccacugcacuccagccugggugacagaacgagacuccaucucaaaaaaaaggaagaauuaaagguaaauucuuagggacaguuuuuggcuaacagguauauaggggagugggguaauggugguggcauggaggggaguguagugcuuaccaugguuuucuguuugccuuuaaugguccuauuugcugucuuacuaugggucugucuauaugaauuuaauauacaguuggcuugauucguauugggggaaagaguucuuuugguuugacaacuucuguuaccgcaacagcuuucaagauguuagaaaguucaagccagaaguuucuucaggguuuggucuaucucauugggaaccugauggguuuggcauuggcuguuuacaagugccaguccaugggacuguuaccuacacaugcaucggauugguuagccuucauugagcccccugagguaaggcaaaagaaaagcugaauuuuggguaguuguaguauacagugaauagcugaccuacuugaugguaggaaauuggaguugguauuugaguuucuuuuuuuuuuuuuuuuuuuuuuugagacggaguauugcucugucgcccaggcuggagugcaguggcaugaucucggcaaccuccgccuccuggguucaagcaauuauucugccucagccuuccaaguagcugggauuacaggcaccugccaccaugcccagcuaauuuuuuuguaucuuuuaguagagaugggguuucaccauguuggccaggcugguuuugaacuccugaccucaagugaccugcccaccucugccucccaaagugcuaggauuacaggcgugagccacugcgccuggccuaggguuucuuaaaaaauaagagccauuaggaguuuuuaaguuauuauuuuuaauuaauuaauuaauuuauuuauuuugagacagagucucacucugucgcccaggcuggaguacaguggugugaucuuggcucacugcaaccuccgccccccagguucaagcgauucuugugccugagccucccuaguagcuggaauuacaggcaacugccacugcaccuggcuaauuuuuguauuuuuaguagagacaggguuucaccauguuggccaggcuggucuucagcuccugaccucaggugauccacccaccucggccucccaaagugcugggauuacaggugugagccaccaugccuggccaaguuauuauuuuugaaacagggucuugcucugucacccaggcuggagugcagucaugugaucauggcucacugcagccucaaccuccgggcucaggcacucagccucucaaguagcugggacuacaggugugcaccccaauggcucgcuaauuuuuguauuucuuguagagacaggguuuugccauguugcccaggcuggucuugaacuccugggcucaagcgaucugccugccuuggccucccaaaguguuuagcuaagauuagcuacugcgccuggccuggaaguucuuuuuuaaggauaggcaaaauagagcuugugguuaaaguauuaaguaauugauucaggaaguuauuuuaacacucauuugccacucaccuauuuauucuuucuuucuucuuucagagaauggaguucagugguggaggacugcuuuugugaacaugagaaagcagcgccuggucccuauguauuugggucuuauuuacauccuucuuuaagcccaguggcuccucagcauacucuuaaacuaaucacuuauguuaaaaagaaccaaaagacucuuuucuccaugguggggugacagguccuagaaggacaaugugcauauuacgacaaacacaaagaaacuauaccauaacccaaggcugaaaauaauguagaaaacuuuauuuuuguuuccaguacagagcaaaacaacaacaaaaaaacauaacuauguaaacaagagaauaacugcugcuaaaucaagaacuguugcagcaucuccuuucaauaaauuaaaugguugagaacaaugcauaa
